United States Patent
Matsuyama et al.

(10) Patent No.: US 9,371,534 B2
(45) Date of Patent: Jun. 21, 2016

(54) METHOD FOR PRODUCING EXPRESSION PRODUCT OF EXOGENOUS GENE IN YEAST, REGULATOR OF EXPRESSION IN YEAST, AND USE THEREOF

(71) Applicants: Takashi Matsuyama, Nagakute (JP); Mamoru Yamanishi, Nagakute (JP); Chie Imamura, Nagoya (JP); Satoshi Katahira, Nagoya (JP); Akinori Ikeuchi, Nagoya (JP); Yoichiro Ito, Nagoya (JP)

(72) Inventors: Takashi Matsuyama, Nagakute (JP); Mamoru Yamanishi, Nagakute (JP); Chie Imamura, Nagoya (JP); Satoshi Katahira, Nagoya (JP); Akinori Ikeuchi, Nagoya (JP); Yoichiro Ito, Nagoya (JP)

(73) Assignee: KABUSHIKI KAISHA TOYOTA CHUO KENKYUSHO, Nagakute-shi (JP)

(*) Notice: Subject to any disclaimer, the term of this patent is extended or adjusted under 35 U.S.C. 154(b) by 0 days.

(21) Appl. No.: 13/840,918

(22) Filed: Mar. 15, 2013

(65) Prior Publication Data

US 2013/0244243 A1 Sep. 19, 2013

(30) Foreign Application Priority Data

| Mar. 15, 2012 | (JP) | 2012-058423 |
| Jul. 23, 2012 | (JP) | 2012-163108 |
| Mar. 8, 2013 | (JP) | 2013-047053 |

(51) Int. Cl.
*C12N 15/81* (2006.01)
*C12N 15/67* (2006.01)

(52) U.S. Cl.
CPC .................................. *C12N 15/81* (2013.01)

(58) Field of Classification Search
None
See application file for complete search history.

(56) References Cited

U.S. PATENT DOCUMENTS 7,504,493 B2 * 3/2009 Velculescu et al. ......... 536/24.32

OTHER PUBLICATIONS

Roberts et al. "Structure, Biosynthesis, and Localization of Dipeptidyl Aminopeptidase B, an Integral Membrane Glycoprotein of the Yeast Vacuole" 108 the Journal of Cell Biology 1363-1373 (1989).*
Johnston et al., "Complete Nucleotide Sequence of Saccharomyces cerevisiae Chromosome VIII" 265(5181) Science 2077-2082 (1994).*
Hitzeman et al., "Secretion of Human Interferons by Yeast" 219 Science 620-625 (1983).*
Carswell et al., "Efficiency of Utilization of the Simian Virus 40 Late Polyadenylation Site: Effects of Upstream Sequences," *Molecular and Cellular Biology*, Oct. 1989, pp. 4248-4258, vol. 9, No. 10, American Society for Microbiology, USA.
Ingelbrecht et al., "Different 3' End Regions Strongly Influence the Level of Gene Expression in Plant Cells," *The Plant Cell*, Jul. 1989, pp. 671-680, vol. 1, American Society of Plant Physiologists, USA.
Kuersten et al., "The Power of the 3' UTR: Translational Control and Development," *Nature Reviews: Genetics*, Aug. 2003, pp. 626-637, vol. 4.
Zhao et al., "Formation of mRNA 3' Ends in Eukaryotes: Mechanism, Regulation, and Interrelationships with Other Steps in mRNA Synthesis," *Microbiology and Molecular Biology Reviews*, Jun. 1999, pp. 405-445, vol. 63, No. 2, American Society for Microbiology, USA.
Wang et al., "Precision and functional specificity in mRNA decay," *PNAS*, Apr. 2002, pp. 5860-5865, vol. 99, No. 9.
Yamanishi et al., "TPS1 Terminator Increases mRNA and Protein Yield in a *Saccharomyces cerevisiae* Expression System," *Biosci. Biotechnol. Biochem.*, 2011, pp. 2234-2236, vol. 75.
Graber et al., "Genomic detection of new yeast pre-mRNA 3'-end-processing signals," *Nucleic Acids Research*, 1999, pp. 888-894, vol. 27, No. 3, Oxford University Press.
Van Helden et al., "Statistical analysis of yeast genomic downstream sequences reveals putative polyadenylation signals," *Nucleic Acids Research*, 2000, pp. 1000-1010, vol. 28, No. 4, Oxford University Press.
Graber et al., "Probabilistic prediction of *Saccharomyces cerevisiae* mRNA 3'-processing sites," *Nucleic Acids Research*, 2002, pp. 1851-1858, vol. 30, No. 8, Oxford University Press.
Gerber et al., "Extensive Association of Functionally and Cytotypically Related mRNAs with Puf Family RNA-Binding Proteins in Yeast," *PLOS Biology*, 2004, vol. 2, No. 3.
Foat et al., "Profiling condition-specific, genome-wide regulation of mRNA stability in yeast," *PNAS*, Dec. 2005, pp. 17675-17680, vol. 102, No. 49.
Babiskin et al., "Synthetic RNA modules for fine-tuning gene expression levels in yeast by modulating RNase III activity," *Nucleic Acids Research*, 2011, pp. 8651-8664, vol. 39, No. 19, Oxford University Press.
Babiskin et al., "A synthetic library of RNA control modules for predictable tuning of gene expression in yeast," *Molecular Systems Biology* 7, Article 471, 2011, pp. 1-15, EMBO and Macmillan Publishers Limited.
Yamanishi et al., "A Genome-Wide Activity Assessment of Terminator Regions in *Saccharomyces cerevisiae* Provides a 'Terminatome' Toolbox," *ASC Synthetic Biology*, 2012, pp. A-K, American Chemical Society.
Richard et al., "Transcription termination by nuclear RNA polymerases," *Genes & Development*, 2009, pp. 1247-1269, vol. 23, Cold Spring Harbor Laboratory Press.

(Continued)

*Primary Examiner* — Nancy J Leith
(74) *Attorney, Agent, or Firm* — Oliff PLC

(57) ABSTRACT

Provided is a method for producing an expression product of an exogenous gene in a yeast with superior output regulation of gene expression. This is a method for producing an expression product of an exogenous gene in a yeast, including using one or two or more kinds of yeast gene terminator regions selected based on expression intensity data related to the expression intensity of yeast gene terminator regions to cause expression of a gene in a yeast.

3 Claims, 12 Drawing Sheets

(56) References Cited

OTHER PUBLICATIONS

Kuehner et al., "Unravelling the means to an end: RNA polymerase II transcription termination," Nature Reviews: *Molecular Cell Biology*, May 2011, pp. 1-12, vol. 12, Macmillan Publishers Limited.

Miura et al., "A large-scale full-length cDNA analysis to explore the budding yeast transcriptome," *PNAS*, Nov. 2006, pp. 17846-17851, vol. 103, No. 47, The National Academy of Sciences of the USA.

Nagalakshmi et al, "The Transcriptional Landscape of the Yeast Genome Defined by RNA Sequencing," *Science*, Jun. 2008, pp. 1344-1349, vol. 320.

Yamanishi et al., "A Modified Cre-lox Genetic Switch to Dynamically Control Metabolic Flow in *Saccharomyces cerevisiae*," *ACS Synthetic Biology*, 2012, pp. 172-180, vol. 1, American Chemical Society.

\* cited by examiner

| Rank | Name | Average | S.D. | Average of Screening |
|---|---|---|---|---|
| 1 | RPL41B | 2.525 | 0.367 | 2.128 |
| 2 | RPL15A | 2.473 | 0.346 | 2.123 |
| 3 | DIT1 | 2.464 | 0.377 | 2.223 |
| 4 | RPL3 | 2.317 | 0.319 | 2.061 |
| 5 | IDP1 | 2.250 | 0.306 | 2.280 |
| 6 | YHI9 | 2.192 | 0.306 | 1.687 |
| 7 | YHL039W | 2.159 | 0.297 | 1.982 |
| 8 | PPA1 | 2.145 | 0.309 | 1.828 |
| 9 | PRC1 | 2.143 | 0.294 | 2.218 |
| 10 | VMA2 | 2.138 | 0.297 | 2.148 |
| 11 | NAT5 | 2.111 | 0.303 | 2.427 |
| 12 | RPS28A | 2.105 | 0.293 | 2.239 |
| 13 | NAT1 | 2.104 | 0.306 | 2.084 |
| 14 | CDC53 | 2.077 | 0.288 | 1.919 |
| 15 | EBS1 | 2.076 | 0.288 | 2.104 |
| 16 | YMR114C | 2.075 | 0.289 | 2.028 |
| 17 | LSC2 | 2.046 | 0.288 | 2.032 |
| 18 | ALY2 | 2.043 | 0.292 | 2.360 |
| 19 | BNA4 | 2.036 | 0.292 | 2.208 |
| 20 | YIP5 | 2.018 | 0.291 | 1.968 |
| 21 | ATG10 | 2.016 | 0.285 | 2.037 |
| 22 | CBR1 | 1.966 | 0.282 | 2.158 |
| 23 | ASP3-1 | 1.964 | 0.286 | 2.275 |
| 24 | SRP54 | 1.925 | 0.271 | 2.042 |
| 25 | YNR021W | 1.915 | 0.271 | 2.094 |
| 26 | YDR119W | 1.901 | 0.288 | 1.928 |
| 27 | YLR361C-A | 1.892 | 0.273 | 2.018 |
| 28 | YPT31 | 1.883 | 0.273 | 1.977 |
| 29 | BUD32 | 1.857 | 0.276 | 2.014 |
| 30 | APL2 | 1.853 | 0.256 | 2.023 |

Fig.5

METHOD FOR PRODUCING EXPRESSION PRODUCT OF EXOGENOUS GENE IN YEAST, REGULATOR OF EXPRESSION IN YEAST, AND USE THEREOF

CROSS-REFERENCE TO RELATED APPLICATION

This application claims priority from Japanese Patent Application No. 2013-47053, filed on Mar. 8, 2013, Japanese Patent Application No. 2012-58423, filed on Mar. 15, 2012 and Japanese Patent Application No. 2012-163108, filed on Jul. 23, 2012 which are incorporated herein by reference.

TECHNICAL FIELD

The present teaching relates to a method for producing an expression product of an exogenous gene in a yeast, and to a regulator of expression in a yeast and a use thereof.

DESCRIPTION OF RELATED ART

Genome integration by homologous recombination and genetic recombination using shuttle vectors with *E. coli* is a method that is used to cause expression of arbitrary exogenous genes in *Saccharomyces cerevisiae* and other yeasts and the like. Various vectors are known for gene expression, and these can be obtained commercially. Normally, an expression vector is provided with a cloning site having multiple restriction enzyme sites, so that a desired gene that has been broken into fragments with a suitable restriction enzyme can be inserted into the vector. Promoters, terminator regions and the like for causing expression of the introduced gene are also incorporated in advance. The purpose of a terminator region is to terminate the transcription of the introduced gene into mRNA.

A variety of promoters derived from yeasts and other eukaryotes are used in such expression vectors. Examples include not only the terminator region (CYC1 terminator region) of the yeast cytochrome C1 (CYC1) gene, but also the PGK1 terminator region, TDH3 terminator region, GAP terminator region and the like, which are terminator regions of enzyme genes in yeast glycolytic systems.

Although the only purpose of terminator regions is transcription termination, it is reported that like promoters, they can play a role in regulating the expression levels of gene products (Carswell S, and Alwine J C, *Mol. Cell. Biol.*, 9, 4248-4258 (1989), Ingelbrecht I L W, Herman L M F, Dekeyser R A, Van Montaqu M C and Depicker A G, *Plant Cell*, 1, 671-680 (1989), Kuersten S and Goodwin E B, *Nature Rev.*, 4, 626-637 (2003), and Zhao J, Hyman L and Moore C, *Microbiol. Mol. Biol. Rev.*, 63, 405-445 (1999)). Moreover, various half-lives have been reported for mRNA (Wang Y, Liu C L, Storey J D, Tibshirani R J, Herschlag D and Brown P O, *Proc. Natl. Acad. Sci. USA*, 99, 5860-5865 (2002)), and specific terminator regions are reportedly involved in mRNA stability (Yamanishi M, Katahira S, Matsuyama T, *Biosci. Biotechnol. Biochem.*, 75, 2234-2236 (2011)). Meanwhile, regions for indicating the transcription termination point (which is the basic function of a terminator), regions for mRNA processing, and regions for PolyA sequence addition have all been reported (Graber J H, Cantor C R, Mohr S C, Smith T F, *Nucleic Acids Res.*, 27, 888-894 (1999), Van Helden J, del Olmo M, Perez-Ortin J E, *Nucleic Acids Res.*, 28, 1000-1010 (2000), and Graber J H, McAllister G D, Smith T F, *Nucleic Acids Res.*, 30, 1851-1858 (2002)). The relationship between the functions of terminator regions and their nucleotide sequences is also being studied (Gerber A P, Herschlag D, Brown P O, PLOS Biol., 2, e79 (2004) and Foat B C, Houshmandi S S, Olivas W M, Bussemaker H J, *Proc. Natl. Acad. Sci. USA*, 102, 17675-17680 (2005)).

BRIEF SUMMARY

For the most part, the nucleotide sequences in yeast terminator regions that contribute to high gene expression and suppression of expression have yet to be identified. To regulate the expression system of an exogenous gene, it is common practice to use a promoter with the desired control function, or to regulate the number of copies of the introduced gene. It is thought that when constructing an expression system, the output of a high-expression system can be further enhanced by combining a high-expression terminator region with a high-expression promoter, while the output of the expression system can be suppressed by using a low-expression terminator region.

It is therefore an object of the disclosures of the present teaching to provide a method for producing an expression product of an exogenous gene in a yeast with excellent output regulation of gene expression, along with a regulator of express in a yeast capable of contributing to output regulation of gene expression, and a use thereof.

The inventors focused on the terminator region as a means of regulating output in gene expression. The inventors then considered the possibility that by selecting a terminator region, it might be possible to either increase or suppress the amount of translation into a protein from a gene transcriptionally regulated by that terminator region, or in other words the expression level of the gene. The inventors found as a result of various researches that a terminator region of a gene from a yeast can contribute to enhancing or suppressing output in gene expression. The disclosures of this Description provide the following means based on these findings.

(1) A method for producing an expression product of an arbitrary gene in a yeast, the method comprising:
using one or two or more kinds of yeast gene terminator regions selected based on expression intensity data about expression intensity of yeast gene terminators to express an arbitrary gene in a yeast.

(2) The production method according to (1), wherein the yeast gene terminators are selected from the group consisting of the yeast genes: ORC4, ICY2, GIC1, HLR1, ECM13, YLR108C, AQR1, YHR213W-A, SUT1, PLB3, AIM26, TPO4, YPR153W, GIS3, WSC3, FUR4, DLT1, MOT1, YNR063W, MET13, YDL156W, YJL107C, YJR154W, YNL042W-B, VHS1, GPI19, YIL057C, STD1, CTF19, RAD34, YIR021W-A, FZF1, YHK8, YGL188C-A, HCM1, CDC6, YPR157W, CLB6, YOX1, YLR285C-A, YDR114C, YHR199C-A, MPS3, MUP3, YIR014W, AAR2, YPT35, AIM33, SCW11, BDF1, YCL042W, BSC4, YGL193C, NUT2, YJL118W, YKL069W, SRB8, YOR060C, MDH2, YPR116W, YPK2, GLN3, YDL211C, RAD55, CYM1, ENT4, ULA1, YMR182W-A, YKR017C, YOR302W, YOR072W-B, VTS1, FYV12, YGL235W, YHR086W-A, YEL067C, YPL257W, UBA3, YMR105W-A, YOR316C-A, TMA0, YDL159W-A, ATG29, YML037C, NSL1, YJL077W-B, POP3, WHI5, MIH1, YGR240C-A, YRM1, KAR9, YJU2, SPC24, DPB2, CHL4, YMR087W, CSI1, YIL134C-A, BUR2, PTH1, SSN8, AUA1, YLR154C-G, YLR342W-A, YCL001W-A, FLC1, YLL006W-A, VAM7, YPL077C, CCZ1, PRP28, ACM1, IME4, YPR096C, FRE5, PDR8, ILV5, YIL161W, PAC11, UBR2, YRB2, YLR125W, YMR253C, DSE4, EPL1, SNP1, YMR160W, SPO77, BUB1, YFR016C, SPC97, GEM1, INO2, SPT10, YLR132C, AIM45, YJR054W, MBF1, YAL064C-A, YML054C-A, NUP1, ECM27, YIL060W, IRE1, YHR177W, YJR079W, YNL187W, YML003W, PHI1, YDR169C-A, PET111, YDL109C, YOR012W, YHR050W-A, TAR1, RIM9, YCR095W-A, RPR2, COS7, YDR049W, CUS1, JJJ3, COS10, MET1, HXT8, GLY1, SUR1, RTG1, PHM7, YJL052C-A, HXT17, YFL052W, ATG1, ECM2, YNR075C-A, YKR041W, ALD5, YHL018W, LUC7, YPS5, YLR297W, SNA4, BIO4, YBR298C-A, ECM12, SEF1, YMR247W-A, EXO1, CTF3, HUR1, SNO3, BSC5, YER175W-A, PGA1, YLR173W, YDR119W-A, IRC15, MGA1, YPR174C, IML3, YLL054C, RDS1, MDM32, PET494, YPR036W-A, GTB1, ISF1, KRE29, SAP190, YHR214C-E, GTO3, YOR365C, MLP1, SIP5, YPL191C, YPL162C, YMR291W, BRN1, MDM1, NAT4, YLR406C-A, YME1, CSI2, YOR008C-A, CEF1, BUD25, DFG16, GPB1, KAR1, PPM2, DSS1, RPC37, VID24, ERV41, YGR169C-A, ECM8, YHR032W, ELA1, PEX29, LTE1, HAT2, SLI1, MUP1, ALG13, FRE7, YMR147W, ISU2, YOR1, JID1, ECM3, ATG5, MED6, YPL014W, YLR030W, AQY2, CCT2, YER067W, NRG1, SPT8, PIR1, YGR068C, YER039C-A, ELM1, ASE1, YBL095W, YNR066C, MTL1, CNE1, CAX4, NDI1, FLX1, YNL130C-A, CWC25, YNL254C, CDC13, ATP10, OCT1, ALF1, YEF1, BAP2, HTL1, PDC5, PKP1, SSK2, CAF120, SKN1, HHF1, CDC39, YFR012W, YEL048C, HAP4, PEX7, TPO1, NFT1, NGL3, YMR206W, DUS3, YAP7, CUS2, YLR415C, FUI1, SLM5, BTT1, YFR035C, RRN10, HAP3, SSY5, SFL1, KIP1, CDC15, GLT1, DOC1, MND1, AAC1, CEP3, UBC5, YNL213C, CLN3, CSF1, ECM18, MRS4, YIL046W-A, INP1, RTT105, MPT5, ATG15, RNH202, TAX4, IZH3, BDF2, COX14, YIP4, YJR120W, SAE2, YMC2, YGR035C, NDD1, HPA2, STL1, GPM3, ERF2, MMS21, YJL133C-A, YNL024C, IFH1, LIN1, ICS3, YNR014W, SPB1, YNL211C, SOL1, COS111, HSH155, NKP2, NAB3, FMT1, YPL152W-A, BOR1, SPC25, MMS1, YIL166C, MAL13, BFA1, AEP3, MTH1, YGR031W, BIT61, YMR230W-A, SKT5, YGL258W-A, PHR1, ITB2, SER1, BAP3, YER053C-A, ATG16, BIO2, MEP3, YNR073C, PCH2, APS2, MDM30, CLB5, ISR1, MRP20, GUD1, MED1, RER2, MCM10, YIR018C-A, SPO14, NUC1, MNN4, IFM1, YLR412C-A, ALT2, NNF1, YKL096C-B, RAD51, CIT2, SPT4, LRC4, USE1, YLR455W, YOL164W-A, PRP18, COA2, HSP82, YER184C, DAD2, LEU1, YDL129W, YPL119C-A, YOR034C-A, PRP38, MSA1, YBR147W, BBP1, MLH1, SWC3, SOH1, HHF2, NIP1, MSL1, RIF2, SPG1, WH3, HTA1, ARR3, YIL077C, SGF29, RAD53, YEL073C, YNR065C, NCA3, YBR296C-A, ECM23, YLR225C, SLD3, YBR197C, YBL059W, YOL075C, DNA2, SIZ1, REC114, MSN1, RGT2, CBF1, YGL176C, PTP2, GAL3, VPS62, HMS2, SMF3, APL1, SKI3, MNS1, YOR214C, TID3, KSS1, YDR194W-A, UPC2, ARG80, MRS2, ATP23, YML100W-A, YGL101W, STE12, RPI1, YDR090C, YEH1, UTP13, AMN1, YIL089W, AVL9, ATO2, HEM3, RPA14, GIP3, YGR053C, ALR2, YAP5, CDD1, SLS1, MET6, ABM1, PET20, CBP1, RAD10, SPO22, PIB1, EAF3, YFR032C-B, ELP2, YA6, PET112, PAU7, MEI4, YEA4, SGS1, JEN1, CLB2, GIC2, SWI6, ULP2, KIN28, YKL033W, CSM4, YNL095C, RRN3, RNR1, TPO3, SUP45, ABP140, RPS28B, MRF1, GLN1, OPT1, PHO4, UBP10, YOL163W, MDS3, OTU1, GAT1, HDA3, MSY1, GNP1, YFL041W-A, YPL141C, MPH2, PMA1, YNL260C, SKS1, YDL177C, SWR1, RMD5, RPL9B, MIC14, AOS1, LRG1, ROX1, PCL10, MRPL3, YER152C, EAF1, HTB1, SPA2, SSN2, YJR129C, ATG8, RHR2, TFG2, YBL100W-C, CSM2, EXG1, STE7, ADH2, SNT2, PML39, SEC2, ASI2, MNT3, BUR6, BIO5, YDR506C, RDR1, MRPL33, YGL159W, RIM8, YGR161W-C, YIG1, PDR16, YDR249C, YDR124W, HSP30, SDH2, YER130C, FAA3, BUD22, TIM22, CBP6, ICE2, SPC110, AFT2, NAM2, YPR071W, DIP5, SDS3, POP4, OCA4, PTC6, YBR201C-A, YPR127W, SEC10, ASF2, SLI15, RRN7, ORC2, GUF1, GPI2, RPS9A, RAD6, PSR2, RIP1, GZF3, CAR1, YHR151C, LEU5, YBR182C-A, IRC7, ASG7, YOR381W-A, OCA5, YHR035W, PET117, ISD11, HSP150, CCC2, YHR131C, MRK1, RXT2, PPH3, ODC2, SHE9, YCR075W-A, CYB5, YDR415C, LRO1, SOF1, YNL162W-A, PAU14, MTO1, YKL061W, MSS11, SAN1, SET2, YMR1, PHD1, YBL071C-B, MPA43, SAM37, AAT1, ASH1, UTR2, CAT8, SLX8, HXT2, COY1, TAF3, DSS4, TOR1, YMR030W-A, PAU5, SFP1, FHL1, COX10, DDR2, SWM1, HXT6, RCR2, YLR091W, RMD9, SHQ1, YLR346C, SPT21, ARE1, KAP95, YGR071C, TRL1, ECM17, YML020W, RPO41, CFT1, LRC5, THI74, TPN1, YOR059C, PRY3, YEL1, CNM67, STB6, YOR385W, RRN6, COP1, PDR12, ELG1, SRP40, SRM1, YDR109C, AIM30, RPC17, YJL028W, YBR071W, APS1, KIP2, ATP22, PRM6, BUD31, IXR1, NFI1, YHL015W-A, VHS3, YNL295W, SML1, SSK1, YAE1, RIM2, YDR246W-A, YLR445W, SPT23, MTG2, SGF11, BRL1, YMR315W, MRPS28, ERG5, UTP30, MDM35, ASR1, YIL102C-A, USA1, DOT6, COX23, ADH5, DAN4, RMA1, SCT1, PHO84, SFG1, SLX4, EST1, YNL190W, SNL1, RRP15, YML082W, DOT1, PEX1, YUR1, YAP1802, YDR185C, GET2, YPL264C, YDR065W, YJR115W, MAK21, YER064C, ATR1, IDP2, KCS1, ZPR1, ITC1, OAZ1, SWC7, RPL8A, CAC2, VTH1, OCH1, BUL1, YNR004W, LST7, MRPS8, TIS11, NDC1, TOS8, ISM1, MSL5, FMP43, YJR098C, COQ3, TPC1, RIM101, ADR1, ALD6, YHR087W, VPS21, POG1, YJR005C-A, SNT1, YHR022C, MEF1, PUP2, ERP6, HHT2, YGR146C, OAR1, YOR129C, YCR045C, DBP7, MUB1, YPL236C, RIB2, YPR084W, AIM5, UTR5, HKR1, YMR010W, ALR1, LRE1, RPN4, YLR363W-A, MGM1, HTD2, NAM8, SED5, YOR161C-C, YML018C, NAB2, YER140W, PRM4, RTR1, YIR042C, THI80, FUN19, DMR1, SIP1, CGR1, MTR3, YJL144W, RIM13, SAL1, MET28, INM1, VID27, CDC34, SRO9, RRP9, YOL087C, MCM22, YMR111C, NDJ1, ATG12, MSM1, SRS2, YBR225W, YLR063W, AI1, CDC36, ASN1, MET31, SSP1, NGG1, RBA50, PUT1, YPT53, NMA2, YBR219C, CDC40, SGO1, YJL047C-A, RPC31, INP52, UGO1, RAD30, CLB1, GLO4, TPK3, GIM3, CDC9, PEX27, AIM32, YGL081W, DJP1, HMS1, JSN1, UBP12, RSM25, UBP5, GIP1, PUT3, CKI1, FAR7, LAG2, DAM1, PSD2, HMT1, COR1, MMR1, MRPL39, CTF8, AGP2, PRM7, HIT1, HAL9, GPA2, TIM44, TFB1, ECM19, MRPL32, YBR284W, NAS2, SBE22, YOR011W-A, ORT1, MRPL25, QNQ1, APC4, TYE7, YPP1, MMT1, MRP10, MRPS5, LIP5, CDC27, ESC2, CAN1, MEC1, TOP1, SLM3, SIP4, URN1, YCK3, USO1, RSM19, ASG1, ISU1, YHL008C, YNL313C, KKQ8, FCY2, GPD1, HHT1, MDJ2, SDH1, SSF1, PIP2, STE13, AZF1, VPS35, YGL146C, TAM41, MIF2, YDL118W, HFM1, PRR1, MRE11, FMP37, MLH2, BUD5, YOR342C, PCL1, DHR2, CDC5, CBP3, RLP24, LSG1, NCL1, YDR262W, PGA3, MID2, YJL027C, YOR305W, QCR6, MSC6, RSC4, PAU18, POL12, SME1, DBF2, RPS27A, NHP6A, YGK3, SLO1, AIM36, UBP13, TRI1, CTH1, PGS1, NMD4, YIL064W, BAR1, BCS1, YBL029W, CTR1, MRPL20, AGP3, YOR338W, FCF2, YOR052C, YJL147C, RSA1, PEX8, YOL159C, RRP45, YDL199C, LIA1, THI2, TRZ1, CYT2, MGM101, YNL277W-A, ARP8, MRPL36, YAR028W, PAU2, SLD5, SMD1, YNL086W, QCR7, FMC1, HOS4, HEM1, NAM7, YPL108W, BUD14, BOI2, HRD1, YOL114C, RIS1, SIC1, BST1, KES1, MET4, TRS120, SYC1, NPA3, YLH47, SRL2, LRC3, MHR1, ZIP2, EAR1, RSF1, RIO2, MET2, NOP4, SRD1, PWP2, MST1, PCK1, CDC7, TOK1, PRO1, RAX2, LSM7, SHG1, TOM7, DAS2, SIP2, RRS1, EUG1, POX1, RAD61, SUN4, HAA1, YNR048W, ACO2, YOL047C, PMD1, FZO1, YEL025C, GPR1, BNI1, RSA4, YMR185W, PAU16, ECM7, YHP1, COG8, LST8, HST1, ESA1, YJL160C, MER1, CIN8, WSS1, PAT1, LRC6, FMP30, LYS21, MET18, MRPL50, GCR1, YOR022C, YJR012C, PDR3, YPL229W, SFK1, DUS4, IDS2, YOL036W, PHM6, YPR117W, RPB7, MCM2, MRS1, GLO2, YKL105C, RCK1, AME1, DIA3, HOM3, YDR541C, PMT6, DSE2, YJL216C, RIO1, ALB1, IBA57, YOR268C, CWC24, ARD1, UTP15, MSE1, UBS1, YNL234W, YDL025C, CAF40, YBR221W-A, ATP18, MAL33, YPT6, OAC1, YJR151W-A, YML018W, COX17, RAD52, HST3, TAZ1, YNR064C, YGL010W, MFA2, PGM3, NRM1, CRS15, CTM1, SKG6, SYF2, HYM1, IPI3, MDH1, TFB2, HST4, MRPL24, YMR166C, AVT5, YGR021W, SUV3, YNL146W, MID1, AKL1, MTR10, LAA1, HDA1, SMY2, MRPL8, PLB2, CWP1, ECM14, ECM1, GAL2, FAS1, KEL1, SET7, TSR2, FET5, DRE2, MMS4, TGS1, COQ1, SUR7, PCL2, SER2, YFL034W, MKK1, SSA2, AVO1, FMP25, YRR1, SLX5, SAF1, YPL260W, YKR096W, UTP14, PAM18, WTM1, STE18, AIM20, SYM1, SIT4, SSH4, MEI5, CYC8, DSN1, STB3, IMD4, YPL109C, ECM25, YMR102C, YDR306C, SUL2, YOL019W, PAU10, HNM1, MRPL1, CMK1, YBR196C-A, YGL226W, YPR147C, PGM2, SLM4, MSS1, YER121W, YDR381C-A, VPS72, YJL043W, PAN6, YMR086W, MDN1, HEH2, YKE4, YKL162C, ZRG8, HIP1, YPR145C-A, YCL056C, ERG1, INP54, MRPS16, MOD5, YJR008W, RMI1, YNL146C-A, RRF1, CAF130, BUD9, GWT1, BEM3, STF2, SSN3, MAS2, SLN1, TLG1, NOP6, YOR097C, HVG1, GCD11, TDP1, ATC1, CIT1, GRR1, RPA12, ADY3, CTA1, SWS2, SNF8, CIS3, MRPL4, CLB4, DBP2, APQ12, UTP5, MPD1, MRS3, AIM43, ATP11, SNU66, ARF3, YKU80, YLR422W, EGT2, MSP1, YLR218C, MRPL44, YHR127W, UBP3, SOD2, CYT1, POP6, HSP10, YHR033W, YKL161C, KIN82, YNL165W, CYC7, FYV7, TAT1, YNR040W, DBP3, SMY1, TRP3, SSL2, RPS24B, UTP4, SAW1, DAN2, YPR011C, YER156C, YGL059W, TRM5, SUT2, IML2, ATP1, CKA1, ECM31, MSK1, SCC2, SYG1, RPO26, YPR114W, HIR3, YIL029C, MAC1, YOR296W, IST3, HOR2, ITT1, PRP22, ROD1, DIA4, FMP32, TOM70, DIP2, YPR159C-A, PSP1, BTS1, ECM37, AST1, SMP1, BPL1, UPS1, BAG7, NOG2, RPC10, CYB2, SMD2, RAD1, ATP3, STP2, BUD21, RRN5, YLR352W, FRE4, PAN2, APL3, SEC7, DUS1, CSE1, MAK3, MRPL19, DBP1, FMP48, JAC1, VPS54, FUR1, PUP3, FUN26, SWI1, PWP1, BUD23, ATF1, FMP16, YOL024W, IPK1, RLM1, YNG2, MSS2, FLO8, SHY1, KSP1, KNH1, DON1, KTI11, SMC5, FPS1, SHU1, RAV2, YOR356W, PFA3, ERG8, SEN15, YNL152W, YJL193W, MSH2, CYC1, YLR446W, MRPL3, ISA1, HUA1, YHL010C, NNT1, RMD8, PPR1, ECM9, BSC2, ACO1, MPS2, LEE1, COG5, MCM1, RFC1, TAT2, DML1, KRE9, SPT2, SPC19, QCR8, HXT1, DOA4, MSR1, STU1, ERG10, TFB4, ATG21, GYP6, DAD4, OAF1, YPR013C, GAS1, FAP7, CPA2, RPO31, ATG20, TEP1, YBL081W, SMP3, MCD1, ADK2, SAD1, HUA2, BUD2, YJR136C, RPS14B, MNL1, MDJ1, FLO10, REB1, DSF2, KHA1, MRPL35, YOR283W, PPG1, CIT3, FAA4, SPL2, MET8, HOP2, HFA1, HAP5, ROG1, MAM3, DPH1, RTG3, YNL195C, DCN1, YLR211C, OXA1, YET2, RSC2, MRPL28, CTT1, YAP3, BIG1, UBP8, YOL019W-A, RIB5, NOG1, VID30, MRP17, ZRT1, UAF30, SPO23, YNL122C, SNU71, CDC43, SPC29, DYS1, PRP11, SVF1, BUD20, MEK1, UBP16, PCF11, GRX4, UTP22, HRK1, RPB9, YPL272C, ERG29, DIS3, YFH1, MRM2, RRP5, PTI1, TIF6, FTH1, MPE1, FKS3, ESP1, YDL007C-A, DMC1, JHD2, LEU2, SNF3, SCJ1, YMR317W, CYK3, GPT2, FMP41, SIA1, HXK1, YGL057C, YLR287C, NSR1, YDL241W, RKR1, REX4, TIM17, TES1, RPO21, YNL300W, BSC6, YHR080C, OPI10, RPB8, UBP9, YKR011C, CRP1, RSM24, ARP1, SIK1, GCR2, YLR345W, FET4, MRPL40, THP2, AMD2, YDR524W-C, PSY4, BUD16, HPT1, YDR333C, RHO4, AHC1, YJL206C, SWT1, HEK2, ATP12, XBP1, RMD6, RPL15B, NUP42, PLC1, MAD3, YPS1, MCM16, HXT4, HXK2, ERG12, MMT2, YMR321C, MUM3, HST2, ROG3, DEF1, YLR281C, SSK22, MLH3, YGR131W, CSE4, YCL002C, MRPS18, CAD1, AIF1, SFC1, OYE3, EAF5, RSC9, GYL1, YDL063C, ISA2, GBP2, IMG1, NRP1, DHH1, RHB1, CIK1, PHO89, AGX1, RPB2, MRPL17, GPX2, LYP1, VPS9, BNA3, CKA2, OPI1, YER034W, RSM26, LSM6, THI3, SMC4, SWF1, YAH1, RPF2, HFI1, PLB1, MAM33, YLR413W, PRP8, ENO1, RPC19, YGL007C-A, YMR181C, URA7, YGL108C, SRB7, DAD1, LYS4, ATG18, FMP45, VAM3, SSC1, SNU56, YHR045W, HTA2, YJL213W, RPL20A, ALD4, QCR10, YGR287C, CBP4, PCI8, MCM4, DEM1, ATO3, TPS2, TAF1, KRE6, KGD2, ARB1, NMD5, EFR3, TRP4, HIJ1, ACE2, LDB17, ATG7, OSH6, AFT1, CTF4, YDR286C, AIM44, YLR149C, MRPS9, BET1, YLF2, BOI1, BUD4, CRF1, MLP2, ARX1, RRP12, NAT2, PCL7, ARP7, SFH1, STF1, YML081W, MRP49, FOL3, SAC7, PCS60, TPA1, SSS1, ERO1, NHP2, AIM1, AMD1, VPS38, COG3, YMR244C-A, PYC1, CCC1, TAO3, YDL233W, RPB10, YBR242W, EDC2, YVC1, YDR266C, PMT3, NIS1, YDR128W, ATP15, YML002W, ATG9, IKS1, SUR2, MSD1, SMC3, SPC1, MRPS35, ZIP1, YPR022C, YKL070W, RIM4, YJL127C-B, ARV1, YML6, CYC3, COX9, RMD11, SNU23, PRS2, YNL092W, TIF4632, CBP2, STP4, YIR024C, SHE1, EMG1, NUP192, THI7, NGL1, LDB19, AFG2, ROT1, PIK1, MRPL31, RHO12, MRPL49, FMO1, LRS4, CHS3, SEC8, HXT5, GRX3, YHL042W, AAC3, WSC4, PIN2, PUB1, ERG28, PSR1, ISY1, VPS70, IRC19, DNM1, RPA190, CCR4, SSU72, MRPL7, TBF1, YPR115W, SKP2, CDC73, RPL31B, MAK16, ERB1, DCG1, RNT1, RRP7, GCD7, RAD18, OMS1, YOL048C, PPT2, SCS7, YBL028C, RSC30, TIM23, PRI1, REC102, MCH5, PST1, CLB3, QCR9, MIR1, SSP120, MEF2, RPL14B, YPR003C, RLI1, SWC4, MTM1, SKY1, TOM1, YGL079W, ROM2, TFA2, AIM3, SSQ1, DUG2, MSF1, RPS0B, SCO2, OLE1, SBE2, SAR1, YJR116W, TEF1, AIM13, DFG5, YLR012C, MCM3, RPS7B, DFR1, YBL039W-B, RML2, RSM27, MEC3, YCG1, RFX1, RPL7B, CHS2, PFX5, TIF4631, RPL18B, SMB1, HUL4, NPL6, YOL107W, TRM1, STE6, ASK1, RAD9, YDL012C, RBG2, SEC6, YLR143K, XPT1, HGH1, YIL091C, PRS3, NTC20, YPR196W, MIC17, POA1, NPY1, SNQ2, ADE3, APT2, YGL082W, YHB1, MRPL16, CSH1, GUP1, YJL171C, IDP3, VHT1, PUG1, MPM1, RRP40, DPM1, AFG3, YBP2, YPL183W-A, AIM31, YCR015C, MSN4, YPL038W-A, TSC11, SEC59, ADA2, TPM2, YHR175W-A, POM152, YJR124C, RPL22, COG7, NEW1, GSM1, UGX2, PRK1, GPD2, LDB16, PAM16, CMC1, TOM6, MBA1, SWC5, PRM10, SAM1, TRS31, YFT2, RGT1, RPL1, KRE33, CDC1, MRPL37, KEX2, VPS13, ACN9, RSC3, PBS2, EPS1, GPI18, ADH4, YTP1, YHM2, ZIM17, LYS5, AIM22, RGM1, ECM10, RDH54, DED1, CSE2, POC4, IPI1, SOL4, YKR075C, RSM10, MAE1, ATF2, SHE4, RSC1, GNT1, MSH4, HSK3, TRS20, NBP35, YBR090C, GLO1, FYV4, AEP2, ARP4, IES3, HYP2, DNF2, GAA1, RPA135, PCL9, SPT5, EDE1, ORC3, YOR304C-A, YCL047C, YER085C, YOL014W, YPL071C, GTS1, RFC2, NDE2, PET127, PLM2, YEA6, RPN7, MDL1, TMA64, NCE103, MCM6, MAS1, TSR1, BAS1, IRC4, TIM21, HCH1, APC5, PMP1, PUF6, YER077C, SNC2, MRP21, YLR036C, YME2, SEC12, YJL062W-A, YMR031C, YAL065C, YNR047W, NHP10, YOL083W, DLS1, IGO2, PAU17, NCS2, TAF7, YDL186W, CMK2, PUS7, TIM9, PMU1, MYP1, SEC16, RIF1, KAR3, MDL2, YLR356W, DCI1, ASP1, NET1, YPL068C, MOT3, NOC3, MRP13, GUT2, ICY1, NTO1, HOS3, TIM54, COX4, UBX2, RVB2, YBL059C-A, RBS1, DCR2, NEM1, MNN9, YNR036C, NOP15, SEC61, RIO6, CCT7, OSM1, SAS5, VPS29, KTI12, POL32, PUS9, SLF1, MUQ1, HSD1, KAR4, STN1, BAT1, THI71, RPL27B, COX5A, AEP1, LPP1, PRM1, YKL222C, TIP41, RPL43, YCR043C, SIP1, AIM8, HXT9, MRP7, YPL216W, SRB6, CTK2, RIT1, NST1, RIB7, MRPL38, SRT1, CBK1, ARL3, DRS2, YLR307C-A, GPI8, SHM2, IPL1, YPL041C, ARR1, GCN20, YPL039W, MNN1, SLX9, SEC1, RMP1, PSA1, CHS6, DAN1, RPB5, SIR3, BCP1, YLL058W, TNA1, TRM13, NOP1, SLP1, PEX31, YIF1, MSA2, ADH3, MNT4, GIS1, SLD2, PIN4, NVJ1, HTS1, RAD7, YKU70, NUF2, YIL001W, ASK10, YBL010C, ATP14, CDC123, MRPL51, YGR127W, YLR392C, APC2, DEP1, APS3, RCL1, DCD1, MIG3, BSP1, YLL014W, TOA1, NBA1, SLC1, IGO1, SDH3, ACS2, YOR093C, MPC54, PFY1, MIA40, YDR034C-A, RDS3, MSC3, TLM50, CSN12, GIN4, SMI1, ADE17, YGR016W, PCP1, SBA1, SRP102, SUM1, ICL1, OAF3, ZRT2, NOP10, BET2, YVH1, SPO75, DNL4, SGV1, IES4, SET4, YCL001W-B, SQT1, REI1, MRPL9, YPL066W, PET191, TEM1, UBX4, DBF20, MSB3, NUP100, RIC1, CUE4, IKI3, YEL043W, MRPL11, MPS1, EAP1, AYT2, GND1, TYW3, POP7, YDR186C, POR2, LSM5, MSH1, TOM22, YBR238C, MEP1, ILV3, YMD8, YJR061W, OSH3, TEF4, SCO1, TDH1, RIM21, YGL185C, NUS1, KTB4, RRP14, TUB4, LEU9, YLR437C, AIM7, ATX2, AI3, OST4, TRA1, MYO5, DAM4, IMG2, LTV1, YGR122W, CFT2, YMR001C-A, CDC16, YAL067W-A, YDR132C, YNL011C, TCP1, CCT3, MKK2, RRI2, ZEO1, RUD3, RTR2, YJL070C, NUP116, ENT1, SLU7, MSC2, STV1, NUP60, AIM28, YOL029C, SHE10, RSB1, SHO1, DLD2, RAX1, LCP5, ATG17, PEX17, GAL4, MET32, YOR223W, STE14, DUG3, SRX1, UFO1, YAT2, NMD3, PRP9, MSN2, PET123, SWD2, SOG2, RRP117, GPB2, YOR293C-A, TEN1, SOV1, PFK27, YJL127C, YNL024C-A, TMT1, SEC39, YER158C, ERP3, YLR257W, PKH3, YNL155W, PSO2, NOP9, GPG1, GIP4, RIB1, CYS4, ZRT3, FMP21, DAK2, ISW1, ACF4, RTT10, RTT109, FMP10, YAP6, APM4, ZAP1, ARO9, SCM4, MIM1, BRR6, SRN2, YOR287C, CLA4, RNR3, ALG8, RAD5, YBR239C, LDB7, ATP17, UGA2, ENA2, YLR408C, SAT4, BOP3, SDH4, YNL045W, RPC40, YNL134C, ARP5, MAD2, GRX6, RSM8, FES1, SGF73, ARH1, MHT1, CNS1, BDH2, YKL063C, GSH1, BOS1, THI72, BSC1, MED8, RAD5, EMP47, SIS2, TEA1, YJL185C, RTF1, CIN4, DIC1, EST2, YNK1, PUS2, PEX13, YNL217W, HOR7, MGS1, YHR009C, YML007C-A, JNM1, YHR078W, YMR155W, STB5, MRP4, STE3, CKS1, TAF13, YNL176C, PCD1, HSP26, DAS1, EDS1, CTR3, PXL1, MRS11, MET3, BDP1, CBF2, DBP6, FAR11, ERI1, MDM10, RPM2, COX13, TOA2, MYO2, PRP5, DRN1, ZDS1, IES2, FAT1, HIS1, MET16, LAS17, ACA1, HIS4, PHO12, EBP2, MRPL6, YLR271W, YBR085C-A, CRR1, SWI3, SWI4, PYK2, BUD7, PEX12, MDV1, IDH2, MRC1, TIM11, SPT15, FBP26, GUP2, NPL4, YCR007C, ABD1, YNL193W, YLR426W, YSP2, SSO2, MRPL23, YHR112C, VPS36, MET77, UTP18, MTW1, DYN1, RNH1, LST4, TAF11, RPL17A, SNA2, YGL041W-A, KAR5, YEH2, YMR118C, CUE2, URA8, YMR034C, YLR152C, YKL088W, HEM13, CAT5, KRE1, IBD2, YOL098C, AIM18, HMG1, TRM7, ADY2, LCD1, YGL194C-A, EFG1, BRX1, HIM1, TCM62, SET6, FIN1, CBF5, ASI1, DUT1, SEC65, YPL067C, RRP43, ASC1, ERG3, RTA1, NFU1, JIP4, YLR419W, YJR011C, YJL045W, ARC18, YBR287W, CAP2, NEO1, TOM5, PEP5, PCC1, PXR1, ALGI1, YLR301W, ARG1, RFC4, AIM42, PPA2, DAP1, RTS1, EDC3, IRC23, YBR220C, GPI14, IML1, NIP7, YPT32, MSS18, CHO1, CST26, MOH1, PLP1, MKC7, XYL2, YMR295C, YLR003C, YIL096C, MOT2, RLP7, YSC84, NDL1, PFK1, MRD1, SAC6, REX2, RPA34, AHC2, APC1, YDR222W, VHR1, SUS1, UTH1, IRC8, SNO1, APT1, YOR352W, YMR258C, MRH1, HRP1, SRP21, MRPL22, SEC9, KAR2, YGR054W, HOF1, YDC1, YGR207C, WSC2, SRC1, YAR023C, HAM1, PER1, YKL047W, FLC3, TRM10, PAU15, RFA1, AI2, MPP10, ELC1, PHB1, OST1, LSB1, OKP1, THI22, MRP51, COX20, FCF1, PHO80, FIT1, YPL056C, KIN4, GCD1, FRT1, ACS1, LGE1, YJL136W-A, MLC2, SMF1, ISW2, HIS6, CTR2, GCV2, GAL83, IMP3, GRS1, MRS5, NCE101, BUD17, MKS1, SYF1, ACH1, ARN1, RCN2, UBC12, YER079W, YHL044W, THI20, PML1, TCO1, BMS1, SSA1, DDI2, RPC11, YDR115W, DDC1, IRC21, DUR3, PET100, SKI8, QRI5, QDR1, UBC11, MRT4, POL3, MFB1, TC089, YDR370C, OYE2, MDM31, SLG1, YOR062C, DNF1, MEH1, AIR2, MSS116, ACB1, ADE12, ELO1, VTA1, MRPL27, YFL054C, SPC34, RGS2, DRS1, GTR1, COX8, KEL2, NUP82, GIR2, FKH2, CLG1, PFX6, HO, YHR003C, NUP84, RRB1, PSY2, BSD2, ESBP6, MED7, RSN1, YKE2, YHL012W, SHE2, RPL2A, DUO1, DST1, PET9, RSA3, GLN4, YKR015C, YJR141W, RIM20, BCK2, SPC42, TRF5, FAA2, TRS130, GUA1, HSL7, PDE2, RRP8, XRS2, SPE1, RFT1, VPS20, SEC20, PAD1, GGC1, ORC1, HMG2, STE2, LSM3, ICS2, TRM2, CDC3, HEM2, SIN4, VIK1, HIS7, RAD54, IQG1, DFG10, TIP1, BRR2, GRX2, HTZ1, BCH2, NRG2, RSC58, TMA16, RAD59, URM1, ADY4, AAP1, ABP1, YGR066C, BRE5, BFR2, LSM1, CHD1, VTI1, AIM1, RFA2, SUR4, YOR228C, DLD3, ISN1, CYC2, SNF5, YMR124W, GIP2, SVL3, SEC13, YEL047C, BEM1, RPL16A, SPR3, ATP4, WAR1, ITR1, FAR3, YOR021C, YBR028C, NOP58, RPN13, YNL035C, YJL049W, YER137C, NOC4, ALG7, MET22, SIL1, TYS1, GLK1, YDR341C, YKR045C, RAD23, BIK1, RPL27A, YOR152C, KNS1, YHR182W, EEB1, RKM1, SNG1, YIL067C, VPS66, TCB1, ADE4, YNL034W, HSP78, HEM15, PKC1, SPP2, MF(ALPHA)1, ARP6, NCS6, RTS3, SPE4, YPL199C, DAL81, SAC1, YOL131W, YHL026C, REC107, YGR174W-A, SGE1, NCB2, YNL320W, CDC20, CSG2, ECM5, NOC2, IFS1, SMK1, PHO86, YHR202W, CIN1, PFS1, MCM21, ROT2, GLC7, HRT1, YDR018C, APM1, DPH2, CDH1, HNT3, ATG4, FRE3, ATP2, YMR148W, YAT1, ERG1, PGI1, FKH1, MET30, YGL140C, ARC35, SNX41, SAS2, YHR007C-A, YML083C, ABF1, YLR104W, TOS1, MF(ALPHA)2, FRM2, OPY1, MMF1, DIG1, PMI40, YIL092W, ASI3, FIR1, ERG26, YMR090W, YGL085W, CDC24, YPL113C, YPR010C-A, BIR1, AAH1, EPT1, MSW1, NOP4, CBT1, COX18, COX16, RRD1, BEM4, GEA2, FOB1, ERG7, YLR042C, SEC7, YPR063C, PUT4, MSI1, RPA43, SPE2, DAL1, RPC25, BRO1, AXL1, EAF7, RCR1, YDR338C, RGA1, LOT5, YIH1, RNA1, SKM1, PUT2, HEM4, AIM37, PHO13, YGR015C, AKR2, YKL050C, TCB2, HAC1, ADE1, RTN1, RPL8B, MDM36, JHD1, CCL1, YDR282C, PRE10, PEX14, OMA1, YNR034W-A, NBP2, SPT20, PRP2, YGL041C-B, YBR255W, YOR246C, YFL012W, YLR412W, DUR1,2, RPS4A, YAL037W, ICT1, CTR86, RPN10, RME1, MSB4, SAM35, MAG2, YOL092W, PPZ1, YGL138C, YIHR097C, SSZ1, SIS1, CTP1, TAF5, PDC1, YPL150W, GCD10, ENP1, TOM40, ERG6, ECM4, RLF2, RKI1, SAM3, SEC62, CRC1, UME1, TUS1, YNL046W, VTC1, TEL2, YEN1, PFX30, GSG1, NTE1, RBG1, TIM8, YNG1, PMT5, PRP16, SPT6, NIP100, THS1, HMRA1, STE20, AIM10, YGL242C, GTR2, YOL157C, LOT6, KEX1, MET14, UBA2, NUT1, SPO21, PAC10, YND1, DSE3, YJR149W, YOR378W, GSY2, YBR063C, SRV2, YCK1, YKL091C, FMS1, UTP23, YCR090C, SFT2, BNI5, SNX3, FSH2, RGD2, SST2, UNG1, YLR164W, RPS26B, TRE1, MSH5, MYO3, YGL039W, SUP35, AMA1, ATP19, YGL036W, PTK2, PBP2, TRM112, SMC1, NPR1, PFK2, PDE1, RRI1, FRE2, YOR118W, FRE1, ECM38, ALD3, STT3, VMR1, RPC82, URK1, ATX1, REG1, PNT1, YMR279C, RSC8, YJR111C, YLR253W, FSH1, YDR336W, ERD1, VPS41, AYT1, VRG4, YPL009C, VID22, YDR514C, APC11, VPS74, KRE11, RRP6, FOX2, ASM4, MED11, TWF1, GRX5, MYO1, YPL107W, PET54, YLR064W, SPC2, APP1, DBP5, BPH1, YKL151C, NAF1, YKL027W, ARO3, UBX6, TIM18, BNI4, SPC98, PZF1, PIC2, UTP8, YBR235W, SMC6, RLR1, DBF4, RPB11, SHE3, SFB3, SYT1, STU2, NGL2, GDS1, NOP2, SVS1, PRY2, GDA1, BCY1, PUS1, COX7, MRPL15, RER1, SLH1, RPB3, TIF11, YDL173W, YML053C, PEX4, MIG1, CLU1, ECM32, FCY1, HSP32, MAL12, JLP2, DAT1, RMR1, KTR6, GST2, NOP12, IRC3, OPT2, YBL054W, PDX1, AMS1, YBR204C, SLM2, VPS64, PTH2, MRP1, TIF5, AAT2, CPR3, AFT6, CLF1, MDM38, COX12, ESS1, RPG1, SNF11, ERV15, YPR078C, RHO3, SUE1, CLN2, YFL040W, YLR040C, RLA1, YMR272W-B, MND2, EHD3, IMP4, PAH1, HMO1, RPL26A, PIR3, MNN5, FCY22, SMD3, YER186C, QDR2, MHP1, CRH1, LSB3, RMD1, SDA1, AXL2, NOP16, YCL058W-A, ORC6, PRR2, STH1, CCA1, FUS1, MRS6, YBP1, RPL12A, UTR4, MTF2, MAK31, BOP2, UIP5, SSL1, INO4, RPT3, YBR072C-A, YHR159W, ITR2, PUF3, ADD66, GCS1, LYS2, MTR2, TRP1, HXT11, ALG1, SPS18, YOR111W, STI1, SSD1, CRN1, CSN9, RSM22, YIL152W, TOF1, HOM2, MOB1, RAD24, IRC25, RSM23, YLR049C, YBLOSSC, SPP41, YMR310C, YHC1, YNL040W, AIM41, APL5, ILV2, YIR035C, REC8, MSS51, GAP1, EMP70, HAL1, CDC21, VPS75, YER066W, MCM7, CHZ1, YKL121W, MMS2, BUL2, SEC1, BEM2, YKR018C, NUP2, VPS73, YIL024C, YPL225W, FEN1, YSR3, CST9, YLR241W, MAK10, CUP2, CCP1, ERV14, YJU3, RAP1, IMP1, COA1, TFA1, FAF1, ATP5, ARG3, RVR1, RPA49, NSE4, YKT6, RRN9, APM2, GAT3, SPN1, CKB1, DTD1, TPO2, PRP45, DEG1, PTC5, TSC10, DPB11, YKR005C, RIM15, PNO1, COX15, VPS4, PKH2, MTR4, YLR053C, LEU4, YPK1, PDX3, TIF2, YDL180W, FYV8, BUD13, YBR139W, TPK2, SSH1, YGR102C, YDR348C, RPL28, QCR2, YAR1, SCP1, TIP20, UBC7, SEC11, RPN11, TGL5, HSP60, RPL42B, PRS1, YKL018C-A, TFC6, RNH201, URA1, ALG9, MSG5, AKR1, MNN11, OCA1, YGP1, PPX1, TSC3, PSF3, YAF9, YMR175W-A, LHP1, YMR252C, SLK9, YJR107W, PMC1, HCR1, SKG1, PCT1, LPE10, PGK1, HAS1, SEC23, GPI13, YDR476C, YLR073C, SUI3, RCO1, LYS20, NUP170, JJJ1, RAD27, YLL032C, GDB1, GON7, PRS4, GAL7, RAI1, MLC1, SWD3, REV1, FET3, DAL7, DAL80, COQ5, TRK2, PRP31, SYP1, RPL36A, OSF7, RPL12B, UME6, LCB4, IZH2, MDH3, OGG1, RPL1A, YGL157W, HUB1, TGL4, CAF16, NPP2, URE2, GMH1, AFT3, FAA1, BET5, YPR091C, PET8, STB1, ERG13, UTP10, MMP1, YTH1, EMI2, MES1, PDS1, NPL3, PRD1, YGR235C, PHO8, PEX22, LAP4, LCB2, YLR326W, EMP46, MRPS17, AIM17, NUP57, YER134C, YCR076C, YBL014C, SSM4, YMR187C, YEF3, PIG1, ECM16, SPO20, ILS1, MFT1, RRP46, RPS23A, ECM40, STT4, SOK2, RPL9A, SIR1, SES1, CDC26, SSU1, SAS3, YKL187C, ARG8, RPL16B, LCB3, TVP18, APJ1, GDH1, IPT1, ATP7, YAR029W, PIS1, TRS23, SEC72, CHA4, DMA2, RUP2, DCP2, KAP114, YTA12, PHO87, TPS3, RPS10B, LIP2, PAF1, MEU1, ALK1, RIM11, SLA2, RSC6, CBC2, YBR016W, FIS1, RAS1, SFA1, YOL057W, YOR292C, MCD4, CSM1, MAK32, DAP2, EXG2, DID2, HXT15, DIE2, VAC8, YBR138C, NTH2, YCR099C, RTT107, MAF1, ERG9, PPN1, SRB4, CDC55, YDR248C, YDR003W-A, GLC8, PDR11, SPB4, YSC83, YLR072W, MCH1, RPH1, DAD3, SPT3, YFR057W, IDI1, TDH3, OCA2, PEX18, FUN30, RRP3, ABC1, IWR1, YJR088C, PTR2, SEC26, AQY1, ECM21, BUD27, PFK26, YDR352W, CUP5, ATG3, AGE2, RIX7, HSE1, AGA1, GRX7, AGE1, TUB2, YHR122W, RIB4, VRP1, LAS1, OCA4, YGR277C, BUB3, LPD1, EMI5, CTF18, YOL073C, SIT1, LYS12, FTR1, TUL1, EKI1, LEO1, GAL1, VAC17, REV7, PMP2, TIM13, YMR158C-A, TLG2, YGR106C, YML079W, YFR045W, YBR056W, YLR065C, HSH49, MTF1, LAG1, ATE1, RFM1, RNH203, DBP8, TPS1, YGR205W, PIM1, RAD16, SPI1, SPP1, CHS5, MNR2, PIL1, SMT3, PEF1, SKO1, CDC45, SUC2, RXT3, RPN9, SPO12, RPE1, SEC15, HMI1, RRP4, ERG25, MUC1, TPT1, OPY2, OSH2, VNX1, PXA2, YSW1, SRP14, OST5, CDC4, RPL38, YDR520C, ARO2, DOM34, SWE1, GTO1, RPL37B, RAD3, MEP2, PKH1, ARL1, ROX3, SFT1, SIM1, CIA1, COX5B, CLN1, MNE1, BRE4, UBX5, DSL1, ACK1, YHR140W, ARG82, SCS22, ADH7, HSC82, ARO80, HED1, MAD1, TRP5, RPN3, SEN54, PTM1, ATG23, GIM4, YDR089W, MON2, PEX32, PUS6, YJL038C, SGN1, PRP39, YNR070W, SPO71, SAE3, MGR2, INP53, TUP1, SHP1, INO80, CDC23, GAB1, PTC1, SKI2, DNF3, YOR389W, AIM14, ATP16, VPS51, NSE3, UTP21, MDE1, ALY1, MNI2, BNS1, ILV1, TPO5, THI21, PEX2, YMR194C-B, SFI1, ESF1, YJL068C, GPI1, ISC10, RPL13A, YDR391C, TVP15, YNL108C, YDR051C, SRP101, SAS4, ARG4, PAN5, PTK1, THI16, YOR019W, GCN5, DID4, TRM11, ABZ2, YHR210C, RPL34B, POL31, RPS4B, COG4, RPS16B, LCB1, ARA2, VPH2, YBT1, HSM3, YBL036C, DAL2, VTC4, RPS21B, YOR131C, ADE13, YKL215C, LSM2, FAR10, MCH2, IMD3, USV1, YAR035C-A, RAM1, SNM1, PNG1, RFC3, ARP2, TOR2, ISC1, CTS1, YSH1, AIM4, BIT2, GVP36, SED1, SPG4, KGD1, NMT1, SSY1, LSC1, NRK1, YLR177W, SCD6, YDR210W, LRP1, URA2, PEX21, MCM5, SSE2, PYC2, GFD1, YNL247W, RAD17, BRE2, CDC48, IES5, RPL23A, PTR3, ATP20, PAU3, CPR8, ARO7, YRO2, HRB1, HSP42, RPS8B, FMP23, ADE6, DER1, PPE1, CUE3, ACF2, QNS1, IOC3, NAM9, YDL144C, ENB1, KTR3, PSD1, HOS1, FCY21, CAJ1, ERP4, LRC2, TFB5, PRM3, CPR7, MET7, SAH1, YGR149W, GAC1, TFC7, RHO5, TIF34, YPT1, MSS4, FLC2, PRE2, YCL068C, GAL80, SPG3, URB1, MGE1, STR2, RPL34A, UIP3, NPP1, FMP24, AIM23, BIO3, PRO2, TMN3, EST3, PHO5, YSP1, TUF1, ORM1, OLA1, NMA1, YMR209C, SEC27, SLA1, YCL102C, SLM1, NOP53, YLR162W-A, PAU13, ALA1, YDL133W, CDC37, HCA4, PRB1, GSY1, YIP3, TMA46, RPP1, PRP3, YBL107C, UBP14, VAM10, CBS1, YOR238W, OMI4, SEC66, CST6, SSF2, FRS1, NCA2, HMX1, NOP13, RNR2, QDR3, OTU2, SPO13, HUL5, SED4, RRP42, CDC33, MLP1, GOR1, YDL119C, YJR039W, HNT2, SCM3, MET12, VPS33, MGR1, PCM1, YUH1, CDS1, SAP185, CRT10, SNF1, CMP2, APL6, IDH1, YDR428C, SEC21, APL4, PAP2, GPI17, SCH9, HOP1, MUK1, RPS25B, NOB1, STE23, YLR243W, GRE3, CCS1, VEL1, ENO2, COG6, RPL11B, HNT1, LEM3, GPI5, FSF1, SEC3, SOL2, PRS5, VPS71, ACC1, ADE8, GNA1, YNR024W, RSF2, MAL32, PAU21, SPS19, YIL002W-A, SPF1, CCT8, PRM2, PDH1, RBL2, PIF1, VBA1, AFG1, DIN7, IZH1, YPL105C, YGR051W, WWM1, SIP3, SYS1, HPC2, RPL40A, NCR1, YER078C, CAP1, GCN4, AIM38, PTC7, FUN14, COS8, MCH4, PRP24, CWC2, CLC1, SIR4, FUS3, YLR057W, ZRG17, YSA1, PTC3, UBP6, KAP122, EFT2, URA3, ALG2, POL5, RPL1B, LIP1, TMA20, NAS6, IRC5, KIN3, YPL033C, AVT4, YGR266W, CTI6, YNL050C, SDP1, ESF2, NFS1, YER078W-A, IZH4, CWC22, YGR110W, DYN2, SNF4, YMR178W, NSE5, RPL40B, TKL2, HIR1, RPS30A, HSP12, YDR539W, GCV1, NTG1, AZR1, SPO7, YNL022C, DIM1, VAM6, YNR061C, PDA1, YOR032W-A, SPC3, CSR1, COS9, YJR085C, PEX15, TGL2, SGD1, YPL278C, YIL108W, THP1, SCY1, YGR130C, UBC6, END3, UBP15, RPL35B, MSB2, YCT1, SOL3, YDL027C, KIP3, UTP11, SUB1, PRP19, DCW1, TAH18, YER010C, PIN3, GYP1, SCW10, CTK1, ARK1, FYV10, YCR016W, YDJ1, ARF1, BGL2, YHR100C, CBS2, REX3, TSA1, RNA14, RCE1, THR4, SIP18, PMS1, DSK2, CDC50, DPH5, HEM12, SER3, YML119W, ESC1, GAL1, PRE7, RPT5, ERG2, DSE1, SEC22, YFH7, HSF1, GOS1, WRS1, EXO70, TSA2, ALK2, COX6, KRI1, YGL015C, RPS17B, YDR367W, TOM20, RSP5, YBL086C, TRM44, YPR109W, PTP1, AVT7, CYR1, CIS1, FAL1, VPS28, AGA2, QRI1, ATS1, GIT1, THO1, FBP1, YJL016W, UGA3, YBR230W-A, CCE1, NDE1, SET5, HOT1, RPT1, CAR2, PRE4, ECM33, ECM1, RAD33, BUB2, SOP4, SPR1, MOG1, SPO11, YKR070W, YBR246W, YKL071W, AHP1, PRP42, GRC3, KEL3, YMR244W, YMR242W-A, HBN1, VAS1, RTT102, ZUO1, YGR250C, FRQ1, YCL049C, MCR1, UBP11, TIF35, ATG26, YKL107W, HEM14, THR1, LUG1, SPS100, VMA22, YEL020C, RPL2B, GAL10, FKS1, YPL247C, YEL057C, RPS22A, TRK1, VTC2, SNU14, SWD1, UBC8, YPT52, XDJ1, YJR142W, COQ9, ERV25, YKL075C, FPR4, SEN2, GDT1, NOP7, YOR251C, SRL1, YLL023C, IRA2, IES6, MLF3, DIA1, MTG1, FPR1, NCE102, ERG4, SIF2, NUP53, RPL14A, SEC18, SSB2, RAT1, YMR027W, GDI1, VAN1, KAP123, ICL2, LPX1, RPP2A, SCD5, EXO84, CWC21, TRE2, YGR153W, YCR061W, RAD14, CUL3, VPS53, GEA1, GET3, TAD2, POT1, MVP1, PUS4, SMC2, RFC5, TIF3, NTG2, HXT10, CDC60, ENT5, GAT4, PGU1, UFD4, RPL37A, PRE5, PDC6, GCV3, EGD1, MSC7, KEM1, APN1, APE2, YLR456W, MAK5, YPR172W, STE24, RPS9B, CRM1, STP22, DIA2, ECO1, MCX1, YKL065W-A, NTR2, HHO1, RRM3, PRE8, NYY1, RPC53, TMA23, REC04, ZTA1, TEC1, TUB3, YJL123C, AST2, SNX4, ARC1, SOD1, SMA2, RGD1, PHM8, SEM1, GGA2, YAK1, RGA2, SCS3, YTA7, MDM12, AUR1, SKN7, MDG1, RSM7, YOL038C-A, OSW2, TIR3, RSM28, NIF3, FRE6, MDM20, YNR071C, GDH2, VPS8, MVD1, GCD2, TFP3, FMP33, NUG1, CPR6, SCP160, SEC14, YNL181W, PRE6, YLR364W, HOG1, NUP49, RPL21B, RPL42A, GTT2, STR3, ARG5,6, RPS24A, PPM1, AIM46, ILM1, PEX10, PDS5, YDR042C, YDL218W, MGT1, NPC2, YLR194C, PDI1, XKS1, SIW14, KOG1, PDR15, NGR1, SMX3, FIP1, UGA4, EDC1, YDL086W, GGA1, SMM1, AIM39, UBC1, YGR203W, PRP4, YSF3, SNA3, SKI6, CDC12, VPS60, MSC1, SET1, NMA111, SKI7, KRE5, FOL2, DAL3, SAK1, RVS161, YBR141C, LHS1, YFL051C, YGR067C, NOT5, CKB2, ATG2, YJR112W-A, RKM2, RPL36B, CNB1, PRP43, LCB5, PAC1, ARP3, LRC1, RGR1, YDL157C, DPL1, GCY1, YER076C, TFB3, RPS8B, GAT2, GFD2, MRP8, VAC14, YIHR138C, PHO90, PSK2, ALT1, ERP5, LAS21, AIM9, SLZ1, SGM1, FMP27, HXT3, YGR273C, RAM2, RET1, YIR007W, RPS2, MTQ2, RPS23B, COS12, RUB1, RGP1, GYP7, YOL138C, PMT2, YMR130W, SPS4, RAD28, YLR099W-A, YOR285W, MBR1, MPH1, NUP159, SEC63, RPS16A, YPL206C, BCD1, HOT13, IVY1, RNA15, YKR104W, STE4, PUP1, SFB2, YCK2, ODC1, FMP42, VPS24, YKL098W, YSY6, RTG2, LYS9, UTR1, HRR25, YBR261C, RPS26A, KTR5, CHL1, MNN10, GLE2, CPD1, SNZ1, PAM17, HIR2, CDC28, YDR061W, ENA5, APM3, YLR118C, AVT1, PEP12, PET18, MAM1, DOA1, FPR2, PIB2, PRP21, TOP2, YBL044W, OST6, AIM24, IRC18, OSW1, COT1, YOR387C, SKP1, STM1, YDL176W, YLR137W, ALE1, PBP1, YNL200C, YBL029C-A, SPE3, RRD2, CNN1, SPR6, PAN3, YRB1, YDL057W, YOR051C, POL4, ORC5, IMP2, ATG19, ARO8, YJL163C, SWI5, LSP1, TMA19, YE73, RAD26, MGA2, IME1, OXR1, GSF2, RPS18A, RUP1, YLR126C, KRE27, TVP23, INO1, ALG14, PUS5, VMA10, SPT16, YLL053C, CHC1, MSH6, SDS24, PTC4, PSP2, VBA2, TSR4, CPR4, DPP1, TFG1, ARN2, YGL230C, NBP1, YKL077W, MOB2, DYN3, UBC13, RFA3, SPG5, GYP5, YPI1, YDR179W-A, CHA1, TOS4, ADH1, SPO1, JJJ2, ADK1, SOK1, GOT1, TIR4, ERP2, SEN1, PHO81, ARF2, YOR227W, TVP38, YDL089W, ZDS2, GCD6, SUI2, VAC7, TAH11, CTR9, YKL100C, NUP188, GRE1, PHB2, BUD3, SMA1, RPL20B, NSP1, PPZ2, STO1, ETR1, SUL1, RPL6B, CPR5, YAL018C, ELP6, ACP1, SHR3, KAP120, YBR137W, IME2, SNF7, YCR023C, GIS2, YIP1, TFC3, CUE1, YLR283W, FUN12, BMH1, RIM1, YMC1, KIC1, NAR1, YBR184W, CAF4, CTK3, NUP157, PRY1, MFA1, POL2, YDL114W, STP3, IRC20, ZPS1, POP1, DUN1, SLY1, UTP6, TAL1, DIB1, PAC2, YNR029C, SPC72, RPC34, KTR7, KRR1, YBR062C, SSA4, VMA9, ATG22, NRD1, INH1, REF2, TSC13, UTP7, AIM15, ARC19, EHT1, YHL017W, NNF2, YPR027C, TGL3, PEX28, TEL1, PGM1, PAN1, HRD3, RPL26B, SDT1, YER128W, PSY3, VPS52, RPB4, AIM2, NUD1, RPS29B, PRO3, RPL32, PXA1, GID8, TRM3, SLX1, PEA2, UBR1, AIP1, RPS10A, CFD1, YOR114W, LEA1, MSN5, RPL6A, PTC2, YER071C, RAS2, ATG14, CDC11, RPS6B, URA6, RPN1, SFH5, YAP801, FLR1, DDR48, YRA2, APN2, ELF1, YJL217W, YPR089W, GSP2, BUG1, PSE1, SUA5, GPM2, POS5, PRM5, TAF4, GIM5, BNR1, YPS7, HAL5, RPS27B, CAK1, PGA2, SSP2, PMR1, NUP85, LSB6, TMA17, TGL1, ASN2, SEI1, VMA7, MDR1, HBS1, PMT1, PHO2, YHR113W, SSO1, RET2, UBA1, ALD2, SEC28, SEH1, YMR144W, HOC1, PRT1, RPS19B, GCN2, SAP4, YLR179C, COQ6, LYS14, LSM12, YGL117W, RED1, VPS34, VTC3, BRF1, ARR2, YMA21, PSF1, SRL3, YDR379C-A, ALG12, RPS25A, SDS23, DGA1, YDR196C, LOC1, RPN2, ANB1, NAN1, STB2, CUE5, CDC8, SPHI1, GID7, UBC4, RPS22B, ACT1, RPS8A, YNR068C, FRS2, TAF8, THI4, RBK1, SET3, YNL305C, TPP1, MSO1, NSA1, YMR210W, ERG24, YMR31, MAK11, URB2, FAD1, AGC1, OM45, APD1, GSH2, SPT14, YGR210C, RPS11A, SWH1, ANT1, SAP30, HRT3, NSG1, BAT2, SOM1, IPP1, HIS2, RSE1, RTT101, CRG1, YJR096W, IMH1, SPT7, MKT1, GTT3, PEX1, YDR374W-A, YPD1, DOS2, YEL023C, RPF1, BNA2, ATG27, RPL29, YPS6, RPL19B, YDR357C, ARO4, YBR096W, PEP8, RPL39, SCC4, HXT7, HSV2, APA2, TFC1, SEC53, PDR5, MUD2, RPL19A, TAF9, MXR1, RIX1, PKR1, CWC27, BFR1, YDR387C, UIP4, OST3, BUD6, GFA1, RPS0A, CRZ1, SLT2, SNC1, SEC5, PCL6, DAL5, MSB1, CSL4, COQ4, IAH1, YPL245W, PRI2, LOS1, SQS1, PBA1, YFR017C, HPA3, SCL1, YGR168C, SAP155, MON1, SGA1, MNI1, TFC8, FAB1, MED2, GCN3, PRE1, BBC1, GPA1, DIG2, IRS4, SXM1, SHU2, SRO7, GEF1, RPL24A, TMN2, RIB3, UBC9, MAL11, ARO10, LAC1, RCN1, MVB12, TBS1, CTL1, NTF2, BZZ1, HXT14, YGR125W, YNR062C, STE50, YLL056C, HIS3, CIN2, TCB3, NUM1, CPA1, PRP40, TRR1, TRP2, ADE16, EFT1, BET3, SUA7, RPS14A, FOL1, DPB4, VPS16, ANP1, YMR099C, VHS2, BMH2, ADH6, GSC2, DBR1, ADP1, CEG1, MBP1, FCP1, SRY1, YNL058C, AVO2, YMR196W, RPL35A, HIF1, YLR050C, YER187W, YOR186W, RAD57, ATH1, PEP7, YJL055W, YBR259W, UBX7, ILV6, SAM4, MRM1, PHO23, MYO4, BRE1, YFR032C, GAS4, MIP6, ERV46, YPR097W, PET10, HDA2, TRX2, MED4, SPO16, NSG2, GND2, PDB1, BDH1, NIT3, MUD1, ERG20, RPL18A, PAI3, TMA108, SAM50, SLY41, YDR461C-A, YMR265C, YJL132W, BLM10, SPO73, CWC15, ALO1, MAP1, YKR023W, PET130, YCS4, CWH41, ARP9, CHK1, PAM1, TAF10, ARA1, CGI121, YIL014C-A, CHS7, RPS21A, VMA13, NAT3, ARG2, DOG1, TMS1, PSF2, YHR126C, KAP104, DPS1, IRR1, YAL044W-A, RPL23B, YDR307W, RPL33A, NAB6, APA1, ALG6, MEX67, DAK1, ARC15, YOS1, GAD1, ECM22, CYS3, PBI2, YBR271W, GPI10, WBP1, ZRC1, FIG2, YOR262W, MSH3, IOC2, YGR201C, NAP1, KAE1, CHS1, GDE1, YTM1, YHR162W, TAD3, ALP1, TRM8, NMD2, YIM1, BCH1, RRP1, VCX1, UGA1, HOL1, GRX1, EMP24, YGR237C, FAP1, KTR2, PBP4, YER163C, RFS1, PTA1, MPD2, SGT2, IKI1, ECM29, REV3, TPD3, YDL124W, MUM2, YFR026C, PHS1, MLS1, POR1, PFD1, EGD2, GYP8, RPT2, TEX1, RPS5, TPK1, DOT5, LSB5, DMA1, BNA6, VAB2, AML1, SEC31, KIN1, STB4, GSP1, AAD4, MNN2, RPP1B, GUK1, MCK1, HSP31, SBP1, ZWF1, IST2, GPI16, CDC42, AHA1, UBP2, YNL115C, CCW14, YDL121C, MCA1, RPT4, ERP1, TMA7, WHI4, YDR131C, PDR1, TSR3, ATG11, DDP1, COQ2, RPP1A, PMP3, CRD1, PHO85, YGR017W, YIL055C, LAP3, YOR291W, GAS5, YKR043C, YIL083C, CHO2, ELP4, BIM1, CAM1, DAL82, UMP1, YBR241C, LTP1, PHO91, RPP0, YOR164C, TOM71, FAS2, FMP46, TMA22, YML131W, YCF1, OPI3, ROM1, IRC24, FYV6, ATG13, TRX3, ENP2, CEX1, VPS3, TRX1, DIT2, SEC4, GDH3, PRE9, UBP1, AYR1, NIT2, PDR17, TUB1, KEG1, CDC25, PIG2, NSE1, VPS25, YLR414C, CWH43, COG2, RCY1, VPS68, RPL7A, TAF14, SRB5, UPF3, YML096W, ARG81, NPR2, PSH1, TAF6, MCT1, SBH1, PBN1, VPS45, SRP68, SAY1, PEP1, CCT4, COQ10, RET3, SSE1, YSP3, ABZ1, PNS1, DPB3, YDL073W, ATM1, RBD2, YFR006W, DDI1, DCP1, SAS10, RMT2, FIG1, MUS81, UBI4, YBR285W, DLD1, RPS15, YPR170W-B, SRP1, PSK1, RAD4, PGD1, PMT4, ABF2, SEC24, URA10, CWC23, RPS11B, TPM1, YLR290C, TRM9, YAP1, UGP1, SPS2, PDR10, POM34, PNC1, STE1, GRH1, YMR018W, TRS33, HEF3, LAT1, BDS1, HMF1, PRP6, FSH3, SRB2, DUG1, ERD2, CDA2, RPS6A, HUT1, SHS1, IRA1, SSA3, ELP3, PRP46, CSM3, PEP4, YHC3, MDY2, RPL43A, IRQ1, YKL023W, DFM1, PCLB, SKG3, GPH1, NEJ1, URA4, GPX1, HOS2, YDR531W, PEP3, MAL31, YGR283C, HFD1, SPR28, SWP82, FUM1, CDA1, HOM6, NHX1, SNF6, ECI1, CDC10, MIS1, YIL165C, GTT1, PLP2, PFA4, RPL30, PRE3, MTD1, MNT2, ECM30, YNL208W, YCR024C-B, PCA1, HCS1, DCC1, FAR8, PPH22, DED81, GPM1, COF1, YGR042W, YPR148C, VPS555, JLP1, CAT2, GCN1, YGL231C, GUS1, YGR111W, VMA4, YDR056C, SCS2, NQM1, UFE1, COG1, PAA1, IRC22, KTR1, TYW1, SSB1, SVP26, ESC8, YNL010W, TIF1, EAF6, SHC1, KIN2, DCS2, RPS1B, URA5, DSD1, YJL218W, NPT1, SRO77, FMN1, CMD1, YTA6, RPL21A, ALG3, KRE2, PCL5, MDM34, PFS2, SNF12, BNA1, AIM29, SNU13, RNR4, MAP2, DCS1, RPN5, PDC2, DOP1, SPO74, PAP1, RPL24B, RPN8, FPR3, ERS1, CPR1, FIT3, HUG1, VPS5, PEX3, RPS29A, ERV29, CAF20, DOG2, RPL4A, YCP4, PBY1, FUS2, SNF2, SUI1, YMR262W, BUD8, TED1, TAH1, YCL048W-A, RPL41A, YDR374C, VMA8, YKR051W, YFL042C, ORM2, TAF12, APE3, YDR239C, ERV2, SHR5, YHR192W, YRB30, PHO88, WHI2, LYS1, RHO1, VPS27, VMA6, PAB1, YJR015W, SIR2, FAR1, CPT1, ECM15, ROK1, YFR018C, IYR1, POL1, CTS2, UBA4, SRP72, RTN2, HAP1, ARE2, RCK2, INM2, AFR1, YOS9, RTT103, RPS12, RNY1, PPA1, LEU3, ERG27, TMA29, UBX3, VPS15, RPT6, LDB18, YPL088W, RPL5, RVYS167, TIR2, PHA2, ERJ5, VPS30, IMD2, PES4, EMI1, YPR085C, YBR200W-A, FMP40, REH1, SGT1, CPS1, YOP1, TRR2, STS1, VPH11, SWA2, YGR026W, CDC53, FMP52, YDR119W, RNQ1, SAG1, RPS20, TRM82, VPS1, YIP5, YPR1, ENT2, YPT31, PRX1, YHL039W, YHI9, BUD32, YLR361C-A, APL2, PTP3, YMR114C, LSC2, ATG10, SRP54, ENT3, RPL3, TYR1, NAT1, YNR021W, EBS1, HBT1, RPL15A, RPL41B, RPP2B, CBR1, BNA4, PRC1, DIT1, RPS28A, ASP3-1, IDP1, SCW4, VMA2, ALY2 and NAT5.

(3) The production method according to (1) or (2), wherein the yeast genes are selected from the group consisting of: YCT1, SOL3, YDL027C, KIP3, UTP11, SUB1, PRP19, DCW1, TAH18, YER010C, PIN3, GYP1, SCW100, CTK1, ARK1, FYV10, YCR016W, YDJ1, ARF1, BGL2, YHR100C, CBS2, REX3, TSA1, RNA14, RCE1, THR4, SIP18, PMS), DSK2, CDC50, DPH5, HEM12, SER3, YML119W, ESC1, GAL11, PRE7, RPT5, ERG2, DSE1, SEC22, YFH7, HSF1, GOS1, WRS1, EXO70, TSA2, ALK2, COX6, KRI1, YGL015C, RPS17B, YDR367W TOM20, RSP5, YBL086C, TAM44, YPR109W, PTP1, AVT7, CYR1, CIS1, FAL1, VPS28, AGA2, QRJ1, ATS1, GIT1, THO1, FBP1, YJL016W, UGA3, YBR230W-A, CCE1, NDE1, SET5, HOT1, RPT1, CAR2, PRE4, ECM33, ECM11, RAD33, BUB2, SOP4, SPR1, MOG1, SPO11, YKR070W, YBR246W, YKL071W, AHP1, PRP42, GRC3, KEL3, YMR244W, YMR242W-A, HBN1, VAS1, RTT102, ZUO1, YGR250C, FRQ1, YCL049C, MCR1, UBP11, TIF35, ATG26, YKR107W, HEM14, THR1, LUG1, SPS100, VMA22, YEL020C, RPL2B, GAL10, FKS1, YPL247C, YEL057C, RPS22A, TRK1, VTC2, SNU114, SWD1, UBC8, YPT52, XDJ1, YJR142W, COQ9, ERV25, YKL075C, FPR4, SEN2, GDT1, NOP7, YOR251C, SRL1, YLL023C, IRA2, IES6, MLF3, DIA1, MTG1, FPR1, NCE102, ERG4, SIF2, NUP53, RPL14A, SEC18, SSB2, RAT1, YMR027W, GDI1, VAN1, KAP123, ICL2, LPX1, RPP2A, SCD5, EXO84, CWC21, TRE2, YGR153W, YCR061W, RAD14, CUL3, VPS53, GEA1, GET3, TAD2, POT1, MVP1, PUS4, SMC2, RFC5, TIF3, NTG2, HXT10, CDC60, ENT5, GAT4, PGU1, UFD4, RPL37A, PRE5, PDC6, GCV3, EGD1, MSC7, KEM1, APN1, APE2, YLR456W, MAK5, YPR172W, STE24, RPS9B, CRM1, STP22, DMA2, ECO1, MCX1, YKL065W-A, NTR2, HHO1, RRM3, PRE8, NYV1, RPC53, TMA23, REC104, ZTA1, TEC1, TUB3, YJL123C, AST2, SNX4, ARC1, SOD1, SMA2, RGD1, PHM8, SEM1, GGA2, YAK1, RGA2, SCS3, YTA7, MDM12, AUR1, SKN7, MDG1, RSM7, YOL038C-A, OSW2, TIR3, RSM28, NIF3, FRE6, MDM20, YNR071C, GDH2, VPS8, MVD1, GCD2, TFP3, FMP33, NUG1, CPR6, SCP160, SEC14, YNL181W, PRE6, YLR364W, HOG1, NUP49, RPL21B, RPL42A, GTT2, STR3, ARG5,6, RPS24A, PPM1, AIM46, ILM1, PEX10, PDS5, YDR042C, YDL218W, MGT1, NPC2, YLR194C, PDI1, XKS1, SIW14, KOG1, PDR115, NGR1, SMX3, FIP1, UGA4, EDC1, YDL086W, GGA1, SMM1, AIM39, UBC1, YGR203W, PRP4, YSF3, SNA3, SKI6, CDC12, VPS60, MSC1, SET1, NMA111, SKI7, KRE5, FOL2, DAL3, SAK1, RVS161, YBR141C, LHS1, YFL051C, YGR067C, NOT5, CKB2, ATG2, YJR112W-A, RKM2, RPL36B, CNB1, PRP43, LCB5, PAC1, ARP3, LRC1, RGR1, YDL157C, DPL1, GCY1, YER076C, TFB3, RPS8B, GAT2, GFD2, MRP8, VAC14, YHR138C, PHO90, PSK2, ALT1, ERP5, LAS21, AIM9, SLZ1, SGM1, FMP27, HXT3, YGR273C, RAM2, RET1, YIR007W, RPS2, MTQ2, RPS23B, COS12, RUB1, RGP1, GYP7, YOL138C, PMT2, YMR130W, SPS4, RAD28, YLR099W-A, YOR285W, MBR1, MPH1, NUP159, SEC63, RPS16A, YPL206C, BCD1, HOT13, IVY1, RNA15, YKR104W, STE4, PUP1, SFB2, YCK2, ODC1, FMP42, VPS24, YKL098W, YSY6, RTG2, LYS9, UTR1, HRR25, YBR261C, RPS26A, KTR5, CHL1, MNN10, GLE2, CPD1, SNZ1, PAM17, HIR2, CDC28, YDR061W, ENA5, APM3, YLR118C, AVT1, PEP12, PET18, MAM1, DOA1, FPR2, PIB2, PRP21, TOP2, YBL044W, OST6, AIM24, IRC18, OSW1, COT1, YOR387C, SKP1, STM1, YDL176W, YLR137W, ALE1, PBP1, YNL200C, YBL029C-A, SPE3, RRD2, CNN1, SPR6, PAN3, YRB1, YDL057W, YOR051C, POL4, ORC5, IMP2, ATG19, ARO8, YJL163C, SWI5, LSP1, TMA19, YET3, RAD26, MGA2, IME1, OXR1, GSF2, RPS18A, RUP1, YLR126C, KRE27, TVP23, INO1, ALG14, PUS5, VMA10, SPT16, YLL053C, CHC1, MSH6, SDS24, PTC4, PSP2, VBA2, ISR4, CPR4, DPP1, TFG1, ARN2, YGL230C, NBP1, YKL077W, MOB2, DYN3, UBC13, RFA3, SPG5, GYP5, YPI1, YDR179W-A, CHA1, TOS4, ADH1, SPO1, JJJ2, ADK1, SOK1, GOT1, TIR4, ERP2, SEN1, PHO81, ARF2, YOR227W, TVP38, YDL089W, ZDS2, GCD6, SUI2, VAC7, TAH11, CTR9, YKL100C, NUP188, GRE1, PHB2, BUD3, SMA1, RPL20B, NSP1, PPZ2, STO1, ETR1, SUL1, RPL6B, CPR5, YAL018C, ELP6, ACP1, SHR3, KAP120, YBR137W, IME2, SNF7, YCR023C, GIS2, YIP1, TFC3, CUE1, YLR283W, FUN12, BMH1, RIM1, YMC1, KIC1, NAR1, YBR184W, CAF4, CTK3, NUP157, PRY1, MFA1, POL2, YDL114W, STP3, IRC20, ZPS1, POP1, DUN1, SLY1, UTP6, TAL1, DIB1, PAC2, YNR029C, SPC72, RPC34, KTR7, KRR1, YBR062C, SSA4, VMA9, ATG22, NRD1, INH1, REF2, TSC13, UTP7, AIM15, ARC19, EHT1, YHL017W, NNF2, YPR027C, TGL3, PEX28, TEL1, PGM1, PAN1, HRD3, RPL26B, SDT1, YER128W, PSY3, VPS52, RPB4, AIM2, NUD1, RPS29B, PRO3, RPL32, PXA1, GID8, TRM3, SLX1, PEA2, UBR1, AIP1, RPS10A, CFD1, YOR114W, LEA1, MSN5, RPL6A, PTC2, YER071C, RAS2, ATG14, CDC11, RPS6B, URA6, RPN1, SFH5, YAP1801, FLR1, DDR48, YRA2, APN2, ELF1, YJL217W, YPR089W, GSP2, BUG1, PSE1, SUA5, GPM2, POS5, PRM5, TAF4, GIM5, BNR1, YPS7, HAL5, RPS27B, CAK1, PGA2, SSP2, PMR1, NUP85, LSB6, TMA17, TGL1, ASN2, SEI1, VMA7, MDR1, HBS1, PMT1, PHO2, YHR113W, SSO1, RET2, UBA1, ALD2, SEC28, SEH1, YMR144W, HOC1, PRT1, RPS19B, GCN2, SAP4, YLR179C, COQ6, LYS14, LSM12, YGL117W, RED1, VPS34, VTC3, BRF1, ARR2, VMA21, PSF1, SRL3, YDR379C-A, ALG12, RPS25A, SDS23, DGA1, YDR196C, LOC1, RPN2, ANB1, NAN1, STB2, CUE5, CDC8, SPH1, GID7, UBC4, RPS22B, ACT1, RPS8A, YNR068C, FRS2, TAF8, THI4, RBK1, SET3, YNL305C, TPP1, MSO1, NSA1, YMR210W, ERG24, YMR31, MAK11, URB2, FAD1, AGC1, OM45, APD1, GSH2, SPT14, YGR210C, RPS11A, SWH1, ANT1, SAP30, HRT3, NSG1, BAT2, SOM1, IPP1, HIS2, RSE1, RTT101, CRG1, YJR096W, IMH1, SPT7, MKT1, GTT3, PEX11, YDR374W-A, YPD1, DOS2, YEL023C, RPF1, BNA2, ATG27, RPL29, YPS6, RPL29B, YDR374C, ARO4, YBR096W, PEP8, RPL39, SCC4, HXT7, HSV2, APA2, TFC1, SEC53, PDR5, MUD2, RPL19A, TAF9, MXR1, RIX1, PKR1, CWC27, BFR1, YDR387C, UIP4, OST3, BUD6, GFA1, RPS0A, CRZ1, SLT2, SNC1, SEC5, PCL6, DAL5, MSB1, CSL4, COQ4, IAH1, YPL245W, PRI2, LOS1, SQS1, PBA1, YFR017C, HPA3, SCL1, YGR168C, SAP155, MON1, SGA1, MNI1, TFC8, FAB1, MED2, GCN3, PRE1, BBC1, GPA1, DIG2, IRS4, SXM1, SHU2, SRO7, GEF1, RPL24A, TMN2, RIB3, UBC9, MAL11, ARO10, LAC1, RCN1, MVB12, TBS1, CTL1, NTF2, BZZ1, HXT14, YGR125W, YNR062C, STE50, YLL056C, HIS3, CIN2, TCB3, NUM1, CPA1, PRP40, TRR1, TRP2, ADH6, EFT1, BET3, SUA7, RPS14A, FOL1, DPB4, VPS16, ANP1, YMR099C, VHS2, BMH2, ADH6, GSC2, DBR1, ADP1, CEG1, MBP1, FCP1, SRY1, YNL058C, AVO2, YMR196W, RPL35A, HIF1, YLR050C, YER187W, YOR186W, RAD57, ATH1, PEP7, YJL055W, YBR259W, UBX7, ILV6, SAM4, MRM1, PHO23, MYO4, BRE1, YFR032C, GAS4, MIP6, ERV46, YPR097W, PET10, HDA2, TRX2, MED4, SPO16, NSG2, GND2, PDB1, BDH1, NIT3, MUD1, ERG20, RPL18A, PAI3, TMA108, SAM50, SLY41, YDR461C-A, YMR265C, YJL132W, BLM10, SPO73, CWC15, ALO1, MAP1, YKR023W, PET130, YCS4, CWH41, ARP9, CHK1, PAM1, TAF10, ARA1, CGI121, YIL014C-A, CHS7, RPS21A, VMA13, NAT3, ARG2, DOG1, TMS1, PSF2, YHR126C, KAP104, DPS1, IRR1, YAL044W-A, RPL23B, YDR307W, RPL33A, NAB6, APA1, ALG6, MEX67, DAK1, ARC15, YOS1, GAD1, ECM22, CYS3, PBI2, YBR271W, GPI10, WBP1, ZRC1, FIG2, YOR262W, MSH3, IOC2, YGR201C, NAP1, KAE1, CHS1, GDE1, YTM1, YHR162W, TAD3, ALP1, TRM8, NMD2, YIM1, BCH1, RRP1, VCX1, UGA1, HOL1, GRX1, EMP24, YGR237C, FAP1, KTR2, PBP4, YER163C, RFS1, PTA1, MPD2, SGT2, IKI1, ECM29, REV3, TPD3, YDL124W, MUM2, YFR026C, PHS1, MLS1, POR1, PFD1, EGD2, GYP8, RPT2, TEX1, RPS5, TPK1, DOT5, LSB5, DMA1, BNA6, VAB2, AML1, SEC31, KIN1, STB4, GSP1, AAD4, MNN2, RPP1B, GUK1, MCK1, HSP31, SBP1, ZWF1, IST2, GPI16, CDC42, AHA1, UBP2, YNL115C, CCW14, YDL121C, MCA1, RPT4, ERP1, TMA7, WHI4, YDR131C, PDR1, TSR3, ATG11, DDP1, COQ2, RPP1A, PMP3, CRD1, PHO85, YGR017W, YIL055C, LAP3, YOR291W, GAS5, YKR043C, YIL083C, CHO2, ELP4, BIM1, CAM1, DAL82, UMP1, YBR241C, LTP1, PHO91, RPP0, YOR164C, TOM71, FAS2, FMP46, TMA22, YML131W, YCF1, OPI13, ROM1, IRC24, FYV6, ATG13, TRX3, ENP2, CEX1, VPS3, TRX1, DIT2, SEC4, GDH3, PRE9, UBP1, AYR1, NIT2, PDR17, TUB1, KEG1, CDC25, PIG2, NSE1, VPS25, YLR414C, CWH43, COG2, RCY1, VPS68, RPL7A, TAF14, SRB5, UPF3, YML096W, ARG81, NPR2, PSH1, TAF6, MCT1, SBH1, PBN1, VPS45, SRP68, SAY1, PEP1, CCT4, COQ10, RET3, SSE1, YSP3, ABZ1, PNS1, DPB3, YDL073W, ATM1, RBD2, YFR006W, DDI1, DCP1, SAS10, RMT2, FIG1, MUS81, UBI4, YBR285W, DLD1, RPS15, YPR170W-B, SRP1, PSK1, RAD4, PGD1, PMT4, ABF2, SEC24, URA10, CWC23, RPS1B, TPM1, YLR290C, TRM9, YAP1, UGP1, SPS2, PDR10, POM34, PNC1, STE11, GRH1, YMR018W, TRS33, HEF3, LAT1, BDS1, HMF1, PRP6, FSH3, SRB2, DUG1, ERD2, CDA2, RPS6A, HUT1, SHS1, IRA1, SSA3, ELP3, PRP46, CSM3, PEP4, YHC3, MDY2, RPL43A, HRQ1, YKL023W, DFM1, PCL8, SKG3, GPH1, NEI1, URA4, GPX1, HOS2, YDR531W, PEP3, MAL31, YGR283C, HFD1, SPR28, SWP82, FUM1, CDA1, HOM6, NIX1, SNF6, ECI1, CDC10, MIS1, YIL165C, GTT1, PLP2, PFA4, RPL30, PRE3, MTD1, MNT2, ECM30, YNL208W, YCR024C-B, PCA1, HCS1, DCC1, FAR8, PPH22, DED81, GPM1, COF1, YGR042, YPR148C, VPS55, JLP1, CAT2, GCN1, YGL231C, GUS1, YGR111W, VMA4, YDR056C, SCS2, NQM1, UFE1, COG1, PAA1, IRC22, KTR1, TYW1, SSB1, SVP26, ESC8, YNL010W, TIF1, EAF6, SHC1, KIN2, DCS2, RPS1B, URA5, DSD1, YJL218W, NPT1, SRO77, FMN1, CMD1, YTA6, RPL21A, ALG3, KRE2, PCL5, MDM34, PFS2, SNF12, BNA1, AIM29, SNU13, RNR4, MAP2, DCS1, RPN5, PDC2, DOP1, SPO74, PAP1, RPL24B, RPN8, FPR3, ERS1, CPR1, FIT3, HUG1, VPS5, PEX3, RPS29A, ERV29, CAF2, DOG2, RPL4A, YCP4, PBY1, FUS2, SNF2, SUI1, YMR262W, BUD8, TED1, TAH1, YCL048W-A, RPL41A, YDR374C, VMA8, YKR051W, YFL042C, ORM2, TAF12, APE3, YDR239C, ERV2, SHR5, YHR192W, YRB30, PHO88, WHI2, LYS1, RHO1, VPS27, VMA6, FAR1, YJR015W, SIR2, FAR1, CPT1, ECM15, ROK1, YFR018C, HYR1, POL1, CTS2, UBA4, SRP72, RTN2, HAP1, ARE2, RCK2, INM2, AFR1, YOS9, RTT103, RPS12, RNY1, PPA1, LEU3, ERG27, TMA29, UBX3, VPS15, RPT6, LDB18, YPL088W, RPL5, RVS167, TIR2, PHA2, ERJ5, VPS30, IMD2, PES4, EMI1, YPR085C, YBR200W-A, FMP40, RER1, SGT1, CPS1, YOP1, TRR2, STS1, VPH1, SWA2, YGR026W, CDC53, FMP52, YDR119W, RNQ1, SAG1, RPS20, TRM82, VPS1, YIP5, YPR1, ENT2, YPT31, PRX1, YHL039W, YHJ9, BUD32, YLR361C-A, APL2, PTP3, YMR114C, LSC2, ATG10, SRP54, ENT3, RPL3, TYR1, NAT1, YNR021W, EBS1, HBT1, RPL15A, RPL41B, RPP2B, CBR1, BNA4, PRC1, DIT1, RPS28A, ASP3-1, IDP1, SCW4, VMA2, ALY2 and NAT5.

(4) The production method according to any one of (1) to (3), wherein the yeast genes are selected from the group consisting of: ARR2, VMA21, PSF1, SAL3, YDR379C-A, ALG12, RPS25A, SDS23, DGA1, YDR196C, LOC1, RPN2, ANB1, NAN1, STB2, CUE5, CDC8, SPH1, GID7, UBC4, RPS22, ACT1, RPS8A, YNR068C, FRS2, TAF8, THI4, RBK1, SET3, YNL305C, TPP1, MSO1, NSA1, YMR210W, ERG24, YMR31, MAK11, URB2, FAD1, AGC1, OM45, APD1, GSH2, SPT14, YGR210C, RPS11A, SWH1, ANT1, SAP3, HRT3, NSG1, BAT2, SOM1, IPP1, HIS2, RSE1, RTT101, CRG1, YJR096W, IMH1, SPT77, MKT1, GTT3, PEX11, YDR374W-A, YPD1, DOS2, YEL023C, RPF1, BNA2, ATG27, RPL29, YPS6, RPL29B, YDR357C, ARO4, YBR096W, PEP8, RPL39, SCC4, HXT7, HSV2, APA2, TFC1, SEC53, PDR5, MUD2, RPL19A, TAF9, MXR1, RIX1, PKR1, CWC27, BFR1, YDR387C, UIP4, OST3, BUD6, GFA1, RPS0A, CRZ1, SLT2, SNC1, SEC5, PCL6, DAL5, MSB1, CSL4, COQ4, IAH1, YPL245W, PRI2, LOS1, SQS1, PBA1, YFR017C, HPA3, SCL1, YGR168C, SAP155, MON1, SGA1, MNI1, TFC8, FAB1, MED2, GCN3, PRE1, BBC1, GPA1, DIG2, IRS4, SXM1, SHU2, SRO7, GEF1, RPL24A, TMN2, RIB3, UBC9, MAL11, ARO10, LAC1, RCN1, MVB12, TBS1, CTL1, NTF2, BZZ1, HXT4, YGR125W, YNR062C, STE50, YLL056C, HIS3, CIN2, TCB3, NUM1, CPA1, PRP40, TRR1, TRP2, ADE16, EFT1, BET3, SUA7, RPS14A, FOL1, DPB4, VPS16, ANP1, YMR099C, VHS2, BMH2, ADH6, GSC2, DBR1, ADP1, CEG1, MBP1, FCP1, SRY1, YNL058C, AVO2, YMR196W, RPL35A, HIF1, YLR050C, YER187W, YOR186W, RAD57, ATH1, PEP7, YJL055W, YBR259W, UBX7, ILV6, SAM4, MRM1, PHO23, MYO4, BRE1, YFR032C, GAS4, MIP6, ERV46, YPR097W, PET10, HDA2, TRX2, MED4, SPO16, NSG2, GND2, PDB1, BDH1, NIT3, MUD1, ERG20, RPL18A, PAI3, TMA108, SAM50, SLY41, YDR461C-A, YMR265C, YJL132W, BLM10, SPO73, CWC15, ALO1, MAP1, YKR023W, PET130, YCS4, CWH41, ARP9, CHK1, PAM1, TAF10, ARA1, CGI121, YIL014C-A, CHS7, RPS21A, VMA13, NAT3, ARG2, DOG1, TMS1, PSF2, YHR126C, KAP104, DPS1, IRR1, YAL044W-A, RPL23B, YDR307W, RPL33A, NAB6, APA1, ALG6, MEX67, DAK1, ARC15, YOS1, GAD1, ECM22, CYS3, PBI2, YBR271W, GPI10, WBP1, ZRC1, FIG2, YOR262W, MSH3, IOC2, YGR201C, NAP1, KAE1, CHS1, GDE1, YTM1, YHR162W, TAD3, ALP1, TRM8, NMD2, YIM1, BCH1, RRP1, VCX1, UGA1, HOL1, GRX1, EMP24, YGR237C, FAP1, KTR2, PBP4, YER163C, RFS1, PTA1, MPD2, SGT2, IKI1, ECM29, REV3, TPD3, YDL124W, MUM2, YFR026C, PHS1, MLS1, POR1, PFD1, EGD2, GYP8, RPT2, TEX1, RPS5, TPK1, DOT5, LSB5, DMA1, BNA6, VAB2, AML1, SEC31, KIN1, STB4, GSP1, AAD4, MNN2, RPP1B, GUK1, MCK1, HSP31, SBP1, ZWF1, IST2, GPI16, CDC42, AHA1, UBP2, YNL115C, CCW14, YDL121C, MCA1, RPT4, ERP1, TMA7, WHI4, YDR131C, PDR1, TSR3, ATG1, DDP1, COQ2, RPP1A, PMP3, CRD1, PHO85, YGR017W, YIL055C, LAP3, YOR291W, GAS5, YKR043C, YIL083C, CHO2, ELP4, BIM1, CAM1, DAL82, UMP1, YBR241C, LTP1, PHO91, RPP0, YOR164C, TOM71, FAS2, FMP46, TMA22, YML131W, YCF1, OPI3, ROM1, IRC24, FYV6, ATG13, TRX3, ENP2, CEX1, VPS3, TRX1, DIT2, SEC4, GDH3, PRE9, UBP1, AYR1, NIT2, PDR17, TUB1, KEG1, CDC25, PIG2, NSE1, VPS25, YLR414C, CWH43, COG2, RCY1, VPS68, RPL7A, TAF14, SRB5, UPF3, YML096W, ARG81, NPR2, PSH1, TAF6, MCT1, SBH1, PBN1, VPS45, SRP68, SAY1, PEP1, CCT4, COQ10, RET3, SSE1, YSP3, ABZ1, PNS1, DPB3, YDL073W, ATM1, RBD2, YFR006W, DDI1, DCP1, SAS10, RMT2, FIG1, MUS81, UBI4, YBR285W, DLD1, RPS15, YPR170W-B, SRP1, PSK1, RAD4, PGD1, PMT4, ABF2, SEC24, URA10, CWC23, RPS11B, TPM1, YLR290C, TRM9, YAP1, UGP1, SPS2, PDR10, POM34, PNC1, STE11, GRH1, YMR018W, TRS33, HEF3, LAT1, BDS1, HMF1, PRP6, FSH3, SRB2, DUG1, ERD2, CDA2, RPS6A, HUT1, SHS1, IRA1, SSA3, ELP3, PRP46, CSM3, PEP4, YHC3, MDY2, RPL43A, HRQ1, YKL023W, DFM1, PCL8, SKG3, GPI1, NEJ1, URA4, GPX1, HOS2, YDR531W, PEP3, MAL31, YGR283C, HFD1, SPR28, SWP82, FUM1, CDA1, HOM6, NHX1, SNF6, ECI1, CDC10, MIS1, YIL165C, GTT1, PLP2, PFA4, RPL30, PRE3, MTD1, MNT2, ECM30, YNL208W, YCR024C-B, PCA1, HCS1, DCC1, FAR8, PPH22, DED81, GPM1, COF1, YGR042W, YPR148C, VPS55, JLP1, CAT2, GCN1, YGL231C, GUS1, YGR111W, VMA4, YDR056C, SCS2, NQM1, UFE1, COG1, PAA1, IRC22, KTR1, TYW1, SSB1, SVP26, ESC8, YNL010W, TIF1, EAF6, SHC1, KIN2, DCS2, RPS1B, URA5, DSD1, YJL218W, NPT1, SRO77, FMN1, CMD1, YTA6, RPL21A, ALG3, KRE2, PCL5, MDM34, PFS2, SNF2, BNA1, AIM29, SNU3, RNR4, MAP2, DCS1, RPN5, PDC2, DOP1, SPO74, PAP1, RPL24B, RPN8, FPR3, ERS1, CPR1, FIT3, HUG1, VPS5, PEX3, RPS29A, ERV29, CAF20, DOG2, RPL4A, YCP4, PBY1, FUS2, SNF2, SUI1, YMR262W, BUD8, TED1, TAH1, YCL048W-A, RPL41A, YDR374C, VMA8, YKR051W, YFL042C, ORM2, TAF12, APE3, YDR239C, ERV2, SHR5, YHR192W, YRB30, PHO88, WHI2, LYS1, RHO1, VPS27, VMA6, PAB1, YJR015W, SIR2, FAR1, CPT1, ECM15, ROK1, YFR018C, HYR1, POL1, CTS2, UBA4, SRP72, RTN2, HAP1, ARE2, RCK2, INM2, AFR1, YOS9, RTT103, RPS12, RNY1, PPA1, LEU3, ERG27, TMA29, UBX3, VPS15, RPT6, LDB18, YPL088W, RPL5, RVS167, TIR2, PHA2, ERJ5, VPS30, IMD2, PES4, EMI1, YPR085C, YBR200W-A, FMP40, REH1, SGT1, CPS1, YOP1, TRR2, S71, VPH1, SWA2, YGR026W, CDC53, FMP52, YDR119W, RNQ1, SAG1, RPS20, TRM82, VPS1, YIP5, YPR1, ENT2, YPT31, PRX1, YHL039W, YHI9, BUD32, YLR361C-A, APL2, PTP3, YMR114C, LSC2, ATG10, SRP54, ENT3, RPL3, TYR1, NAT1, YNR021W, EBS1, HBT1, RPL15A, RPL41B, RPP2B, CBR1, BNA4, PRC1, DIT1, RPS28A, ASP3-1, IDP1, SCW4, VMA2, ALY2 and NAT5.

(5) The production method according to any one of (1) to (4), wherein the yeast genes are selected from the group consisting of: SRB5, UPF3, YML096W, ARG81, NPR2, PSH1, TAF6, MCT1, SBH1, PBN1, VPS45, SRP68, SAY1, PEP1, CCT4, COQ10, RET3, SSE1, YSP3, ABZ1, PNS1, DPB3, YDL073W, ATM1, RBD2, YFR006W, DDI1, DCP1, SAS10, RMT2, FIG1, MUS81, UBI4, YBR285W, DLD1, RPS15, YPR170W-B, SRP1, PSK1, RAD4, PGD1, PMT4, ABF2, SEC24, URA10, CWC23, RPS11B, TPM1, YLR290C, TRM9, YAP1, UGP1, SPS2, PDR10, POM34, PNC1, STE11, GRH1, YMR018W, TRS33, HEF3, LAT1, BDS1, HMF1, PRP6, FSH3, SRB2, DUG1, ERD2, CDA2, RPS6A, HUT1, SHS1, IRA1, SSA3, ELP3, PRP46, CSM3, PEP4, YHC3, MDY2, RPL43A, HRQ1, YKL023W, DFM1, PCL8, SKG3, GPH1, NEJ1, URA4, GPX1, HOS2, YDR531W, PEP3, MAL31, YGR283C, HFD1, SPR28, SWP82, FUM1, CDA1, HOM6, NHX1, SNF6, ECI1, CDC10, MIS1, YIL165C, GTT1, PLP2, PFA4, RPL30, PRE3, MTD1, MNT2, ECM30, YNL208W, YCR024C-B, PCA1, HCS1, DCC1, FAR8, PPH22, DED81, GPM1, COF1, YGR042W, YPR148C, VPS55, JLP1, CAT2, GCN1, YGL231C, GUS1, YGR111W, VMA4, YDR056C, SCS2, NQM1, UFE1, COG1, PAA1, IRC22, KTR1, TYW1, SSB1, SVP26, ESC8, YNL010W, TIF1, EAF6, SHC1, KIN2, DCS2, RPS1B, URA5, DSD1, YJL218W, NPT1, SRO77, FMN1, CMD1, YTA6, RPL21A, ALG3, KRE2, PCL5, MDM34, PFS2, SNF12, BNA1, AIM29, SNU13, RNR4, MAP2, DCS1, RPN5, PDC2, DOP1, SPO74, PAP1, RPL24B, RPN8, FPR3, ERS1, CPR1, FIT3, HUG1, VPS5, PEX3, RPS29A, ERV29, CAF20, DOG2, RPL4A, YCP4, PBY1, FUS2, SNF2, SUI1, YMR262W, BUD8, TED1, TAH1, YCL048W-A, RPL41A, YDR374C, VMA8, YKR051W, YFL042C, ORM2, TAF2, APE3, YDR239C, ERV2, SHR5, YHR192W, YRB30, PHO88, WHI2, LYS1, RHO1, VPS27, VMA6, PAB1, YJR015W, SIR2, FAR1, CPT1, ECM15, ROK1, YFR018C, HYR1, POL1, CTS2, UBA4, SRP72, RTN2, HAP1, ARE2, RCK2, INM2, AFR1, YOS9, RTT103, RPS12, RNY1, PPA1, LEU3, ERG27, TMA29, UBX3, VPS15, RPT6, LDB18, YPL088W, RPL5, RVS167, TIR2, PHA2, ERJ5, VPS30, IMD2, PES4, EMI1, YPR085C, YBR200W-A, FMP40, REH1, SGT1, CPS1, YOP1, TRR2, STS1, VPH1, SWA2, YGR026W, CDC53, FMP52, YDR119W, RNQ1, SAG1, RPS20, TRM82, VPS1, YIP5, YPR1, ENT2, YPT31, PRX1, YHL039W, YHI9, BUD32, YLR361C-A, APL2, PTP3, YMR114C, LSC2, ATG10, SRP54, ENT3, RPL3, TYR1, NAT1, YNR021W, EBS1, HBT1, RPL15A, RPL41B, RPP2B, CBR1, BNA4, PRC1, DIT1, RPS28A, ASP3-1, IDP1, SCW4, VMA2, ALY2 and NAT5.

(6) The production method according to any one of (1) to (5), wherein the yeast genes are selected from the group consisting of: FUS2, SNF2, SUI1, YMR262W, BUD8, TED1, TAH1, YCL048W-A, RPL41A, YDR374C, VMA8, YKR051W, YFL042C, ORM2, TAF12, APE3, YDR239C, ERV2, SHR5, YHR192W, YRB30, PHO88, WHI2, LYS1, RHO1, VPS27, VMA6, PAB1, YJR015W, SIR2, FAR1, CPT1, ECM15, ROK1, YFR018C, HYR1, POL1, CTS2, UBA4, SRP72, RTN2, HAP1, ARE2, RCK2, INM2, AFR1, YOS9, RTT103, RPS12, RNY1, PPA1, LEU3, ERG27, TMA29, UBX3, VPS15, RPT6, LDB18, YPL088W, RPL5, RVS167, TIR2, PHA2, ERJ5, VPS30, IMD2, PES4, EMI1, YPR085C, YBR200W-A, FMP40, REH1, SGT1, CPS1, YOP1, TRR2, STS1, VPH1, SWA2, YGR026W, CDC53, FMP52, YDR119W, RNQ1, SAG1, RPS20, TRM82, VPS1, YIP5, YPR1, ENT2, YPT31, PRX1, YHL039W, YHI9, BUD32, YLR361C-A, APL2, PTP3, YMR114C, LSC2, ATG10, SRP54, ENT3, RPL3, TYR1, NAT1, YNR021W, EBS1, HBT1, RPL15A, RPL41B, RPP2B, CBR1, BNA4, PRC1, DIT1, RPS28A, ASP3-1, IDP1, SCW4, VMA2, ALY2 and NAT5.

(7) The production method according to any one of (1) to (6), wherein the yeast genes are selected from the group consisting of: RNQ1, SAG1, RPS20, TRM82, VPS1, YIP5, YPR1, ENT2, YPT31, PRX1, YHL039W, YHI9, BUD32, YLR361C-A, APL2, PTP3, YMR114C, LSC2, ATG10, SRP54, ENT3, RPL3, TYR1, NAT1, YNR021W, EBS1, HBT1, RPL15A, RPL41B, RPP2B, CBR1, BNA4, PRC1, DIT1, RPS28A, ASP3-1, IDP1, SCW4, VMA2, ALY2 and NAT5.

(8) The production method according to any one of (1) to (7), wherein the yeast genes are selected from the group consisting of: YHI9, BUD32, YLR361C-A, APL2, PTP3, YMR114C, LSC2, ATG10, SRP54, ENT3, RPL3, TYR1, NAT1, YNR021W, EBS1, HBT1, RPL15A, RPL41B, RPP2B, CBR1, BNA4, PRC1, DIT1, RPS28A, ASP3-1, IDP1, SCW4, VMA2, ALY2 and NAT5.

(9) The production method according to any one of (1) to (8), wherein the yeast genes are selected from the group consisting of: ORC4, ICY2, GIC1, HLR1, ECM13, YLR108C, AQR1, YHR213W-A, SUT1, PLB3, AIM26, TPO4, YPR153W, GIS3, WSC3, FUR4, DLT1, MOT1, YNR063W, MET13, YDL156W, YJL107C, YJR154W, YNL042W-B, VHS1, GPI19, YIL057C, STD1, CTF19, RAD34, YIR021W-A, FZF1, YHK8, YGL188C-A, HCM1, CDC6, YPR157W, CLB6, YOX1, YLR285C-A, YDR114C, YHR199C-A, MPS3, MUP3, YIR014W, AAR2, YPT35, AIM33, SCW11, BDF1, YCL042W, BSC4, YGL193C, NUT2, YJL118W, YKL069W, SRB8, YOR060C, MDH2, YPR116W, YPK2, GLN3, YDL211C, RAD55, CYM1, ENT4, ULA1, YMR182W-A, YKR017C, YOR302W, YOR072W-B, VTS1, FYV12, YGL235W, YHR086W-A, YEL067C, YPL257W, UBA3, YMR105W-A, YOR316C-A, TMA10, YDL159W-A, ATG29, YML037C, NSL1, YJL077W-B, POP3, WHI5, MIH1, YGR240C-A, YRM1, KAR9, YJU2, SPC24, DPB2, CHL4, YMR087W, CSI1, YIL134C-A, BUR2, PTH1, SSN8, AUA1, YLR154C-G, YLR342W-A, YCL001W-A, FLC1, YLL006W-A, VAM7, YPL077C, CCZ1, PRP28, ACM1, IME4, YPR096C, FRE5, PDR8, ILV5, YIL161W, PAC11, UBR2, YRB2, YLR125W, YMR253C, DSE4, EPL1, SNP1, YMR160W, SPO77, BUB1, YFR016C, SPC97, GEM1, INO2, SPT10, YLR132C, AIM4, YJR054W, MBF1, YAL064C-A, YML054C-A, NUP1, ECM27, YIL060W, IRE1, YHR177W, YJR079W, YNL187W, YML003W, PIN1, YDR169C-A, PET111, YDL109C, YOR012W, YHR050W-A, TAR1, RIM9, YCR095W-A, RPR2, COS7, YDR049W, CUS1, JJJ3, COS10, MET1, HXT8, GLY1, SUR1, RTG1, PHM7, YJL052C-A, HXT17, YFL052W, ATG1, ECM2, YNR075C-A, YKR041W, ALD5, YHL018W, LUC7, YPS5, YLR297W, SNA4, BIO4, YBR298C-A, ECM12, SEF1, YMR247W-A, EXO1, CTF13, HUR1, SNO3, BSC5, YER175W-A, PGA1, YLR173W, YDR119W-A, IRC15, MGA1, YPR174C, IML3, YLL054C, RDS1, MDM32, PET494, YFR036W-A, GTB1, ISF1, KRE29, SAP190, YHR214C-E, GTO3, YOR365C, MIP1, SIP5, YPL191C, YPL162C, YMR291W, BRN1, MDM1, NAT4, YLR406C-A, YME1, CSI2, YOR008C-A, CEF1, BUD25, DFG16, GPB1, KAR1, PPM2, DSS1, RPC37, VID24, ERV41, YGR169C-A, ECM8, YHR032W, ELA1, PEX29, LTE1, HAT2, SLI1, MUP1, ALG13, FRE7, YMR147W, ISU2, YOR1, JID1, ECM3, ATG5, MED6, YPL014W, YLR030W, AQY2, CCT2, YER067W, NRG1, SPT8, PIR1, YGR068C, YER039C-A, ELM1, ASE1, YBL095W, YNR066C, MTL1, CNE1, CAX4, NDI1, FLX1, YNL130C-A, CWC2, YNL254C, CDC13, ATP10, OCT1, ALF1, YEF1, BAP2, HTL1, PDC5, PKP1, SSK2, CAF120, SKN1, HHF1, CDC39, YFR012W, YEL048C, HAP4, PEX7, TPO1, NFT1, NGL3, YMR206W, DUS3, YAP7, CUS2, YLR415C, FUI1, SLM5, BTT1, YFR035C, RRN10, HAP3, SSY5, SFL1, KIP1, CDC15, GLT1, DOC1, MND1, AAC1, CEP3, UBC5, YNL213C, CLN3, CSF1, ECM18, MRS4, YIL046W-A, INP1, RTT105, MPT5, ATG15, RNH202, TAX4, IZH3, BDF2, COX14, YIP4, YJR120W, SAE2, YMC2, YGR035C, NDD1, HPA2, STL1, GPM3, ERF2, MMS21, YJL133C-A, YNL024C, IFH1, LIN1, ICS3, YNR014W, SPB1, YNL211C, SOL1, COS111, HSH155, NKP2, NAB3, FMT1, YPL152W-A, BOR1, SPC25, MMS1, YIL166C, MAL13, BFA1, AEP3, MTH1, YGR031W, BIT61, YMR230W-A, SKT5, YGL258W-A, PHR1, HTB2, SER1, BAP3, YER053C-A, ATG16, BIO2, MEP3, YNR073C, PCH2, APS2, MDM30, CLB5, ISR1, MRP20, GUD1, MED1, RER2, MCM10, YIR018C-A, SPO14, NUC1, MNN4, IFM1, YLR412C-A, ALT2, NNF1, YKL096C-B, RAD51, CIT2, SPT4, LRC4, USE1, YLR455W, YOL164W-A, PRP18, COA2, HSP82, YER184, DAD2, LEU1, YDL129W, YPL119C-A, YOR034C-A, PRP38, MSA1, YBR147W, BBP1, MLH1, SWC3, SOH1, HHF2, NIP1, MSL1, RIF2, SPG1, WHI3, HTA1, ARR3, YIL077C, SGF29, RAD53, YEL073C, YNR065C, NCA3, YBR296C-A, ECM23, YLR225C, SLD3, YBR197C, YBL059W, YOL075C, DNA2, SIZ1, REC114, MSN1, RGT2, CBF1, YGL176C, PTP2, GAL3, VPS62, HMS2, SMF3, APL1, SKI3, MNS1, YOR214C, TID3, KSS1, YDR194W-A, UPC2, ARG8, MRS2, ATP23, YML100W-A, YGL101W, STE12, RPI1, YDR090C, YEH1, UTP13, AMN1, YIL089W, AVL9, ATO2, HEM3, RPA14, GIP3, YGR053C, ALR2, YAP5, CDD1, SLS1, MET6, ABM1, PET20, CBP1, RAD10, SPO22, PIB1, EAF3, YFR032C-B, ELP2, YIA6, PET112, PAU7, MEI4, YEA4, SGS1, JEN1, CLB2, GIC2, SWI6, ULP2, KIN28, YKL033W, CSM4, YNL095C, RRN3, RNR1, TPO3, SUP45, ABP140, RPS28B, MRF1, GLN1, OPT1, PHO4, UBP10, YOL163W, MDS3, OTU1, GAT1, HDA3, MSY1, GNP1, YFL041W-A, YPL141C, MPH2, PMA1, YNL260C, SKS1, YDL177C, SWR1, RMD5, RPL9B, MIC14, AOS1, LRG1, ROX1, PCL10, MRPL3, YER152C, EAF1, HTB1, SPA2, SSN2, YJR129C, ATG8, RHR2, TFG2, YBL100W-C, CSM2, EXG1, STE7, ADH2, SNT2, PML39, SEC2, ASI2, MNT3, BUR6, BIO5, YDR506C, RDR1, MRPL33, YGL159W, RIM8, YGR161W-C, YIG1, PDR16, YDR249C, YDR124W, HSP30, SDH2, YER130C, FAA3, BUD22, TIM22, CBP6, ICE2, SPC110, AFT2, NAM2, YPR071W, DIP5, SDS3, POP4, OCA6, PTC6, YBR201C-A, YPR127W, SEC10, ASF2, SLI15, RRN7, ORC2, GUF1, GPI2, RPS9A, RAD6, PSR2, RIP1, GZF3, CAR1, YHR151C, LEU5, YBR182C-A, LRC7, ASG7, YOR381W-A, OCA5, YHR035W, PET117, ISD11, HSP150, CCC2, YHR131C, MRK1, RXT2, PPH3, ODC2, SHE9, YCR075W-A, CYB5, YDR415C, LRO1, SOF1, YNL162W-A, PAU14, MTO1, YKL061W, MSS1, SAN1, SET2, YMR1, PHD1, YBL071C-B, MPA43, SAM37, AAT1, ASH1, UTR2, CAT8, SLX8, HXT2, COY1, TAF3, DSS4, TOR1, YMR030W-A, PAU5, SFP1, FHL1, COX10, DDR2, SWM1, HXT6, RCR2, YLR091W, RMD9, SHQ1, YLR346C, SPT21, ARE1, KAP9, YGR071C, TRL1, ECM17, YML020W, RPO41, CFT1, LRC5, THI74, TPN1, YOR059C, PRY3, YEL1, CNM67, STB6, YOR385W, RRN6, COP1, PDR12, ELG1, SRP40, SRM1, YDR109C, AIM30, RPC17, YJL028W, YBR071W, APS1, KIP2, ATP22, PRM6, BUD31, IXR1, NFI1, YHL015W-A, VHS3, YNL295W, SML1, SSK1, YAE1, RIM2, YDR246W-A, YLR445W, SPT23, MTG2, SGF11, BRL1, YMR315W, MRPS28, ERG5, UTP30, MDM35, ASR1, YIL102C-A, USA1, DOT6, COX23, ADH5, DAN4, RMA1, SCT1, PHO84, SFG1, SLX4, EST1, YNL190W, SNL1, RRP15, YML082W, DOT1, PEX1, YUR1, YAP1802, YDR185C, GET2, YPL264C, YDR065W, YJR115W, MAK21, YER064C, ATR1, IDP2, KCS1, ZPR1, ITC1, OAZ1, SWC7, RPL8A, CAC2, VTH1, OCH1, BUL1, YNR004W, LST7, MRPS8, TIS11, NDC1, TOS8, ISM1, MSL5, FMP43, YJR098C, COQ3, TPC1, RIM101, ADR1, ALD6, YHR087W, VPS21, POG1, YJR005C-A, SNT1, YHR022C, MEF1, PUP2, ERP6, HHT2, YGR146C, OAR1, YOR129C, YCR045C, DBP7, MUB1, YPL236C, RIB2, YPR084W, AIM5, UTR5, HKR1, YMR010W, ALR1, LRE1, RPN4, YLR363W-A, MGM1, HTD2, NAM8, SED5, YOR161C-C, YML018C, NAB2, YER140W, PRM4, RTR1, YIR042C, THI80, FUN19, DMR1, SIP1, CGR1, MTR3, YJL144W, RIM13, SRL1, MET28, INM1, VID27, CDC34, SRO9, RRP9, YOL087C, MCM22, YMR111C, NDJ1, ATG12, MSM1, SRS2, YBR225W, YLR063W, AI1, CDC36, ASN1, MET31, SSP1, NGG1, RBA50, PUT1, YPT53, NMA2, YBR219C, CDC40, SGO1, YJL047C-A, RPC31, INP52, UGO1, RAD30, CLB1, GLO4, TPK3, GIM3, CDC9, PEX27, AIM32, YGL081W, DJP1, HMS1, JSN1, UBP12, RSM25, UBP5, GIP1, PUT3, CKI1, FAR7, LAG2, DAM1, PSD2, HMT1, COR1, MMR1, MRPL39, CTF8, AGP2, PRM7, HIT1, HAL9, GPA2, TIM44, TFB1, ECM19, MRPL32, YBR284W, NAS2, SBE22, YOR011W-A, ORT1, MRPL25, QNQ1, APC4, TYE7, YPP1, MMT1, MRP10, MRPS5, LIP5, CDC27, ESC2, CAN1, MEC1, TOP1, SLM3, SIP4, URN1, YCK3, USO1, RSM19, ASG1, ISU1, YHL008C, YNL313C, KKQ8, FCY2, GPD1, HHT1, MDJ2, SDH1, SSF1, PIP2, STE13, AZF1, VPS3, YGL146C, TAM41, MIF2, YDL118W, HFM1, PRR1, MRE11, FMP37, MLH2, BUD5, YOR342C, PCL1, DHR2, CDC5, CBP3, RLP24, LSG1, NCL1, YDR262W, PGA3, MID2, YJL027C, YOR305W, QCR6, MSC6, RSC4, PAU18, POL12, SME1, DBF2, RPS27A, NHP6A, YGK3, SLO1, AIM36, UBP13, TRI1, CTH1, PGS1, NMD4, YIL064W, BAR1, BCS1, YBL029W, CTR1, MRPL20, AGP3, YOR338W, FCF2, YOR052C, YJL147C, RSA1, PEX8, YOL159C, RRP45, YDL199C, LIA1, THI2, TRZ1, CYT2, MGM101, YNL277W-A, ARP8, MRPL36, YAR028W, PAU2, SLD5, SMD1, YNL086W, QCR7, FMC1, HOS4, HEM1, NAM7, YPL108W, BUD14, BOI2, HRD1, YOL114C, RIS1, SIC1, BST1, KES1, MET4, TRS120, SYC1, NPA3, YLH47, SRL2, LRC3, MHR1, ZIP2, EAR1, RSF1, RIO2, MET2, NOP4, SRD1, PWP2, MST1, PCK1, CDC7, TOK1, PRO1, RAX2, LSM7, SHG1, TOM7, DAS2, SIP2, RRS1, EUG1, POX1, RAD61, SUN4, HAA1, YNR048W, ACO2, YOL047C, PMD1, FZO1, YEL025C, GPR1, BNI1, RSA4, YMR185W, PAU16, ECM7, YHP1, COG8, LST8, HST1, ESA1, YJL160C, MER1, CIN8, WSS1, PAT1, LRC6, FMP30, LYS21, MET18, MRPL50, GCR1, YOR022C, YJR012C, PDR3, YPL229W, SFK1, DUS4, IDS2, YOL036W, PHM6, YPR117W, RPB7, MCM2, MRS1, GLO2, YKL105C, RCK1, AME1, DIA3, HOM3, YDR541C, PMT6, DSE2, YJL216C, RIO1, ALB1, IBA57, YOR268C, CWC24, ARD1, UTP15, MSE1, UBS1, YNL234W, YDL025C, CAF40, YBR221W-A, ATP18, MAL33, YPT6, OAC1, YJR151W-A, YML108W, COX17, RAD52, HST3, TAZ1, YNR064C, YGL010W, MFA2, PGM3, NRM1, CRS5, CTM1, SKG6, SYF2, HYM1, IPI3, MDH1, TFB2, HST4, MRPL24, YMR166C, AVT5, YGR021W, SUV3, YNL146W, MID1, AKL1, MTR1, LAA1, HDA1, SMY2, MRPL8, PLB2, CWP1, ECM14, ECM1, GAL2, FAS1, KEL1, SET7, TSR2, FET5, DRE2, MMS4, TGS1, COQ1, SUR7, PCL2, SER2, YFL034W, MKK1, SSA2, AVO1, FMP25, YRR1, SLX5, SAF1, YPL260W, YKR096W, UTP14, PAM18, WTM1, STE18, AIM20, SYM1, SIT4, SSH4, MEI5, CYC8, DSN1, STB3, IMD4, YPL109C, ECM25, YMR102C, YDR306C, SUL2, YOL019W, PAU10, HNM1, MRPL1, CMK1, YBR196C-A, YGL226W, YPR147C, PGM2, SLM4, MSS1, YER121W, YDR381C-A, VPS72, YJL043W, PAN6, YMR086W, MDN1, HEH2, YKE4, YKL162C, ZRG8, HIP1, YPR145C-A, YCL056C, ERG1, INP54, MRPS16, MOD5, YJR008W, RMI1, YNL146C-A, RRF1, CAF130, BUD9, GWT1, BEM3, STF2, SSN3, MAS2, SLN1, TLG1, NOP6, YOR097C, HVG1, GCD11, TDP1, ATC1, CIT1, GRR1, RPA12, ADY3, CTA1, SWS2, SNF8, CIS3, MRPL4, CLB4, DBP2, APQ12, UTP5, MPD1, MRS3, AIM43, ATP11, SNU66, ARF3, YKU80, YLR422W, EGT2, MSP1, YLR218C, MRPL44, YHR127W, UBP3, SOD2, CYT1, POP6, HSP10, YHR033W, YKL161C, KIN82, YNL165W, CYC7, FYV7, TAT1, YNR040W, DBP3, SMY1, TRP3, SSL2, RPS24B, UTP4, SAW1, DAN2, YPR011C, YER156C, YGL059W, TRM5, SUT2, IML2, ATP1, CKA1, ECM31, MSK1, SCC2, SYG1, RPO26, YPR114W, HIR3, YIL029C, MAC1, YOR296W, IST3, HOR2, ITT1, PRP22, ROD1, DIA4, FMP32, TOM70, DIP2, YPR159C-A, PSP1, BTS1, ECM37, AST1, SMP1, BPL1, UPS1, BAG7, NOG2, RPC10, CYB2, SMD2, RAD1, ATP3, STP2, BUD21, RRN5, YLR352W, FRE4, PAN2, APL3, SEC7, DUS1, CSE1, MAK3, MRPL19, DBP1, FMP48, JAC1, YPS54, FUR1, PUP3, FUN26, SWI1, PWP1, BUD23, ATF1, FMP16, YOL024W, IPK1, RLM1, YNG2, MSS2, FLO8, SHY1, KSP1, KNH1, DON1, KTI11, SMC5, FPS1, SHU1, RAV2, YOR356W, PFA3, ERG8, SEN15, YNL152W, YJL193W, MSH2, CYC1, YLR446W, MRPL13, ISA1, HUA1, YHL010C, NNT1, RMD8, PPR1, ECM9, BSC2, ACO1, MPS2, LEE1, COG5, MCM1, RFC1, TAT2, DML1, KRE9, SPF12, SPC19, QCR8, HXT1, DOA4, MSR1, STU1, ERG10, TFB4, ATG21, GYP6, DAD4, OAF1, YPR013C, GAS1, FAP7, CPA2, RPO31, ATG20, TEP1, YBL081W, SMP3, MCD1, ADK2, SAD1, HUA2, BUD2, YJR136C, RPS14, MNL1, MDJ1, FLO10, REB1, DSF2, KHA1, MRPL35, YOR283W, PPG1, CIT3, FAA4, SPL2, MET8, HOP2, HFA1, HAP5, ROG1, MAM3, DPH1, RTG3, YNL195C, DCN1, YLR211C, OXA1, YET2, RSC2, MRPL28, CTT1, YAP3, BIG1, UBP8, YOL019W-A, RIB5, NOG1, VID30, MRP17, ZRT1, UAF3, SPO23, YNL122C, SNU71, CDC43, SPC29, DYS1, PRP11, SYF1, BUD20, MEK1, UBP16, PCF11, GRX4, UTP22, HRK1, RPB9, YPL272C, ERG29, DIS3, YFH1, MRM2, RRP5, PTI1, TIF6, FTH1, MPE1, FKS3, ESP1, YDL007C-A, DMC1, JHD2, LEU2, SNF3, SCJ1, YMR317W, CYK3, GPT2, FMP41, SIA1, HXK1, YGL057C, YLR287C, NSR1, YDL241W, RKR1, REX4, TIM17, TES1, RPO21, YNL300W, BSC6, YHR080C, OPI10, RPB8, UBP9, YKR011C, CRP1, RSM24, ARP1, SIK1, GCR2, YLR345A, FET4, MRPL40, THP2, AMD2, YDR524W-C, PSY4, BUD16, HPT1, YDR333C, RHO4, AHC1, YJL206C, SWT1, HEK2, ATP12, XBP1, RMD6, RPL15B, NUP42, PLC1, MAD3, YPS1, MCM16, HXT4, HXK2, ERG12, MMT2, YMR321C, MUM3, HST2, ROG3, DEF1, YLR281, SSK22, MLH3, YGR131W, CSE4, YCL002C, MRPS18, CAD1, AIF1, SFC1, OYE3, EAF5, RSC9, GYL1, YDL063C, ISA2, GBP2, IMG1, NRP1, DHH1, RHB1, CIK1, PHO89, AGX1, RPB2, MRPL17, GPX2, LYP1, VPS9, BNA3, CKA2, OPI1, YER034W, RSM26, LSM6, THI3, SMC4, SWF1, YAH1, RPF2, HFI1, PLB1, MAM33, YLR413W, PRP8, ENO1, RPC19, YGL007C-A, YMR181C, URA1, YGL108C, SRB7, DAD1, LYS4, ATG18, FMP4, VAM3, SSC1, SNU56, YHR045W, HTA2, YJL213W, RPL20A, ALD4, QCR10, YGR287C, CBP4, PCI8, MCM4, DEM1, ATO3, TPS2, TAF1, KRE6, KGD2, ARB1, NMD5, EFR3, TRP4, HLJ1, ACE2, LDB17, ATG7, OSH6, AFT1, CTF4, YDR286C, AIM44, YLR149C, MRPS9, BET1, YLF2, BOI1, BUD4, CRF1, MLP2, ARX1, RRP12, NAT2, PCL1, ARP7, SFH1, STF1, YML081W, MRP49, FOL3, SAC7, PCS60, TPA1, SSS1, ERO1, NHP2, AIM1, AMD1, VPS38, COG3, YMR244C-A, PYC1, CCC1, TAO3 and YDL233W.

(10) The production method according to any one of (1) to (9), wherein the yeast genes are selected from the group consisting of: ORC4, ICY2, GIC1, HLR1, ECM13, YLR108C, AQR1, YHR213W-A, SUT1, PLB3, AIM26, TPO4, YPR153W, GIS3, WSC3, FUR4, DLT1, MOT1, YNR063W, MET13, YDL156W, YJL107C, YJR154W, YNL042W-B, VHS1, GPI19, YIL057C, STD1, CTF19, RAD34, YIR021W-A, FZF1, YHK8, YGL188C-A, HCM1, CDC6, YPR157W, CLB6, YOX1, YLR285C-A, YDR114C, YHR199C-A, MPS3, MUP3, YIR014W, AAR2, YPT35, AIM33, SCW11, BDF1, YCL042W, BSC4, YGL193C, NUT2, YJL118W, YKL069W, SRB8, YOR060C, MDH2, YPR116W, YPK2, GLN3, YDL211C, RAD55, CYM1, ENT4, ULA1, YMR182W-A, YKR017C, YOR302W, YOR072W-B, VTS1, FYV12, YGL235W, YHR086W-A, YEL067C, YPL257W, UBA3, YMR105W-A, YOR316C-A, TMA10, YDL159W-A, ATG29, YML037C, NSL1, YJL077W-B, POP3, WHI5, MIH1, YGR240C-A, YRM1, KAR9, YJU2, SPC24, DPB2, CHL4, YMR087W, CSI1, YIL134C-A, BUR2, PTH1, SSN8, AUA1, YLR154C-G, YLR342W-A, YCL001W-A, FLC1, YLL006W-A, VAM7, YPL077C, CCZ1, PRP28, ACM1, IME4, YPR096C, FRE5, PDR8, ILV5, YIL161W, PAC11, UBR2, YRB2, YLR125W, YMR253C, DSE4, EPL1, SNP1, YMR160W, SPO77, BUB1, YFR016C, SPC97, GEM1, INO2, SPT10, YLR132C, AIM45, YJR054W, MBF1, YAL064C-A, YML054C-A, NUP1, ECM27, YIL060W, IRE1, YHR177W, YJR079W, YNL187W, YML003W, PIH1, YDR169C-A, PET111, YDL109C, YOR102W, YHR050W-A, TAR1, RIM9, YCR095W-A, RPR2, COS7, YDR049W, CUS1, JJJ3, COS10, MET1, HXT8, GLY1, SUR1, RTG1, PHM7, YJL052C-A, HXT17, YFL052W, ATG1, ECM2, YNR075C-A, YKR041W, ALD5, YHL018W, LUC7 and YPS5.

(11) The production method according to any one of (1) to (10)0, wherein the yeast genes are selected from the group consisting of: ORC4, ICY2, GIC1, HLR1, ECM13, YLR108C, AQR1, YHR213W-A, SUT1, PLB3, AIM26, TPO4, YPR153W, GIS3, WSC3, FUR4, DLT1, MOT1, YNR063W, MET13, YDL156W, YJL107C, YJR154W, YNL042W-B, VHS1, GPI19, YIL057C, STD1, CTF19 and RAD34.

(12) The production method according to any one of (1) to (11), the method further comprising the step of preparing the yeast gene terminator regions based on nucleotide sequences represented by SEQ ID NOS:10591-15885.

(13) A regulator of gene expression in a yeast, comprising a terminator region of a yeast gene selected from the yeast genes according to (3).

(14) The regulator of gene expression according to (13), wherein the yeast gene is selected from the yeast genes according to (14)

(15) The regulator of gene expression according to (13) or (14), wherein the yeast gene is selected from the yeast genes according to (5).

(16) The regulator of gene expression according to any one of (13) to (15), wherein the yeast gene is selected from the yeast genes according to (9).

(17) A regulator of gene expression in a yeast, selected from the yeast gene terminator regions according to (10).

(18) The regulator of gene expression according to (17), wherein the yeast gene is selected from the yeast genes according to (11).

(19) The regulator of gene expression according to any one of (13) to (18), wherein the terminator region contains one of the following nucleotide sequences, and has activity equivalent to original terminator activity:

(a) a nucleotide sequence represented by a sequence ID specified by any one of SEQ ID NOS:10590-15885;
(b) a nucleotide sequence represented by a sequence ID specified by any one of SEQ ID NOS:10590-15885 with 1 or 2 or more nucleotides deleted, substituted, inserted and/or added therein; and
(c) a nucleotide sequence having 90% or greater identity with a nucleotide sequence represented by a sequence ID specified by any one of SEQ ID NOS:10590-15885.

(20) A cassette for gene expression in a yeast, the cassette comprising:
a promoter that functions in a yeast; and
a regulator of gene expression according to any one of embodiments 13 to 18, disposed downstream from the promoter.

(21) A recombinant yeast carrying DNA including a promoter that functions in a yeast, an exogenous gene controlled by the promoter, and a regulator of gene expression according to any one of (13) to (19) disposed downstream from the exogenous gene.

(22) A recombination yeast in which expression intensity of one or two or more kinds of genes selected from endogenous genes and exogenous genes has been modified using a terminator region of a yeast gene selected from the yeast genes according to (3) and (9).

(23) A method for screening regulators of expression in a yeast, the method comprising:
evaluating an amount of a protein produced by a recombinant yeast carrying DNA including a promoter that functions in a yeast, a coding region encoding an arbitrary protein, and a terminator region from a yeast gene; and
evaluating expression intensity of the terminator region based on the amount of the protein.

(24) A method for regulating expression intensity of one or two or more kinds of endogenous genes and/or exogenous genes using terminator regions of one or two or more kinds of yeast genes selected from the yeast genes according to (3) and the yeast genes according to (9).

(25) A method for using a yeast to screen drugs, the method comprising:
using terminator regions of one or two or more kinds of yeast genes selected from the yeast genes according to embodiment 3 and the yeast genes according to embodiment 9 to obtain one or two or more kinds of recombinant yeasts in which expression intensity of one or two or more kinds of genes selected from endogenous genes and exogenous genes associated with the drug has been modified; and
using the one or two or more kinds of recombinant yeasts to screen the drug.

BRIEF DESCRIPTION OF DRAWINGS

FIG. 5 shows the top 30 terminator regions selected in Example 7.

DETAILED DESCRIPTION

Figure 1:
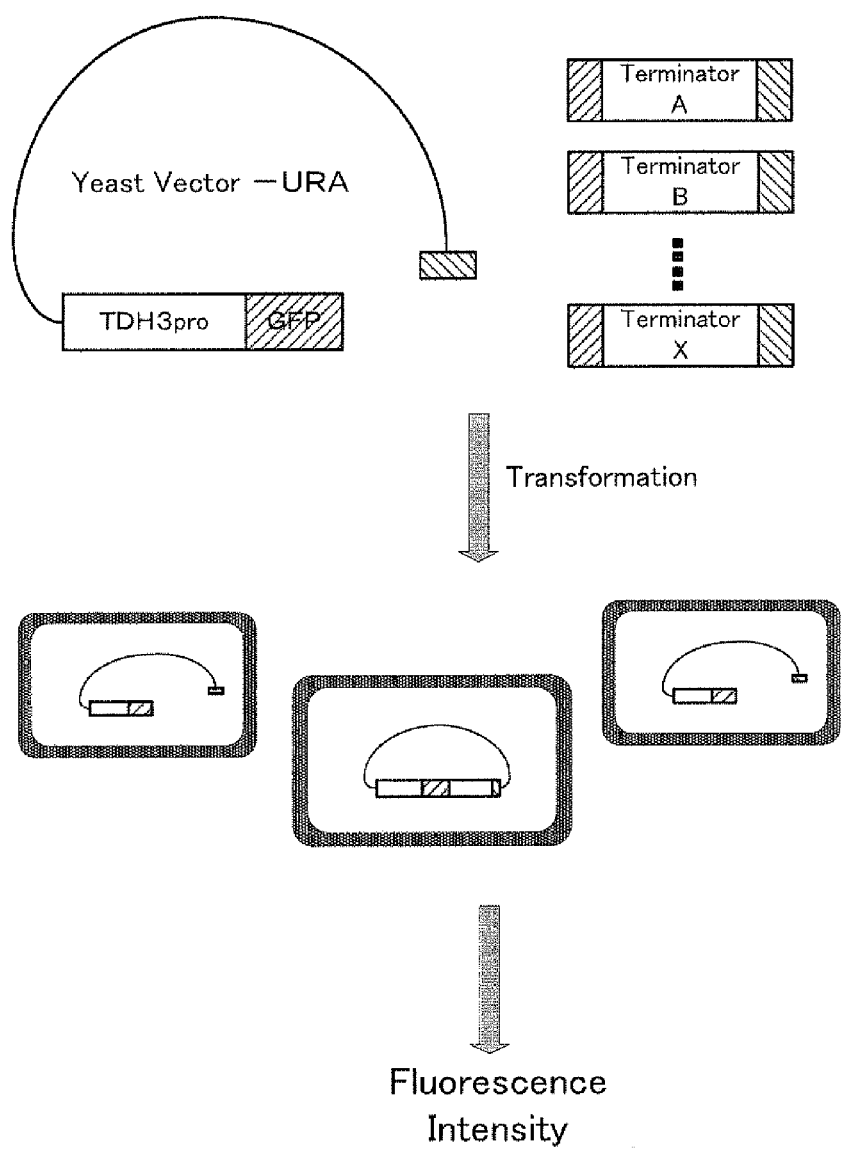
FIG. 1 shows an outline of a vector used in the examples for evaluating terminator regions.

The disclosures of this Description are based on a comprehensive evaluation by the inventors of the effects of yeast gene terminator regions on gene expression levels, focusing on the possibility that a yeast gene terminator region might be used to regulate the expression level of a gene the transcription termination of which is regulated by that terminator region. They are also based on the resulting discovery that yeast gene terminator regions are deeply involved in gene expression levels. The disclosures of this Description allow the expression of exogenous genes in yeasts to be regulated more easily and precisely.

Based on these findings, the disclosures of this Description relate to a method for producing an expression product of a gene in a yeast, to a regulator of gene expression in a yeast, and to a gene expression cassette, recombinant yeast, screening method and the like.

Various embodiments included in the disclosures of this Description are explained in detail below.

(Method for Producing Expression Product of Arbitrary Gene in a Yeast)

The production method of the present teaching comprises a step of causing expression of an arbitrary gene by using a terminator region selected based on expression intensity data about terminator regions of genes from yeasts. Expression intensity data is data about the expression intensity, or in other words the expression level, of a gene that has been attached so that it is transcriptionally controlled by the terminator region. Expression intensity data can be obtained as data about relative expression levels in comparison with expression levels using a known yeast terminator region, such as the yeast PGK1 terminator or the like.

The inventors have shown that when various yeast gene terminator regions are linked under specific conditions (for example, using expression cassettes each comprising the same promoter and exogenous gene), each yeast gene terminator region exhibits its own particular expression intensity.

The terminator region means a region which is arranged downstream of the code region of the gene, codes the sequence of the 3'-UTR region of the mRNA and has a transcript termination function. Transcript termination function comprises functions of terminating transcription from the DNA to the mRNA, processing the 3' end of the mRNA into an appropriate position and adding Poly A to the mRNA (Richard, P. and Manley, J. L. (2009), Genes De. 23. 1247-1269, Kuehner, J. N., Pearson, E. L. and Moore, C. (2011) Nat. Rev. Mol. Cell. Biol. 12, 283-294)). Further, the 3'-UTR region coded in the terminator region performs the post-transcriptional control regarding the gene expression. Stability of the mRNA, translation efficiency and localization of the mRNA are founded as major controlling mechanisms.

Expression intensity data is shown below for the terminator regions of 5295 genes obtained from yeasts, particularly the budding yeast *Saccharomyces cerevisiae*. The expression intensity data is shown by the gene name followed (in parentheses) by the relative expression intensity compared to that of the PGK1 terminator region. Although these genes are derived from the model yeast *Saccharomyces cerevisiae*, the teaching is widely applicable to other yeasts including budding yeasts. The gene names are listed below beginning with the gene with the lowest relative expression intensity.

(Expression Intensity Data)
ORC4 (0.030), ICY2 (0.044), GIC1 (0.047), HLR1 (0.053), ECM13 (0.057), YLR108C (0.060), AQR1 (0.064), YHR213W-A (0.065), SUT1 (0.068), PLB3 (0.070), AIM26 (0.072), TPO4 (0.073), YPR153W (0.073), GIS3 (0.073), WSC3 (0.079), FUR4 (0.079), DLT1 (0.080), MOT1 (0.080), YNR063W (0.081), MET13 (0.081), YDL156W (0.082), YJL107C (0.082), YJR154W (0.082), YNL042W-B (0.082), VHS1 (0.083), GPI19 (0.084), YIL057C (0.084), STD1 (0.085), CTF19 (0.088), RAD34 (0.088), YIR021W-A (0.088), FZF1 (0.089), YHK8 (0.089), YGL188C-A (0.089), HCM1 (0.090), CDC6 (0.090), YPR157W (0.091), CLB6 (0.091), YOX1 (0.091), YLR285C-A (0.091), YDR114C (0.092), YHR199C-A (0.092), MPS3 (0.092), MUP3 (0.093), YIR014W (0.094), AAR2 (0.094), YPT35 (0.094), AIM33 (0.095), SCW11 (0.095), BDF1 (0.095), YCL042W (0.096), BSC4 (0.096), YGL193C (0.096), NUT2 (0.097), YJL118W (0.098), YKL069W (0.099), SRB8 (0.099), YOR060C (0.099), MDH2 (0.099), YPR116W (0.100), YPK2 (0.101), GIN3 (0.101), YDL211C (0.101), RAD55 (0.102), CYM1 (0.102), ENT4 (0.102), ULA1 (0.103), YMR182W-A (0.104), YKR017C (0.104), YOR302W (0.106), YOR072W-B (0.107), VTS1 (0.107), FYV12 (0.107), YGL235W (0.108), YHR086W-A (0.108), YEL067C (0.109), YPL257W (0.109), UBA3 (0.109), YMR105W-A (0.109), YOR316C-A (0.110), TMA10 (0.110), YDL159W-A (0.112), ATG29 (0.113), YML037C (0.113), NSL1 (0.113), YJL077W-B (0.113), POP3 (0.113), WHI5 (0.113), MIH1 (0.114), YGR240C-A (0.115), YRM1 (0.115), KAR9 (0.115), YJU2 (0.116), SPC24 (0.116), DPB2 (0.117), CHL4 (0.117), YMR087W (0.118), CSI1 (0.118), YIL134C-A (0.118), BUR2 (0.118), PTH1 (0.119), SSN8 (0.119), AUA1 (0.119), YLR154C-G (0.120), YLR342W-A (0.120), YCL001W-A (0.120), FLC1 (0.121), YLL006W-A (0.121), VAM7 (0.121), YPL077C (0.121), CCZ1 (0.123), PRP28 (0.123), ACM1 (0.123), IME4 (0.123), YPR096C (0.123), FRE5 (0.124), PDR8 (0.125), ILV5 (0.125), YIL161W (0.126), PAC1 (0.126), UBR2 (0.126), YRB2 (0.128), YLR125W (0.128), YMR253C (0.128), DSE4 (0.128), EPL1 (0.128), SNP1 (0.128), YMR160W (0.128), SPO77 (0.129), BUB1 (0.129), YFR016C (0.129), SPC97 (0.130), GEM1 (0.130), INO2 (0.130), SPT10 (0.130), YLR132C (0.131), AIM45 (0.131), YJR054W (0.132), MBF1 (0.132), YAL064C-A (0.132), YML054C-A (0.132), NUP1 (0.132), ECM27 (0.132), YIL060W (0.133), IRE1 (0.133), YHR177W (0.134), YJR079W (0.134), YNL187W (0.136), YML003W (0.136), PHI1 (0.136), YDR169C-A (0.136), PET111 (0.137), YDL109C (0.137), YOR012W (0.138), YHR050W-A (0.138), TAR1 (0.139), RIM9 (0.139), YCR095W-A (0.140), RPR2 (0.140), COS7 (0.140), YDR049W (0.142), CUS1 (0.142), JJJ3 (0.142), COS10 (0.143), MET1 (0.144), HXT8 (0.145), GLY1 (0.146), SUR1 (0.146), RTG1 (0.147), PHM7 (0.147), YJL052C-A (0.147), HXT17 (0.147), YFL052W (0.148), ATG1 (0.148), ECM2 (0.148), YNR075C-A (0.148), YKR041W (0.149), ALD5 (0.149), YHL018W (0.149), LUC7 (0.149), YPS5 (0.149), YLR297W (0.150), SNA4 (0.150), BIO4 (0.150), YBR298C-A (0.150), ECM12 (0.152), SEF1 (0.152), YMR247W-A (0.152), EXO1 (0.153), CTF13 (0.154), HUR1 (0.154), SNO3 (0.154), BSC5 (0.154), YER175W-A (0.155), PGA1 (0.155), YLR173W (0.156), YDR119W-A (0.157), IRC15 (0.157), MGA1 (0.157), YPR174C (0.159), IML3 (0.159), YLL054C (0.159), RDS1 (0.159), MDM32 (0.160), PET494 (0.160), YPR036W-A (0.160), GTB1 (0.160), ISF1 (0.161), KRE29 (0.161), SAP190 (0.161), YHR214C-E (0.162), GTO3 (0.163), YOR365C (0.163), MIP1 (0.163), SIP5 (0.164), YPL191C (0.164), YPL162C (0.164), YMR291W (0.165), BRN1 (0.166), MDM1 (0.166), NAT4 (0.166), YLR406C-A (0.166), YME1 (0.166), CSI2 (0.166), YOR008C-A (0.167), CEF1 (0.169), BUD25 (0.169), DFG16 (0.170), GPB1 (0.170), KAR1 (0.170), PPM2 (0.171), DSS1 (0.171), RPC37 (0.172), VID24 (0.172), ERV41 (0.172), YGR169C-A (0.172), ECM8 (0.173), YHR032W (0.173), ELA1 (0.173), PEX29 (0.173), LTE1 (0.173), HAT2 (0.174), SLI1 (0.174), MUP1 (0.175), ALG13 (0.176), FRE7 (0.176), YMR147W (0.177), ISU2 (0.177), YOR1 (0.178), JID1 (0.179), ECM3 (0.179), ATG5 (0.179), MED6 (0.180), YPL014W (0.180), YLR030W (0.180), AQY2 (0.180), CCT2 (0.180), YER067W (0.181), NRG1 (0.181), SPT8 (0.181), PIR1 (0.181), YGR068C (0.182), YER039C-A (0.182), ELM1 (0.182), ASE1 (0.182), YBL095W (0.183), YNR066C (0.183), MTL1 (0.183), CNE1 (0.183), CAX4 (0.183), NDI1 (0.184), FLX1 (0.184), YNL130C-A (0.184), CWC25 (0.186), YNL254C (0.186), CDC13 (0.186), ATP100 (0.187), OCT1 (0.187), ALF1 (0.187), YEF1 (0.187), BAP2 (0.187), HTL1 (0.188), PDC5 (0.189), PKP1 (0.190), SSK2 (0.191), CAF120 (0.192), SKN1 (0.192), HHF1 (0.193), CDC39 (0.194), YFR012W (0.194), YEL048C (0.194), HAP4 (0.195), PEX7 (0.195), TPO1 (0.196), NFT1 (0.196), NGL3 (0.198), YMR206W (0.199), DUS3 (0.200), YAP7 (0.200), CUS2 (0.201), YLR415C (0.201), FUI1 (0.202), SLM5 (0.203), BTT1 (0.203), YFR035C (0.203), RRN10 (0.203), HAP3 (0.204), SSY5 (0.204), SFL1 (0.204), KIP1 (0.205), CDC15 (0.206), GLT1 (0.207), DOC1 (0.208), MND1 (0.209), AAC1 (0.209), CEP3 (0.209), UBC5 (0.209), YNL213C (0.209), CLN3 (0.210), CSF1 (0.210), ECM18 (0.210), MRS4 (0.210), YIL046W-A (0.211), INP1 (0.211), RTT105 (0.211), MPT5 (0.211), ATG1 (0.212), RNH202 (0.212), TAX4 (0.213), IZH3 (0.213), BDF2 (0.214), COX14 (0.214), YIP4 (0.214), YJR120W (0.214), SAE2 (0.215), YMC2 (0.216), YGR035C (0.216), NDD11 (0.216), HPA2 (0.216), STL1 (0.216), GPM3 (0.216), ERF2 (0.217), MMS21 (0.217), YJL133C-A (0.218), YNL024C (0.218), IFH1 (0.219), LIN1 (0.220), ICS3 (0.220), YNR014W (0.220), SPB1 (0.220), YNL211C (0.221), SOL1 (0.221), COS111 (0.221), HSH155 (0.221), NKP2 (0.221), NAB3 (0.221), FMT1 (0.222), YPL152W-A (0.222), BOR1 (0.222), SPC25 (0.222), MMS1 (0.222), YIL166C (0.223), MAL13 (0.223), BFA1 (0.223), AEP3 (0.224), MTH1 (0.225), YGR031W (0.225), BIT61 (0.227), YMR230W-A (0.227), SKT5 (0.227), YGL258W-A (0.227), PHR1 (0.227), HTB2 (0.228), SER1 (0.229), BAP3 (0.230), YER053C-A (0.230), ATG16 (0.231), BIO2 (0.231), MEP3 (0.232), YNR073C (0.232), PCH2 (0.232), APS2 (0.232), MDM30 (0.233), CLB5 (0.233), ISR1 (0.234), MRP20 (0.234), GUD1 (0.235), MED1 (0.235), RER2 (0.236), MCM10 (0.236), YIR018C-A (0.236), SPO14 (0.236), NUC1 (0.237), MNN4 (0.237), IFM1 (0.237), YLR412C-A (0.237), ALT2 (0.237), NNF1 (0.238), YKL096C-B (0.239), RAD51 (0.239), CIT2 (0.239), SPT4 (0.239), LRC4 (0.240), USE1 (0.240), YLR455W (0.241), YOL164W-A (0.241), PRP18 (0.242), COA2

(0.242), HSP82 (0.243), YER184C (0.244), DAD2 (0.246), LEU1 (0.247), YDL129W (0.247), YPL119C-A (0.248), YOR034C-A (0.249), PRP38 (0.249), MSA1 (0.250), YBR147W (0.250), BBP1 (0.250), MLH1 (0.250), SWC3 (0.251), SOH1 (0.251), HHF2 (0.251), NIP1 (0.251), MSL1 (0.251), RIF2 (0.252), SPG1 (0.252), WHI3 (0.253), HTA1 (0.253), ARR3 (0.253), YIL077C (0.253), SGF29 (0.254), RAD53 (0.255), YEL073C (0.257), YNR065C (0.258), NCA3 (0.258), YBR296C-A (0.259), ECM23 (0.259), YLR225C (0.259), SLD3 (0.259), YBR197C (0.259), YBL059W (0.260), YOL075C (0.262), DNA2 (0.263), SIZ1 (0.263), REC114 (0.263), MSN1 (0.264), RGT2 (0.264), CBF1 (0.264), YGL176C (0.265), PTP2 (0.265), GAL3 (0.265), VPS62 (0.266), HMS2 (0.266), SMF3 (0.267), APL1 (0.268), SKI3 (0.268), MNS1 (0.268), YOR214C (0.268), TID3 (0.269), KSS1 (0.269), YDR194W-A (0.270), UPC2 (0.270), ARG80 (0.270), MRS2 (0.271), ATP23 (0.272), YML100W-A (0.272), YGL101W (0.272), STE12 (0.272), RPI1 (0.273), YDR090C (0.273), YEH1 (0.273), UTP13 (0.273), AMN1 (0.275), YIL089W (0.275), AVL9 (0.276), ATO2 (0.276), HEM3 (0.276), RPA14 (0.277), GIP3 (0.277), YGR503C (0.278), ALR2 (0.278), YAP5 (0.278), CDD1 (0.279), SLS1 (0.279), MET6 (0.279), ABM1 (0.2779), PET20 (0.280), CBP1 (0.280), RAD10 (0.280), SPO22 (0.281), PIB1 (0.281), EAF3 (0.281), YFR032C-B (0.282), ELP2 (0.282), YIA6 (0.282), PET112 (0.282), PAU7 (0.283), MEI4 (0.283), YEA4 (0.283), SGS1 (0.284), JEN1 (0.284), CLB2 (0.284), GIC2 (0.284), SWI6 (0.284), ULP2 (0.286), KIN28 (0.286), YKL033W (0.286), CSM4 (0.286), YNL095C (0.286), RRN3 (0.286), RNR1 (0.286), TPO3 (0.286), SUP45 (0.287), ABP140 (0.288), RPS28B (0.289), MRF1 (0.289), GLN1 (0.290), OPT1 (0.291), PHO4 (0.291), UBP10 (0.291), YOL163W (0.291), MDS3 (0.292), OTU1 (0.292), GAT1 (0.292), HDA3 (0.293), MSY1 (0.294), GNP1 (0.295), YFL041W-A (0.295), YPL141C (0.295), MPH2 (0.295), PMA1 (0.296), YNL260C (0.296), SKS1 (0.296), YDL177C (0.296), SWR1 (0.296), RMD5 (0.297), RPL9B (0.297), MIC14 (0.297), AOS1 (0.297), LRG1 (0.297), ROX1 (0.298), PCL10 (0.298), MRPL3 (0.298), YER152C (0.298), EAF1 (0.298), HTB1 (0.298), SPA2 (0.299), SSN2 (0.299), YJR129C (0.300), ATG8 (0.300), RHR2 (0.300), TFG2 (0.300), YBL100W-C (0.301), CSM2 (0.301), EXG1 (0.301), STE7 (0.301), ADH2 (0.302), SNT2 (0.302), PML39 (0.302), SEC2 (0.303), ASI2 (0.305), MNT3 (0.306), BUR6 (0.306), BIO5 (0.306), YDR506C (0.306), RDR1 (0.307), MRPL33 (0.307), YGL159W (0.307), RIM8 (0.309), YGR161W-C (0.310), YIG1 (0.310), PDR16 (0.310), YDR249C (0.311), YDR124W (0.311), HSP30 (0.311), SDH2 (0.313), YER130C (0.313), FAA3 (0.314), BUD22 (0.314), TIM22 (0.315), CBP6 (0.316), ICE2 (0.316), SPC110 (0.316), AFT2 (0.316), NAM2 (0.316), YPR071W (0.317), DIP5 (0.317), SDS3 (0.317), POP4 (0.317), OCA6 (0.317), PTC6 (0.317), YBR201C-A (0.318), YPR127W (0.318), SEC10 (0.318), ASF2 (0.318), SLI15 (0.319), RRN7 (0.320), ORC2 (0.320), GUF1 (0.320), GPI2 (0.323), RPS9A (0.324), RAD6 (0.324), PSR2 (0.325), RIP1 (0.325), GZF3 (0.325), CAR1 (0.325), YHR151C (0.325), LEU5 (0.325), YBR182C-A (0.326), IRC7 (0.326), ASG7 (0.327), YOR381W-A (0.327), OCA5 (0.327), YHR035W (0.328), PET117 (0.329), ISD11 (0.329), HSP150 (0.329), CCC2 (0.329), YHR131C (0.329), MRK1 (0.330), RXT2 (0.330), PPH3 (0.330), ODC2 (0.331), SHE9 (0.331), YCR075W-A (0.331), CYB5 (0.332), YDR415C (0.332), LRO1 (0.333), SOF1 (0.333), YNL162W-A (0.334), PAU14 (0.335), MTO1 (0.336), YKL061W (0.336), MSS11 (0.336), SAN1 (0.336), SET2 (0.336), YMR1 (0.336), PHD1 (0.338), YBL071C-B (0.338), MPA43 (0.339), SAM37 (0.339), AAT1 (0.339), ASH1 (0.340), UTR2 (0.340), CAT8 (0.341), SLX8 (0.341), HXT2 (0.342), COY1 (0.342), TAF3 (0.342), DSS4 (0.342), TOR1 (0.342), YMR030W-A (0.343), PAU5 (0.343), SFP1 (0.343), FHL1 (0.344), COX10 (0.344), DDR2 (0.344), SWM1 (0.345), HXT6 (0.346), RCR2 (0.346), YLR091W (0.346), RMD9 (0.346), SHQ1 (0.346), YLR346C (0.347), SPT21 (0.347), ARE1 (0.348), KAP95 (0.349), YGR071C (0.349), TRL1 (0.350), ECM17 (0.350), YML020W (0.350), RPO4 (0.351), CFT1 (0.351), LRC5 (0.352), THI74 (0.352), TPN1 (0.352), YOR059C (0.352), PRY3 (0.352), YEL1 (0.352), CNM67 (0.353), STB6 (0.354), YOR385W (0.354), RRN6 (0.354), COP1 (0.354), PDR12 (0.355), ELG1 (0.355), SRP40 (0.355), SRM1 (0.355), YDR109C (0.356), AIM30 (0.356), RPC17 (0.356), YJL028W (0.356), YBR071W (0.357), APS1 (0.357), KIP2 (0.358), ATP22 (0.358), PRM6 (0.358), BUD31 (0.359), IXR1 (0.359), NFI1 (0.359), YHL015W-A (0.359), VHS3 (0.360), YNL295W (0.361), SML1 (0.361), SSK1 (0.361), YAE1 (0.361), RIM2 (0.361), YDR246W-A (0.362), YLR445W (0.362), SPT23 (0.362), MTG2 (0.363), SGF1 (0.363), BRL1 (0.363), YMR315W (0.364), MRPS28 (0.365), ERG5 (0.365), UTP30 (0.365), MDM35 (0.365), ASR1 (0.366), YIL102C-A (0.366), USA1 (0.366), DOT6 (0.368), COX23 (0.369), ADH5 (0.370), DAN4 (0.370), RMA1 (0.370), SCT1 (0.370), PHO84 (0.371), SFG1 (0.371), SLX4 (0.372), EST1 (0.373), YNL190W (0.373), SNL1 (0.374), RRP15 (0.374), YML082W (0.375), DOT1 (0.375), PFX1 (0.375), YUR1 (0.376), YAP1802 (0.376), YDR185C (0.376), GET2 (0.376), YPL264C (0.377), YDR065W (0.377), YJR115W (0.378), MAK21 (0.378), YER064C (0.378), ATR1 (0.378), IDP2 (0.378), KCS1 (0.379), ZPR1 (0.379), ITC1 (0.379), OAZ1 (0.379), SWC7 (0.380), RPL8A (0.380), CAC2 (0.380), VTH1 (0.382), OCH1 (0.382), BUL1 (0.382), YNR004W (0.382), LST7 (0.382), MRPS8 (0.383), TIS11 (0.383), NDC1 (0.384), TOS8 (0.385), ISM1 (0.385), MSL5 (0.385), FMP43 (0.386), YJR098C (0.386), COQ3 (0.387), TPC1 (0.388), RIM101 (0.388), ADR1 (0.388), ALD6 (0.389), YHR087W (0.389), VPS21 (0.389), POG1 (0.389), YJR005C-A (0.389), SNT1 (0.390), YHR022C (0.390), MEF1 (0.390), PUP2 (0.391), ERP6 (0.391), HHT2 (0.392), YGR146C (0.392), OAR1 (0.392), YOR129C (0.392), YCR045C (0.392), DBP7 (0.393), MUB1 (0.393), YPL236C (0.393), RIB2 (0.394), YPR084W (0.394), AIM5 (0.395), UTR5 (0.395), HKR1 (0.396), YMR010W (0.397), ALR1 (0.398), LRE1 (0.399), RPN4 (0.399), YLR363W-A (0.399), MGM1 (0.399), HTD2 (0.399), NAM8 (0.399), SED5 (0.400), YOR161C-C (0.401), YML018C (0.401), NAB2 (0.401), YER140W (0.402), PRM4 (0.402), RTR1 (0.402), YIR042C (0.402), THI80 (0.402), FUN19 (0.402), DMR1 (0.402), SIP1 (0.403), CGR1 (0.403), MTR3 (0.404), YJL144W (0.404), RIM13 (0.404), SAL1 (0.405), MET28 (0.405), INM1 (0.405), VID27 (0.405), CDC34 (0.406), SRO9 (0.406), RRP9 (0.406), YOL087C (0.406), MCM22 (0.406), YMR111C (0.406), NDJ1 (0.407), ATG12 (0.407), MSM1 (0.408), SRS2 (0.408), YBR225W (0.409), YLR063W (0.410), AI1 (0.410), CDC36 (0.410), ASN1 (0.410), MET31 (0.410), SSP1 (0.410), NGG1 (0.410), RBA50 (0.411), PUT1 (0.412), YPT53 (0.412), NMA2 (0.412), YBR219C (0.413), CDC40 (0.413), SGO1 (0.414), YJL047C-A (0.414), RPC31 (0.414), INP52 (0.414), UGO1 (0.414), RAD30 (0.415), CLB1 (0.415), GLO4 (0.415), TPK3 (0.416), GIM3 (0.416), CDC9 (0.417), PEX27 (0.417), AIM32 (0.417), YGL081W (0.418), DJP1 (0.418), HMS1 (0.419), JSN1 (0.419), UBP12 (0.420), RSM25 (0.420), UBP5 (0.420), GIP1 (0.420), PUT3 (0.421), CKI1 (0.421), FAR7 (0.421), LAG2 (0.421), DAM1 (0.422), PSD2 (0.423), HMT1 (0.423), COR1 (0.423), MMR1

(0.424), MRPL39 (0.424), CTF8 (0.424), AGP2 (0.425), PRM7 (0.425), HIT1 (0.425), HAL9 (0.426), GPA2 (0.426), TIM44 (0.426), TFB1 (0.426), ECM19 (0.428), MRPL32 (0.428), YBR284W (0.428), NAS2 (0.429), SBE22 (0.429), YOR011W-A (0.430), ORT1 (0.430), MRPL25 (0.430), QNQ1 (0.430), APC4 (0.430), TYE7 (0.431), YPP1 (0.431), MMT1 (0.431), MRP10 (0.431), MRPS5 (0.431), LIP5 (0.431), CDC27 (0.432), ESC2 (0.432), CAN1 (0.433), MEC1 (0.433), TOP1 (0.433), SLM3 (0.433), SIP4 (0.434), URN1 (0.434), YCK3 (0.434), USO1 (0.434), RSM19 (0.434), ASG1 (0.434), ISU1 (0.435), YHL008C (0.435), YNL313C (0.435), KKQ8 (0.436), FCY2 (0.436), GPD1 (0.436), HHT1 (0.437), MDJ2 (0.437), SDH1 (0.437), SSF1 (0.437), PIP2 (0.438), STE13 (0.438), AZF1 (0.438), VPS35 (0.438), YGL146C (0.439), TAM41 (0.440), MIF2 (0.441), YDL118W (0.441), HFM1 (0.441), PRR1 (0.441), MRE11 (0.442), FMP37 (0.442), MLH2 (0.442), BUD5 (0.443), YOR342C (0.443), PCL1 (0.443), DHR2 (0.444), CDC5 (0.444), CBP3 (0.444), RLP24 (0.444), LSG1 (0.444), NCL1 (0.444), YDR262W (0.445), PGA3 (0.445), MID2 (0.445), YJL027C (0.446), YOR305W (0.446), QCR6 (0.447), MSC6 (0.447), RSC4 (0.447), PAU18 (0.448), POL12 (0.448), SME1 (0.448), DBF2 (0.448), RPS27A (0.448), NHP6A (0.449), YGK3 (0.449), SLO1 (0.452), AIM36 (0.452), UBP13 (0.452), TRI1 (0.453), CTH1 (0.453), PGS1 (0.454), NMD4 (0.455), YIL064W (0.455), BAR1 (0.456), BCS1 (0.456), YBL029W (0.456), CTR1 (0.456), MRPL20 (0.457), AGP3 (0.457), YOR338W (0.457), FCF2 (0.457), YOR052C (0.457), YJL147C (0.457), RSA1 (0.457), PEX8 (0.458), YOL159C (0.459), RRP45 (0.459), YDL199C (0.459), LIA1 (0.459), THI2 (0.459), TRZ1 (0.459), CYT2 (0.460), MGM101 (0.460), YNL277W-A (0.460), ARP8 (0.460), MRPL36 (0.460), YAR028W (0.460), PAU2 (0.461), SLD5 (0.462), SMD1 (0.462), YNL086W (0.463), QCR7 (0.463), FMC1 (0.463), HOS4 (0.463), HEM1 (0.463), NAM7 (0.464), YPL108W (0.465), BUD14 (0.465), BOI2 (0.465), HRD1 (0.465), YOL114C (0.466), RIS1 (0.466), SIC1 (0.467), BST1 (0.467), KES1 (0.467), MET4 (0.467), TRS120 (0.467), SYC1 (0.468), NPA3 (0.469), YLH47 (0.469), SRL2 (0.469), LRC3 (0.469), MHR1 (0.470), ZIP2 (0.470), EAR1 (0.470), RSF1 (0.470), RIO2 (0.471), MET2 (0.471), NOP4 (0.471), SRD1 (0.471), PWP2 (0.472), MST1 (0.472), PCK1 (0.472), CDC7 (0.472), TOK1 (0.472), PRO1 (0.473), RAX2 (0.473), LSM7 (0.473), SHG1 (0.474), TOM7 (0.474), DAS2 (0.474), SIP2 (0.475), RRS1 (0.475), EUG1 (0.475), POX1 (0.475), RAD61 (0.476), SUN4 (0.476), HAA1 (0.476), YNR048W (0.477), ACO2 (0.477), YOL047C (0.477), PMD1 (0.477), FZO1 (0.477), YEL025C (0.477), GPR1 (0.478), BNI1 (0.478), RSA4 (0.478), YMR185W (0.478), PAU16 (0.479), ECM7 (0.479), YHP1 (0.479), COG8 (0.479), LST8 (0.479), HST1 (0.479), ESA1 (0.480), YJL160C (0.480), MER1 (0.480), CIN8 (0.480), WSS1 (0.481), PAT1 (0.481), LRC6 (0.482), FMP30 (0.482), LYS21 (0.483), MET18 (0.483), MRPL50 (0.483), GCR1 (0.484), YOR022C (0.484), YJR012C (0.484), PDR3 (0.485), YPL229W (0.485), SFK1 (0.485), DUS4 (0.485), IDS2 (0.486), YOL036W (0.486), PHM6 (0.486), YPR117W (0.486), RPB7 (0.486), MCM2 (0.487), MRS1 (0.487), GLO2 (0.487), YKL105C (0.487), RCK1 (0.487), AME1 (0.488), DIA3 (0.488), HOM3 (0.488), YDR541C (0.488), PMT6 (0.488), DSE2 (0.489), YJL216C (0.489), RIO1 (0.489), ALB1 (0.490), IBA57 (0.490), YOR268C (0.490), CWC24 (0.491), ARD1 (0.491), UTP15 (0.491), MSE1 (0.491), UBS1 (0.491), YNL234W (0.492), YDL025C (0.492), CAF40 (0.492), YBR221W-A (0.493), ATP18 (0.493), MAL33 (0.493), YPT6 (0.493), OAC1 (0.493), YJR151W-A (0.493), YML108W (0.494), COX17 (0.494), RAD52 (0.495), HST3 (0.495), TAZ1 (0.495), YNR064C (0.495), YGL010W (0.496), MFA2 (0.496), PGM3 (0.496), NRM1 (0.496), CRS5 (0.496), CTM1 (0.496), SKG6 (0.497), SYF2 (0.497), HYM1 (0.497), IPI3 (0.498), MDH1 (0.499), TFB2 (0.499), HST4 (0.499), MRPL24 (0.499), YMR166C (0.500), AVT5 (0.501), YGR021W (0.501), SUV3 (0.501), YNL146W (0.502), MID1 (0.502), AKL1 (0.503), MTR10 (0.503), LAA1 (0.503), HDA1 (0.504), SMY2 (0.504), MRPL8 (0.505), PLB2 (0.505), CWP1 (0.506), ECM14 (0.506), ECM1 (0.506), GAL2 (0.506), FAS1 (0.506), KEL1 (0.506), SET7 (0.506), TSR2 (0.507), FET5 (0.507), DRE2 (0.507), MMS4 (0.508), TGS1 (0.508), COQ1 (0.508), SUR7 (0.508), PCL2 (0.508), SER2 (0.509), YFL034W (0.509), MKK1 (0.509), SSA2 (0.510), AVO1 (0.510), FMP2 (0.511), YRR1 (0.511), SLK5 (0.511), SAF1 (0.51), YPL260W (0.511), YKR096W (0.511), UTP14 (0.511), PAM18 (0.512), WTM1 (0.512), STE18 (0.512), AIM20 (0.512), SYM1 (0.512), SIT4 (0.513), SSH4 (0.513), MEI5 (0.513), CYC8 (0.514), DSN1 (0.514), STB3 (0.514), IMD4 (0.514), YPL109C (0.514), ECM2 (0.514), YMR102C (0.515), YDR306C (0.516), SUL2 (0.516), YOL019W (0.516), PAU10 (0.516), HNM1 (0.516), MRPL1 (0.516), CMK1 (0.516), YBR196C-A (0.517), YGL226W (0.517), YPR147C (0.517), PGM2 (0.519), SLM4 (0.519), MSS1 (0.520), YER121W (0.520), YDR381C-A (0.520), VPS72 (0.520), YJL043W (0.520), PAN6 (0.520), YMR086W (0.521), MDN1 (0.521), HEH2 (0.521), YKE4 (0.521), YKL162C (0.522), ZRG8 (1.522), HIP1 (0.523), YPR145C-A (0.523), YCL056C (0.523), ERG1 (0.523), INP54 (0.523), MRPS16 (0.524), MOD5 (0.524), YJR008W (0.524), RMI1 (0.524), YNL146C-A (0.525), REF1 (0.525), CAF130 (0.525), BUD9 (0.526), GWT1 (0.526), BEM3 (0.527), STF2 (0.527), SSN3 (0.527), MAS2 (0.527), SLN1 (0.528), TLG1 (0.528), NOP6 (0.528), YOR097C (0.528), HVG1 (0.528), GCD11 (0.528), TDP1 (0.528), ATC1 (0.529), CIT1 (0.529), GRR1 (0.529), RPA12 (0.530), ADY3 (0.530), CTA1 (0.530), SWS2 (0.530), SNF8 (0.530), CIS3 (0.530), MRPL4 (0.531), CLB4 (0.531), DBP2 (0.532), APQ12 (0.532), UTP5 (0.532), MPD1 (0.532), MRS3 (0.532), AIM43 (0.532), ATP11 (0.533), SNU66 (0.533), ARF3 (0.533), YKU800 (0.534), YLR422W (0.534), EGT2 (0.534), MSP1 (0.535), YLR218C (0.535), MRPL44 (0.535), YHR127W (0.536), UBP3 (0.536), SOD2 (0.536), CYT1 (0.536), POP6 (0.536), HSP10 (0.536), YHR033W (0.536), YKL161C (0.538), KIN82 (0.538), YNL165W (0.538), CYC7 (0.538), FYV7 (0.538), TAT1 (0.539), YNR040W (0.539), DBP3 (0.539), SMY1 (0.539), TRP3 (0.540), SSL2 (0.540), RPS24B (0.540), UTP4 (0.540), SAW1 (0.540), DAN2 (0.541), YPR011C (0.541), YER156C (0.541), YGL059W (0.541), TRM5 (0.541), SUT2 (0.541), IML2 (0.542), ATP1 (0.542), CKA1 (0.542), ECM31 (0.542), MSK1 (0.542), SCC2 (0.543), SYG1 (0.543), RPO26 (0.543), YPR114W (0.544), HIR3 (0.544), YIL029C (0.544), MAC1 (0.545), YOR296W (0.545), IST3 (0.546), HOR2 (0.546), ITT1 (0.547), PRP22 (0.547), ROD1 (0.548), DIA4 (0.548), FMP32 (0.548), TOM70 (0.548), DIP2 (0.548), YPR159C-A (0.549), PSP1 (0.549), BTS1 (0.549), ECM37 (0.550), AST1 (0.550), SMP1 (0.550), BPL1 (0.550), UPS1 (0.551), BAG7 (0.551), NOG2 (0.551), RPC10 (0.552), CYB2 (0.552), SMD2 (0.552), RAD1 (0.552), ATP3 (0.553), STP2 (0.553), BUD21 (0.553), RRN5 (0.553), YLR352W (0.553), FRE4 (0.553), PAN2 (0.554), APL3 (0.555), SEC7 (0.555), DUS1 (0.555), CSE1 (0.555), MAK3 (0.556), MRPL19 (0.556), DBP1 (0.556), FMP48 (0.556), JAC1 (0.556), VPS54 (0.556), FUR1 (0.557), PUP3 (0.557), FUN26 (0.558), SWI1 (0.558), PWP1 (0.559), BUD23 (0.559), ATF1 (0.559), FMP6 (0.559), YOL024W (0.560),

IPK1 (0.560), RLM1 (0.560), YNG2 (0.560), MSS2 (0.561), FLO8 (0.561), SHY1 (0.561), KSP1 (0.561), KNH1 (0.562), DON1 (0.562), KTI11 (0.562), SMC5 (0.562), FPS1 (0.562), SHU1 (0.563), RAV2 (0.563), YOR356W (0.563), PFA3 (0.564), ERG8 (0.564), SEN15 (0.565), YNL152W (0.565), YJL193W (0.565), MSH2 (0.565), CYC1 (0.565), YLR446W (0.566), MRPL13 (0.566), ISA1 (0.566), HUA1 (0.567), YHL010C (0.567), NNT1 (0.567), RMD8 (0.567), PPR1 (0.568), ECM9 (0.568), BSC2 (0.568), ACO1 (0.568), MPS2 (0.568), LEE1 (0.568), COG5 (0.568), MCM1 (0.569), RFC1 (0.569), TAT2 (0.569), DML1 (0.569), KRE9 (0.570), SPT2 (0.571), SPC9 (0.571), QCR8 (0.571), HXT1 (0.572), DOA4 (0.572), MSR1 (0.572), STU1 (0.572), ERG10 (0.573), TFB4 (0.573), ATG21 (0.573), GYP6 (0.574), DAD4 (0.574), OAF1 (0.574), YPR013C (0.574), GAS1 (0.574), FAP7 (0.575), CPA2 (0.575), RPO31 (0.575), ATG20 (0.575), TEP1 (0.575), YBL081W (0.575), SMP3 (0.575), MCD1 (0.576), ADK2 (0.576), SAD1 (0.576), HUA2 (0.577), BUD2 (0.577), YJR136C (0.577), RPS14B (0.578), MNL1 (0.578), MDJ1 (0.578), FLO10 (0.578), REB1 (0.578), DSF2 (0.579), KHA1 (0.580), MRPL35 (0.580), YOR283W (0.580), PPG1 (0.581), CIT3 (0.581), FAA4 (0.581), SPL2 (0.581), MET8 (0.581), HOP2 (0.582), HFA1 (0.582), HAP5 (0.583), ROG1 (0.584), MAM3 (0.584), DPH1 (0.584), RTG3 (0.584), YNL195C (0.584), DCN1 (0.584), YLR211C (0.585), OXA1 (0.585), YET2 (0.585), RSC2 (0.586), MRPL28 (0.586), CTT1 (0.586), YAP3 (0.586), BIG1 (0.587), UBP8 (0.587), YOL019W-A (0.587), RIB5 (0.587), NOG1 (0.588), VID30 (0.588), MRP17 (0.588), ZRT1 (0.588), UAF30 (0.588), SPO23 (0.589), YNL122C (0.589), SNU71 (0.590), CDC43 (0.591), SPC29 (0.591), DYS1 (0.591), PRP1 (0.591), SVF1 (0.591), BUD20 (0.591), MEK1 (0.592), UBP16 (0.592), PCF11 (0.592), GRX4 (0.593), UTP22 (0.593), HRK1 (0.593), RPB9 (0.593), YPL272C (0.593), ERG29 (0.594), DIS3 (0.594), YFH1 (0.594), MRM2 (0.595), RRP5 (0.595), PTI1 (0.595), TIF6 (0.595), FTH1 (0.595), MPE1 (0.595), FKS3 (0.595), ESP1 (0.596), YDL007C-A (0.596), DMC1 (0.596), JHD2 (0.597), LEU2 (0.597), SNF3 (0.597), SCJ1 (0.597), YMR317W (0.598), CYK3 (0.598), GPT2 (0.598), FMP4 (0.598), SIA1 (0.598), HXK1 (0.598), YGL057C (0.599), YLR287C (0.599), NSR1 (0.599), YDL241W (0.599), RKR1 (0.599), REX4 (0.600), TIM17 (0.600), TES1 (0.600), RPO21 (0.600), YNL300W (0.601), BSC6 (0.601), YHR080C (0.601), OPI10 (0.602), RPB8 (0.602), UBP9 (0.602), YKR011C (0.602), CRP1 (0.602), RSM24 (0.602), ARP1 (0.603), SIK1 (0.603), GCR2 (0.603), YLR345W (0.603), FET4 (0.603), MRPL40 (0.605), THP2 (0.606), AMD2 (0.607), YDR524W-C (0.607), PSY4 (0.607), BUD16 (0.607), HPT1 (0.608), YDR333C (0.608), RHO4 (0.609), AHC1 (0.609), YJL206C (0.609), SWT1 (0.610), HEK2 (0.610), ATP2 (0.610), XBP1 (0.610), RMD6 (0.611), RPL15B (0.611), NUP42 (0.611), PLC1 (0.611), MAD3 (0.612), YPS1 (0.612), MCM16 (0.612), HXT4 (0.612), HXK2 (0.612), ERG12 (0.613), MMT2 (0.613), YMR321C (0.613), MUM3 (0.613), HST2 (0.613), ROG3 (0.613), DEF1 (0.615), YLR281C (0.615), SSK22 (0.616), MLH3 (0.617), YGR131W (0.617), CSE4 (0.617), YCL002C (0.617), MRPS18 (0.618), CAD1 (0.618), AIF1 (0.618), SFC1 (0.618), OYE3 (0.619), EAF5 (0.619), RSC9 (0.620), GYL1 (0.620), YDL063C (0.620), ISA2 (0.621), GBP2 (0.621), IMG1 (0.621), NRP1 (0.621), DHH1 (0.622), RHB1 (0.622), CIK1 (0.623), PHO89 (0.623), AGX1 (0.623), RPB2 (0.624), MRPL17 (0.624), GPX2 (0.625), LYP1 (0.625), VPS9 (0.625), BNA3 (0.626), CKA2 (0.626), OPI1 (0.626), YER034W (0.626), RSM26 (0.626), LSM6 (0.627), THI13 (0.627), SMC4 (0.627), SWF1 (0.627), YAH1 (0.628), RPF2 (0.628), HFI1 (0.628), PLB1 (0.628), MAM33 (0.628), YLR413W (0.628), PRP8 (0.628), ENO1 (0.629), RPC19 (0.629), YGL007C-A (0.629), YMR181C (0.629), URA7 (0.629), YGL108C (0.629), SRB7 (0.630), DAD1 (0.630), LYS4 (0.630), ATG18 (0.630), FMP45 (0.630), VAM3 (0.630), SSC1 (0.631), SNU56 (0.631), YHR045W (0.631), HTA2 (0.631), YJL213W (0.631), RPL20A (0.632), ALD4 (0.632), QCR10 (0.632), YGR287C (0.632), CBP4 (0.632), PCI8 (0.632), MCM4 (0.632), DEM1 (0.633), ATO3 (0.633), TPS2 (0.633), TAF1 (0.633), KRE6 (0.634), KGD2 (0.634), ARB1 (0.635), NMD5 (0.636), EFR3 (0.637), TRP4 (0.637), HLJ1 (0.638), ACE2 (0.638), LDB17 (0.638), ATG7 (0.639), OSH6 (0.639), AFT1 (0.639), CTF4 (0.639), YDR286C (0.639), AIM44 (0.639), YLR149C (0.640), MRPS9 (0.640), BET1 (0.641), YLF2 (0.641), BOI1 (0.642), BUD4 (0.642), CRF1 (0.642), MLP2 (0.643), ARX1 (0.643), RRP12 (0.644), NAT2 (0.645), PCL7 (0.645), ARP7 (0.645), SFH1 (0.645), STF1 (0.645), YML081W (0.646), MRP49 (0.646), FOL3 (0.646), SAC7 (0.646), PCS60 (0.647), TPA1 (0.647), SSS1 (0.647), ERO1 (0.647), NHP2 (0.648), AIM1 (0.648), AMD1 (0.648), VPS38 (0.648), COG3 (0.648), YMR244C-A (0.648), PYC1 (0.648), CCC1 (0.648), TAO3 (0.649), YDL233W (0.649), RPB10 (0.650), YBR242W (0.650), EDC2 (0.650), YVC1 (0.650), YDR266C (0.651), PMT3 (0.651), NIS1 (0.651), YDR128W (0.651), ATP15 (0.651), YML002W (0.652), ATG9 (0.652), IKS1 (0.652), SUR2 (0.652), MSD1 (0.652), SMC3 (0.653), SPC1 (0.653), MRPS35 (0.653), ZIP1 (0.653), YPR022C (0.654), YKL070W (0.654), RIM4 (0.654), YJL127C-B (0.654), ARV1 (0.655), YML6 (0.655), CYC3 (0.656), COX9 (0.656), RMD11 (0.656), SNU23 (0.657), PRS2 (0.657), YNL092W (0.657), TIF4632 (0.657), CBP2 (0.658), STP4 (0.658), YIR024C (0.658), SHE1 (0.658), EMG1 (0.659), NUP192 (0.659), THI7 (0.659), NGL1 (0.659), LDB19 (0.659), AFG2 (0.660), ROT1 (0.660), PIK1 (0.660), MRPL31 (0.660), RHO2 (0.660), MRPL49 (0.660), FMO1 (0.661), LRS4 (0.661), CHS3 (0.661), SEC8 (0.662), HXT5 (0.662), GRX3 (0.663), YHL042W (0.663), AAC3 (0.663), WSC4 (0.663), PIN2 (0.663), PUB1 (0.663), ERG28 (0.663), PSR1 (0.663), ISY1 (0.664), VPS70 (0.664), IRC19 (0.664), DNM1 (0.665), RPA190 (0.665), CCR4 (0.665), SSU72 (0.665), MRPL7 (0.665), TBF1 (0.666), YPR115W (0.666), SKP2 (0.666), CDC73 (0.666), RPL31B (0.666), MAK16 (0.666), ERB1 (0.666), DCG1 (0.666), RNT1 (0.667), RRP7 (0.667), GCD7 (0.667), RAD18 (0.667), OMS1 (0.668), YOL048C (0.668), PPT2 (0.668), SCS7 (0.668), YBL028C (0.668), RSC30 (0.668), TIM23 (0.668), PRI1 (0.669), REC102 (0.669), MCH5 (0.669), PST1 (0.669), CLB3 (0.669), QCR9 (0.670), MIR1 (0.670), SSP120 (0.670), MEF2 (0.672), RPL4B (0.672), YPR003C (0.672), RLI1 (0.672), SWC4 (0.672), MTM1 (0.673), SKY1 (0.674), TOM1 (0.674), YGL079W (0.674), ROM2 (0.674), TFA2 (0.674), AIM3 (0.674), SSQ1 (0.675), DUG2 (0.675), MSF1 (0.675), RPS0B (0.675), SCO2 (0.675), OLE1 (0.676), SBE2 (0.676), SAR1 (0.676), YJR116W (0.676), TEF1 (0.677), AIM13 (0.677), DFG5 (0.677), YLR012C (0.677), MCM3 (0.677), RPS7B (0.678), DFR1 (0.678), YBL039W-B (0.678), RML2 (0.679), RSM27 (0.679), MEC3 (0.679), YCG1 (0.679), RFX1 (0.680), RPL7B (0.680), CHS2 (0.681), PEX5 (0.681), TIF4631 (0.681), RPL18B (0.681), SMB1 (0.682), HUL4 (0.682), NPL6 (0.682), YOL107W (0.683), TRM1 (0.683), STE6 (0.683), ASK1 (0.684), RAD9 (0.684), YDL012C (0.684), RBG2 (0.684), SEC6 (0.684), YLR143W (0.685), XPT1 (0.685), HGH1 (0.685), YJL091C (0.685), PRS3 (0.686), NTC20 (0.686), YPR196W (0.686), MIC17 (0.686), POA1 (0.687), NPY1 (0.687), SNQ2 (0.687), ADE3 (0.687), APT2 (0.688), YGL082W (0.688),

YHB1 (0.689), MRPL16 (0.689), CSH1 (0.690), GUP1 (0.690), YJL171C (0.690), IDP3 (0.690), VHT1 (0.691), PUG1 (0.691), MPM1 (0.691), RRP40 (0.691), DPM1 (0.691), AFG3 (0.691), YBP2 (0.691), YPL183W-A (0.692), AIM31 (0.692), YCR015C (0.692), MSN4 (0.692), YPL038W-A (0.692), TSC11 (0.692), SEC59 (0.693), ADA2 (0.693), TPM2 (0.693), YHR175W-A (0.693), POM152 (0.694), YJR124C (0.694), RPL22B (0.694), COG7 (0.694), NEW1 (0.695), GSM1 (0.695), UGX2 (0.696), PRK1 (0.696), GPD2 (0.696), LDB16 (0.697), PAM16 (0.697), CMC1 (0.697), TOM6 (0.698), MBA1 (0.698), SWC5 (0.698), PRM10 (0.698), SAM1 (0.699), TRS31 (0.699), YFT2 (0.699), RGT1 (0.700), RPL10 (0.700), KRE33 (0.700), CDC1 (0.700), MRPL37 (0.700), KEX2 (0.701), VPS13 (0.701), ACN9 (0.701), RSC3 (0.701), PBS2 (0.702), EPS1 (0.702), GPI18 (0.702), ADH4 (0.702), YTP1 (0.702), YHM2 (0.703), ZIM17 (0.703), LYS5 (0.703), AIM22 (0.703), RGM1 (0.703), ECM10 (0.703), RDH54 (0.703), DED1 (0.704), CSE2 (0.704), POC4 (0.704), IPI1 (0.704), SOL4 (0.705), YKR075C (0.706), RSM10 (0.707), MAE1 (0.707), ATF2 (0.707), SHE4 (0.707), RSC1 (0.708), GNT1 (0.708), MSH4 (0.708), HSK3 (0.708), TRS20 (0.709), NBP35 (0.709), YBR090C (0.709), GLO1 (0.709), FYV4 (0.709), AEP2 (0.709), ARP4 (0.710), IES3 (0.710), HYP2 (0.710), DNF2 (0.711), GAA1 (0.711), RPA135 (0.711), PCL9 (0.711), SPT5 (0.711), EDE1 (0.711), ORC3 (0.711), YOR304C-A (0.711), YCL047C (0.711), YER085C (0.711), YOL014W (0.711), YPL071C (0.712), GTS1 (0.712), RFC2 (0.712), NDE2 (0.712), PET127 (0.713), PLM2 (0.713), YEA6 (0.713), RPN7 (0.713), MDL1 (0.713), TMA64 (0.714), NCE103 (0.714), MCM6 (0.714), MAS1 (0.715), TSR1 (0.715), BAS1 (0.715), IRC4 (0.716), TIM21 (0.716), HCH1 (0.716), APC5 (0.716), PMP1 (0.716), PUF6 (0.716), YER077C (0.716), SNC2 (0.716), MRP21 (0.716), YLR036C (0.717), YME2 (0.717), SEC12 (0.717), YJL062W-A (0.718), YMR031C (0.718), YAL065C (0.718), YNR047W (0.718), NHP10 (0.718), YOL083W (0.719), DLS1 (0.719), IGO2 (0.719), PAU17 (0.719), NCS2 (0.720), TAF7 (0.720), YDL186W (0.720), CMK2 (0.721), PUS7 (0.721), TIM9 (0.721), PMU1 (0.722), MNP1 (0.722), SEC16 (0.722), RIF1 (0.723), KAR3 (0.723), MDL2 (0.723), YLR356W (0.724), DCI1 (0.724), ASP1 (0.724), NET1 (0.725), YPL068C (0.725), MOT3 (0.725), NOC3 (0.725), MRP13 (0.725), GUT2 (0.725), ICY1 (0.725), NTO1 (0.726), HOS3 (0.726), TIM54 (0.726), COX4 (0.726), UBX2 (0.727), RVB2 (0.727), YBL059C-A (0.727), RBS1 (0.727), DCR2 (0.727), NEM1 (0.727), MNN9 (0.728), YNR036C (0.728), NOP15 (0.728), SEC61 (0.728), RTT106 (0.729), CCT7 (0.729), OSM1 (0.729), SAS5 (0.729), VPS29 (0.729), KTI12 (0.729), POL32 (0.729), PUS9 (0.730), SLF1 (0.730), MUQ1 (0.730), HSD1 (0.730), KAR4 (0.730), STN1 (0.731), BAT1 (0.731), THI71 (0.731), RPL27B (0.732), COX5A (0.732), AEP1 (0.732), LPP1 (0.732), PRM1 (0.732), YKL222C (0.732), TIP41 (0.733), RPL43B (0.733), YCR043C (0.733), STP1 (0.734), AIM8 (0.734), HXT9 (0.734), MRP7 (0.734), YPL216W (0.735), SRB6 (0.735), CTK2 (0.736), RIT1 (0.736), NST1 (0.737), RIB7 (0.737), MRPL38 (0.737), SRT1 (0.737), CBK1 (0.738), ARL3 (0.738), DRS2 (0.738), YLR307C-A (0.738), GPI8 (0.738), SHM2 (0.739), IPL1 (0.739), YPL041C (0.739), ARR1 (0.739), GCN20 (0.740), YPL039W (0.740), MNN1 (0.740), SLX9 (0.740), SEO1 (0.741), RMP1 (0.741), PSA1 (0.741), CHS6 (0.741), DAN1 (0.742), RPB5 (0.742), SIR3 (0.742), BCP1 (0.742), YLL058W (0.742), TNA1 (0.742), TRM13 (0.743), NOP1 (0.743), SLP1 (0.743), PEX31 (0.743), YIF1 (0.743), MSA2 (0.743), ADH3 (0.744), MNT1 (0.744), GIS1 (0.744), SLD2 (0.745), PIN4 (0.745), NVJ1 (0.745), HTS1 (0.745), RAD7 (0.745), YKU70 (0.745), NUF2 (0.745), YIL001W (0.745), ASK10 (0.745), YBL010C (0.745), ATP14 (0.746), CDC123 (0.746), MRPL51 (0.746), YGR127W (0.747), YLR392C (0.747), APC2 (0.747), DEP1 (0.747), APS3 (0.747), RCL1 (0.747), DCD1 (0.747), MIG3 (0.747), BSP1 (0.749), YLL014W (0.750), TOA1 (0.750), NBA1 (0.750), SLC1 (0.750), IGO1 (0.752), SDH3 (0.752), ACS2 (0.752), YOR093C (0.752), MPC54 (0.752), PFY1 (0.753), MIA40 (0.753), YDR034C-A (0.753), RDS3 (0.753), MSC3 (0.753), TIM50 (0.753), CSN12 (0.753), GIN4 (0.753), SMI1 (0.753), ADE17 (0.754), YGR016W (0.754), PCP1 (0.754), SBA1 (0.754), SRP102 (0.754), SUM1 (0.754), ICL1 (0.754), OAF3 (0.754), ZRT2 (0.754), NOP10 (0.755), BET2 (0.755), YVH1 (0.756), SPO75 (0.756), DNL4 (0.756), SGV1 (0.756), IES4 (0.757), SET4 (0.757), YCL001W-B (0.757), SQT1 (0.757), REI1 (0.757), MRPL9 (0.757), YPL066W (0.758), PET191 (0.758), TEM1 (0.758), UBX4 (0.759), DBF20 (0.760), MSB3 (0.760), NUP100 (0.760), RIC1 (0.760), CUE4 (0.761), IKI3 (0.761), YEL043W (0.761), MRPL11 (0.761), MPS1 (0.761), EAP1 (0.762), AVT2 (0.762), GND1 (0.762), TYW3 (0.762), POP7 (0.762), YDR186C (0.762), POR2 (0.762), LSM5 (0.763), MSH1 (0.763), TOM22 (0.763), YBR238C (0.764), MEP1 (0.764), ILV3 (0.764), YMD8 (0.764), YJR061W (0.764), OSH3 (0.764), TEF4 (0.765), SCO1 (0.765), TDH1 (0.765), RIM21 (0.766), YGL185C (0.766), NUS1 (0.766), KTR4 (0.767), RRP14 (0.767), TUB4 (0.767), LEU9 (0.767), YLR437C (0.768), AIM7 (0.768), ATX2 (0.768), AI3 (0.769), OST4 (0.769), TRA1 (0.769), MYO5 (0.769), DAL4 (0.769), IMG2 (0.769), LTV1 (0.769), YGR122W (0.770), CFT2 (0.770), YMR001C-A (0.771), CDC16 (0.771), YAL067W-A (0.771), YDR132C (0.771), YNL011C (0.772), TCP1 (0.772), CCT3 (0.772), MKK2 (0.772), RRI2 (0.772), ZEO1 (0.772), RUD3 (0.772), RTR2 (0.772), YJL070C (0.773), NUP116 (0.773), ENT1 (0.774), SLU7 (0.774), MSC2 (0.774), STV1 (0.774), NUP60 (0.775), AIM28 (0.776), YOL029C (0.776), SHE10 (0.776), RSB1 (0.776), SHO1 (0.776), DLD2 (0.777), RAX1 (0.777), LCP5 (0.777), ATG17 (0.777), PEX17 (0.778), GAL4 (0.778), MET32 (0.778), YOR223W (0.779), STE14 (0.779), DUG3 (0.780), SRX1 (0.780), UFO1 (0.780), YAT2 (0.780), NMD3 (0.780), PRP9 (0.780), MSN2 (0.781), PET123 (0.781), SWD2 (0.781), SOG2 (0.781), RRP17 (0.781), GPB2 (0.781), YOR293C-A (0.781), TEN1 (0.781), SOV1 (0.782), PFK27 (0.782), YIL127C (0.782), YNL024C-A (0.782), TMT1 (0.783), SEC39 (0.783), YER158C (0.783), ERP3 (0.783), YLR257W (0.783), PKH3 (0.783), YNL155W (0.783), PSO2 (0.783), NOP9 (0.783), GPG1 (0.784), GIP4 (0.784), RIB1 (0.784), CYS4 (0.784), ZRT3 (0.784), FMP21 (0.785), DAK2 (0.785), ISW1 (0.785), ACF4 (0.785), RTT10 (0.785), RTT109 (0.785), FMP10 (0.785), YAP6 (0.785), APM4 (0.785), ZAP1 (0.785), ARO9 (0.786), SCM4 (0.786), MIM1 (0.786), BRR6 (0.787), SRN2 (0.787), YOR287C (0.787), CLA4 (0.787), RNR3 (0.787), ALG8 (0.787), RAD50 (0.787), YBR239C (0.788), LDB7 (0.788), ATP17 (0.788), UGA2 (0.788), ENA2 (0.788), YLR408C (0.788), SAT4 (0.788), BOP3 (0.788), SDH4 (0.789), YNL045W (0.789), RPC40 (0.790), YNL134C (0.790), ARP5 (0.790), MAD2 (0.790), GRX6 (0.790), RSM18 (0.790), FES1 (0.791), SGF73 (0.791), ARH1 (0.791), MHT1 (0.791), CNS1 (0.791), BDH2 (0.792), YKL063C (0.792), GSH1 (0.792), BOS1 (0.792), THI72 (0.792), BSC1 (0.792), MED8 (0.793), RAD5 (0.793), EMP47 (0.793), SIS2 (0.793), TEA1 (0.793), YJL185C (0.793), RTF1 (0.793), CIN4 (0.794), DIC1 (0.794), EST2 (0.795), YNK1 (0.795), PUS2 (0.795), PEX13 (0.795), YNL217W (0.795), HOR7 (0.795), MGS1 (0.796), YHR009C (0.796), YML007C-A (0.796), JNM1 (0.796),

YHR078W (0.796), YMR155W (0.796), STB5 (0.796), MRP4 (0.796), STE3 (0.797), CKS1 (0.797), TAF13 (0.797), YNL176C (0.797), PCD1 (0.797), HSP26 (0.797), DAS1 (0.798), EDS1 (0.798), CTR3 (0.798), PXL1 (0.798), MRS111 (0.799), MET3 (0.799), BDP1 (0.799), CBF2 (0.799), DBP6 (0.799), FAR11 (0.799), ERI1 (0.800), MDM10 (0.801), RPM2 (0.801), COX13 (0.801), TOA2 (0.801), MYO2 (0.802), PRP5 (0.802), DRN1 (0.802), ZDS1 (0.802), IES2 (0.803), FAT1 (0.803), HIS1 (0.803), MET16 (0.803), LAS17 (0.803), ACA1 (0.803), HIS4 (0.803), PHO12 (0.804), EBP2 (0.804), MRPL6 (0.804), YLR271W (0.804), YBR085C-A (0.804), CRR1 (0.805), SWI13 (0.805), SWI4 (0.805), PYK2 (0.805), BUD7 (0.806), PEX12 (0.806), MDV1 (0.806), IDH2 (0.807), MRC1 (0.807), TIM1 (0.807), SPT15 (0.808), FBP26 (0.808), GUP2 (0.808), NPL4 (0.808), YCR007C (0.809), ABD1 (0.809), YNL193W (0.809), YLR426W (0.810), YSP2 (0.810), SSO2 (0.810), MRPL23 (0.810), YHR112C (0.810), VPS36 (0.811), MET7 (0.811), UTP18 (0.811), MTW1 (0.811), DYN1 (0.812), RNH1 (0.812), LST4 (0.812), TAF11 (0.812), RPL17A (0.812), SNA2 (0.812), YGL041W-A (0.813), KAR5 (0.813), YEH2 (0.814), YMR118C (0.814), CUE2 (0.814), URA8 (0.814), YMR034C (0.814), YLR152C (0.815), YKL088W (0.815), HEM13 (0.815), CAT5 (0.815), KRE1 (0.815), IBD2 (0.817), YOL098C (0.817), AIM18 (0.817), HMG1 (0.817), TRM7 (0.817), ADY2 (0.818), LCD1 (0.818), YGL194C-A (0.818), EFG1 (0.818), BRX1 (0.819), HIM1 (0.819), TCM62 (0.819), SET6 (0.819), FIN1 (0.819), CBF5 (0.820), ASI1 (0.820), DUT1 (0.820), SEC65 (0.820), YPL067C (0.820), RRP43 (0.820), ASC1 (0.821), ERG3 (0.821), RTA1 (0.821), NFU1 (0.821), JIP4 (0.821), YLR419W (0.822), YJR011C (0.822), YJL045W (0.822), ARC18 (0.822), YBR287W (0.822), CAP2 (0.822), NEO1 (0.823), TOM5 (0.823), PEP5 (0.823), PCC1 (0.823), PXR1 (0.823), ALG1 (0.823), YLR301W (0.824), ARG1 (0.824), RFC4 (0.824), AIM42 (0.824), PPA2 (0.824), DAP1 (0.824), RTS1 (0.825), EDC3 (0.825), IRC23 (0.825), YBR220C (0.825), GPI14 (0.825), IML1 (0.825), NIP7 (0.826), YPT32 (0.826), MSS18 (0.826), CHO1 (0.826), CST26 (0.826), MOH1 (0.826), PLP1 (0.827), MKC7 (0.827), XYL2 (0.827), YMR295C (0.828), YLR003C (0.828), YIL096C (0.828), MOT2 (0.828), RLP7 (0.828), YSC84 (0.828), NDL1 (0.828), PFK1 (0.828), MRD11 (0.829), SAC6 (0.829), REX2 (0.829), RPA34 (0.829), AHC2 (0.829), APC1 (0.829), YDR222W (0.829), VHR1 (0.829), SUS1 (0.829), UTH1 (0.829), IRC8 (0.830), SNO1 (0.830), APT1 (0.830), YOR352W (0.830), YMR258C (0.831), MRH1 (0.831), HRP1 (0.831), SRP21 (0.831), MRPL22 (0.831), SEC9 (0.831), KAR2 (0.832), YGR054W (0.832), HOF1 (0.832), YDC1 (0.832), YGR207C (0.833), WSC2 (0.833), SRC1 (0.833), YAR023C (0.834), HAM1 (0.834), PER1 (0.834), YKL047W (0.834), FLC3 (0.834), TRM10 (0.834), PAU15 (0.834), RFA1 (0.835), AI2 (0.835), MPP10 (0.835), ELC1 (0.835), PHB1 (0.836), OST1 (0.836), LSB1 (0.836), OKP1 (0.836), THI22 (0.836), MRPS1 (0.836), COX20 (0.837), FCF1 (0.837), PHO80 (0.837), FIT1 (0.837), YPL056C (0.838), KIN4 (0.838), GCD1 (0.839), FRT1 (0.839), ACS1 (0.839), LGE1 (0.839), YJL136W-A (0.840), MLC2 (0.840), SMF1 (0.840), ISW2 (0.840), HIS6 (0.841), CTR2 (0.841), GCV2 (0.841), GAL83 (0.841), IMP3 (0.842), GRS1 (0.842), MRS5 (0.842), NCE101 (0.843), BUD17 (0.843), MKS1 (0.843), SYF1 (0.843), ACH1 (0.844), ARN1 (0.844), RCN2 (0.844), UBC12 (0.844), YER079W (0.845), YHL044W (0.845), THI21 (0.845), PML1 (0.845), IRC10 (0.846), BMS1 (0.846), SSA1 (0.846), DDI2 (0.846), RPC11 (0.846), YDR115W (0.847), DDC1 (0.847), IRC21 (0.847), DUR3 (0.847), PET100 (0.847), SKI8 (0.847), QRI5 (0.847), QDR1 (0.847), UBC11 (0.848), MRT4 (0.848), POL3 (0.848), MFB1 (0.848), TCO89 (0.848), YDR370C (0.848), OYE2 (0.848), MDM31 (0.849), SLG1 (0.849), YOR062C (0.849), DNF1 (0.850), MEH1 (0.850), AIR2 (0.850), MSS116 (0.850), ACB1 (0.850), ADE12 (0.851), ELO1 (0.851), VTA1 (0.851), MRPL27 (0.852), YFL054C (0.852), SPC34 (0.852), RGS2 (0.853), DRS1 (0.853), GTR1 (0.853), COX8 (0.853), KEL2 (0.854), NUP82 (0.854), GIR2 (0.855), FKH2 (0.855), CLG1 (0.855), PEX6 (0.855), HO (0.855), YHR003C (0.855), NUP84 (0.856), RRB1 (0.856), PSY2 (0.856), BSD2 (0.856), ESBP6 (0.856), MED7 (0.857), RSN1 (0.857), YKE2 (0.857), YHL012W (0.857), SHE2 (0.858), RPL2A (0.858), DUO1 (0.858), DST1 (0.858), PET9 (0.858), RSA3 (0.858), GLN4 (0.858), YKR015C (0.858), YJR141W (0.858), RIM20 (0.858), BCK2 (0.859), SPC42 (0.859), TRF5 (0.859), FAA2 (0.859), TRS130 (0.859), GUA1 (0.860), HSL7 (0.860), PDE2 (0.860), RRP8 (0.860), XRS2 (0.860), SPE1 (0.860), RFT1 (0.860), VPS20 (0.860), SEC20 (0.860), PAD1 (0.861), GGC1 (0.861), ORC1 (0.861), HMG2 (0.861), STE2 (0.861), LSM3 (0.861), ICS2 (0.861), TRM2 (0.861), CDC3 (0.862), HEM2 (0.862), SIN4 (0.862), VIK1 (0.862), HIS7 (0.863), RAD54 (0.863), IQG1 (0.863), DFG10 (0.863), TIP1 (0.864), BRR2 (0.864), GRX2 (0.864), HTZ77 (0.864), BCH2 (0.864), NRG2 (0.865), RSC58 (0.865), TMA16 (0.865), RAD59 (0.866), URM1 (0.866), ADY4 (0.866), AAP1 (0.866), ABP1 (0.866), YGR066C (0.867), BRE5 (0.868), BFR2 (0.868), LSM1 (0.868), CHD1 (0.868), VTI1 (0.868), AIM1 (0.868), RFA2 (0.869), SUR4 (0.869), YOR228C (0.869), DLD3 (0.870), ISN1 (0.870), CYC2 (0.870), SNF5 (0.870), YMR124W (0.870), GIP2 (0.870), SVL3 (0.870), SEC13 (0.870), YEL047C (0.870), BEM1 (0.871), RPL16A (0.871), SPR3 (0.873), ATP4 (0.873), WAR1 (0.873), ITR1 (0.873), FAR3 (0.873), YOR021C (0.874), YBR028C (0.874), NOP58 (0.875), RPN13 (0.877), YNL035C (0.878), YJL049W (0.878), YER137C (0.878), NOC4 (0.879), ALG7 (0.879), MET22 (0.880), SIL1 (0.880), TYS1 (0.880), GLK1 (0.880), YDR341C (0.880), YKR045C (0.880), RAD23 (0.880), BIK1 (0.881), RPL27A (0.881), YOR152C (0.881), KNS1 (0.881), YHR182W (0.881), EEB1 (0.881), RKM1 (0.881), SNG1 (0.882), YIL067C (0.882), VPS66 (0.883), TCB1 (0.883), ADE4 (0.883), YNL034W (0.883), HSP78 (0.883), HEM15 (0.883), PKC1 (0.883), SPP2 (0.883), MF(ALPHA)1 (0.883), ARP6 (0.884), NCS6 (0.884), RTS3 (0.884), SPE4 (0.884), YPL199C (0.884), DAL81 (0.884), SAC1 (0.884), YOL131W (0.884), YHL026C (0.884), REC107 (0.884), YGR174W-A (0.885), SGE1 (0.885), NCB2 (0.885), YNL320W (0.885), CDC20 (0.885), CSG2 (0.886), ECM5 (0.886), NOC2 (0.886), IES1 (0.886), SMK1 (0.887), PHO86 (0.887), YHR202W (0.887), CIN1 (0.887), PFS1 (0.887), MCM21 (0.887), ROT2 (0.888), GLC7 (0.888), HRT1 (0.888), YDR018C (0.888), APM1 (0.888), DPH2 (0.888), CDH1 (0.889), HNT3 (0.889), ATG4 (0.889), FRE3 (0.889), ATP2 (0.889), YMR148W (0.890), YAT1 (0.890), ERG11 (0.890), PGI1 (0.890), FKH1 (0.890), MET30 (0.890), YGL140C (0.890), ARC35 (0.890), SNX41 (0.890), SAS2 (0.890), YHR007C-A (0.890), YML083C (0.891), ABF1 (0.891), YLR104W (0.892), TOS1 (0.892), MF(ALPHA)2 (0.892), FRM2 (0.892), OPY1 (0.892), MMF1 (0.893), DIG1 (0.893), PMI40 (0.894), YIL092W (0.894), ASI3 (0.895), FIR1 (0.895), ERG26 (0.895), YMR090W (0.895), YGL085W (0.896), CDC24 (0.896), YPL113C (0.896), YPR010C-A (0.896), BIR1 (0.896), AAH1 (0.896), EPT1 (0.896), MSW1 (0.896), NOP4 (0.897), CBT1 (0.897), COX18 (0.897), COX16 (0.898), RRD1 (0.898), BEM4 (0.898), GEA2 (0.898), FOB1 (0.898), ERG7 (0.898), YLR042C (0.899), SEC17 (0.899), YPR063C (0.899), PUT4 (0.900), MSI1 (0.900), RPA43 (0.900), SPE2 (0.900), DAL1 (0.901), RPC25 (0.901), BRO1 (0.901), AXL1 (0.901), EAF7 (0.901), RCR1 (0.901), YDR338C (0.901), RGA1 (0.902), LOT5 (0.902), YIH1 (0.902), RNA1 (0.902), SKM1 (0.903), PUT2 (0.903), HEM4 (0.904), AIM37 (0.904), PHO13 (0.904), YGR015C (0.904), AKR2 (0.904), YKL050C (0.904), TCB2 (0.904), HAC1 (0.904), ADE1 (0.905), RTN1 (0.905), RPL8B (0.905), MDM36 (0.905), JHD1 (0.905), CCL1 (0.905), YDR282C (0.906), PRE10 (0.906), PEX14 (0.906), OMA1 (0.906), YNR034W-A (0.906), NBP2 (0.906), SPT20 (0.906), PRP2 (0.907), YGL041C-B (0.907), YBR255W (0.907), YOR246C (0.907), YFL012W (0.907), YLR412W (0.908), DUR1,2 (0.908), RPS4A (0.908), YAL037W (0.908), ICT1 (0.908), CTR86 (0.909), RPN10 (0.909), RME1 (0.909), MSB4 (0.909), SAM35 (0.909), MAG2 (0.909), YOL092W (0.909), PPZ1 (0.909), YGL138C (0.910), YHR097C (0.910), SSZ1 (0.910), SIS1 (0.910), CTP1 (0.910), TAF5 (0.910), PDC1 (0.910), YPL150W (0.910), GCD10 (0.911), ENP1 (0.911), TOM40 (0.911), ERG6 (0.912), ECM4 (0.912), RLF2 (0.913), RKI1 (0.913), SAM3 (0.913), SEC62 (0.913), CRC1 (0.914), UME1 (0.914), TUS1 (0.915), YNL046W (0.916), VTC1 (0.916), TEL2 (0.916), YEN1 (0.916), PEX30 (0.917), GSG1 (0.917), NTE1 (0.918), RBG1 (0.918), TIM8 (0.918), YNG1 (0.918), PMT5 (0.918), PRP16 (0.918), SPT6 (0.918), NIP100 (0.919), THS1 (0.919), HMRA1 (0.920), STE20 (0.920), AIM10 (0.921), YGL242C (0.921), GTR2 (0.921), YOL157C (0.921), LOT6 (0.921), KEX1 (0.921), MET14 (0.922), UBA2 (0.922), NUT1 (0.922), SPO21 (0.923), PAC10 (0.923), YND1 (0.923), DSE3 (0.923), YJR149W (0.923), YOR378W (0.923), GSY2 (0.923), YBR063C (0.924), SRV2 (0.924), YCK1 (0.924), YKL091C (0.925), FMS1 (0.925), UTP23 (0.925), YCR090C (0.925), SFT2 (0.925), BNI5 (0.925), SNX3 (0.925), FSH2 (0.926), RGD2 (0.926), SST2 (0.926), UNG1 (0.927), YLR164W (0.927), RPS26B (0.927), TRE1 (0.927), MSH5 (0.927), MYO3 (0.928), YGL039W (0.928), SUP35 (0.929), AMA1 (0.929), ATP19 (0.929), YGL036W (0.930), PTK2 (0.930), PBP2 (0.930), TRM112 (0.931), SMC1 (0.931), NPR1 (0.931), PFK2 (0.932), PDE1 (0.932), RRI1 (0.932), FRE2 (0.932), YOR118W (0.933), FRE1 (0.933), ECM38 (0.933), ALD3 (0.933), STT3 (0.934), VMR1 (0.934), RPC82 (0.934), URK1 (0.934), ATX1 (0.934), REG1 (0.935), PNT1 (0.935), YMR279C (0.935), RSC8 (0.935), YJR111C (0.935), YLR253W (0.935), FSH1 (0.935), YDR336W (0.935), ERD1 (0.935), VPS41 (0.936), AYT1 (0.936), VRG4 (0.936), YPL009C (0.936), VID22 (0.936), YDR514C (0.936), APC11 (0.937), VPS74 (0.937), KRE1 (0.937), RRP6 (0.938), FOX2 (0.938), ASM4 (0.938), MED11 (0.938), TWF1 (0.939), GRX5 (0.939), MYO1 (0.939), YPL107W (0.939), PET54 (0.939), YLR064W (0.940), SPC2 (0.940), APP1 (0.940), DBP5 (0.940), BPH1 (0.941), YKL151C (0.941), NAF1 (0.941), YKL027W (0.941), ARO3 (0.941), UBX6 (0.942), TIM18 (0.942), BNI4 (0.942), SPC98 (0.943), PZF1 (0.943), PIC2 (0.943), UTP8 (0.943), YBR235W (0.943), SMC6 (0.943), RLR1 (0.943), DBF4 (0.943), RPB11 (0.944), SHE3 (0.944), SFB3 (0.944), SYT1 (0.944), STU2 (0.945), NGL2 (0.945), GDS1 (0.945), NOP2 (0.945), SVS1 (0.945), PRY2 (0.946), GDA1 (0.946), BCY1 (0.947), PUS1 (0.947), COX7 (0.947), MRPL15 (0.947), RER1 (0.948), SLH1 (0.948), RPB3 (0.948), TIF11 (0.948), YDL173W (0.948), YML053C (0.948), PEX4 (0.949), MIG1 (0.949), CLU1 (0.950), ECM32 (0.950), FCY1 (0.950), HSP32 (0.950), MAL12 (0.950), JLP2 (0.950), DAT1 (0.950), RMR1 (0.950), KTR6 (0.950), OST2 (0.951), NOP12 (0.951), IRC3 (0.951), OPT2 (0.952), YBL054W (0.952), PDX1 (0.952), AMS1 (0.952), YBR204C (0.953), SLM2 (0.953), VPS64 (0.953), PTH2 (0.953), MRP1 (0.953), TIF5 (0.954), AAT2 (0.954), CPR3 (0.954), AVT6 (0.954), CLF1 (0.954), MDM38 (0.954), COX12 (0.954), ESS1 (0.954), RPG1 (0.955), SNF11 (0.955), ERV15 (0.955), YPR078C (0.955), RHO3 (0.956), SUE1 (0.956), CLN2 (0.956), YFL040W (0.956), YLR040C (0.956), RLA1 (0.957), YMR272W-B (0.957), MND2 (0.957), EHD3 (0.957), IMP4 (0.957), PAH1 (0.958), HMO1 (0.958), RPL26A (0.958), PIR3 (0.959), MNN5 (0.959), FCY22 (0.959), SMD3 (0.959), YER186C (0.959), QDR2 (0.959), MHP1 (0.960), CRH1 (0.960), LSB3 (0.960), RMD1 (0.960), SDA1 (0.960), AXL2 (0.961), NOP16 (0.961), YCL058W-A (0.962), ORC6 (0.962), PRR2 (0.963), STH1 (0.963), CCA1 (0.963), FUS1 (0.963), MRS6 (0.963), YBP1 (0.963), RPL12A (0.963), UTR4 (0.964), MTF2 (0.964), MAK31 (0.964), BOP2 (0.964), UIP5 (0.964), SSL1 (0.965), INO4 (0.965), RPT3 (0.965), YBR072C-A (0.966), YHR159W (0.966), ITR2 (0.966), PUF3 (0.967), ADD66 (0.967), GCS1 (0.968), LYS2 (0.968), MTR2 (0.968), TRP1 (0.968), HXT11 (0.968), ALG1 (0.969), SPS18 (0.969), YOR111W (0.969), STI1 (0.969), SSD1 (0.969), CRN1 (0.969), CSN9 (0.970), RSM22 (0.970), YIL152W (0.970), TOF1 (0.970), HOM2 (0.970), MOB1 (0.971), RAD24 (0.971), IRC25 (0.971), RSM23 (0.971), YLR049C (0.971), YBL055C (0.971), SPP41 (0.972), YMR310C (0.972), YHC1 (0.972), YNL040W (0.973), AIM41 (0.973), APL5 (0.973), ILV2 (0.974), YIR035C (0.974), REC8 (0.974), MSS51 (0.974), GAP1 (0.975), EMP70 (0.975), HAL1 (0.975), CDC21 (0.975), VPS75 (0.975), YER066W (0.975), MCM7 (0.975), CHZ1 (0.976), YKL121W (0.977), MMS2 (0.977), BUL2 (0.977), SEC1 (0.977), BEM2 (0.977), YKR018C (0.978), NUP2 (0.978), VPS73 (0.978), YIL024C (0.978), YPL225W (0.979), FEN1 (0.979), YSR3 (0.979), CST9 (0.979), YLR241W (0.979), MAK10 (0.980), CUP2 (0.980), CCP1 (0.980), ERV14 (0.980), YJU3 (0.980), RAP1 (0.980), IMP1 (0.980), COA1 (0.981), TFA1 (0.981), FAF1 (0.981), ATP5 (0.981), ARG3 (0.982), RVB1 (0.982), RPA49 (0.982), NSE4 (0.982), YKT6 (0.982), RRN9 (0.983), APM2 (0.983), GAT3 (0.983), SPN1 (0.983), CKB1 (0.983), DTD1 (0.983), TPO2 (0.983), PRP45 (0.984), DEG1 (0.984), PTC5 (0.984), TSC10 (0.984), DPB11 (0.984), YKR005C (0.985), RIM15 (0.985), PNO1 (0.985), COX15 (0.985), VPS4 (0.985), PKH12 (0.986), MTR4 (0.986), YLR053C (0.986), LEU4 (0.986), YPK1 (0.987), PDX3 (0.987), TIF2 (0.988), YDL180W (0.988), FYV8 (0.988), BUD13 (0.988), YBR139W (0.988), TPK2 (0.988), SSH1 (0.989), YGR102C (0.989), YDR348C (0.989), RPL28 (0.990), QCR2 (0.990), YAR1 (0.990), SCP1 (0.990), TIP20 (0.990), UBC7 (0.990), SEC11 (0.991), RPN1 (0.993), TGL5 (0.993), HSP60 (0.993), RPL42B (0.994), PRS1 (0.994), YKL018C-A (0.994), TFC6 (0.994), RNH201 (0.994), URA1 (0.995), ALG9 (0.995), MSG5 (0.995), AKR1 (0.995), MNN11 (0.996), OCA1 (0.996), YGP1 (0.997), PPX1 (0.997), TSC3 (0.997), PSF3 (0.998), YAF9 (0.998), YMR175W-A (0.998), LHP1 (0.998), YMR252C (0.999), SLK19 (0.999), YJR107W (0.999), PMC1 (0.999), HCR1 (0.999), SKG1 (0.999), PCT1 (0.999), LPE10 (1.000), PGK1 (1.000), HAS1 (1.000), SEC23 (1.000), GPI13 (1.000), YDR476C (1.001), YLR073C (1.001), SUI3 (1.001), RCO1 (1.001), LYS20 (1.002), NUP170 (1.002), JJJ1 (1.002), RAD27 (1.002), YLL032C (1.002), GDB1 (1.002), GON7 (1.002), PRS4 (1.002), GAL7 (1.002), RAI1 (1.003), MLC1 (1.003), SWD3 (1.003), REV1 (1.003), FET3 (1.003), DAL7 (1.004), DAL80 (1.004), COQ5 (1.004), TRK2 (1.005), PRP31 (1.005), SYP1 (1.005), RPL36A (1.005), OSH7 (1.005), RPL12B (1.005), UME6 (1.006), LCB4 (1.006), IZH2 (1.006), MDH3 (1.006), OGG1 (1.006), RPL1A (1.007),

YGL157W (1.007), HUB1 (1.007), TGL4 (1.007), CAF16 (1.007), NPP2 (1.007), URE2 (1.007), GMH1 (1.007), AVT3 (1.007), FAA1 (1.007), BET5 (1.008), YPR091C (1.008), PET8 (1.009), STB1 (1.009), ERG13 (1.009), UTP10 (1.009), MMP1 (1.010), YTH1 (1.010), EMI2 (1.010), MES1 (1.010), PDS1 (1.010), NPL3 (1.010), PRD1 (1.010), YGR235C (1.011), PHO8 (1.011), PEX22 (1.011), LAP4 (1.011), LCB2 (1.011), YLR326W (1.011), EMP46 (1.011), MRPS17 (1.011), AIM17 (1.011), NUP57 (1.011), YER134C (1.012), YCR076C (1.012), YBL104C (1.012), SSM4 (1.012), YMR187C (1.012), YEF3 (1.012), PIG1 (1.012), ECM16 (1.012), SPO20 (1.013), ILS1 (1.013), MFT1 (1.014), RRP46 (1.014), RPS23A (1.015), ECM40 (1.015), STT4 (1.015), SOK2 (1.016), RPL9A (1.016), SIR1 (1.017), SES1 (1.017), CDC26 (1.018), SSU1 (1.018), SAS3 (1.019), YKL187C (1.019), ARG8 (1.019), RPL16B (1.019), LCB3 (1.020), TVP18 (1.020), APJ1 (1.021), GDH1 (1.021), IPT1 (1.021), ATP7 (1.021), YAR029W (1.021), PIS1 (1.022), TRS23 (1.022), SEC72 (1.022), CHA4 (1.022), DMA2 (1.023), RUP2 (1.023), DCP2 (1.024), KAP114 (1.024), YTA12 (1.024), PHO87 (1.024), TPS3 (1.024), RPS10B (1.024), LIP2 (1.025), PAF1 (1.026), MEU1 (1.026), ALK1 (1.026), RIM11 (1.026), SLA2 (1.026), RSC6 (1.027), CBC2 (1.027), YBR016W (1.027), FIS1 (1.027), RAS1 (1.027), SFA1 (1.028), YOL057W (1.028), YOR292C (1.028), MCD4 (1.028), CSM1 (1.028), MAK32 (1.028), DAP2 (1.028), EXG2 (1.028), DID2 (1.029), HXT15 (1.029), DIE2 (1.029), VAC8 (1.030), YBR138C (1.030), NTH2 (1.030), YCR099C (1.031), RTT107 (1.031), MAF1 (1.031), ERG9 (1.031), PPN1 (1.031), SRB4 (1.032), CDC55 (1.032), YDR248C (1.032), YDR003W-A (1.032), GLC8 (1.033), PDR11 (1.033), SPB4 (1.033), YSC83 (1.034), YLR072W (1.034), MCH1 (1.035), RPH1 (1.035), DAD3 (1.35), SPT3 (1.036), YFR057W (1.036), IDI1 (1.036), TDH3 (1.036), OCA2 (1.036), PEX18 (1.036), FUN30 (1.037), RRP3 (1.037), ABC1 (1.037), IWR1 (1.037), YJR088C (1.037), PTR2 (1.038), SEC26 (1.039), AQY1 (1.040), ECM21 (1.040), BUD27 (1.040), PFK26 (1.041), YDR352W (1.041), CUP5 (1.041), ATG3 (1.042), AGE2 (1.042), RIX7 (1.042), HSE1 (1.042), AGA1 (1.043), GRX7 (1.043), AGE1 (1.043), TUB2 (1.043), YHR122W (1.043), RIB4 (1.043), VRP1 (1.043), LAS1 (1.043), OCA4 (1.044), YGR277C (1.044), BUB3 (1.044), LPD1 (1.044), EMI5 (1.044), CTF18 (1.044), YOL073C (1.044), SIT1 (1.045), LYS12 (1.045), FTR1 (1.045), TUL1 (1.045), EKI1 (1.046), LEO1 (1.046), GAL1 (1.046), VAC17 (1.046), REV7 (1.046), PMP2 (1.046), TIM13 (1.047), YMR158C-A (1.047), TLG2 (1.047), YGR106C (1.047), YML079W (1.048), YFR045W (1.048), YBR056W (1.048), YLR065C (1.048), HSH49 (1.048), MTF1 (1.049), LAG1 (1.049), ATE1 (1.049), RFM1 (1.049), RNH203 (1.050), DBP8 (1.050), TPS1 (1.050), YGR205W (1.050), PIM1 (1.050), RAD16 (1.050), SPI1 (1.051), SPP1 (1.05), CHS5 (1.051), MNR2 (1.051), PIL1 (1.052), SMT3 (1.052), PEF1 (1.052), SKO1 (1.052), CDC45 (1.052), SUC2 (1.052), RXT3 (1.052), RPN9 (1.053), SPO12 (1.053), RPE1 (1.053), SEC15 (1.053), HMI1 (1.054), RRP4 (1.054), ERG25 (1.054), MUC1 (1.055), TPT1 (1.055), OPY2 (1.055), OSH2 (1.055), VNX1 (1.055), PXA2 (1.055), YSW1 (1.057), SRP14 (1.057), OST5 (1.058), CDC4 (1.058), RPL38 (1.058), YDR520C (1.058), ARO2 (1.059), DOM34 (1.059), SWE1 (1.059), GTO1 (1.059), RPL37B (1.060), RAD3 (1.060), MEP2 (1.060), PKH1 (1.061), ARL1 (1.061), ROX3 (1.061), SFT1 (1.061), SIM1 (1.062), CIA1 (1.062), COX5B (1.062), MNE1 (1.062), BRE4 (1.062), UBX5 (1.063), DSL1 (1.063), ACK1 (1.063), YHR140W (1.063), ARG82 (1.063), SCS22 (1.063), ADH7 (1.063), HSC82 (1.063), ARO80 (1.063), HED1 (1.063), MAD1 (1.064), TRP5 (1.064), RPN3 (1.065), SEN54 (1.065), PTM1 (1.065), ATG23 (1.065), GIM4 (1.065), YDR089W (1.066), MON2 (1.066), PEX32 (1.066), PUS6 (1.066), YJL038C (1.066), SGN1 (1.066), PRP39 (1.066), YNR070W (1.067), SPO71 (1.067), SAE3 (1.067), MGR2 (1.068), INP53 (1.068), TUP1 (1.068), SHP1 (1.068), INO80 (1.068), CDC23 (1.068), GAB1 (1.068), PTC1 (1.069), SKI2 (1.069), DNF3 (1.069), YOR389W (1.070), AIM14 (1.071), ATP16 (1.071), VPS51 (1.071), NSE33 (1.071), UTP21 (1.071), MDE1 (1.072), ALY1 (1.072), MNI2 (1.072), BNS1 (1.072), ILV1 (1.073), TPO5 (1.073), THI21 (1.074), PEX2 (1.074), YMR194C-B (1.074), SFI1 (1.074), ESF1 (1.074), YJL068C (1.075), GPI1 (1.075), ISC10 (1.075), RPL13A (1.076), YDR391C (1.076), TVP15 (1.076), YNL108C (1.076), YDR051C (1.076), SRP101 (1.076), SAS4 (1.076), ARG4 (1.077), PAN5 (1.077), PTK1 (1.077), THI6 (1.077), YOR019W (1.077), GCN5 (1.077), DID4 (1.078), TRM11 (1.078), ABZ2 (1.079), YHR210C (11.079), RPL34B (1.079), POL31 (1.079), RPS4B (1.080), COG4 (1.080), RPS16B (1.080), LCB1 (1.080), ARA2 (1.080), VPH2 (1.081), YBT1 (1.081), HSM3 (1.081), YBL036C (1.081), DAL2 (1.081), VTC4 (1.081), RPS21B (1.081), YOR131C (1.081), ADE13 (1.081), YKL215C (1.081), LSM2 (1.082), FAR10 (1.082), MCH2 (1.082), IMD3 (1.082), USV1 (1.082), YAR035C-A (1.082), RAM1 (1.083), SNM1 (1.083), PNG1 (1.083), RFC3 (1.084), ARP2 (1.084), TOR2 (1.084), ISC1 (1.084), CTS1 (1.085), YSH1 (1.085), AIM4 (1.085), BIT2 (1.085), GVP36 (1.086), SED1 (1.086), SPG4 (1.086), KGD1 (1.086), NMT1 (1.086), SSY1 (1.086), LSC1 (1.086), NRK1 (1.086), YLR177W (1.086), SCD6 (1.087), YDR210W (1.087), LRP1 (1.087), URA2 (1.087), PEX21 (1.088), MCM5 (1.088), SSE2 (1.088), PYC2 (1.088), GFD1 (1.088), YNL247W (1.088), RAD17 (1.089), BRE2 (1.089), CDC48 (1.089), ESS1 (1.089), RPL23A (1.089), PTR3 (1.089), ATP20 (1.089), PAU3 (1.089), CPR8 (1.090), ARO7 (1.090), YRO2 (1.090), HRB1 (1.091), HSP42 (1.091), RPS18B (1.091), FMP23 (1.091), ADE6 (1.091), DER1 (1.092), PPE1 (1.092), CUE3 (1.092), ACF2 (1.092), QNS1 (1.092), IOC3 (1.093), NAM9 (1.093), YDL144C (1.094), ENB1 (1.094), KTR3 (1.095), PSD1 (1.095), HOS1 (1.096), FCY21 (1.096), CAJ1 (1.096), ERP4 (1.096), LRC2 (1.097), TFB5 (1.098), PRM3 (1.098), CPR7 (1.098), MET17 (1.098), SAH1 (1.098), YGR149W (1.099), GAC1 (1.099), TFC7 (1.099), RHO5 (1.099), TIF34 (1.099), YPT1 (1.099), MSS4 (1.100), FLC2 (1.100), PRE2 (1.100), YCL068C (1.101), GAL80 (1.101), SPG3 (1.101), URB1 (1.101), MGE1 (1.102), STR2 (1.102), RPL34A (1.102), ULP3 (1.102), NPP1 (1.102), FMP24 (1.102), AIM23 (1.102), BIO3 (1.103), PRO2 (1.103), TMN3 (1.103), EST3 (1.103), PHO5 (1.104), YSP1 (1.104), TUF1 (1.104), ORM1 (1.104), OLA1 (1.105), NMA1 (1.105), YMR209C (1.105), SEC27 (1.105), SLA1 (1.105), YCL012C (1.105), SLM1 (1.106), NOP53 (1.106), YLR162W-A (1.106), PAU13 (1.106), ALA1 (1.106), YDL133W (1.107), CDC37 (1.107), HCA4 (1.107), PRB1 (1.107), GSY1 (1.107), YIP3 (1.108), TMA46 (1.108), RPP1 (1.109), PRP3 (1.109), YBL107C (1.109), UBP14 (1.110), VAM10 (1.110), CBS1 (1.110), YOR238W (1.110), OMI4 (1.110), SEC66 (1.111), CST6 (1.111), SSF2 (1.111), FRS1 (1.111), NCA2 (1.112), HMX1 (1.112), NOP13 (1.112), RNR2 (1.114), QDR3 (1.114), OTU2 (1.114), SPO13 (1.114), HUL5 (1.115), SED4 (1.115), RRP42 (1.115), CDC33 (1.116), MLP1 (1.116), GOR1 (1.116), YDL119C (1.116), YJR039W (1.116), HNT2 (1.116), SCM3 (1.116), MET12 (1.117), VPS33 (1.117), MGR1 (1.117), PCM1 (1.117), YUH1 (1.117), CDS1 (1.117), SAP185 (1.118), CRT10 (1.118), SNF1 (1.118), CMP2 (1.118), APL6 (1.118),

IDH1 (1.119), YDR428C (1.119), SEC21 (1.119), APL4 (1.119), PAP2 (1.119), GPI17 (1.119), SCH9 (1.120), HOP1 (1.120), MUK1 (1.120), RPS25B (1.120), NOB1 (1.120), STE23 (1.121), YLR243W (1.122), GRE3 (1.122), CCS1 (1.122), VEL1 (1.122), ENO2 (1.123), COG6 (1.123), RPL11B (1.123), HNT1 (1.123), LEM3 (1.123), GPI15 (1.124), FSF1 (1.124), SEC3 (1.124), SOL2 (1.124), PRS5 (1.124), VPS71 (1.124), ACC1 (1.124), ADE8 (1.124), GNA1 (1.124), YNR024W (1.126), RSF2 (1.126), MAL32 (1.126), PAU21 (1.126), SPS19 (1.127), YIL002W-A (1.127), SPF1 (1.127), CCT8 (1.127), PRM2 (1.128), PDH1 (1.128), RBL2 (1.128), PIF1 (1.128), VBA1 (1.128), AFG1 (1.129), DIN7 (1.129), IZH1 (1.129), YPL105C (1.130), YCR051W (1.130), WWM1 (1.130), SIP3 (1.130), SYS1 (1.131), HPC2 (1.131), RPL40A (1.131), NCR1 (1.131), YER078C (1.131), CAP1 (1.131), GCN4 (1.131), AIM38 (1.131), PTC7 (1.132), FUN14 (1.132), COS8 (1.132), MCH4 (1.132), PRP24 (1.132), CWC2 (1.132), CLC1 (1.132), SIR4 (1.133), FUS3 (1.133), YLR057W (1.133), ZRG7 (1.133), YSA1 (1.133), PTC3 (1.134), UBP6 (1.134), KAP122 (1.134), EFT2 (1.134), URA3 (1.135), ALG2 (1.135), POL5 (1.135), RPL1B (1.136), LIP1 (1.136), TMA20 (1.137), NAS6 (1.137), IRC5 (1.137), KIN3 (1.137), YPL033C (1.137), AVT4 (1.137), YGR266W (1.137), CTI6 (1.138), YNL050C (1.138), SDP1 (1.139), ESF2 (1.139), NFS1 (1.140), YER078W-A (1.140), IZH4 (1.140), CWC22 (1.140), YGR110W (1.140), DYN2 (1.140), SNF4 (1.141), YMR178W (1.141), NSE5 (1.142), RPL40B (1.142), TKL2 (1.142), HIR1 (1.142), RPS30A (1.142), HSP12 (1.142), YDR539W (1.143), GCV1 (1.144), NTG1 (1.144), AZR1 (1.144), SPO7 (1.144), YNL022C (1.144), DIM1 (1.145), VAM6 (1.145), YNR061C (1.145), PDA1 (1.145), YOR032W-A (1.145), SPC3 (1.146), CSR1 (1.146), COS9 (1.147), YJR085C (1.147), PEX15 (1.147), TGL2 (1.147), SGD1 (1.147), YPL278C (1.147), YIL108W (1.148), THP1 (1.148), SCY1 (1.149), YGR130C (1.149), UBC6 (1.149), END3 (1.149), UBP15 (15.1.149), RPL35B (1.149), MSB2 (1.149), YCT1 (1.150), SOL3 (1.150), YDL027C (1.151), KIP3 (1.151), UTP11 (1.151), SUB1 (1.152), PRP19 (1.152), DCW1 (1.152), TAH18 (1.152), YER010C (1.152), PIN3 (1.152), GYP1 (1.152), SCW10 (1.152), CTK1 (1.153), ARK1 (1.153), FYV0 (1.153), YCR016W (1.153), YDJ1 (1.153), ARF1 (1.153), BGL2 (1.153), YHR100C (1.154), CBS2 (1.154), REX3 (1.154), TSA1 (1.155), RNA14 (1.155), RCE1 (1.155), THR4 (1.155), SIP18 (1.156), PMS1 (1.156), DSK2 (1.156), CDC50 (1.156), DPH5 (1.156), HEM12 (1.156), SER3 (1.157), YML119W (1.157), ESC1 (1.157), GAL11 (1.158), PRE7 (1.158), RPT5 (1.158), ERG2 (1.158), DSE1 (1.158), SEC22 (1.159), YFH7 (1.159), HSF1 (1.159), GOS1 (1.160), WRS1 (1.161), EXO70 (1.161), TSA2 (1.162), ALK2 (1.162), COX6 (1.162), KRI1 (1.162), YGL015C (1.162), RPS17B (1.163), YDR367W (1.163), TOM20 (1.163), RSP5 (1.163), YBL086C (1.163), TRM44 (1.163), YPR109W (1.164), PTP1 (1.164), AVT7 (1.164), CYR1 (1.164), CIS1 (1.164), FAL1 (164), VPS28 (1.165), AGA2 (1.165), QRI1 (1.165), ATS1 (1.165), GIT1 (1.166), THO1 (1.166), FBP1 (1.166), YJL016W (1.166), UGA3 (1.166), YBR230W-A (1.167), CCE1 (1.167), NDE1 (1.167), SET5 (1.168), HOT1 (1.168), RPT1 (1.168), CAR2 (1.168), PRE4 (1.169), ECM33 (1.169), ECM11 (1.169), RAD33 (1.169), BUB2 (1.169), SOP4 (1.169), SPR1 (1.170), MOG1 (1.170), SPO11 (1.171), YKR070W (1.171), YBR246W (1.171), YKL071W (1.172), AHP1 (1.172), PRP42 (1.172), GRC3 (1.173), KEL3 (1.173), YMR244W (1.174), YMR242W-A (1.174), HBN1 (1.174), VAS1 (1.174), RTT102 (1.174), ZUO1 (1.175), YGR250C (1.175), FRQ1 (1.175), YCL049C (1.175), MCR1 (1.175), UBP1 (1.175).

Figure 2:
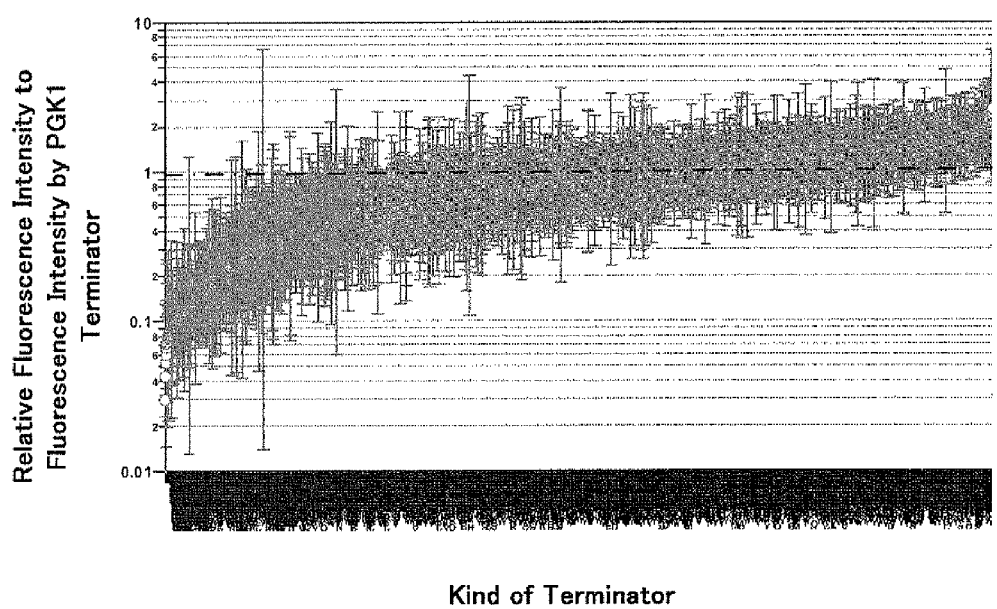
FIG. 2 shows an overview of terminator region evaluation results.

TIF35 (1.176), ATG26 (1.176), YKL107W (1.177), HEM14 (1.177), THR1 (1.178), LUG1 (1.178), SPS100 (1.178), VMA22 (1.179), YEL020C (1.179), RPL2B (1.179), GAL10 (1.180), FKS1 (1.180), YPL247C (1.180), YEL057C (1.180), RPS22A (1.181), TRK1 (1.181), VTC2 (1.181), SNU14 (1.181), SWD1 (1.181), UBC8 (1.181), YPT52 (1.181), XDJ1 (1.182), YJR142W (1.182), COQ9 (1.183), ERV25 (1.184), YKL075C (1.184), FPR4 (1.184), SEN2 (1.184), GDT1 (1.184), NOP7 (1.184), YOR251C (1.184), SRL1 (1.184), YLL023C (1.185), IRA2 (1.185), IES6 (1.185), MLF3 (1.186), DIA1 (1.186), MTG1 (1.186), FPR1 (1.186), NCE102 (1.186), ERG4 (1.187), SIF2 (1.187), NUP53 (1.187), RPL14A (1.187), SEC18 (1.187), SSB2 (1.188), RAT1 (1.188), YMR027W (1.188), GDI1 (1.189), VAN1 (1.189), KAP123 (1.189), ICL2 (1.189), LPX1 (1.189), RPP2A (1.190), SCD5 (1.190), EXO84 (1.190), CWC21 (1.191), TRE2 (1.191), YGR153W (1.191), YCR061W (1.191), RAD14 (1.192), CUL3 (1.192), VPS53 (1.192), GEA1 (1.192), GET3 (1.192), TAD2 (1.193), POT1 (1.193), MVP1 (1.193), PUS4 (1.194), SMC2 (1.194), RFC5 (1.194), TIF3 (1.195), NTG2 (1.195), HXT10 (1.195), CDC60 (1.195), ENT5 (1.196), GAT4 (1.196), PGU1 (1.196), UFD4 (1.197), RPL37A (1.198), PRE5 (1.198), PDC6 (1.198), GCV3 (1.198), EGD1 (1.199), MSC7 (1.200), KEM1 (1.200), APN1 (1.200), APE2 (1.200), YLR456W (1.200), MAK5 (1.201), YPR172W (1.202), STE24 (1.202), RPS9B (1.203), CRM1 (1.203), STP22 (1.204), DIA2 (1.205), ECO1 (1.205), MCX1 (1.205), YKL065W-A (1.205), NTR2 (1.205), HHO1 (1.206), RRM3 (1.206), PRE8 (1.206), NYV1 (1.206), RPC53 (1.207), TMA23 (1.208), REC104 (1.208), ZTA1 (1.209), TEC1 (1.209), TUB3 (1.209), YJL123C (1.209), AST2 (1.209), SNX4 (1.210), ARC1 (1.210), SOD1 (1.210), SMA2 (1.211), RGD1 (1.211), PHM8 (1.211), SEM1 (1.211), GGA2 (1.211), YAK1 (1.211), RGA2 (1.211), SCS3 (1.212), YTA7 (1.213), MDM12 (1.213), AUR1 (1.213), SKN7 (1.213), MDG1 (1.213), RSM7 (1.214), YOL038C-A (1.214), OSW2 (1.214), TIR3 (1.214), RSM28 (1.214), NIF3 (1.215), FRE6 (1.215), MDM20 (1.215), YNR071C (1.215), GDH2 (1.215), VPS8 (1.216), MVD1 (1.216), GCD2 (1.216), TFP3 (1.216), FMP33 (1.216), NUG1 (1.217), CPR6 (1.219), SCP160 (1.219), SEC14 (1.219), YNL181W (1.219), PRE6 (1.220), YLR364W (1.220), HOG1 (1.221), NUP49 (1.221), RPL21B (1.221), RPL42A (1.221), GTT2 (1.221), STR3 (1.222), ARG5,6 (1.222), RPS24A (1.222), PPM1 (1.222), AIM46 (1.222), ILM1 (1.222), PEX10 (1.222), PDS5 (1.223), YDR042C (1.223), YDL218W (1.223), MGT1 (1.223), NPC2 (1.223), YLR194C (1.223), PDI1 (1.223), XKS1 (1.223), SIW14 (1.224), KOG1 (1.224), PDR15 (1.224), NGR1 (1.225), SMX3 (1.225), FIP1 (1.225), UGA4 (1.225), EDC1 (1.225), YDL086W (1.225), GGA1 (1.226), SMM1 (1.227), AIM39 (1.227), UBC1 (1.227), YGR203W (1.227), PRP4 (1.227), YSF3 (1.227), SNA3 (1.228), SKI6 (1.228), CDC12 (1.228), VPS60 (1.228), MSC1 (1.229), SET1 (1.229), NMA111 (1.229), SKI7 (1.229), KRE5 (1.229), FOL2 (1.229), DAL3 (1.230), SAK1 (1.230), RVS161 (1.230), YBR141C (1.231), LHS1 (1.231), YFL051C (1.231), YGR067C (1.231), NOT5 (1.231), CKB2 (1.231), ATG2 (1.232), YJR112W-A (1.232), RKM2 (1.232), RPL36B (1.232), CNB1 (1.232), PRP43 (1.233), LCB5 (1.233), PAC1 (1.233), ARP3 (1.234), LRC1 (1.234), RGR1 (1.234), YDL157C (1.234), DPL1 (1.234), GCY1 (1.235), YER076C (1.235), TFB3 (1.235), RPS8B (1.235), GAT2 (1.235), GFD2 (1.235), MRP8 (1.236), VAC14 (1.236), YHR138C (1.237), PHO90 (1.237), PSK2 (1.238), ALT1 (1.238), ERP5 (1.238), LAS21 (1.238), AIM9 (1.239), SLZ1 (1.240), SGM1 (1.240), FMP27 (1.241), HXT3 (1.241),

YGR273C (1.241), RAM2 (1.241), RET1 (1.241), YIR007W (1.241), RPS2 (1.242), MTQ2 (1.242), RPS23B (1.242), COS12 (1.242), RUB1 (1.242), RGP1 (1.242), GYP7 (1.243), YOL138C (1.243), PMT2 (1.243), YMR130W (1.243), SPS4 (1.244), RAD28 (1.244), YLR099W-A (1.245), YOR285W (1.245), MBR1 (1.245), MPH1 (1.246), NUP159 (1.246), SEC63 (1.246), RPS16A (1.247), YPL206C (1.247), BCD1 (1.247), HOT13 (1.248), IVY1 (1.248), RNA15 (1.248), YKR104W (1.248), STE4 (1.249), PUP1 (1.250), SFB2 (1.251), YCK2 (1.251), ODC1 (1.251), FMP42 (1.251), VPS24 (1.251), YKL098W (1.252), YSY6 (1.252), RTG2 (1.252), LYS9 (1.253), UTR1 (1.253), HRR25 (1.253), YBR261C (1.254), RPS26A (1.254), KTR5 (1.254), CHL1 (1.255), MNN10 (1.255), GLE2 (1.255), CPD1 (1.255), SNZ1 (1.256), PAM17 (1.256), HIR2 (1.256), CDC28 (1.257), YDR061W (1.257), ENA5 (1.257), APM3 (1.258), YLR118C (1.258), AVT1 (1.258), PEP12 (1.258), PET18 (1.258), MAM1 (1.258), DOA1 (1.259), FPR2 (1.259), PIB2 (1.259), PRP21 (1.260), TOP2 (1.261), YBL044W (1.261), OST6 (1.261), AIM24 (1.262), IRC18 (1.262), OSW1 (1.263), COT1 (1.263), YOR387C (1.263), SKP1 (1.263), STM1 (1.263), YDL176W (1.263), YLR137W (1.263), ALE1 (1.264), PBP1 (1.264), YNL200C (1.264), YBL029C-A (1.265), SPE3 (1.265), RRD2 (1.265), CNN1 (1.266), SPR6 (1.266), PAN3 (1.267), YRB1 (1.268), YDL057W (1.268), YOR051C (1.268), POL4 (1.268), ORC5 (1.269), IMP2 (1.269), ATG19 (1.269), ARO8 (1.269), YJL163C (1.269), SWI5 (1.270), LSP1 (1.270), TMA19 (1.270), YET3 (1.271), RAD26 (1.271), MGA2 (1.271), IME1 (1.272), OXR1 (1.272), GSF2 (1.273), RPS18A (1.273), RUP1 (1.273), YLR126C (1.273), KRE27 (1.273), TVP23 (1.273), INO1 (1.273), ALG14 (1.274), PUS5 (1.274), VMA10 (1.275), SPT16 (1.275), YLL053C (1.276), CHC1 (1.276), MSH6 (1.276), SDS24 (1.277), PTC4 (1.278), PSP2 (1.278), VBA2 (1.278), TSR4 (1.278), CPR4 (1.278), DPP1 (1.279), TFG1 (1.279), ARN2 (1.279), YGL230C (1.279), NBP1 (1.280), YKL077W (1.280), MOB2 (1.280), DYN3 (1.280), UBC13 (1.280), RFA3 (1.281), SPG5 (1.281), GYP5 (1.281), YPI1 (1.281), YDR179W-A (1.281), CHA1 (1.282), TOS4 (1.282), ADH1 (1.282), SPO1 (1.282), JJJ2 (1.283), ADK1 (1.283), SOK1 (1.284), GOT1 (1.285), TIR4 (1.285), ERP2 (1.285), SEN1 (1.285), PHO8 (1.285), ARF2 (1.285), YOR227W (1.285), TVP38 (1.286), YDL089W (1.286), ZDS2 (1.286), GCD6 (1.286), SUI2 (1.286), VAC7 (1.287), TAH1 (1.288), CTR9 (1.288), YKL100C (1.289), NUP188 (1.289), GRE1 (1.289), PHB2 (1.289), BUD3 (1.290), SMA1 (1.290), RPL20B (1.290), NSP1 (1.291), PPZ2 (1.291), STO1 (1.291), ETR1 (1.291), SUL1 (1.292), RPL6B (1.292), CPR5 (1.292), YAL018C (1.292), ELP6 (1.292), ACP1 (1.293), SHR3 (1.293), KAP120 (1.293), YBR137W (1.293), IME2 (1.293), SNF7 (1.293), YCR023C (1.293), GIS2 (1.294), YIP1 (1.294), TFC3 (1.294), CUE1 (1.295), YLR283W (1.295), FUN12 (1.296), BMH1 (1.296), RIM1 (1.297), YMC1 (1.297), KIC1 (1.297), NAR1 (1.298), YBR184W (1.298), CAF4 (1.298), CTK3 (1.298), NUP157 (1.299), PRY1 (1.299), MFA1 (1.300), POL2 (1.300), YDL114W (1.300), STP3 (1.301), IRC20 (1.301), ZPS1 (1.302), POP1 (1.303), DUN1 (1.303), SLY1 (1.303), UTP6 (1.303), TAL1 (1.303), DIB1 (1.303), PAC2 (1.303), YNR029C (1.304), SPC72 (1.305), RPC34 (1.305), KTR7 (1.305), KRR1 (1.305), YBR062C (1.306), SSA4 (1.306), VMA9 (1.308), ATG22 (1.308), NRD1 (1.309), INH1 (1.309), REF2 (1.312), TSC13 (1.312), UTP7 (1.312), AIM15 (1.313), ARC19 (1.313), EHT1 (1.313), YHL017W (1.313), NNF2 (1.313), YPR027C (1.314), TGL3 (1.314), PEX28 (1.314), TEL1 (1.315), PGM1 (1.315), PAN1 (1.315), HRD3 (1.315), RPL26B (1.316), SDT1 (1.316), YER128W (1.317), PSY3 (1.317), VPS52 (1.318), RPB4 (1.318), AIM2 (1.318), NUD1 (1.318), RPS29B (1.320), PRO3 (1.320), RPL32 (1.321), PXA1 (1.321), GID8 (1.322), TRM3 (1.322), SLX1 (1.322), PEA2 (1.322), UBR1 (1.322), AIP1 (1.322), RPS10A (1.323), CFD1 (1.324), YOR114W (1.324), LEA1 (1.324), MSN5 (1.324), RPL6A (1.324), PTC2 (1.324), YER071C (1.325), RAS2 (1.325), ATG14 (1.326), CDC1 (1.326), RPS6B (1.326), URA6 (1.326), RPN1 (1.327), SFH5 (1.329), YAP1801 (1.329), FLR1 (1.329), DDR48 (1.329), YRA2 (1.329), APN2 (1.330), ELF1 (1.330), YJL217W (1.331), YPR089W (1.331), GSP2 (1.331), BUG1 (1.331), PSE1 (1.331), SUA5 (1.332), GPM2 (1.332), POS5 (1.332), PRM5 (1.334), TAF4 (1.334), GIM5 (1.336), BNR1 (1.336), YPS7 (1.337), HAL5 (1.337), RPS27B (1.337), CAK1 (1.337), PGA2 (1.337), SSP2 (1.338), PMR1 (1.338), NUP85 (1.339), LSB6 (1.339), TMA17 (1.340), TGL1 (11.340), ASN2 (1.340), SEI1 (1.341), VMA7 (1.341), MDR1 (1.341), HBS1 (1.341), PMT1 (1.342), PHO2 (1.342), YHR113W (1.342), SSO1 (1.342), RET2 (1.342), UBA1 (1.342), ALD2 (1.342), SEC28 (1.343), SEH1 (1.343), YMR144W (1.343), HOC1 (1.343), PRT1 (1.344), RPS19B (1.344), GCN2 (1.345), SAP4 (1.345), YLR179C (1.346), COQ6 (1.346), LYS14 (1.346), LSM12 (1.347), YGL117W (1.347), RED1 (1.348), VPS34 (1.348), VTC3 (1.348), BRF1 (1.348), ARR2 (1.350), VMA21 (1.350), PSF1 (1.351), SRL3 (1.351), YDR379C-A (1.351), ALG12 (1.352), RPS25A (1.352), SDS23 (1.352), DGA1 (1.352), YDR196C (1.353), LOC1 (1.354), RPN2 (1.355), ANB1 (1.355), NAN1 (1.355), STB2 (1.355), CUE5 (1.356), CDC8 (1.356), SPH1 (1.357), GID7 (1.357), UBC4 (1.357), RPS22B (1.358), ACT1 (1.360), RPS8A (1.360), YNR068C (1.360), FRS2 (1.360), TAF8 (1.361), THI4 (1.361), RBK1 (1.362), SET3 (1.362), YNL305C (1.362), TPP1 (1.362), MSO1 (1.363), NSA1 (1.364), YMR210W (1.364), ERG24 (1.364), YMR31 (1.364), MAK1 (1.364), URB2 (1.364), FAD1 (1.365), AGC1 (1.366), OM45 (1.366), APD1 (1.367), GSH2 (1.367), SPT14 (1.367), YGR210C (1.368), RPS11A (1.368), SWH1 (1.369), ANT1 (1.369), SAP30 (1.369), HRT3 (1.369), NSG1 (1.370), BAT2 (1.370), SOM1 (1.371), IPP1 (1.372), HIS2 (1.372), RSE1 (1.372), RTT101 (1.372), CRG1 (1.373), YJR096W (1.374), IMH1 (1.374), SPT7 (1.374), MKT1 (1.374), GTT3 (1.375), PEX11 (1.375), YDR374W-A (1.377), YPD1 (1.377), DOS2 (1.377), YEL023C (1.378), RPF1 (1.378), BNA2 (1.380), ATG27 (1.380), RPL29 (1.382), YPS6 (1.382), RPL19B (1.382), YDR357C (1.382), ARO4 (1.383), YBR096W (1.384), PEP8 (1.384), RPL39 (1.385), SCC4 (1.386), HXT7 (1.386), HSV2 (1.386), APA2 (1.386), TFC1 (1.386), SEC53 (1.386), PDR5 (1.386), MUD2 (1.387), RPL19A (1.387), TAF9 (1.387), MXR1 (1.388), RIX1 (1.388), PKR1 (1.389), CWC27 (1.390), BFR1 (1.390), YDR387C (1.390), UIP4 (1.390), OST3 (1.391), BUD6 (1.392), GFA1 (1.393), RPS0A (1.395), CRZ1 (1.396), SLT2 (1.396), SNC1 (1.396), SEC5 (1.397), PCL6 (1.397), DAL5 (1.398), MSB1 (1.399), CSL4 (1.399), COQ4 (1.400), IAH1 (1.400), YPL245W (1.400), PRI2 (1.400), LOS1 (1.400), SQS1 (1.401), PBA1 (1.401), YFR017C (1.402), HPA3 (1.402), SCL1 (1.403), YGR168C (1.404), SAP155 (1.405), MON1 (1.405), SGA1 (1.405), MNI1 (1.406), TFC8 (1.407), FAB1 (1.407), MED2 (1.407), GCN3 (1.408), PRE1 (1.408), BBC1 (1.409), GPA1 (1.409), DIG2 (1.409), IRS4 (1.409), SXM1 (1.410), SHU2 (1.410), SRO7 (1.411), GEF1 (1.412), RPL24A (1.413), TMN2 (1.413), RIB3 (1.414), UBC9 (1.414), MAL11 (1.415), ARO10 (1.415), LAC1 (1.415), RCN1 (1.416), MVB12 (1.418), TBS1 (1.418), CTL1 (1.419), NTF2 (1.419), BZZ1 (1.420), HXT14 (1.421), YGR125W (1.421), YNR062C (1.422), STE50 (1.422), YLL056C (1.423), HIS3 (1.423),

CIN2 (1.423), TCB3 (1.423), NUM1 (1.424), CPA1 (1.425), PRP40 (1.425), TRR1 (1.425), TRP2 (1.426), ADE16 (1.427), EFT1 (1.427), BET3 (1.428), SUA7 (1.430), RPS14A (1.430), FOL1 (1.431), DPB4 (1.431), VPS16 (1.431), ANP1 (1.431), YMR099C (1.432), VHS2 (1.432), BMH2 (1.432), ADH6 (1.432), GSC2 (1.433), DBR1 (1.433), ADP1 (1.433), CEG1 (1.434), MBP1 (1.434), FCP1 (1.434), SRY1 (1.434), YNL058C (1.435), AVO2 (1.435), YMR196W (1.435), RPL35A (1.435), HIF1 (1.435), YLR050C (1.436), YER187W (1.436), YOR186W (1.436), RAD57 (1.437), ATH1 (1.437), PEP7 (1.437), YJL055W (1.438), YBR259W (1.439), UBX7 (1.439), ILV6 (1.439), SAM4 (1.441), MRM1 (1.441), PHO23 (1.441), MYO4 (1.443), BRE1 (1.443), YFR032C (1.444), GAS4 (1.444), MIP6 (1.444), ERV46 (1.444), YPR097W (1.444), PET10 (1.445), HDA2 (1.445), TRX2 (1.445), MED4 (1.446), SPO16 (1.446), NSG2 (1.446), GND2 (1.447), PDB1 (1.448), BDH1 (1.448), NIT3 (1.449), MUD1 (1.449), ERG20 (1.450), RPL18A (1.451), PAI3 (1.452), TMA108 (1.452), SAM50 (1.452), SLY4 (1.452), YDR461C-A (1.454), YMR265C (1.454), YJL132W (1.454), BLM10 (1.454), SPO73 (1.454), CWC15 (1.455), ALO1 (1.456), MAP1 (1.456), YKR023W (1.456), PET130 (1.456), YCS4 (1.458), CWH41 (1.458), ARP9 (1.458), CHK1 (1.459), PAM1 (1.459), TAF10 (1.459), ARA1 (1.461), CGI121 (1.461), YIL014C-A (1.461), CHS7 (1.461), RPS21A (1.463), VMA13 (1.463), NAT3 (1.464), ARG2 (1.464), DOG1 (1.465), TMS1 (1.465), PSF2 (1.465), YHR126C (1.465), KAP104 (1.466), DPS1 (1.466), IRR1 (1.466), YAL044W-A (1.466), RPL23B (1.467), YDR307W (1.467), RPL33A (1.468), NAB6 (1.468), APA1 (1.469), ALG6 (1.469), MEX67 (1.470), DAK1 (1.471), ARC15 (1.471), YOS1 (1.472), GAD1 (1.472), ECM22 (1.473), CYS3 (1.473), PBI2 (1.474), YBR271W (1.474), GPI10 (1.474), WBP1 (1.477), ZRC1 (1.477), FIG2 (1.477), YOR262W (1.477), MSH3 (1.478), IOC2 (1.478), YGR201C (1.479), NAP1 (1.479), KAE1 (1.479), CHS1 (1.480), GDE1 (1.480), YTM1 (1.480), YHR162W (1.480), TAD3 (1.480), ALP1 (1.481), TRM8 (1.482), NMD2 (1.482), YIM1 (1.483), BCH1 (1.483), RRP1 (1.483), VCX1 (1.483), UGA1 (1.484), HOL1 (1.484), GRX1 (1.484), EMP24 (1.484), YGR237C (1.485), FAP1 (1.485), KTR2 (1.486), PBP4 (1.486), YER163C (1.486), RFS1 (1.486), PTA1 (1.487), MPD2 (1.487), SGT2 (1.487), IKI1 (1.487), ECM29 (1.488), REV3 (1.489), TPD3 (1.489), YDL124W (1.490), MUM2 (1.491), YFR026C (1.491), PHS1 (1.491), MLS1 (1.493), POR1 (1.494), PFD1 (1.494), EGD2 (1.494), GYP8 (1.495), RPT2 (1.495), TEX1 (1.495), RPS5 (1.496), TPK1 (1.496), DOT5 (1.497), LSB5 (1.498), DMA1 (1.498), BNA6 (1.498), VAB2 (1.499), AML1 (1.500), SEC31 (1.500), KIN1 (1.501), STB4 (1.502), GSP1 (1.502), AAD4 (1.502), MNN2 (1.503), RPP1B (1.503), GUK1 (1.506), MCK1 (1.506), HSP31 (1.506), SBP1 (1.506), ZWF1 (1.507), IST2 (1.508), GPI16 (1.508), CDC42 (1.508), AHA1 (1.509), UBP2 (1.510), YNL115C (1.510), CCW14 (1.510), YDL121C (1.510), MCA1 (1.510), RPT4 (1.511), ERP1 (1.512), TMA7 (1.513), WHI4 (1.513), YDR131C (1.513), PDR1 (1.514), TSR3 (1.516), ATG11 (1.516), DDP1 (1.516), COQ2 (1.516), RPP1A (1.517), PMP3 (1.517), CRD1 (1.517), PHO85 (1.517), YGR017W (1.517), YIL055C (1.518), LAP3 (1.518), YOR291W (1.519), GAS5 (1.519), YKR043C (1.520), YIL083C (1.520), CHO2 (1.521), ELP4 (1.521), BIM1 (1.522), CAM1 (1.522), DAL82 (1.523), UMP1 (1.524), YBR241C (1.524), LTP1 (1.524), PHO91 (1.525), RPP0 (1.526), YOR164C (1.526), TOM71 (1.527), FAS2 (1.528), FMP46 (1.528), TMA22 (1.528), YML131W (1.528), YCF1 (1.530), OPI13 (1.530), ROM1 (1.530), IRC24 (1.530), FYV6 (1.531), ATG13 (1.534), TRX3 (1.534), ENP2 (1.534), CEX1 (1.534), VPS3 (1.535), TRX1 (1.536), DIT2 (1.536), SEC4 (1.536), GDH3 (1.537), PRE9 (1.537), UBP1 (1.537), AYR1 (1.537), NIT2 (1.537), PDR17 (1.538), TUB1 (1.539), KEG1 (1.539), CDC25 (1.539), PIG2 (1.539), NSE1 (1.541), VPS25 (1.541), YLR414C (1.541), CWH43 (1.541), COG2 (1.545), RCY1 (1.545), VPS68 (1.546), RPL7A (1.548), TAF14 (1.549), SRB5 (1.553), UPF3 (1.553), YML096W (1.555), ARG81 (1.555), NPR2 (1.555), PSH1 (1.556), TAF6 (1.557), MCT1 (1.557), SBH1 (1.557), PBN1 (1.558), VPS45 (1.560), SRP68 (1.560), SAY1 (1.561), PEP1 (1.562), CCT4 (1.563), COQ10 (1.565), RET3 (1.566), SSE1 (1.566), YSP3 (1.567), ABZ1 (1.567), PNS1 (1.567), DPB3 (1.568), YDL073W (1.568), ATM1 (1.568), RBD2 (1.568), YFR006W (1.569), DDI1 (1.569), DCP1 (1.570), SAS10 (1.570), RMT2 (1.571), FIG1 (1.572), MUS81 (1.573), UBI4 (1.573), YBR285W (1.574), DLD1 (1.576), RPS15 (1.576), YPR170W-B (1.576), SRP1 (1.577), PSK1 (1.577), RAD4 (1.578), PGD1 (1.580), PMT4 (1.581), ABF2 (1.582), SEC24 (1.584), URA10 (1.585), CWC23 (1.585), RPS11B (1.586), TPM1 (1.586), YLR290C (1.588), TRM9 (1.588), YAP1 (1.589), UGP1 (1.589), SPS2 (1.590), PDR10 (1.591), POM34 (1.591), PNC1 (1.591), STE11 (1.593), GRH1 (1.596), YMR018W (1.596), TRS33 (1.596), HEF3 (1.597), LAT1 (1.597), BDS1 (1.597), HMF1 (1.598), PRP6 (1.600), FSH3 (1.600), SRB2 (1.601), DUG1 (1.601), ERD2 (1.602), CDA2 (1.602), RPS6A (1.602), HUT1 (1.604), SHS1 (1.604), IRA1 (1.605), SSA3 (1.606), ELP3 (1.606), PRP46 (1.606), CSM3 (1.606), PEP4 (1.607), YHC3 (1.610), MDY2 (1.610), RPL43A (1.613), HRQ1 (1.613), YKL023W (1.613), DFM1 (1.614), PCL8 (1.614), SKG3 (1.614), GPH1 (1.615), NEJ1 (1.616), URA4 (1.617), GPX1 (1.620), HOS2 (1.622), YDR531W (1.623), PEP3 (1.624), MAL31 (1.625), YGR283C (1.626), HFD01 (1.627), SPR28 (1.627), SWP82 (1.628), FUM1 (1.629), CDA1 (1.629), HOM6 (1.630), NHX1 (1.631), SNF6 (1.632), ECI1 (1.632), CDC10 (1.632), MIS1 (1.632), YIL165C (1.632), GTT1 (1.636), PLP2 (1.636), PFA4 (1.636), RPL30 (1.637), PRE3 (1.640), MTD1 (1.640), MNT2 (1.642), ECM30 (1.643), YNL208W (1.645), YCR024C-B (1.645), PCA1 (1.646), HCS1 (1.648), DCC1 (1.650), FAR8 (1.652), PPH22 (1.654), DED81 (1.656), GPM1 (1.657), COF1 (1.658), YGR042W (1.658), YPR148C (1.659), VPS55 (1.659), JLP1 (1.660), CAT2 (1.661), GCN1 (1.664), YGL231C (1.664), GUS1 (1.665), YGR111W (1.667), VMA4 (1.671), YDR056C (1.671), SCS2 (1.672), NQM1 (1.675), UFE1 (1.677), COG1 (1.677), PAA1 (1.677), IRC22 (1.682), KTR1 (1.682), TYW1 (1.683), SSB1 (1.683), SVP26 (1.686), ESC8 (1.687), YNL010W (1.687), TIF1 (1.689), EAF6 (1.690), SHC1 (1.690), KIN2 (1.692), DCS2 (1.692), RPS1B (1.692), URA5 (1.692), DSD1 (1.693), YJL218W (1.694), NPT1 (1.694), SRO77 (1.695), FMN1 (1.695), CMD1 (1.695), YTA6 (1.697), RPL21A (1.699), ALG3 (1.699), KRE2 (1.703), PCL5 (1.704), MDM34 (1.705), PFS2 (1.708), SNF12 (1.708), BNA1 (1.709), AIM29 (1.710), SNU13 (1.712), RNR4 (1.712), MAP2 (1.713), DCS1 (1.716), RPN5 (1.716), PDC2 (1.722), DOP1 (1.723), SPO74 (1.725), PAP1 (1.728), RPL24B (1.732), RPN8 (1.734), FPR3 (1.734), ERS1 (1.735), CPR1 (1.736), FIT3 (1.740), HUG1 (1.742), VPS5 (1.742), PEX3 (1.742), RPS29A (1.743), ERV29 (1.743), CAF20 (1.743), DOG2 (1.743), RPL4A (1.744), YCP4 (1.745), PBY1 (1.746), FUS2 (1.750), SNF2 (1.752), SUI1 (1.752), YMR262W (1.759), BUD8 (1.761), TED1 (1.763), TAH1 (1.765), YCL048W-A (1.769), RPL41A (1.774), YDR374C (1.776), VMA8 (1.777), YKR051W (1.777), YFL042C (1.778), ORM2 (1.778), TAF12 (1.778), APE3 (1.781), YDR239C (1.782), ERV2 (1.784), SHR5 (1.785),

YHR192W (1.787), YRB30 (1.791), PHO88 (1.791), WHI2 (1.792), LYS1 (1.793), RHO1 (1.795), VPS27 (1.797), VMA6 (1.797), PAB1 (1.806), YJR015W (1.807), SIR2 (1.809), FAR1 (1.809), CPT1 (1.814), ECM15 (1.815), ROK1 (1.815), YFR018C (1.820), HYR1 (1.821), POL1 (1.821), CTS2 (1.830), UBA4 (1.832), SRP72 (1.833), RTN2 (1.834), HAP1 (1.835), ARE2 (1.836), RCK2 (1.837), INM2 (1.839), AFR1 (1.840), YOS9 (1.840), RTT103 (1.842), RPS12 (1.845), RNY1 (1.847), PPA1 (1.848), LEU3 (1.849), ERG27 (1.850), TMA29 (1.851), UBX3 (1.852), VPS15 (1.854), RPT6 (1.855), LDB18 (1.859), YPL088W (1.862), RPL5 (1.863), RVS167 (1.870), TIR2 (1.871), PHA2 (1.873), ERJ5 (1.873), VPS30 (1.876), IMD2 (1.878), PES4 (1.879), EMI1 (1.897), YPR085C (1.901), YBR200W-A (1.903), FMP40 (1.909), REH1 (1.909), SGT1 (1.911), CPS1 (1.913), YOP1 (1.917), TRR2 (1.919), STS1 (1.920), VPH1 (1.931), SWA2 (1.933), YGR026W (1.938), CDC53 (1.938), FMP52 (1.941), YDR119W (1.945), RNQ1 (1.953), SAG1 (1.956), RPS20 (1.974), TRM82 (1.979), VPS1 (1.981), YIP5 (1.987), YPR1 (1.988), ENT2 (1.992), YPT31 (1.997), PRX1 (2.003), YHL039W (2.003), YHI9 (2.022), BUD32 (2.035), YLR361C-A (2.037), APL2 (2.043), PTP3 (2.046), YMR114C (2.049), LSC2 (2.054), ATG10 (2.056), SRP54 (2.065), ENT3 (2.077), RPL3 (2.080), TYR1 (2.095), NAT1 (2.106), YNR021W (2.114), EBS1 (2.126), HBT1 (2.132), RPL15A (2.145), RPL41B (2.149), RPP2B (2.166), CBR1 (2.178), BNA4 (2.233), PRC1 (2.240), DIT1 (2.244), RPS28A (2.260), ASP3-1 (2.300), IDP1 (2.304), SCW4 (2.321), VMA2 (2.369), ALY2 (2.382), and NAT5 (2.449).

In the expression intensity data above, the genes names are based on public genome data available by ftp at ncbi.nih.gov/genomes/Fungi/Saccharomyces cerevisiae_uid128. With this genome data, a gene sequence downstream from the coding region of each gene can be obtained by referencing the gene names listed above. It has been reported that the median value of the length of a 3'-UTR in the mRNA of yeasts is about 100 bp, and that most 3'-UTRs are in the range of about 500 bp (Miura F, Kawaguchi N, Sese J, Toyoda A, Hattori M, Morishita S, Ito T, *Proc. Natl. Acad. Sci. USA,* 103, 17846-17851 (2006); Nagalakshmi U, Wang Z, Waern K, Shou C, Raha D, Gerstein M, Snyder M, *Science,* 320, 1344-1349 (2008)). For such reasons, about 300 bp downstream from the termination codon of the coding region is presumed to be the terminator region of the gene in yeasts. A person skilled in the art can design appropriate primers by known techniques based on the nucleotide sequence of the presumed DNA of the terminator region, and amplify the presumed terminator region of the specific gene to perform terminator cloning, and the activity of this as a terminator region can also be evaluated.

An example of the nucleotide sequences of the terminator regions of the aforementioned genes is given by SEQ ID NOS:10591-15885, in the same order as the list of genes above. The nucleotide sequences of the terminator regions of the genes for which expression intensity data is given above are based on results obtained with unique primer sets designed for obtaining the terminator region of each gene, and include roughly 300 bp to 700 bp downstream from the coding region of each gene. The nucleotide sequences of the 5' primers are represented by SEQ ID NOS:1-5295, and the nucleotide sequences of the 3' primers by SEQ ID NOS:5296-10590.

A terminator region used in this production method may be identical to a specified nucleotide sequence, but it is also possible to use one that has been modified as necessary. For example, this may be a nucleotide sequence of DNA comprising a nucleotide sequence represented by a sequence ID specified by any of SEQ ID NOS:10591-15885 with 1 or 2 or more nucleotides deleted, substituted, inserted and/or added therein, and having terminator activity equivalent to that of the original terminator region. It may also be a nucleotide sequence of DNA that hybridizes under stringent conditions with DNA complementary to all or part of a nucleotide sequence represented by a sequence ID specified by any of SEQ ID NOS:10591-15885, and that has terminator activity equivalent to that of the original terminator region. Moreover, it may be a nucleotide sequence of DNA having at least 80% or preferably at least 85% or more preferably at least 90% or still more preferably at least 95% or most preferably at least 98% or ideally at least 99% identity with a nucleotide sequence represented by a sequence ID specified by any of SEQ ID NOS:10591-15885, and having terminator activity equivalent to that of the original terminator region. Equivalent terminator activity here means for example that the relative expression intensity is within the range of ±20% of the relative expression intensity given by the expression intensity data for the original terminator region. More preferably, it is within the range of ±10%, or still more preferably ±5%.

"Identity" and "similarity" herein, as have been known well to those skilled in the art, are relationships between two or more proteins or two more polynucleotide determined by comparing the sequences. "Identity" in the art, also means the degree of sequence invariance between protein or polynucleotide sequences, as determined by the alignment between the protein or polynucleotide sequences, as the case maybe the alignment between strings of such sequences. In addition, "similarity" means the degree of sequence relatedness between protein or polynucleotide sequences, as determined by the alignment between the protein or polynucleotide sequences, as the case maybe the alignment between strings of such sequences. More specifically, "Similarity" is determined by the sequence identity or conservativeness (replacement which can maintain the physical and chemical properties of a particular amino acid or amino acid sequence). "Similarity" is referred to as similarity in the search result BLAST sequence homology to be described later. Preferred methods of determining "identity" or "similarity" are designed to give the longest alignment between the sequences to be tested. Method for determining identity and similarity, are codified in publicly available computer programs. "Identity" and "similarity" can be determined by, for example, using the BLAST (Basic Local Alignment Search Tool) program by Altschul et. al., (for example, Altschul S F, Gish W, Miller W, Myers E W, Lipman D J, J. Mol. Biol, 215: P403-410 (1990), Altschyl S F, Madden T L, Schaffer A A, Zhang J, Miller W, Lipman D J, 25 Nucleic Acids Res. 25: p 3389-3402 (1997)). Where software such as BLAST used, it is but not limited to, preferable to use default values.

Stringent condition refers to conditions, for example in which so-called specific hybrid is formed, a non-specific hybrid is not formed. For example, a condition such that the complementary strand of the DNA or the part thereof having high identity such as at least 80% identical, preferably at least 85% identity, more preferably at least 90%, or still more preferably at least 95%, further more preferably at least 98%, or most preferably at least 99% identity with the predetermined sequence hybridizes with the DNA while the complementary strand or the part thereof having the lower identity does not hybridize with the DNA is included. Typically, sodium salt concentration is 15 to 750 mM, preferably 50 to 750 mM, more preferably 300 to 750 mM, temperature is 25 to 70° C., preferably 50 to 70° C., more preferably 55° to 65° C., and formamide concentration is 0 to 50%, preferably 20 to 50%, more preferably 35 to 45%. Further, stringent condition includes filter washing condition after hybridization which sodium salt concentration is 15 to 600 mM, preferably 50 to 600 mM, more preferably 300 to 600 mM and temperature is 50 to 70° C., preferably 55 to 70° C., more preferably 60° to 65° C., typically. Accordingly, further embodiments of the terminator region include terminator region having high identity such as at least 80% identical, preferably at least 85% identity, more preferably at least 90%, or still more preferably at least 95%, further more preferably at least 98%, or most preferably at least 99% identity with the predetermined terminator region.

The terminator region may be arranged down stream of the code region of the gene of an interest whose expression is to be controlled. The terminator region may effect the expression level of the gene in spite of the code region which is arranged upstream thereof. The terminator region may provide its intrinsic expression controlling ability without the effect of the expression controlling ability of the promoter arranged upstream of the terminator region.

For example, to enhance the expression output of an arbitrary gene (which may be an exogenous gene or an endogenous gene in a yeast), a terminator region exhibiting high expression intensity can be used based on the expression intensity data for the terminator regions of each gene. A relative expression intensity of at least 1.2, or preferably at least 1.3, or more preferably at least 1.4, or still more preferably at least 1.5, or yet more preferably at least 1.6 is desirable, and at least 1.7 or preferably at least 1.8 or more preferably at least 1.9 is still more desirable, while at least 2.0 or more is most desirable.

Examples of terminator regions with a relative expression intensity of 1.2 or more include YCT1, SOL3, YDL027C, KIP3, UTP11, SUB1, PRP19, DCW1, TAH18, YER010C, PIN3, GYP1, SCW10, CTK1, ARK1, FYV10, YCR016W, YDJ1, ARF1, BGL2, YHR100C, CBS2, REX3, TSA1, RNA14, RCE1, THR4, SIP18, PMS1, DSK2, CDC50, DPH5, HEM12, SER3, YML119W, ESC1, GAL11, PRE7, RPT5, ERG2, DSE1, SEC22, YFH7, HSF1, GOS1, WRS1, EXO70, TSA2, ALK2, COX6, KRI1, YGL015C, RPS17B, YDR367W, TOM20, RSP5, YBL086C, TRM44, YPR109W, PTP1, AVT7, CYR1, CIS1, FAL1, VPS28, AGA2, QRI1, ATS1, GIT1, THO1, FBP1, YJL016W, UGA3, YBR230W-A, CCE1, NDE1, SET5, HOT1, RPT1, CAR2, PRE4, ECM33, ECM11, RAD33, BUB2, SOP4, SPR1, MOG1, SPO11, YKR070W, YBR246W, YKL071W, AHP1, PRP42, GRC3, KEL3, YMR244W, YMR242W-A, HBN1, VAS1, RTT102, ZUO1, YGR250C, FRQ1, YCL049C, MCR1, UBP11, TIF35, ATG26, YKL107W, HEM14, THR1, LUG1, SPS100, VMA22, YEL020C, RPL2B, GAL10, FKS1, YPL247C, YEL057C, RPS22A, TRK1, VTC2, SNU114, SWD1, UBC8, YPT52, XDJ1, YJR142W, COQ9, ERV25, YKL075C, FPR4, SEN2, GDT1, NOP7, YOR251C, SRL1, YLL023C, IRA2, IES6, MLF3, DIA1, MTG1, FPR1, NCE102, ERG4, SIF2, NUP53, RPL24A, SEC18, SSB2, RAT1, YMR027W, GDI1, VAN1, KAP123, ICL2, LPX1, RPP2A, SCD5, EXO84, CWC21, TRE2, YGR153W, YCR061W, RAD14, CUL3, VPS53, GEA1, GET3, TAD2, POT1, MVP1, PUS4, SMC2, RFC5, TIF3, NTG2, HXT10, CDC60, ENT1, GAT4, PGU1, UFD4, RPL37A, PRE5, PDC6, GCV3, EGD1, MSC7, KEM1, APN1, APE2, YLR456W, MAK5, YPR172W, STE24, RPS9B, CRM1, STP22, DIA2, ECO1, MCX1, YKL065W-A, NTR2, HHO1, RRM3, PRE8, NYV1, RPC53, TMA23, REC104, ZTA1, TEC), TUB3, YJL123C, AST2, SNX4, ARC1, SOD1, SMA2, RGD1, PHM8, SEM1, GGA2, YAK1, RGA2, SCS3, YTA7, MDM12, AUR1, SKN7, MDG1, RSM7, YOL038C-A, OSW2, TIR3, RSM28, NIF3, FRE6, MDM20, YNR071C, GDH2, VPS8, MVD1, GCD2, TFP3, FMP33, NUG1, CPR6, SCP160, SEC14, YNL181W, PRE6, YLR364, HOG1, NUP49, RPL21B, RPL42A, GTT2, STR3, ARG5,6, RPS24A, PPM1, AIM46, ILM1, PEX1, PDS5, YDR042C, YDL218W, MGT1, NPC2, YLR194C, PDI1, XKS1, SIW14, KOG1, PDR15, NGR1, SMX3, FIP1, UGA4, EDC1, YDL086W, GGA1, SMM1, AIM39, UBC1, YGR203W, PRP4, YSF3, SNA3, SKI6, CDC12, VPS60, MSC1, SET1, NMA111, SKI7, KRE5, FOL2, DAL3, SAK1, RVS161, YBR141C, LHS1, YFL051C, YGR067C, NOT5, CKB2, ATG2, YJR112W-A, RKM2, RPL36B, CNB1, PRP43, LCB5, PAC1, ARP3, LRC1, RGR1, YDL157C, DPL1, GCY1, YER076C, TFB3, RPS8B, GAT2, GFD2, MRP8, VAC14, YHR138C, PHO9, PSK2, ALT1, ERP5, LAS21, AIM9, SLZ1, SGM1, FMP27, HXT3, YGR273C, RAM2, RET1, YIR007W, RPS2, MTQ2, RPS23B, COS12, RUB1, RGP1, GYP7, YOL138C, PMT2, YMR130W, SPS4, RAD28, YLR099W-A, YOR285W, MBR1, MPH1, NUP159, SEC63, RPS16A, YPL206C, BCD1, HOT13, IVY1, RNA15, YKR104W, STE4, PUP1, SFB2, YCK2, ODC1, FMP42, VPS24, YKL098W, YSY6, RTG2, LYS9, UTR1, HRR25, YBR261C, RPS26A, KTR5, CHL1, MNN10, GLE2, CPD1, SNZ1, PAM17, HIR2, CDC28, YDR061W, ENA5, APM3, YLR118C, AVT1, PEP12, PET18, MAM1, DOA1, FPR2, PIB2, PRP21, TOP2, YBL044W, OST6, AIM24, IRC18, OSW1, COT1, YOR387C, SKP1, STM1, YDL176W, YLR137W, ALE1, PBP1, YNL200C, YBL029C-A, SPE3, RRD2, CNN1, SPR6, PAN3, YRB1, YDL057W, YOR051C, POL4, ORC5, IMP2, ATG19, ARO8, YJL163C, SWI5, LSP1, TMA19, YET3, RAD26, MGA2, IME1, OXR1, GSF2, RPS18A, RUP1, YLR126C, KRE27, TVP23, INO1, ALG14, PUS5, VMA10, SPT16, YLL053C, CHC1, MSH6, SDS24, PTC4, PSP2, VBA2, TSR4, CPR4, DPP1, TFG1, ARN2, YGL230C, NBP1, YKL077W, MOB2, DYN3, UBC13, RFA3, SPG5, GYP5, YPI1, YDR179W-A, CHA1, TOS4, ADH1, SPO1, JJJ2, ADK1, SOK1, GOT1, TIR4, ERP2, SEN1, PHO81, ARF2, YOR227W, TVP38, YDL0089, ZDS2, GCD6, SUI2, VAC7, TAH1, CTR9, YKL100C, NUP88, GRE1, PHB2, BUD3, SMA1, RPL20B, NSP1, PPZ2, STO1, ETR1, SUL1, RPL6B, CPR5, YAL018C, ELP6, ACP1, SHR3, KAP120, YBR137W, IME2, SNF7, YCR023C, GIS2, YIP1, TFC3, CUE1, YLR283W, FUN12, BMH1, RIM1, YMC1, KIC1, NAR1, YBR184W, CAF4, CTK3, NUP157, PRY1, MFA1, POL2, YDL114W, STP3, IRC20, ZPS1, POP1, DUN1, SLY1, UTP6, TAL1, DIB1, PAC2, YNR029C, SPC72, RPC34, KTR7, KRR1, YBR062C, SSA4, VMA9, ATG22, NRD1, INH1, REF2, TSC13, UTP7, AIM15, ARC9, EHT1, YHL017W, NNF2, YPR027C, TGL3, PEX28, TEL1, PGM1, PAN1, HRD3, RPL26B, SDT1, YER128W, PSY3, VPS52, RPB4, AIM2, NUD1, RPS29B, PRO3, RPL32, PXA1, GID8, TRM3, SLX1, PEA2, UBR1, ALP1, RPS10A, CFD1, YOR114W, LEA41, MSN5, RPL6A, PTC2, YER071C, RAS2, ATG14, CDC11, RPS6B, URA6, RPN1, SFH5, YAP1801, FLR1, DDR48, YRA2, APN2, ELF1, YJL217W, YPR089W, GSP2, BUG1, PSE1, SUA5, GPM2, POS5, PRM5, TAF4, GIM5, BNR1, YPS7, HAL5, RPS27B, CAK1, PGA2, SSP2, PMR1, NUP85, LSB6, TMA17, TGL1, ASN2, SEI1, VMA7, MDR1, HBS1, PMT1, PHO2, YHR113W, SSO1, RET2, UBA1, ALD2, SEC28, SEH1, YMR144W, HOC1, PRT1, RPS19B, GCN2, SAP4, YLR179C, COQ6, LYS14, LSM12, YGL117W, RED1, VPS34, VTC3, BRF1, ARR2, VMA21, PSF1, SRL3, YDR379C-A, ALG12, RPS25A, SDS23, DGA1, YDR196C, LOC1, RPN2, ANB1, NAN1, STB2, CUE5, CDC8, SPH1, GID7, UBC4, RPS22B, ACT1, RPS8A, YNR068C, FRS2, TAF8, THI4, RBK1, SET3, YNL305C, TPP1, MSO1, NSA1, YMR210W, ERG24, YMR31, MAK11, URB2, FAD1, AGC1, OM45, APD1, GSH2, SPT14, YGR210C, RPS11A, SWH1, ANT1, SAP30, HRT3, NSG1, BAT2, SOM1, IPP1, HMS2, RSE1, RTT101, CRG1, YJR096W, IMH1, SPT7, MKT1, GTT3, PEX1, YDR374W-A, YPD1, DOS2, YEL023C, RPF1, BNA2, ATG27, RPL29, YPS6, RPL19B, YDR357C, ARO4, YBR096W, PEP8, RPL39, SCC4, HXT7, HSV2, APA2, TFC1, SEC53, PDR5, MUD2, RPL19A, TAF9, MXR1, RIX1, PKR1, CWC27, BFR1, YDR387C, UIP4, OST3, BUD6, GFA1, RPS0A, CRZ1, SLT2, SNC1, SEC5, PCL6, DAL5, MSB1, CSL4, COQ4, IAH1, YPL245W, PRI2, LOS1, SQS1, PBA1, YFR017C, HPA3, SCL1, YGR168C, SAP155, MON1, SGA1, MNI1, TFC8, FAB1, MED2, GCN3, PRE1, BBC1, GPA1, DIG2, IRS4, SXM1, SHU2, SRO7, GEF1, RPL24A, TMN2, RIB3, UBC9, MAL11, ARO10, LAC1, RCN1, MVB12, TBS1, CTL1, NTF2, BZZ1, HXT4, YGR125W, YNR062C, STE50, YLL056C, HIS3, CIN2, TCB3, NUM1, CPA1, PRP400, TRR1, TRP2, ADE16, EFT1, BET3, SUA7, RPS14A, FOL1, DPB4, VPS16, ANP1, YMR099C, VHS2, BMH2, ADH6, GSC2, DBR1, ADP1, CEG1, MBP1, FCP1, SRY1, YNL058C, AVO2, YMR196W, RPL35A, HIF1, YLR050C, YER187W, YOR186W, RAD57, ATH1, PEP7, YJL055W, YBR259W, UBX7, ILV6, SAM4, MRM1, PHO23, MYO4, BRE1, YFR032C, GAS4, MIP6, ERV46, YPR097W, PET10, HDA2, TRX2, MED4, SPO16, NSG2, GND2, PDB1, BDH1, NIT3, MUD1, ERG20, RPL18A, PAI3, TMA108, SAM50, SLY41, YDR461C-A, YMR265C, YJL132W, BLM10, SPO73, CWC15, ALO1, MAP1, YKR023W, PET130, YCS4, CWH41, ARP9, CHK1, PAM1, TAF10, ARA1, CGI121, YIL014C-A, CHS7, RPS21A, VMA13, NAT3, ARG2, DOG1, TMS1, PSF2, YHR126C, KAP104, DPS1, IRR1, YAL044W-A, RPL23B, YDR307W, RPL33A, NAB6, APA1, ALG6, MEX67, DAK1, ARC15, YOS1, GAD1, ECM22, CYS3, PBI2, YBR271W, GPI10, WBP1, ZRC1, FIG2, YOR262W, MSH3, IOC2, YGR201C, NAP1, KAE1, CHS1, GDE1, YTM1, YHR162W, TAD3, ALP1, TRM8, NMD2, YIM1, BCH1, RRP1, VCX1, UGA1, HOL1, GRX1, EMP24, YGR237C, FAP1, KTR2, PBP4, YER163C, RFS1, PTA1, MPD2, SGT2, IKI1, ECM29, REV3, TPD3, YDL124W, MUM2, YFR026C, PHS1, MLS1, POR1, PFD1, EGD2, GYP8, RPT2, TEX1, RPS5, TPK1, DOT5, LSB5, DMA1, BNA6, VAB2, AML1, SEC31, KIN1, STB4, GSP1, AAD4, MNN2, RPP1B, GUK1, MCK1, HSP31, SBP1, ZWF1, IST2, GPI6, CDC42, AHA1, UBP2, YNL115C, CCW14, YDL121C, MCA1, RPT4, ERP1, TMA7, WHI4, YDR131C, PDR1, TSR3, ATG11, DDP1, COQ2, RPP1A, PMP3, CRD1, PHO85, YGR017W, YIL055C, LAP3, YOR291, GAS5, YKR043C, YIL083C, CHO2, ELP4, BIM1, CAM1, DAL82, UMP1, YBR241C, LTP1, PHO91, RPP0, YOR164C, TOM71, FAS2, FMP46, TMA22, YML131W, YCF1, OPI3, ROM1, IRC24, FYV6, ATG13, TRX3, ENP2, CEX1, VPS3, TRX1, DIT2, SEC4, GDH3, PRE9, UBP1, AYR1, NIT2, PDR17, TUB1, KEG1, CDC25, PIG2, NSE1, VPS25, YLR414C, CWH43, COG2, RCY1, VPS68, RPL7A, TAF14, SRB5, UPF3, YML096W, ARG81, NPR2, PSH1, TAF6, MCT1, SBH1, PBN1, VPS45, SRP68, SAY1, PEP1, CCT4, COQ10, RET3, SSE1, YSP3, ABZ1, PNS1, DPB3, YDL073W, ATM1, RBD2, YFR006W, DDI1, DCP1, SAS10, RMT2, FIG1, MUS81, UBI4, YBR285W, DLD1, RPS15, YPR170W-B, SRP1, PSK1, RAD4, PGD1, PMT4, ABF2, SEC24, URA10, CWC23, RPS11B, TPM1, YLR290C, TRM9, YAP1, UGP1, SPS2, PDR10, POM34, PNC1, STE1, GRH1, YMR018W, TRS33, HEF3, LAT1, BDS1, HMF1, PRP6, FSH3, SRB2, DUG1, ERD2, CDA2, RPS6A, HUT1, SHS1, IRA1, SSA3, ELP3, PRP46, CSM3, PEP4, YHC3, MDY2, RPL43A, HRQ1, YKL023W, DFM1, PCL8, SKG3, GPH1, NEJ1, URA4, GPX1, HOS2, YDR531W, PEP3, MAL31, YGR283C, HFD1, SPR28, SWP82, FUM1, CDA1, HOM6, NHX1, SNF6, ECI1, CDC10, MIS1, YIL165C, GTT1, PLP2, PFA4, RPL30, PRE3, MTD1, MNT2, ECM30, YNL208W, YCR024C-B, PCA1, HCS1, DCC1, FAR8, PPH22, DED81, GPM1, COF1, YGR042W, YPR148C, VPS555, JLP1, CAT2, GCN1, YGL231C, GUS1, YGR111W, VMA4, YDR056C, SCS2, NQM1, UFE1, COG1, PAA1, IRC22, KTR1, TYW1, SSB1, SVP26, ESC8, YNL010W, TIF1, EAF6, SHC1, KIN2, DCS2, RPS1B, URA5, DSD1, YJL218W, NPT1, SRO77, FMN1, CMD1, YTA6, RPL21A, ALG3, KRE2, PCL5, MDM34, PFS2, SNF2, BNA1, AIM29, SNU13, RNR4, MAP2, DCS1, RPN5, PDC2, DOP1, SPO74, PAP1, RPL24B, RPN8, FPR3, ERS1, CPR1, FIT3, HUG1, VPS5, PEX3, RPS29A, ERV29, CAF20, DOG2, RPL4A, YCP4, PBY1, FUS2, SNF2, SUI1, YMR262W, BUD8, TED1, TAH1, YCL048W-A, RPL41A, YDR374C, VMA8, YKR051W, YFL042C, ORM2, TAF12, APE3, YDR239C, ERV2, SHR5, YHR192W, YRB30, PHO88, WHI2, LYS1, RHO1, VPS27, VMA6, PAB1, YJR015W, SIR2, FAR1, CPT1, ECM15, ROK1, YFR018C, HYR1, POL1, CTS2, UBA4, SRP72, RTN2, HAP1, ARE2, RCK2, INM2, AFR1, YOS9, RTT103, RPS12, RNY1, PPA1, LEU3, ERG27, TMA29, UBX3, VPS51, RPT6, LDB18, YPL088W, RPL5, RVS167, TIR2, PHA2, ERJ5, VPS30, IMD2, PES4, EMI1, YPR085C, YBR200W-A, FMP40, REH1, SGT1, CPS1, YOP1, TRR2, STS1, VPH1, SWA2, YGR026W, CDC53, FMP52, YDR119W, RNQ1, SAG1, RPS20, TRM82, VPS1, YIP5, YPR1, ENT2, YPT31, PRX1, YHL039W, YHI9, BUD32, YLR361C-A, APL2, PTP3, YMR114C, LSC2, ATG10, SRP54, ENT3, RPL3, TYR1, NAT1, YNR021W, EBS1, HBT1, RPL15A, RPL41B, RPP2B, CBR1, BNA4, PRC1, DIT1, RPS28A, ASP3-1, IDP1, SCW4, VMA2, ALY2, NAT5.

Examples of terminator regions with a relative expression intensity of 1.3 or more include PUP1, SFB2, YCK2, ODC1, FMP42, VPS24, YKL098W, YSY6, RTG2, LYS9, UTR1, HRR25, YBR261C, RPS26A, KTR5, CHL1, MNN10, GLE2, CPD1, SNZ1, PAM17, HIR2, CDC28, YDR061W, ENA5, APM3, YLR118C, AVT1, PEP12, PET18, MAM1, DOA1, FPR2, PIB2, PRP21, TOP2, YBL044W, OST6, AIM24, IRC18, OSW1, COT1, YOR387C, SKP1, STM1, YDL176W, YLR137W, ALE1, PBP1, YNL200C, YBL029C-A, SPE3, RRD2, CNN1, SPR6, PAN3, YRB1, YDL057W, YOR051C, POL4, ORC5, IMP2, ATG19, ARO8, YJL163C, SWI5, LSP1, TMA19, YET3, RAD26, MGA2, IME1, OXR1, GSF2, RPS18A, RUP1, YLR126C, KRE27, TVP23, INO1, ALG14, PUS5, VMA10, SPT16, YLL053C, CHC1, MSH6, SDS24, PTC4, PSP2, VBA2, TSR4, CPR4, DPP1, TFG1, ARN2, YGL230C, NBP1, YKL077W, MOB2, DYN3, UBC13, RFA3, SPG5, GYP5, YPI1, YDR179W-A, CHA1, TOS4, ADH1, SPO1, JJJ2, ADK1, SOK1, GOT1, TIR4, ERP2, SEN1, PHO81, ARF2, YOR227W, TVP38, YDL089W, ZDS2, GCD6, SUI2, VAC7, TAH11, CTR9, YKL100C, NUP188, GRE1, PHB2, BUD3, SMA1, RPL20B, NSP1, PPZ2, STO1, ETR1, SUL1, RPL6B, CPR5, YAL018C, ELP6, ACP1, SHR3, KAP120, YBR137W, IME2, SNF7, YCR023C, GIS2, YIP1, TFC3, CUE1, YLR283W, FUN12, BMH1, RIM1, YMC1, KIC1, NAR1, YBR184W, CAF4, CTK3, NUP157, PRY1, MFA1, POL2, YDL141W, STP3, IRC20, ZPS1, POP1, DUN1, SLY1, UTP6, TAL1, DIB1, PAC2, YNR029C, SPC72, RPC34, KTR7, KRR1, YBR062C, SSA4, VMA9, ATG22, NRD1, INH1, REF2, TSC13, UTP7, AIM15, ARC19, EHT1, YHL017W, NNF2, YPR027C, TGL3, PEX28, TEL1, PGM1, PAN1, HRD3, RPL26B, SDT1, YER128W, PSY3, VPS52, RPB4, AIM2, NUD1, RPS29B, PRO3, RPL32, PXA1, GID8, TRM3, SLX1, PEA2, UBR1, AIP1, RPS10A, CFD1, YOR114W, LEA1, MSN5, RPL6A, PTC2, YER071C, RAS2, ATG14, CDC11, RPS6B, URA6, RPN1, SFH5, YAP1801, FLR1, DDR48, YRA2, APN2, ELF1, YJL217W, YPR089W, GSP2, BUG1, PSE1, SUA5, GPM2, POS5, PRM5, TAF4, GIM5, BNR1, YPS7, HAL5, RPS27B, CAK1, PGA2, SSP2, PMR1, NUP85, LSB6, TMA17, TGL1, ASN2, SEI1, VMA7, MDR1, HBS1, PMT1, PHO2, YHR113W, SSO1, RET2, UBA1, ALD2, SEC28, SEH1, YMR144W, HOC1, PRT1, RPS19B, GCN2, SAP4, YLR179C, COQ6, LYS14, LSM12, YGL117W, RED1, VPS34, VTC3, BRF1, ARR2, VMA21, PSF1, SRL3, YDR379C-A, ALG12, RPS25A, SDS23, DGA1, YDR196C, LOC1, RPN2, ANB1, NAN1, STB2, CUE5, CDC8, SPHI1, GID7, UBC4, RPS22B, ACT1, RPS8A, YNR068C, FRS2, TAF8, THI4, RBK1, SET3, YNL305C, TPP1, MSO1, NSA1, YMR210W, ERG24, YMR31, MAK11, URB2, FAD1, AGC1, OM45, APD1, GSH2, SPT14, YGR210C, RPS11A, SWH1, ANT1, SAP30, HRT3, NSG1, BAT2, SOM1, IPP1, HIS2, RSE1, RTT101, CRG1, YJR096, IMH1, SPT7, MKT1, GTT3, PEX11, YDR374W-A, YPD1, DOS2, YEL023C, RPF1, BNA2, ATG27, RPL29, YPS6, RPL19B, YDR357C, ARO4, YBR096W, PEP8, RPL39, SCC4, HXT7, HSV2, APA2, TFC1, SEC53, PDR5, MUD2, RPL19A, TAF9, MXR1, RIX1, PKR1, CWC27, BFR1, YDR387C, UIP4, OST3, BUD6, GFA1, RPS0A, CRZ1, SLT2, SNC1, SEC5, PCL6, DAL5, MSB1, CSL4, COQ4, IAH1, YPL245W, PRI2, LOS1, SQS1, PBA1, YFR017C, HPA3, SCL1, YGR168C, SAP155, MON1, SGA1, MNI1, TFC8, FAB1, MED2, GCN3, PRE1, BBC1, GPA1, DIG2, IRS4, SXM1, SHU2, SRO7, GEF1, RPL24A, TMN2, RIB3, UBC9, MAL11, ARO10, LAC1, RCN1, MVB12, TBS1, CTL1, NTF2, BZZ1, HXT14, YGR125W, YNR062C, STE50, YLL056C, HIS3, CIN2, TCB3, NUM1, CPA1, PRP40, TRR1, TRP2, ADE16, EFT1, BET3, SUA7, RPS14A, FOL1, DPB4, VPS16, ANP1, YMR099C, VHS2, BMH2, ADH6, GSC2, DBR1, ADP1, CEG1, MBP1, FCP1, SRY1, YNL058C, AVO2, YMR196W, RPL35A, HIF1, YLR050C, YER187W, YOR186W, RAD57, ATH1, PEP7, YJL055W, YBR259W, UBX7, ILV6, SAM4, MRM1, PHO23, MYO4, BRE1, YFR032C, GAS4, MIP6, ERV46, YPR097W, PET10, HDA2, TRX2, MED4, SPO16, NSG2, GND2, PDB1, BDH1, NIT3, MUD1, ERG20, RPL18A, PAI3, TMA108, SAM50, SLY41, YDR461C-A, YMR265C, YJL132W, BLM10, SPO73, CWC15, ALO1, MAP1, YKR023W, PET130, YCS4, CWH41, ARP9, CHK1, PAM1, TAF10, ARA1, CGI121, YIL014C-A, CHS7, RPS21A, VMA13, NAT3, ARG2, DOG1, TMS1, PSF2, YHR126C, KAP104, DPS1, IRR1, YAL044W-A, RPL23B, YDR307W, RPL33A, NAB6, APA1, ALG6, MEX67, DAK1, ARC15, YOS1, GAD1, ECM22, CYS3, PBI2, YBR271W, GPI10, WBP1, ZRC1, FIG2, YOR262W, MSH3, IOC2, YGR201C, NAP1, KAE1, CHS1, GDE1, YTM1, YHR162W, TAD3, ALP1, TRM8, NMD2, YIM1, BCH1, RRP1, VCX1, UGA1, HOL1, GRX1, EMP24, YGR237C, FAP1, KTR2, PBP4, YER163C, RFS1, PTA11, MPD2, SGT2, IKI1, ECM29, REV3, TPD3, YDL124W, MUM2, YFR026C, PHS1, MLS1, POR1, PFD1, EGD2, GYP8, RPT2, TEX1, RPS5, TPK1, DOT5, LSB5, DMA1, BNA6, VAB2, AML1, SEC31, KIN1, STB4, GSP1, AAD4, MNN2, RPP1B, GUK1, MCK1, HSP31, SBP1, ZWF1, IST2, GPI16, CDC42, AHA1, UBP2, YNL115C, CCW14, YDL121C, MCA1, RPT4, ERP1, TMA7, WHI4, YDR131C, PDR1, TSR3, ATG11, DDP1, COQ2, RPP1A, PMP3, CRD1, PHO85, YGR017W, YIL055C, LAP3, YOR291W, GAS5, YKR043C, YIL083C, CHO2, ELP4, BIM1, CAM1, DAL82, UMP1, YBR241C, LTP1, PHO91, RPP0, YOR164C, TOM71, FAS2, FMP46, TMA22, YML131W, YCF1, OPI3, ROM1, IRC24, FYV6, ATG13, TRX3, ENP2, CEX1, VPS3, TRX1, DIT2, SEC4, GDH3, PRE9, UBP1, AYR1, NIT2, PDR17, TUB1, KEG1, CDC25, PIG2, NSE1, VPS2, YLR414C, CWH43, COG2, RCY1, VPS68, RPL7A, TAF14, SRB5, UPF3, YML096W, ARG81, NPR2, PSH1, TAF6, MCT1, SBH1, PBN1, VPS4, SRP68, SAY1, PEP1, CCT4, COQ10, RET3, SSE1, YSP3, ABZ1, PNS1, DPB3, YDL073W, ATM1, RBD2, YFR006W, DDI1, DCP1, SAS10, RMT2, FIG1, MUS81, UBI4, YBR285W, DDI1, RPS15, YPR170W-B, SRP1, PSK1, RAD4, PGD1, PMT4, ABF2, SEC24, URA10, CWC23, RPS11B, TPM1, YLR290C, TRM9, YAP1, UGP1, SPS2, PDR1, POM34, PNC1, STE11, GRH1, YMR018W, TRS33, HEF3, LAT1, BDS1, HMF1, PRP6, FSH3, SRB2, DUG1, ERD2, CDA2, RPS6A, HUT1, SHS1, IRA1, SSA3, ELP3, PRP46, CSM3, PEP4, YHC3, MDY2, RPL43A, HRQ1, YKL023W, DFM1, PCL8, SKG3, GPH1, NEJ1, URA4, GPX1, HOS2, YDR531W, PEP3, MAL31, YGR283C, HFD1, SPR28, SWP82, FUM1, CDA1, HOM6, NHX1, SNF6, ECI1, CDC10, MIS1, YIL165C, GTT1, PLP2, PFA4, RPL3, PRE3, MTD1, MNT2, ECM30, YNL208W, YCR024C-B, PCA1, HCS1, DCC1, FAR8, PPH22, DED81, GPM1, COF1, YGR042W, YPR148C, VPS55, JLP1, CAT2, GCN1, YGL231C, GUS1, YGR111W, VMA4, YDR056C, SCS2, NQM1, UFE1, COG1, PAA1, IRC22, KTR1, TYW1, SSB1, SVP26, ESC8, YNL010W, TIF1, EAF6, SHC1, KIN2, DCS2, RPS1B, URA5, DSD1, YJL218W, NPT1, SRO77, FMN1, CMD1, YTA6, RPL21A, ALG3, KRE2, PCL5, MDM34, PFS2, SNF12, BNA1, AIM29, SNU13, RNR4, MAP2, DCS1, RPN5, PDC2, DOP1, SPO74, PAP1, RPL24B, RPN8, FPR3, ERS1, CPR1, FIT3, HUG1, VPS5, PEX3, RPS29A, ERV29, CAF20, DOG2, RPL4A, YCP4, PBY1, FUS2, SNF2, SUI1, YMR262W, BUD8, TED1, TAH1, YCL048W-A, RPL41A, YDR374C, VMA8, YKR051W, YFL042C, ORM2, TAF12, APE3, YDR239C, ERV2, SHR5, YHR192W, YRB30, PHO88, WHI2, LYS1, RHO1, VPS27, VMA6, PAB1, YJR015W, SIR2, FAR1, CPT1, ECM15, ROK1, YFR018C, HYR1, POL1, CTS2, UBA4, SRP72, RTN2, HAP1, ARE2, RCK2, INM2, AFR1, YOS9, RTT103, RPS12, RNY1, PPA1, LEU3, ERG27, TMA29, UBX3, VPS15, RPT6, LDB18, YPL088W, RPL5, RVS167, TIR2, PHA2, ERJ5, VPS30, IMD2, PES4, EMI1, YPR085C, YBR200W-A, FMP40, REH1, SGT1, CPS1, YOP1, TRR2, STS1, VPH1, SWA2, YGR026W, CDC53, FMP52, YDR119W, RNQ1, SAG1, RPS20, TRM82, VPS1, YIP5, YPR1, ENT2, YPT31, PRX1, YHL039W, YHI9, BUD32, YLR361C-A, APL2, PTP3, YMR114C, LSC2, ATG10, SRP54, ENT3, RPL3, TYR1, NAT1, YNR021W, EBS1, HBT1, RPL15A, RPL41B, RPP2B, CBR1, BNA4, PRC1, DIT1, RPS28A, ASP3-1, IDP1, SCW4, VMA2, ALY2, and NAT5.

Examples of terminator regions with a relative expression intensity of 1.4 or more include ARR2, VMA21, PSF1, SRL3, YDR379C-A, ALG12, RPS25A, SDS23, DGA1, YDR196C, LOC1, RPN2, ANB1, NAN1, STB2, CUE5, CDC8, SPH1, GID7, UBC4, RPS22B, ACT1, RPS8A, YNR068C, FRS2, TAF8, THI4, RBK1, SET3, YNL305C, TPP1, MSO1, NSA1, YMR210W, ERG24, YMR31, MAK11, URB2, FAD1, AGC1, OM45, APD1, GSH2, SPT14, YGR210C, RPS11A, SWH1, ANT1, SAP30, HRT3, NSG1, BAT2, SOM1, IPP1, HIS2, RSE1, RTT100, CRG1, YJR096W, IMH1, SPT7, MKT1, GTT3, PEX11, YDR374W-A, YPD1, DOS2, YEL023C, RPF1, BNA2, ATG27, RPL29, YPS6, RPL19B, YDR357C, ARO4, YBR096W, PEP8, RPL39, SCC4, HXT7, HSV2, APA2, TFC1, SEC53, PDR5, MUD2, RPL19A, TAF9, MXR1, RIX1, PKR1, CWC27, BFR1, YDR387C, UIP4, OST3, BUD6, GFA1, RPS0A, CRZ1, SLT2, SNC1, SEC5, PCL6, DAL5, MSB1, CSL4, COQ4, IAH1, YPL245W, PRI2, LOS1, SQS1, PBA1, YFR017C, HPA3, SCL1, YGR168C, SAP155, MON1, SGA1, MNI1, TFC8, FAB1, MED2, GCN3, PRE1, BBC1, GPA1, DIG2, IRS4, SXM1, SHU2, SRO7, GEF1, RPL24A, TMN2, RIB3, UBC9, MAL11, ARO10, LAC1, RCN1, MVB2, TBS1, CTL1, NTF2, BZZ1, HXT14, YGR125W, YNR062C, STE50, YLL056C, HIS3, CIN2, TCB3, NUM1, CPA1, PRP40, TRR1, TRP2, ADE16, EFT1, BET3, SUA7, RPS4A, FOL1, DPB4, VPS16, ANP1, YMR099C, VHS2, BMH2, ADH6, GSC2, DBR1, ADP1, CEG1, MBP1, FCP1, SRY1, YNL058C, AVO2, YMR196W, RPL35A, HIF1, YLR050C, YER187W, YOR186W, RAD57, ATH1, PEP7, YJL055W, YBR259W, UBX7, ILV6, SAM4, MRM1, PHO23, MYO4, BRE1, YFR032C, GAS4, MIP6, ERV46, YPR097W, PET10, HDA2, TRX2, MED4, SPO16, NSG2, GND2, PDB1, BDH1, NIT3, MUD1, ERG20, RPL18A, PAI3, TMA108, SAM50, SLY41, YDR461C-A, YMR265C, YJL132W, BLM10, SPO73, CWC15, ALO1, MAP1, YKR023W, PET130, YCS4, CWH41, ARP9, CHK1, PAM1, TAF10, ARA1, CGI121, YIL014C-A, CHS7, RPS21A, VMA13, NAT3, ARG2, DOG1, TMS1, PSF2, YHR126C, KAP104, DPS1, IRR1, YAL044W-A, RPL23B, YDR307W, RPL33A, NAB6, APA1, ALG6, MEX67, DAK1, ARC15, YOS1, GAD1, ECM22, CYS3, PBI2, YBR271W, GPI10, WBP1, ZRC1, FIG2, YOR262W, MSH3, IOC2, YGR201C, NAP1, KAE1, CHS1, GDE1, YTM1, YHR162W, TAD3, ALP1, TRM8, NMD2, YIM1, BCH1, RRP1, VCX1, UGA1, HOL1, GRX1, EMP24, YGR237C, FAP1, KTR2, PBP4, YER163C, RFS1, PTA1, MPD2, SGT2, IKI1, ECM29, REV3, TPD3, YDL124W, MUM2, YFR026C, PHS1, MLS1, POR1, PFD1, EGD2, GYP8, RPT2, TEX1, RPS5, TPK1, DOT5, LSB5, DMA1, BNA6, VAB2, AML1, SEC31, KIN1, STB4, GSP1, AAD4, MNN2, RPP1B, GUK1, MCK1, HSP31, SBP1, ZWF1, IST2, GPI16, CDC42, AHA1, UBP2, YNL115C, CCW14, YDL121C, MCA1, RPT4, ERP1, TMA7, WHI4, YDR131C, PDR1, TSR3, ATG11, DDP1, COQ2, RPP1A, PMP3, CRD1, PHO85, YGR017W, YIL055C, LAP3, YOR291W, GAS5, YKR043C, YIL083C, CHO2, ELP4, BIM1, CAM1, DAL82, UMP1, YBR241C, LTP1, PHO91, RPP0, YOR164C, TOM71, FAS2, FMP46, TMA22, YML131W, YCF1, OPI3, ROM1, IRC24, FYV6, ATG13, TRX3, ENP2, CEX1, VPS3, TRX1, DIT2, SEC4, GDH3, PRE9, UBP1, AYR1, NIT2, PDR17, TUB1, KEG1, CDC25, PIG2, NSE1, VPS25, YLR414C, CWH43, COG2, RCY1, VPS68, RPL7A, TAF14, SRB5, UPF3, YML096W, ARG81, NPR2, PSH1, TAF6, MCT1, SBH1, PBN1, VPS45, SRP68, SAY1, PEP1, CCT4, COQ10, RET3, SSE1, YSP3, ABZ1, PNS1, DPB3, YDL073W, ATM1, RBD2, YFR006W, DDI1, DCP1, SAS10, RMT2, FIG1, MUS81, UBI4, YBR285W, DLD1, RPS15, YPR170W-B, SRP1, PSK1, RAD4, PGD1, PMT4, ABF2, SEC24, URA10, CWC23, RPS11B, TPM1, YLR290C, TRM9, YAP1, UGP1, SPS2, PDR10, POM34, PNC1, STE11, GRH1, YMR018, TRS33, HEF3, LAT1, BDS1, HMF1, PRP6, FSH3, SRB2, DUG1, ERD2, CDA2, RPS6A, HUT1, SHS1, IRA1, SSA3, ELP3, PRP46, CSM3, PEP4, YHC3, MDY2, RPL43A, HRQ1, YKL023W, DFM1, PCL8, SKG3, GPH1, NEJ1, URA4, GPX1, HOS2, YDR531W, PEP3, MAL31, YGR283C, HFD1, SPR28, SWP82, FUM1, CDA1, HOM6, NHX1, SNF6, ECI1, CDC10, MIS1, YIL165C, GTT1, PLP2, PFA4, RPL30, PRE3, MTD1, MNT2, ECM30, YNL208W, YCR024C-B, PCA1, HCS1, DCC1, FAR8, PPH22, DED81, GPM1, COF1, YGR042W, YPR148C, VPS55, JLP1, CAT2, GCN1, YGL231C, GUS1, YGR111W, VMA4, YDR056C, SCS2, NQM1, UFE1, COG1, PAA1, IRC22, KTR1, TYW1, SSB1, SVP26, ESC8, YNL010W, TIF1, EAF6, SHC1, KIN2, DCS2, RPS1B, URA5, DSD1, YJL218W, NPT1, SRO77, FMN1, CMD1, YTA6, RPL21A, ALG3, KRE2, PCL5, MDM34, PFS2, SNF12, BNA1, AIM29, SNU3, RNR4, MAP2, DCS1, RPN5, PDC2, DOP1, SPO74, PAP1, RPL24B, RPN8, FPR3, ERS1, CPR1, FIT3, HUG1, VPS5, PEX3, RPS29A, ERV29, CAF20, DOG2, RPL4A, YCP4, PBY1, FUS2, SNF2, SUI1, YMR262W, BUD8, TED1, TAH11, YCL048W-A, RPL41A, YDR374C, VMA8, YKR051W, YFL042C, ORM2, TAF12, APE3, YDR239C, ERV2, SHR5, YHR192W, YRB30, PHO88, WHI2, LYS1, RHO1, VPS27, VMA6, PAB1, YJR015W, SIR2, FAR1, CPT1, ECM15, ROK1, YFR018C, HYR1, POL1, CTS2, UBA4, SRP72, RTN2, HAP1, ARE2, RCK2, INM2, AFR1, YOS9, RTT103, RPS12, RNY1, PPA1, LEU3, ERG27, TMA29, UBX3, VPS15, RPT6, LDB18, YPL088W, RPL5, RVS167, TIR2, PHA2, ERJ5, VPS30, IMD2, PES4, EMI1, YPR085C, YBR200W-A, FMP40, REH1, SGT1, CPS1, YOP1, TRR2, STS1, VPH1, SWA2, YGR026W, CDC53, FMP52, YDR119W, RNQ1, SAG1, RPS20, TRM82, VPS1, YIP5, YPR1, ENT2, YPT31, PRX1, YHL039W, YHI9, BUD32, YLR361C-A, APL2, PTP3, YMR114C, LSC2, ATG10, SRP54, ENT3, RPL3, TYR1, NAT1, YNR021W, EBS1, HBT1, RPL15A, RPL41B, RPP2B, CBR1, BNA4, PRC1, DIT1, RPS28A, ASP3-1, IDP1, SCW4, VMA2, ALY2, and NAT5.

Examples of terminator regions with a relative expression intensity of 1.5 or more include ERG20, RPL18A, PAI3, TMA108, SAM50, SLY41, YDR461C-A, YMR265C, YJL132W, BLM1, SPO73, CWC15, ALO1, MAP1, YKR023W, PET30, YCS4, CWH41, ARP9, CHK1, PAM1, TAF10, ARA1, CGI121, YIL014C-A, CHS7, RPS21A, VMA13, NAT3, ARG2, DOG1, TMS1, PSF2, YHR126C, KAP104, DPS1, IRR1, YAL044W-A, RPL23B, YDR307W, RPL33A, NAB6, APA1, ALG6, MEX67, DAK1, ARC15, YOS1, GAD1, ECM22, CYS3, PBI2, YBR271W, GPI10, WBP1, ZRC1, FIG2, YOR262W, MSH3, IOC2, YGR201C, NAP1, KAE1, CHS1, GDE1, YTM1, YHR162W, TAD3, ALP1, TRM8, NMD2, YIM1, BCH1, RRP1, VCX1, UGA1, HOL1, GRX1, EMP24, YGR237C, FAP1, KTR2, PBP4, YER163C, RFS1, PTA1, MPD2, SGT2, IKI1, ECM29, REV3, TPD3, YDL124W, MUM2, YFR026C, PHS1, MLS1, POR1, PFD1, EGD2, GYP8, RPT2, TEX1, RPS5, TPK1, DOT5, LSB5, DMA1, BNA6, VAB2, AML1, SEC31, KIN1, STB4, GSP1, AAD4, MNN2, RPP1B, GUK1, MCK1, HSP31, SBP1, ZWF1, IST2, GPI16, CDC42, AHA1, UBP2, YNL115C, CCW14, YDL121C, MCA1, RPT4, ERP1, TMA7, WHI4, YDR131C, PDR1, TSR3, ATG11, DDP1, COQ2, RPP1A, PMP3, CRD1, PHO8, YGR017W, YJL055C, LAP3, YOR291W, GAS5, YKR043C, YIL083C, CHO2, ELP4, BIM1, CAM1, DAL82, UMP1, YBR241C, LTP1, PHO91, RPP0, YOR164C, TOM71, FAS2, FMP46, TMA22, YML131W, YCF1, OPI3, ROM1, IRC24, FYV6, ATG13, TRX3, ENP2, CEX1, VPS3, TRX1, DIT2, SEC4, GDH3, PRE9, UBP1, AYR1, NIT2, PDR17, TUB1, KEG1, CDC25, PIG2, NSE1, VPS25, YLR414C, CWH43, COG2, RCY1, VPS68, RPL7A, TAF14, SRB5, UPF3, YML096W, ARG8), NPR2, PSH1, TAF6, MCT1, SBH1, PBN1, VPS45, SRP68, SAY1, PEP1, CCT4, COQ10, RET3, SSE1, YSP3, ABZ1, PNS1, DPB3, YDL073W, ATM1, RBD2, YFR006W, DDI1, DCP1, SAS10, RMT2, FIG1, MUS81, UBI4, YBR285W, DLD1, RPS1, YPR170W-B, SRP1, PSK1, RAD4, PGD1, PMT4, ABF2, SEC24, URA10, CWC23, RPS11B, TPM1, YLR290C, TRM9, YAP1, UGP1, SPS2, PDR1, POM34, PNC1, STE11, GRH1, YMR018W, TRS33, HEF3, LAT1, BDS1, HMF1, PRP6, FSH3, SRB2, DUG1, ERD2, CDA2, RPS6A, HUT1, SHS1, IRA1, SSA3, ELP3, PRP46, CSM3, PEP4, YHC3, MDY2, RPL43A, HRQ1, YKL023W, DFM1, PCL8, SKG3, GPH1, NEJ1, URA4, GPX1, HOS2, YDR531W, PEP3, MAL31, YGR283C, HFD1, SPR28, SWP82, FUM1, CDA1, HOM6, NHX1, SNF6, ECI1, CDC1, MIS1, YIL165C, GTT1, PLP2, PFA4, RPL30, PRE3, MTD1, MNT2, ECM3, YML208W, YCR024C-B, PCA1, HCS1, DCC1, FAR8, PPH22, DED81, GPM1, COF1, YGR042W, YPR148C, VPS5, JLP1, CAT2, GCN1, YGL231C, GUS1, YGP111W, VMA4, YDR056C, SCS2, NQM1, UFE1, COG1, PAA1, IRC22, KTR1, TYW1, SSB1, SVP26, ESC8, YNL010W, TIF1, EAF6, SHC1, KIN2, DCS2, RPS1B, URA45, DSD1, YJL218W, NPT1, SRO77, FMN1, CMD1, YTA6, RPL21A, ALG3, KRE2, PCL5, MDM34, PFS2, SNF12, BNA1, AIM29, SNU13, RNR4, MAP2, DCS1, RPN5, PDC2, DOP1, SPO74, PAP1, RPL24B, RPN8, FPR3, ERS1, CPR1, FIT1, HUG1, VPS5, PEX3, RPS29A, ERV29, CAF20, DOG2, RPL4A, YCP4, PBY1, FUS2, SNF2, SUI1, YMR262W, BUD8, TED1, TAH1, YCL048W-A, RPL41A, YDR374C, VMA8, YKR051W, YFL042C, ORM2, TAF12, APE3, YDR239C, ERV2, SHR5, YHR192W, YRB3, PHO88, WHI2, LYS1, RHO1, VPS27, VMA6, PAB1, YJR015W, SIR2, FAR1, CPT1, ECM1, ROK1, YFR018C, HYR1, POL1, CTS2, UBA4, SRP72, RTN2, HAP1, ARE2, RCK2, INM2, AFR1, YOS9, RTT103, RPS12, RNY1, PPA1, LEU3, ERG27, TMA29, UBX3, VPS15, RPT6, LDB18, YPL088W, RPL5, RVS167, TIR2, PHA2, ERJ5, VPS3, IMD2, PES4, EMI1, YPR085C, YBR200W-A, FMP40, REH1, SGT1, CPS1, YOP1, TRR2, STS1, VPH1, SWA2, YGR026W, CDC53, FMP52, YDR119W, RNQ1, SAG1, RPS20, TRM82, VPS1, YIP5, YPR1, ENT2, YPT31, PRX1, YHL039W, YHI9, BUD32, YLR361C-A, APL2, PTP3, YMR114C, LSC2, ATG10, SRP54, ENT3, RPL3, TYR1, NAT1, YNR021W, EBS1, HBT1, RPL15A, RPL4), RPP2B, CBR1, BNA4, PRC1, DIT1, RPS28A, ASP3-1, IDP1, SCW4, VMA2, ALY2, and NAT5.

Examples of terminator regions with a relative expression intensity of 1.6 or more include SRB5, UPF3, YML096W, ARG81, NPR2, PSH1, TAF6, MCT1, SBH1, PBN1, VPS45, SRP68, SAY1, PEP1, CCT4, COQ10, RET3, SSE1, YSP3, ABZ1, PNS1, DPB3, YDL073W, ATM1, RBD2, YFR006W, DDI1, DCP1, SAS10, RMT2, FIG1, MUS81, UBI4, YBR285W, DLD1, RPS15, YPR170W-B, SRP1, PSK1, RAD4, PGD1, PMT4, ABF2, SEC24, URA10, CWC23, RPS11B, TPM1, YLR290C, TRM9, YAP1, UGP1, SPS2, PDR10, POM34, PNC1, STE11, GRH1, YMR018W, TRS33, HEF3, LAT1, BDS1, HMF1, PRP6, FSH3, SRB2, DUG1, ERD2, CDA2, RPS6A, HUT1, SHS1, IRA1, SSA3, ELP3, PRP46, CSM3, PEP4, YHC3, MDY2, RPL43A, HRQ1, YKL023W, DFM1, PCL8, SKG3, GPH1, NEJ1, URA4, GPX1, HOS2, YDR531W, PEP3, MAL31, YGR283C, HFD1, SPR28, SWP82, FUM1, CDA1, HOM6, NHX1, SNF6, ECI1, CDC10, MIS1, YIL165C, GTT7, PLP2, PFA4, RPL30, PRE3, MTD1, MNT2, ECM30, YNL208W, YCR024C-B, PCA1, HCS1, DCC1, FAR8, PPH22, DED81, GPM1, COF1, YGR042W, YPR148C, VPS55, JLP1, CAT2, GCN1, YGL231C, GUS1, YGR111W, VMA4, YDR056C, SCS2, NQM1, UFE1, COG1, PAA1, IRC22, KTR1, TYW1, SSB1, SVP26, ESC8, YNL010W, TIF1, EAF6, SHC1, KIN2, DCS2, RPS1B, URA5, DSD1, YJL218W, NPT1, SRO77, FMN1, CMD1, YTA6, RPL21A, ALG3, KRE2, PCL5, MDM34, PFS2, SNF12, BNA1, AIM29, SNU13, RNR4, MAP2, DCS1, RPN5, PDC2, DOP1, SPO74, PAP1, RPL24B, RPN8, FPR3, ERS1, CPR1, FIT3, HUG1, VPS5, PFX3, RPS29A, ERV29, CAF20, DOG2, RPL4A, YCP4, PBY1, FUS2, SNF2, SUI1, YMR262W, BUD8, TED1, TAH1, YCL048W-A, RPL41A, YDR374C, VMA8, YKR051W, YFL042C, ORM2, TAF12, APE3, YDR239C, ERV2, SHR5, YHR192W, YRB30, PHO88, WHI2, LYS1, RHO1, VPS27, VMA6, PAB1, YJR015W, SIR2, FAR1, CPT1, ECM15, ROK1, YFR018C, HYR1, POL1, CTS2, UBA4, SRP72, RTN2, HAP1, ARE2, RCK2, INM2, AFR1, YOS9, RTT103, RPS12, RNY1, PPA1, LEU3, ERG27, TMA29, UBX3, VPS15, RPT6, LDB18, YPL088W, RPL5, RVS167, TIR2, PHA2, ERJ5, VPS30, IMD2, PES4, EMI1, YPR085C, YBR200W-A, FMP40, REH1, SGT1, CPS1, YOP1, TRR2, STS1, VPH1, SWA2, YGR026W, CDC53, FMP52, YDR119W, RNQ1, SAG1, RPS20, TRM82, VPS1, YIP5, YPR1, ENT2, YPT31, PRX1, YHL039W, YHI9, BUD32, YLR361C-A, APL2, PTP3, YMR114C, LSC2, ATG10, SRP54, ENT3, RPL3, TYR1, NAT1, YNR021W, EBS1, HBT1, RPL25A, RPL411B, RPP2B, CBR1, BNA4, PRC1, DIT1, RPS28A, ASP3-1, IDP1, SCW4, VMA2, ALY2, and NAT5.

Examples of terminator regions with a relative expression intensity of 1.7 or more include DCC1, FAR8, PPH22, DED81, GPM1, COF1, YGR042W, YPR148C, VPS55, JLP1, CAT2, GCN1, YGL231C, GUS1, YGR111W, VMA4, YDR056C, SCS2, NQM1, UFE1, COG1, PAA1, IRC22, KTR1, TYW1, SSB1, SVP26, ESC8, YNL010W, TIF1, EAF6, SHC1, KIN2, DCS2, RPS1B, URA5, DSD1, YJL218W, NPT1, SRO77, FMN1, CMD1, YTA6, RPL21A, ALG3, KRE2, PCL5, MDM34, PFS2, SNF2, BNA1, AIM29, SNU13, RNR4, MAP2, DCS1, RPN5, PDC2, DOP1, SPO74, PAP1, RPL24B, RPN8, FPR3, ERS1, CPR1, FIT3, HUG1, VPS5, PEX3, RPS29A, ERV29, CAF20, DOG2, RPL4A, YCP4, PBY1, FUS2, SNF2, SUI1, YMR262W, BUD8, TED1, TAH1, YCL048W-A, RPL41A, YDR374C, VMA8, YKR051W, YFL042C, ORM2, TAF12, APE3, YDR239C, ERV2, SHR5, YHR192W, YRB30, PHO88, WHI2, LYS1, RHO1, VPS27, VMA6, PAB1, YJR015, SIR2, FAR1, CPT1, ECM15, ROK1, YFR018C, HYR1, POL1, CTS2, UBA4, SRP72, RTN2, HAP1, ARE2, RCK2, INM2, AFR1, YOS9, RTT103, RPS12, RNY1, PPA1, LEU3, ERG27, TMA29, UBX3, VPS15, RPT6, LDB18, YPL088W, RPL5, RVS167, TIR2, PHA2, ERJ5, VPS30, IMD2, PES4, EMI1, YPR085C, YBR200W-A, FMP40, REH1, SGT1, CPS1, YOP1, TRR2, STS1, VPH1, SWA2, YGR026W, CDC53, FMP52, YDR119W, RNQ1, SAG1, RPS20, TRM82, VPS1, YIP5, YPR1, ENT2, YPT31, PRX1, YHL039W, YHI9, BUD32, YLR361C-A, APL2, PTP3, YMR114C, LSC2, ATG10, SRP54, ENT3, RPL3, TYR1, NAT1, YNR021W, EBS1, HBT1, RPL5A, RPL41B, RPP2B, CBR1, BNA4, PRC1, DIT1, RPS28A, ASP3-1, IDP1, SCW4, VMA2, ALY2, and NAT5.

Examples of terminator regions with a relative expression intensity of 1.8 or more include FUS2, SNF2, SUI1, YMR262W, BUD8, TED1, TAH1, YCL048W-A, RPL41A, YDR374C, VMA8, YKR051W, YFL042C, ORM2, TAF12, APE3, YDR239C, ERV2, SHR5, YHR192W, YRB30, PHO88, WHI2, LYS1, RHO1, VPS27, VMA6, PAB1, YJR015W, SIR2, FAR1, CPT1, ECM15, ROK1, YFR018C, HYR1, POL1, CTS2, UBA4, SRP72, RTN2, HAP1, ARE2, RCK2, INM2, AFR1, YOS9, RTT103, RPS12, RNY1, PPA1, LEU3, ERG27, TMA29, UBX3, VPS15, RPT6, LDB18, YPL088W, RPL5, RVS167, TIR2, PHA2, ERJ5, VPS30, IMD2, PES4, EMI1, YPR085C, YBR200W-A, FMP40, REH1, SGT1, CPS1, YOP1, TRR2, STS1, VPH1, SWA2, YGR026W, CDC53, FMP52, YDR119W, RNQ1, SAG1, RPS20, TRM82, VPS1, YIP5, YPR1, ENT2, YPT31, PRX1, YHL039W, YHI9, BUD32, YLR361C-A, APL2, PTP3, YMR114C, LSC2, ATG10, SRP54, ENT3, RPL3, TYR1, NAT1, YNR021W, EBS1, HBT1, RPL15A, RPL41B, RPP2B, CBR1, BNA4, PRC1, DIT1, RPS28A, ASP3-1, IDP1, SCW4, VMA2, ALY2, and NAT5.

Examples of terminator regions with a relative expression intensity of 1.9 or more include ERG27, TMA29, UBX3, VPS15, RPT6, LDB18, YPL088W, RPL5, RVS167, TIR2, PHA2, ERJ5, VPS30, IMD2, PES4, EMI1, YPR085C, YBR200W-A, FMP40, REH1, SGT1, CPS1, YOP1, TRR2, STS1, VPH1, SWA2, YGR026W, CDC53, FMP52, YDR119W, RNQ1, SAG1, RPS20, TRM82, VPS1, YIP5, YPR1, ENT2, YPT31, PRX1, YHL039W, YHI9, BUD32, YLR361C-A, APL2, PTP3, YMR114C, LSC2, ATG10, SRP54, ENT3, RPL3, TYR1, NAT1, YNR021W, EBS1, HBT1, RPL15A, RPL41B, RPP2B, CBR1, BNA4, PRC1, DIT11, RPS28A, ASP3-1, IDP1, SCW4, VMA2, ALY2, and NAT5.

Examples of terminator regions with a relative expression intensity of 2.0 or more include RNQ1, SAG1, RPS20, TRM82, VPS1, YIP5, YPR1, ENT2, YPT31, PRX1, YHL039W, YHI9, BUD32, YLR361C-A, APL2, PTP3, YMR114C, LSC2, ATG10, SRP54, ENT3, RPL3, TYR1, NAT1, YNR021W, EBS1, HBT1, RPL15A, RPL41B, RPP2B, CBR1, BNA4, PRC1, DIT1, RPS28A, ASP3-1, IDP1, SCW4, VMA2, ALY2, and NAT5.

Other examples include YHI9, BUD32, YLR361C-A, APL2, PTP3, YMR114C, LSC2, ATG10, SRP54, ENT3, RPL3, TYR1, NAT1, YNR021W, EBS1, HBT1, RPL15A, RPL41B, RPP2B, CBR1, BNA4, PRC1, DIT1, RPS28A, ASP3-1, IDP1, SCW4, VMA2, ALY2, and NAT5.

Moreover, RPL41B, RPL15A, DIT1, RPL3, IDP1, YHI9, YHL039W, PPA1, PRC1, VMA2, NAT5, RPS28A, NAT1, CDC53, EBS1, YMR114C, LSC2, ALY2, BNA4, YIP5, ATG10, CBR1, ASP3-1, SRP54, YNR021W, YDR119W, YLR361C-A, YPT31, BUD32 and APL2 are also desirable. Strong terminator activity can be obtained more reliably with these 30 terminator regions. RPL41B, RPL115A, DIT1, RPL3 and IDP1 are especially desirable. Strong terminator activity can be obtained even more reliably with these terminator regions. That is, strong terminator activity can be obtained with a high degree of reliability under different culture conditions, under salt stress and osmotic stress, and in different hosts. Of these, terminator regions of DIT1, RPL41B and RPL3 can provide strong terminator activity even under different culture conditions for example. Moreover, terminator regions of RPL41B and IDP1 can provide strong terminator activity even under salt stress because they are resistant to salt stress from the medium. In addition, terminator regions of DIT1 and RPL41B can provide strong terminator activity even under osmotic stress because they are resistant to osmotic stress. DIT1 terminator region in particular can provide strong terminator activity regardless of the host for example.

When the aim is to suppress the expression activity of an arbitrary gene (which may be an endogenous gene or an exogenous gene in a yeast), on the other hand, a terminator region exhibiting low expression intensity can be used based on the aforementioned expression intensity data. A relative intensity of no more than 0.8 or preferably no more than 0.7 or more preferably no more than 0.6 or still more preferably no more than 0.5 or yet more preferably no more than 0.4 is desirable, and no more than 0.3 or preferably no more than 0.2 is more desirable, while no more than 0.1 is most desirable.

Examples of terminator regions with a relative expression intensity of no more than 0.8 include ORC4, ICY2, GIC1, HLR1, ECM13, YLR108C, AQR1, YHR213W-A, SUT1, PLB3, AIM26, TPO4, YPR153W, GIS3, WSC3, FUR4, DLT1, MOT1, YNR063W, MET13, YDL156W, YJL107C, YJR154W, YNL042W-B, VHS1, GPI19, YIL057C, STD1, CTF19, RAD34, YIR021W-A, FZF1, YHK8, YGL188C-A, HCM1, CDC6, YPR157W, CLB6, YOX1, YLR285C-A, YDR114C, YHR199C-A, MPS3, MUP3, YIR014W, AAR2, YPT35, AIM33, SCW11, BDF1, YCL042W, BSC4, YGL193C, NUT2, YJL118W, YKL069W, SRB8, YOR060C, MDH2, YPR116W, YPK2, GLN3, YDL211C, RAD55, CYM1, ENT4, ULA1, YMR182W-A, YKR017C, YOR302W, YOR072W-B, VTS1, FYV12, YGL235W, YHR086W-A, YEL067C, YPL257W, UBA3, YMR105W-A, YOR316C-A, TMA10, YDL159W-A, ATG29, YML037C, NSL1, YJL077W-B, POP3, WHI5, MIH1, YGR240C-A, YRM1, KAR9, YJU2, SPC24, DPB2, CHL4, YMR087W, CSI1, YIL134C-A, BUR2, PTH1, SSN8, AUA1, YLR154C-G, YLR342W-A, YCL001W-A, FLC1, YLL006W-A, VAM7, YPL077C, CCZ1, PRP28, ACM1, IME4, YPR096C, FRE5, PDR8, ILV5, YIL161W, PAC11, UBR2, YRB2, YLR125W, YMR253C, DSE4, EPL1, SNP1, YMR160W, SPO77, BUB1, YFR016C, SPC97, GEM1, INO2, SPT10, YLR132C, AIM45, YJR054W, MBF1, YAL064C-A, YML054C-A, NUP1, ECM27, YIL060W, IRE1, YHR177W, YJR079W, YNL187W, YML003W, PIH1, YDR169C-A, PET111, YDL109C, YOR012W, YHR050W-A, TAR1, RIM9, YCR095W-A, RPR2, COS7, YDR049W, CUS1, JJJ3, COS10, MET1, HXT8, GLY1, SUR1, RTG1, PHM7, YJL052C-A, HXT117, YFL052W, ATG1, ECM2, YNR075C-A, YKR041W, ALD5, YHL018W, LUC7, YPS5, YLR297W, SNA4, BIO4, YBR298C-A, ECM12, SEF1, YMR247W-A, EXO1, CTF13, HUR1, SNO3, BSC5, YER175W-A, PGA1, YLR173W, YDR119W-A, IRC15, MGA1, YPR174C, IML3, YLL054C, RDS1, MDM32, PET494, YPR036W-A, GTB1, ISF1, KRE29, SAP190, YHR214C-E, GTO3, YOR365C, MIP1, SIP5, YPL191C, YPL162C, YMR291W, BRN1, MDM1, NAT4, YLR406C-A, YME1, CSI2, YOR008C-A, CEF1, BUD25, DFG16, GPB1, KAR1, PPM2, DSS1, RPC37, VID24, ERV41, YGR169C-A, ECM8, YHR032W, ELA1, PEX29, LTE1, HA 72, SLI1, MUP1, ALG13, FRE7, YMR147W, ISU2, YOR1, JID1, ECM3, ATG5, MED6, YPL014W, YLR030W, AQY2, CCT2, YER067W, NRG1, SPT8, PIR1, YGR068C, YER039C-A, ELM1, ASE1, YBL095W, YNR066C, MTL1, CNE1, CAX4, NDI1, FLX1, YNL130C-A, CWC2, YNL254C, CDC13, ATP10, OCT1, ALF1, YEF1, BAP2, HTL1, PDC5, PKP1, SSK2, CAF120, SKN1, HHF1, CDC39, YFR012W, YEL048C, HAP4, PEX7, TPO1, NFT1, NGL3, YMR206W, DUS3, YAP7, CUS2, YLR415C, FUI1, SLM5, BTT1, YFR035C, RRN10, HAP3, SSY5, SFL1, KIP1, CDC15, GLT1, DOC1, MND1, AAC1, CEP3, UBC5, YNL213C, CLN3, CSF1, ECM18, MRS4, YIL046W-A, INP1, RTT105, MPT5, ATG15, RNH202, TAX4, IZH3, BDF2, COX14, YIP4, YJR120W, SAE2, YMC2, YGR035C, NDD1, HPA2, STL1, GPM3, ERF2, MMS21, YJL133C-A, YNL024C, IFH1, LIN1, ICS3, YNR014W, SPE1, YNL211C, SOL1, COS111, HSH155, NKP2, NAB3, FMT1, YPL152W-A, BOR1, SPC25, MMS1, YJL166C, MAL13, BFA1, AEP3, MTH1, YGR031W, BIT61, YMR230W-A, SKT5, YGL258W-A, PHR1, HTB2, SER1, BAP3, YER053C-A, ATG16, BIO2, MEP3, YNR073C, PCH2, APS2, MDM30, CLB5, ISR1, MRP20, GUD1, MED1, RER2, MCM10, YIR018C-A, SPO14, NUC1, MNN4, IFM1, YLR412C-A, ALT2, NNF1, YKL096C-B, RAD51, CIT2, SPT4, LRC4, USE1, YLR455W, YOL164W-A, PRP18, COA2, HSP82, YER184C, DAD2, LEU1, YDL129W, YPL119C-A, YOR034C-A, PRP38, MSA1, YBR147W, BBP1, MLH1, SWC3, SOH1, HHF2, NIP1, MSL1, RLF2, SPG1, WHI3, HTA1, ARR3, YIL077C, SGF29, RAD53, YEL073C, YNR065C, NCA3, YBR296C-A, ECM23, YLR225C, SLD3, YBR197C, YBL059W, YOL075C, DNA2, SIZ1, REC114, MSN1, RGT2, CBF1, YGL176C, PTP2, GAL3, VPS62, HMS2, SMF3, APL1, SKI3, MNS1, YOR214C, TID3, KSS1, YDR194W-A, UPC2, ARG80, MRS2, ATP23, YML100W-A, YGL101W, STE12, RPI1, YDR090C, YEH1, UTP13, AMN1, YIL089W, AVL9, ATO2, HEM3, RPA14, GIP3, YGR053C, ALR2, YAP5, CDD1, SLS1, MET6, ABM1, PET20, CBP1, RAD10, SPO22, PIB1, EAF3, YFR032C-B, ELP2, YIA6, PET112, PAU7, MEI4, YEA4, SGS1, JEN1, CLB2, GIC2, SWI6, ELP2, KIN28, YKL033W, CSM4, YNL095C, RRN3, RNR1, TPO3, SUP45, ABP140, RPS28B, MRF1, GLN1, OPT1, PHO4, UBP10, YOL163W, MDS3, OTU1, GAT1, HDA3, MSY1, GNP1, YFL041W-A, YPL141C, MPH2, PMA1, YNL260C, SKI1, YDL177C, SWR1, RMD5, RPL9B, MIC14, AOS1, LAG1, ROX1, PCL10, MRPL3, YER152C, EAF1, HTB1, SPA2, SSN2, YJR129C, ATG8, RHR2, TFG2, YBL100W-C, CSM2, EXG1, STE7, ADH2, SNT2, PML39, SEC2, ASI2, MNT3, BUR6, BIO5, YDR506C, RDR1, MRPL33, YGL159A, RIM8, YGR161W-C, YIG1, PDR16, YDR249C, YDR124W, HSP30, SDH2, YER130C, FAA3, BUD22, TIM22, CBP6, ICE2, SPC110, AFT2, NAM2, YPR071W, DIP5, SDS3, POP4, OCA6, PTC6, YBR201C-A, YPR127W, SEC10, ASF2, SLI15, RRN7, ORC2, GUF1, GPI2, RPS9A, RAD6, PSR2, RIP1, GZF3, CAR1, YHR151C, LEU5, YBR182C-A, IRC7, ASG7, YOR381W-A, OCA5, YHR035W, PET117, ISD11, HSP150, CCC2, YHR131C, MRK1, RXT2, PPH3, ODC2, SHE9, YCR075W-A, CYB5, YDR415C, LRO1, SOF1, YNL162W-A, PAU14, MTO1, YKL061W, MSS11, SAN1, SET2, YMR1, PHD1, YBL071C-B, MPA43, SAM37, AAT1, ASH1, UTR2, CAT8, SLX8, RXT2, COY1, TAF3, DSS4, TOR1, YMR030W-A, PAU5, SFP1, FHL1, COX10, DDR2, SWM1, HXT6, RCR2, YLR091W, AMD9, SHQ1, YLR346C, SPT21, ARE1, KAP95, YGR071C, TRL1, ECM17, YML020W, RPO41, CFT1, LRC5, THI74, TPN1, YOR059C, PRY3, YEL1, CNM67, STB6, YOR385W, RRN6, COP1, PDR12, ELG1, SRP40, SRM1, YDR109C, AIM30, RPC17, YJL028W, YBR071W, APS1, KIP2, ATP22, PRM6, BUD31, IXR1, NFI1, YHL015W-A, VHS3, YNL295W, SML1, SSK1, YAE1, RIM2, YDR246W-A, YLR445W, SPT23, MTG2, SGF11, BRL1, YMR315W, MRPS28, ERG5, UTP30, MDM35, ASR1, YJL102C-A, USA1, DOT6, COX23, ADH5, DAN4, RMA1, SCT1, PHO84, SFG1, SLX4, EST1, YNL190W, SNL1, RRP1, YML082W, DOT1, PEX1, YUR1, YAP1802, YDR185C, GET2, YPL264C, YDR065W, YJR115W, MAK21, YER064C, ATR1, IDP2, KCS1, ZPR1, ITC1, OAZ1, SWC7, RPL8A, CAC2, VTH1, OCH1, BUL1, YNR004W, LST7, MRPS8, TIS11, NDC1, TOS8, ISM1, MSL5, FMP43, YJR098C, COQ3, TPC1, RIM101, ADR1, ALD6, YHR087W, VPS21, POG1, YJR005C-A, SNT1, YHR022C, MEF1, PUP2, ERP6, HHT2, YGR146C, OAR1, YOR129C, YCR045C, DBP7, MUB1, YPL236C, RIB2, YPR084W, AIM5, UTR5, HKR1, YMR010W, ALR1, LRE1, RPN4, YLR363W-A, MGM1, HTD2, NAM8, SED5, YOR161C-C, YML018C, NAB2, YER140W, PRM4, RTR1, YIR042C, THI8, FUN19, DMR1, SIP1, CGR1, MTR3, YJL144W, RIM13, SAL1, MET28, INM1, VID27, CDC34, SRO9, RRP9, YOL087C, MCM22, YMR111C, NDJ1, ATG12, MSM1, SRS2, YBR225W, YLR063W, AI1, CDC36, ASN1, MET31, SSP1, NGG1, RBA50, PUT1, YPT53, NMA2, YBR219C, CDC40, SGO1, YJL047C-A, RPC31, INP52, UGO1, RAD30, CLB1, GLO4, TPK3, GIM3, CDC9, PFX27, AIM32, YGL081W, DJP1, HMS1, JSN1, UBP12, RSM2, UBP5, GIP1, PUT3, CKI1, FAR7, LAG2, DAM1, PSD2, HMT1, COR1, MMR1, MRPL39, CTF8, AGP2, PRM7, HIT1, HAL9, GPA2, TIM44, TFB1, ECM19, MRPL32, YBR284W, NAS2, SBE22, YOR011W-A, ORT1, MRPL2, QNQ1, APC4, TYE7, YPP1, MMT1, MRP10, MRPS5, LIP5, CDC27, ESC2, CAN1, MEC1, TOP1, SLM3, SIP4, URN1, YCK3, USO1, RSM19, ASG1, ISU1, YHL008C, YNL313C, KKQ8, FCY2, GPD1, HHT1, MDJ2, SDH1, SSF1, PIP2, STE13, AZF1, VPS35, YGL146C, TAM41, MIF2, YDL118W, HFM1, PRR1, MRE11, FMP37, MLH2, BUD5, YOR342C, PCL1, DHR2, CDC5, CBP3, RLP24, LSG1, NCL1, YDR262W, PGA3, MID2, YJL027C, YOR305W, QCR6, MSC6, RSC4, PAU18, POL12, SME1, DBF2, RPS27A, NHP6A, YGK3, SLO1, AIM36, UBP13, TRI1, CTH1, PGS1, NMD4, YIL064W, BAR1, BCS1, YBL029W, CTR1, MRPL20, AGP3, YOR338W, FCF2, YOR052C, YJL147C, RSA1, PEX8, YOL159C, RRP45, YDL199C, LIA1, THI2, TRZ1, CYT12, MGM101, YNL277W-A, ARP8, MRPL36, YAR028W, PAU2, SLD5, SMD1, YNL086W, QCR7, FMC1, HOS4, HEM11, NAM7, YPL108W, BUD14, BOI2, HRD1, YOL114C, RIS1, SIC1, BST1, KES1, MET4, TRS120, SYC1, NPA3, YLH47, SRL2, LRC3, MHR1, ZIP2, EAR1, RSF1, RIO2, MET2, NOP4, SRD1, PWP2, MST1, PCK1, CDC7, TOK1, PRO1, RAX2, LSM7, SHG1, TOM7, DAS2, SIP2, RRS1, EUG1, POX1, RAD61, SUN4, HAA1, YNR048W, ACO2, YOL047C, PMD1, FZO1, YEL025C, GPR1, BNI1, RSA4, YMR185W, PAU16, ECM7, YHP1, COG8, LST8, HST1, ESA1, YJL160C, MER1, CIN8, WSS1, PAT1, LRC6, FMP30, LYS21, MET18, MRPL50, GCR1, YOR022C, YJR012C, PDR3, YPL229W, SFK1, DUS4, IDS2, YOL036W, PHM6, YPR117W, RPB7, MCM2, MRS1, GLO2, YKL105C, RCK1, AME1, DIA3, HOM3, YDR541C, PMT6, DSE2, YJL216C, RIO1, ALB1, IBA57, YOR268C, CWC24, ARD1, UTP15, MSE1, UBS1, YNL234W, YDL025C, CAF40, YBR221W-A, ATP18, MAL33, YPT6, OAC1, YJR151W-A, YML108W, COX17, RAD52, HST3, TAZ1, YNR064C, YGL010W, MFA2, PGM3, NRM1, CRS5, CTM1, SKG6, SYF2, HYM1, IPI3, MDH1, TFB2, HST4, MRPL24, YMR166C, AVT5, YGR021W, SUV3, YNL146W, MID1, AKL1, MTR10, LAA1, HDA1, SMY2, MRPL8, PLB2, CWP1, ECM14, ECM1, GAL2, FAS1, KEL1, SET7, TSR2, FET5, DRE2, MMS4, TGS1, COQ1, SUR7, PCL2, SER2, YFL034W, MKK1, SSA2, AVO1, FMP25, YRR1, SLX5, SAF1, YPL260W, YKR096W, UTP14, PAM18, WTM1, STE1, AIM20, SYM1, SIT4, SSH4, MEI5, CYC8, DSN1, STB3, IMD4, YPL109C, ECM2, YMR102C, YDR306C, SUL2, YOL019W, PAU10, HNM1, MRPL1, CMK1, YBR196C-A, YGL226W, YPR147C, PGM2, SLM4, MSS1, YER121W, YDR381C-A, VPS72, YJL043W, PAN6, YMR086W, MDN1, HEH2, YKE4, YKL162C, ZRG8, HIP1, YPR145C-A, YCL056C, ERG1, INP54, MRPS16, MOD5, YJR008W, RMI1, YNL146C-A, RRF1, CAF130, BUD9, GWT1, BEM3, STF2, SSN3, MAS2, SLN1, TLG1, NOP6, YOR097C, HVG1, GCD11, TDP1, ATC1, CIT1, GRR1, RPA12, ADY3, CTA1, SWS2, SNF8, CIS3, MRPL4, CLB4, DBP2, APQ12, UTP5, MPD1, MRS3, AIM43, ATP11, SNU66, ARF3, YKU80, YLR422W, EGT2, MSP1, YLR218C, MRPL44, YHR127W, UBP3, SOD2, CYT1, POP6, HSP10, YHR033W, YKL161C, KIN82, YNL165W, CYC7, FYV7, TAT1, YNR040W, DBP3, SMY1, TRP3, SSL2, RPS24B, UTP4, SAW1, DAN2, YPR011C, YER156C, YGL059W, TRM5, SUT2, IML2, ATF1, CKA1, ECM31, MSK1, SCC2, SYG1, RPO26, YPR114W, HIR3, YIL029C, MAC1, YOR296W, IST3, HOR2, ITT1, PRP22, ROD1, DIA4, FMP32, TOM70, DIP2, YPR159C-A, PSP1, BTS1, ECM37, AST1, SMP1, BPL1, UPS1, BAG7, NOG2, RPC10, CYB2, SMD2, RAD1, ATP3, STP2, BUD21, RRN5, YLR352W, FRE4, PAN2, APL3, SEC7, DUS1, CSE1, MAK3, MRPL19, DBP1, FMP48, JAC1, VPS54, FUR1, PUP3, FUN26, SWI1, PWP1, BUD23, ATF1, FMP16, YOL024W, IPK1, RLM1, YNG2, MSS2, FLO8, SHY1, KSP1, KNH1, DON1, KTI11, SMC5, FPS1, SHU1, RAV2, YOR356W, PFA3, ERG8, SEN1, YNL152W, YJL193W, MSH2, CYC1, YLR446W, MRPL13, ISA1, HUA1, YHL010C, NNT1, RMD8, PPR1, ECM9, BSC2, ACO1, MPS2, LEE1, COG5, MCM1, RFC1, TAT2, DML1, KRE9, SPT2, SPC19, QCR8, HXT1, DOA4, MSR1, STU1, ERG1, TFB4, ATG21, GYP6, DAD4, OAF1, YPR013C, GAS1, FAP7, CPA2, RPO31, ATG2, TEP1, YBL081W, SMF3, MCD1, ADK2, SAD1, HUA2, BUD2, YJR136C, RPS14, MNL1, MDJ1, FLO10, REB1, DSF2, KHA1, MRPL35, YOR283W, PPG1, CIT3, FAA4, SPL2, MET8, HOP2, HFA1, HAP5, ROG1, MAM3, DPH1, RTG3, YNL195C, DCN1, YLR211C, OXA1, YET2, RSC2, MRPL28, CTT1, YAP3, BIG1, UBP8, YOL019W-A, RIB5, NOG1, VID30, MRP17, ZRT1, UAF30, SPO23, YNL122C, SNU71, CDC43, SPC29, DYS1, PRP11, SVF1, BUD20, MEK1, UBP16, PCF11, GRX4, UTP22, HRK1, RPB9, YPL272C, ERG29, DIS3, YFR1, MRM2, RRP5, PTI1, TIF6, FTH1, MPE1, FKS3, ESP1, YDL007C-A, DMC1, JHD2, LEU2, SNF3, SCJ1, YMR317W, CYK3, GPT2, FMP41, SIA1, HXK1, YGL057C, YLR287C, NSR1, YDL241W, RKR1, REX4, TIM17, TES1, RPO21, YNL300W, BSC6, YHR080C, OPI10, RPB8, UBP9, YKR011C, CRP1, RSM24, ARP1, SIK1, GCR2, YLR345W, FET4, MRPL40, THP2, AMD2, YDR524W-C, PSY4, BUD16, HPT1, YDR333C, RHO4, AHC1, YJL206C, SWT1, HEK2, ATP12, XBP1, RMD6, RPL15, NUP42, PLC1, MAD3, YPS1, MCM16, HXT4, HXK2, ERG12, MMT2, YMR321C, MUM3, HST2, ROG3, DEF1, YLR281C, SSK22, MLH3, YGR131W, CSE4, YCL002C, MRPS18, CAD1, AIF1, SFC1, OYE3, EAF5, RSC9, GYL1, YDL063C, ISA2, GBP2, IMG1, NRP1, DHH1, RHB1, CIK1, PHO89, AGX1, RPB2, MRPL17, GPX2, LYP1, VPS9, BNA3, CKA2, OPI1, YER034W, RSM26, LSM6, THI3, SMC4, SWF1, YAH1, RPF2, HFI1, PLB1, MAM33, YLR413W, PRP8, ENO1, RPC19, YGL007C-A, YMR181C, URA7, YGL108C, SRB7, DAD1, LYS4, ATG18, FMP45, VAM3, SSC1, SNU56, YHR045W, HTA2, YJL213W, RPL20A, ALD4, QCR10, YGR287C, CBP4, PCI8, MCM4, DEM1, ATO3, TPS2, TAF1, KRE6, KGD2, ARB1, NMD5, EFR3, TRP4, HLJ1, ACE2, LDB17, ATG7, OSH16, AFT1, CTF4, YDR286C, AIM44, YLR149C, MRPS9, BET1, YLF2, BOI1, BUD4, CRF1, MLP2, ARK1, RRP12, NAT2, PCL7, ARP7, SFH1, STF1, YML081W, MRP49, FOL3, SAC7, PCS60, TPA1, SSS1, ERO1, NHP2, AIM1, AMD1, VPS38, COG3, YMR244C-A, PYC1, CCC1, TAO3, YDL233W, RPB10, YBR242W, EDC2, YVC1, YDR266C, PMT3, NIS1, YDR128W, ATP15, YML002W, ATG9, IKS1, SUR2, MSD1, SMC3, SPC1, MRPS35, ZIP1, YPR022C, YKL070W, RLM14, YJL127C-B, ARV1, YML6, CYC3, COX9, RMD11, SNU23, PRS2, YNL092W, TIF4632, CBP2, STP4, YIR024C, SHE1, EMG1, NUP192, THI7, NGL1, LDB19, AFG2, ROT1, PIK1, MRPL31, RHO2, MRPL49, FMO1, LRS4, CHS3, SEC8, HXT5, GRX3, YHL042W, AAC3, WSC4, PIN2, PUB1, ERG28, PSR1, ISY1, VPS70, IRC19, DNM1, RPA190, CCR4, SSU72, MRPL7, TBF1, YPR115W, SKP2, CDC73, RPL31B, MAK16, ERB1, DCG1, RNT1, RRP7, GCD7, RAD18, OMS1, YOL048C, PPT2, SCS7, YBL028C, RSC30, TIM23, PRI1, REC102, MCH5, PST1, CLB3, QCR9, MIR1, SSP120, MEF2, RPL14B, YPR003C, RLI1, SWC4, MTM1, SKY1, TOM1, YGL079W, ROM2, TFA2, AIM3, SSQ1, DUG2, MSF1, RPS0B, SCO2, OLE1, SBE2, SAR1, YJR116W, TEF1, AIM13, DFG5, YLR012C, MCM3, RPS7B, DFR1, YBL039W-B, RML2, RSM27, MEC3, YCG1, RFX1, RPL7B, CHS2, PEX5, TIF4631, RPL18B, SMB1, HUL4, NPL6, YOL107W, TRM1, STE6, ASK1, RAD9, YDL012C, RBG2, SEC6, YLR143W, XPT1, HGH1, YIL091C, PRS3, NTC20, YPR196W, MIC17, POA1, NPY1, SNQ2, ADE3, APT2, YGL082W, YHB1, MRPL16, CSH1, GUP1, YJL171C, IDP3, VHT1, PUG1, MPM1, RRP40, DPM1, AFG3, YBP2, YPL183W-A, AIM31, YCR015C, MSN4, YPL038W-A, TSC11, SEC59, ADA2, TPM2, YHR175W-A, POM152, YJR124C, RPL22B, COG7, NEW1, GSM1, UGX2, PRK1, GPD2, LDB16, PAM16, CMC1, TOM6, MBA1, SWC5, PRM10, SAM1, TRS31, YFT2, RGT1, RPL10, KRE33, CDC1, MRPL37, KEX2, VPS13, ACN9, RSC3, PBS2, EPS1, GPI18, ADH4, YTP1, YHM2, ZIM7, LYS5, AIM22, RGM1, ECM10, RDH54, DED1, CSE2, POC4, IPI1, SOL4, YKR075C, RSM10, MAE1, ATF2, SHE4, RSC1, GNT1, MSH4, HSK3, TRS20, NBP3, YBR090C, GLO1, FYV4, AEP2, ARP4, IES3, HYP2, DNF2, GAA1, RPA135, PCL9, SPT5, EDE1, ORC3, YOR304C-A, YCL047C, YER085C, YOL014W, YPL071C, GTS1, RFC2, NDE2, PET127, PLM2, YEA6, RPN7, MDL1, TMA64, NCE103, MCM6, MAS1, TSR1, BAS1, IRC4, TIM21, HCH1, APC5, PMP1, PUF6, YER077C, SNC2, MRP21, YLR036C, YME2, SEC12, YJL062W-A, YMR031C, YAL065C, YNR047W, NHP10, YOL083W, DLS1, IGO2, PAU17, NCS2, TAF7, YDL186W, CMK2, PUS7, TIM9, PMU1, MNP1, SEC16, RIF1, KAR3, MDL2, YLR356W, DCI1, ASP1, NET1, YPL068C, MOT3, NOC3, MRP13, GUT2, ICY1, NTO1, HOS3, TIM54, COX4, UBX2, RVB2, YBL059C-A, RBS1, DCR2, NEM1, MNN9, YNR036C, NOP1, SEC61, RTT106, CCT7, OSM1, SAS5, VPS29, KTI12, POL32, PUS9, SLF1, MUQ1, HSD1, KAR4, STN1, BAT1, THI71, RPL27B, COX5A, AEP1, LPP1, PRM11, YKL222C, TIP41, RPL43B, YCR043C, STP1, AIM8, HXT9, MRP7, YPL216W, SRB6, CTK2, RIT1, NST1, RIB7, MRPL38, SRT1, CBK1, ARL3, DRS2, YLR307C-A, GPI8, SHM2, IPL1, YPL041C, ARR1, GCN20, YPL039W, MNN1, SLX9, SEO1, RMP1, PSA1, CHS6, DAN1, RPB5, SIR3, BCP1, YLL058W, TNA1, TRM13, NOP1, SLP1, PEX31, YIF1, MSA2, ADH3, MNT4, GIS1, SLD2, PIN4, NVJ1, HTS1, RAD7, YKU70, NUF2, YIL001W, ASK10, YBL010C, ATP14, CDC123, MRPL51, YGR127W, YLR392, APC2, DEP1, APS3, RCL1, DCD1, MIG3, BSP1, YLL014W, TOA1, NBA1, SLC1, IGO1, SDH3, ACS2, YOR093C, MPC54, PFY1, MIA40, YDR034C-A, RDS3, MSC3, TIM50, CSN12, GIN4, SMI1, ADE17, YGR016W, PCP1, SBA1, SRP102, SUM1, ICL1, OAF3, ZRT2, NOP10, BET2, YVH1, SPO75, DNL4, SGV1, IES4, SET4, YCL001W-B, SQT1, REI1, MRPL9, YPL066W, PET191, TEM1, UBX4, DBF20, MSB3, NUP100, RIC1, CUE4, IKI3, YEL043W, MRPL11, MPS1, EAP1, AVT2, GND1, TYW3, POP7, YDR186C, POR2, LSM5, MSH1, TOM22, YBR238C, MEP1, ILV3, YMD8, YJR061W, OSH3, TEF4, SCO1, TDH1, RIM21, YGL185C, NUS1, KTR4, RRP14, TUB4, LEU9, YLR437C, AIM7, ATX2, AI3, OST4, TRA1, MYO5, DAL4, IMG2, LTV1, YGR122W, CFT2, YMR001C-A, CDC16, YAL067W-A, YDR132C, YNL011C, TCP1, CCT3, MKK2, RRI2, ZEO1, RUD3, RTR2, YJL070C, NUP116, ENT1, SLU7, MSC2, STV1, NUP60, AIM28, YOL029C, SHE10, RSB1, SHO1, DLD2, RAX1, LCP5, ATG17, PEX17, GAL4, MET32, YOR223W, STE14, DUG3, SRX1, UFO1, YAT2, NMD3, PRP9, MSN2, PET123, SWD2, SOG2, RRP17, GPB2, YOR293C-A, TEN1, SOV1, PFK27, YIL127C, YNL024C-A, TMT1, SEC39, YER158C, ERP3, YLR257W, PKH3, YNL155W, PSO2, NOP9, GPG1, GIP4, RIB1, CYS4, ZRT3, FMP21, DAK2, ISW1, ACF4, RTT10, RTT109, FMP10, YAP6, APM4, ZAP1, ARO9, SCM4, MIM1, BRR6, SRN2, YOR287C, CLA4, RNR3, ALG8, RAD50, YBR239C, LDB7, ATP17, UGA2, ENA2, YLR408C, SAT4, BOP3, SDH14, YNL045W, RPC40, YNL134C, ARP5, MAD2, GRX6, RSM18, FES1, SGF73, ARH1, MHT1, CNS1, BDH2, YKL063C, GSH1, BOS1, THI72, BSC1, MED8, RAD5, EMP47, SIS2, TEA1, YJL185C, RTF1, CIN4, DIC1, EST2, YNK1, PUS2, PEX3, YNL217W, HOR7, MGS1, YHR009C, YML007C-A, JNM1, YHR078W, YMR155W, STB85, MRP4, STE3, CKS1, TAF13, YNL176C, PCD1, HSP26, DAS1, EDS1, CTR3, PXL1, MRS11, MET3, BDP1, CBF2, DBP6, FAR11, ERJ1, MDM10, RPM2, COX13, TOA2, MYO2, PRP5, DRN1, ZDS1, IES2, FAT1, HIS1, MET16, LAS17, ACA1, HIS4, PHO012, EBP2, MRPL6, YLR271W, YBR085C-A, CRR1, SWI3, SWI4, PYK2, BUD7, PEX12, MDV1, IDH2, MRC1, TIM11, SPT15, FBP26, GUP2, NPL4, YCR007C, ABD1, YNL193W, YLR426W, YSP2, SSO2, MRPL23, YHR112C, VPS36, MET7, UTP18, MTW1, DYN1, RNH1, LST4, TAF11, RPL17A, SNA2, YGL041W-A, KAR5, YEH2, YMR118C, CUE2, URA8, YMR034C, YLR152C, YKL088W, HEM13, CAT5, KRE1, IBD2, YOL098C, AIM18, HMG1, TRM7, ADY2, LCD1, YGL194C-A, EFG1, BRX1, HIM1, TCM62, SET6, FIN1, CBF5, ASI1, DUT1, SEC65, YPL067C, RRP43, ASC1, ERG3, RTA1, NFU1, JIP4, YLR419W, YJR011C, YJL045W, ARC18, YBR287W, CAP2, NEO1, TOM5, PEP5, PCC1, PXR1, ALG11, YLR301W, ARG1, RFC4, AIM42, PPA2, DAP1, RTS1, EDC3, IRC23, YBR220C, GPI14, IML1, NIP7, YPT32, MSS18, CHO1, CST26, MOH1, PLP1, MKC7, XYL2, YMR295C, YLR003C, YIL096C, MOT2, RLP7, YSC84, NDL1, PFK1, MRD1, SAC6, REX2, RPA34, AHC2, APC1, YDR222W, VHR1, SUS1, UTH1, IRC8, SNO1, APT1, YOR352W, YMR258C, MRH1, HRP1, SRP21, MRPL22, SEC9, KAR2, YGR054W, HOF1, YDC1, YGR207W, WSC2, SRC1, YAR023C, HAM1, PER1, YKL047W, FLC3, TRM10, PAU15, RFA1, AI2, MPP10, ELC1, PHB1, OST1, LSB1, OKP1, THI22, MRPS1, COX20, FCF1, PHO80, FIT1, YPL056C, KIN4, GCD1, FRT1, ACS1, LGE1, YJL136W-A, MLC2, SMF1, ISW2, HIS6, CTR2, GCV2, GAL83, IMP3, GRS1, MRS5, NCE101, BUD17, MKS1, SYF1, ACH1, ARN1, RCN2, UBC12, YER079W, YHL044W, THI20, PML1, IRC10, BMS1, SSA1, DDI2, RPC11, YDR115W, DDC1, IRC21, DUR3, PET100, SKI8, QRI5, QDR1, UBC11, MRT4, POL3, MFB1, TC089, YDR370C, OYE2, MDM31, SLG1, YOR062C.

Examples of terminator regions with a relative expression intensity of no more than 0.7 include ORC4, ICY2, GIC1, HLR1, ECM13, YLR108C, AQR1, YHR213W-A, SUT1, PLB3, AIM26, TPO4, YPR153W, GIS3, WSC3, FUR4, DLT1, MOT1, YNL063W, MET13, YDL156W, YJL107C, YJR154W, YNL042W-B, VHS1, GPI19, YIL057C, STD1, CTF19, RAD34, YIR021W-A, FZF1, YHK8, YGL188C-A, HCM1, CDC6, YPR157W, CLB6, YOX1, YLR285C-A, YDR114C, YHR199C-A, MPS3, MUP3, YIR014W, AAR2, YPT3, AIM33, SCW11, BDF1, YCL042W, BSC4, YGL193C, NUT2, YJL118W, YKL069W, SRB8, YOR060C, MDH2, YPR116W, YPK2, GLN3, YDL211C, RAD5, CYM1, ENT4, ULA1, YMR182W-A, YKR017C, YOR302W, YOR072W-B, VTS1, FYV12, YGL235W, YHR086W-A, YEL067C, YPL257W, UBA3, YMR105W-A, YOR316C-A, TMA10, YDL159W-A, ATG29, YML037C, NSL1, YJL077W-B, POP3, WHI5, MIH1, YGR240C-A, YRM1, KAR9, YJU2, SPC24, DPB2, CHL4, YMR087W, CSI1, YIL134C-A, BUR2, PTH1, SSN8, AUA1, YLR154C-G, YLR342W-A, YCL001W-A, FLC1, YLL006W-A, VAM7, YPL077C, CCZ1, PRP28, ACM1, IME4, YPR096C, FRE5, PDR8, ILV5, YIL161W, PAC11, UBR2, YRB2, YLR125W, YMR253C, DSE4, EPL1, SNP1, YMR160W, SPO7, BUB1, YFR016C, SPC97, GEM1, INO2, SPT10, YLR132C, AIM45, YJR054, MBF1, YAL064C-A, YML054C-A, NUP1, ECM27, YIL060W, IRE1, YHR177W, YJR079W, YNL187W, YML003W, PIH1, YDR169C-A, PET111, YDL109C, YOR012W, YHR050W-A, TAR1, RIM9, YCR095W-A, RPR2, COS7, YDR049W, CUS1, JJJ3, COS10, MET1, HXT8, GLY1, SUR1, RTG1, PHM7, YJL052C-A, HXT17, YFL052W, ATG1, ECM2, YNR075C-A, YKR041W, ALD5, YHL018W, LUC7, YPS5, YLR297W, SNA4, BIO4, YBR298C-A, ECM12, SEF1, YMA247W-A, EXO1, CTF13, HUR1, SNO3, BSC5, YEA175W-A, PGA1, YLR173W, YDR119W-A, IRC15, MGA1, YPR174C, IML3, YLL054C, RDS1, MDM32, PET494, YPR036W-A, GTB1, ISF1, KRE29, SAP190, YHR214C-E, GTO3, YOR365C, MIP1, SIP5, YPL191C, YPL162C, YMR291W, BRN1, MDM1, NAT4, YLR406C-A, YME1, CSI2, YOR008C-A, CEF1, BUD25, DFG16, GPB1, KAR1, PPM2, DSS1, RPC37, VID24, ERV41, YGR169C-A, ECM8, YHR032W, ELA1, PEX29, LTE1, HAT2, SLI1, MUP1, ALG13, FRE7, YMR147W, ISU2, YOR1, JID1, ECM3, ATG5, MED6, YPL014W, YLR030W, AQY2, CCT2, YER067W, NRG1, SPT8, PIR1, YGR068C, YER039C-A, ELM1, ASE1, YBL095W, YNR066C, MTL1, CNE1, CAX4, NDI1, FLX1, YNL130C-A, CWC25, YNL254C, CDC13, ATP10, OCT1, ALF1, YEF1, BAP2, HTL1, PDC5, PKP1, SSK2, CAF120, SKN1, HHF1, CDC39, YFR012W, YEL048C, HAP4, PEX7, TPO1, NFT1, NGL3, YMR206W, DUS3, YAP7, CUS2, YLR415C, FUI1, SLM5, BTT1, YFR035C, RRN10, HAP3, SSY5, SFL1, KIP1, CDC15, GLT1, DOC1, MND1, AAC1, CEP3, UBC5, YNL213C, CLN3, CSF1, ECM18, MRS4, YIL046W-A, INP1, RTT105, MPT5, ATG15, RNH202, TAX4, IZH3, BDF2, COX14, YIP4, YJR120W, SAE2, YMC2, YGR035C, NDD1, HPA2, STL1, GPM3, ERF2, MMS21, YJL133C-A, YNL024C, IFH1, LIN1, ICS3, YNR014W, SPB1, YNL211C, SOL1, COS111, HSH155, NKP2, NAB3, FMT1, YPL152W-A, BOR1, SPC25, MMS1, YLL166C, MAL13, BFA1, AEP3, MTH1, YGR031W, BIT61, YMR230W-A, SKT5, YGL258W-A, PHR1, HTB2, SER1, BAP3, YER053C-A, ATG16, BIO2, MEP3, YNR073C, PCH2, APS2, MDM30, CLB5, ISR1, MRP20, GUD1, MED1, RER2, MCM10, YIR018C-A, SPO14, NUC1, MNN4, IFM1, YLR412C-A, ALT2, NNF1, YKL096C-B, RAD51, CIT2, SPT4, LRC4, USE1, YLR455W, YOL164W-A, PRP18, COA2, HSP82, YER184C, DAD2, LEU1, YDL129W, YPL119C-A, YOR034C-A, PRP38, MSA1, YBR147, BBP1, MLH1, SWC3, SOH1, HHF2, NIP1, MSL1, RIF2, SPG1, WHI3, HTA1, ARR3, YIL077C, SGF29, RAD53, YEL073C, YNR065C, NCA3, YBR296C-A, ECM23, YLR225C, SLD3, YBR197C, YBL059W, YOL075C, DNA2, SIZ1, REC114, MSN1, RGT2, CBF1, YGL176C, PTP2, GAL3, VPS62, HMS2, SMF3, APL1, SKI3, MNS1, YOR214C, TID3, KSS1, YDR194W-A, UPC2, ARG80, MRS2, ATP23, YML100W-A, YGL110W, STE12, RPI1, YDR090C, YEH1, UTP13, AMN1, YKL089W, AVL9, ATO2, HEM3, RPA14, GIP3, YGR053C, ALR2, YAP5, CDD1, SLS1, MET6, ABM1, PET20, CBP1, RAD10, SPO22, PIB1, EAF3, YFR032C-B, ELP2, YIA6, PET112, PAU7, MEI4, YEA4, SGS1, JEN1, CLB2, GIC2, SWI6, ULP2, KIN28, YKL033W, CSM4, YNL095C, RRN3, RNR1, TPO3, SUP45, ABP140, RPS28B, MRF1, GLN1, OPT1, PHO4, UBP10, YOL163W, MDS3, OTU1, GAT1, HDA3, MSY1, GNP1, YFL041W-A, YPL141C, MPH2, PMA1, YNL260C, SKS1, YDL177C, SWR1, RMD5, RPL9B, MIC14, AOS1, LRG1, ROX1, PCL10, MRPL3, YER152C, EAF1, HTB1, SPA2, SSN2, YJR129C, ATG8, RHR2, TFG2, YBL100W-C, CSM2, EXG1, STE7, ADH2, SNT2, PML39, SEC2, ASI2, MNT3, BUR6, BIO5, YDR506C, RDR1, MRPL33, YGL159W, RIM8, YGR161W-C, YIG1, PDR16, YDR249C, YDR124W, HSP30, SDH2, YER130C, FAA3, BUD22, TIM22, CBP6, ICE2, SPC110, AFT2, NAM2, YPR071W, DIP5, SDS3, POP4, OCA6, PTC6, YBR201C-A, YPR127W, SEC10, ASF2, SLI15, RRN7, ORC2, GUF1, GPI2, RPS9A, RAD6, PSR2, RIP1, GZF3, CAR1, YHR151C, LEU5, YBR182C-A, IRC7, ASG7, YOR381W-A, OCA5, YHR035W, PET117, ISD11, HSP150, CCC2, YHR131C, MRK1, RXT2, PPH13, ODC2, SHE9, YCR075W-A, CYB5, YDR415C, LRO1, SOF1, YNL162W-A, PAU14, MTO1, YKL061W, MSS11, SAN1, SET2, YMR1, PHD1, YBL071C-B, MPA43, SAM37, AAT1, ASH1, UTR2, CAT8, SLX8, HXT2, COY1, TAF3, DSS4, TOR1, YMR030W-A, PAU5, SFP1, FHL1, COX10, DDR2, SWM1, HXT6, RCR2, YLR091W, RMD9, SHQ1, YLR346C, SPT21, ARE1, KAP95, YGR071C, TRL1, ECM17, YML020W, RPO41, CFT1, LRC5, THI74, TPN1, YOR059C, PRY3, YEL1, CNM67, STB6, YOR385W, RRN6, COP1, PDR12, ELG1, SRP40, SRM1, YDR109C, AIM30, RPC17, YJL028W, YBR071W, APS1, KIP2, ATP22, PRM6, BUD31, IXR1, NFI1, YHL015W-A, VHS3, YNL295W, SML1, SSK1, YAE1, RIM2, YDR246W-A, YLR445W, SPT23, MTG2, SGF11, BRL1, YMR315W, MRPS28, ERG5, UTP30, MDM35, ASR1, YIL102C-A, USA1, DOT6, COX23, ADH5, DAN4, AMA1, SCT1, PHO84, SFG1, SLX4, EST1, YNL190W, SNL1, RRP15, YML082W, DOT1, PEX1, YUR1, YAP1802, YDR185C, GET2, YPL264C, YDR065W, YJR115W, MAK21, YER064C, ATR1, IDP2, KCS1, ZPR1, ITC1, OAZ1, SWC7, RPL8A, CAC2, VTH1, OCH1, BUL1, YNR004W, LST7, MRPS8, TIS11, NDC1, TOS8, ISM1, MSL5, FMP43, YJR098C, COQ3, TPC1, RIM101, ADR1, ALD6, YHR087W, VPS21, POG1, YJR005C-A, SNT1, YHR022C, MEF1, PUP2, ERP6, HHT2, YGR146C, OAR1, YOR129C, YCR045C, DBP7, MUB1, YPL236C, RIB2, YPR084W, AIM5, UTR5, HKR1, YMR010W, ALR1, LRE1, RPN4, YLR363W-A, MGM1, HTD2, NAM8, SED5, YOR161C-C, YML018C, NAB2, YER140A, PRM4, RTR1, YIR042C, THI18, FUN19, DMR1, SIP1, CGR1, MTR3, YJL144W, RIM13, SRL1, MET28, INM1, VID27, CDC34, SRO9, RRP9, YOL087C, MCM22, YMR111C, NDJ1, ATG12, MSM1, SRS2, YBR225W, YLR063W, AI1, CDC36, ASN1, MET31, SSP1, NGG1, RBA50, PUT1, YPT53, NMA2, YBR219C, CDC40, SGO1, YJL047C-A, RPC31, INP52, UGO1, RAD30, CLB1, GLO4, TPK3, GIM3, CDC9, PEX27, AIM32, YGL081W, DJP1, HMS1, JSN1, UBP12, RSM25, UBP5, GIP1, PUT3, CKI1, FAR7, LAG2, DAM1, PSD12, HMT1, COR1, MMR1, MRPL39, CTF8, AGP2, PRM7, HIT1, HAL9, GPA2, TIM44, TFB1, ECM19, MRPL32, YBR284W, NAS2, SBE22, YOR011W-A, ORT1, MRPL25, QNQ1, APC4, TYE7, YPP1, MMT1, MRP10, MRPS5, LIP5, CDC27, ESC2, CAN1, MEC1, TOP1, SLM3, SIP4, URN1, YCK3, USO1, RSM19, ASG1, ISU1, YHL008C, YNL313C, KKQ8, FCY2, GPD1, HHT1, MDJ2, SDH1, SSF1, PIP2, STE13, AZF1, VPS35, YGL146C, TAM41, MIF2, YDL118W, HFM1, PRR1, MRE11, FMP37, MLH2, BUD5, YOR342C, PCL1, DHR2, CDC5, CBP3, RLP24, LSG1, NCL1, YDR262W, PGA3, MID2, YJL027C, YOR305W, QCR6, MSC6, RSC4, PAU18, POL12, SME1, DBF2, RPS27A, NHP6A, YGK3, SLO1, AIM36, UBP13, TRI1, CTH1, PGS1, NMD4, YIL064W, BAR1, BCS1, YBL029W, CTR1, MRPL20, AGP3, YOR338W, FCF2, YOR052C, YJL147C, RSA1, PEX8, YOL159C, RRP4, YDL199C, LIA1, THI2, TRZ1, CYT2, MGM101, YNL277W-A, ARP8, MRPL36, YAR028, PAU2, SLD5, SMD1, YNL086W, QCR7, FMC1, HOS4, HEM1, NAM7, YPL108W; BUD14, BOI2, HRD1, YOL114C, RIS1, SIC1, BST7, KES1, MET4, TRS120, SYC1, NPA3, YLH47, SRL2, LRC3, MHR1, ZIP2, EAR1, RSF1, RIO2, MET2, NOP4, SAD1, PWP2, MST1, PCK1, CDC7, TOK1, PRO1, RAX2, LSM7, SHG1, TOM7, DAS2, SIP2, RRS1, LUG1, POX1, RAD61, SUN4, HAA1, YNR048W, ACO2, YOL047C, PMD1, FZO1, YEL025C, GPR1, BNI1, RSA4, YMR185W, PAU16, ECM7, YHP1, COG8, LST8, HST1, ESA1, YJL160C, MER1, CIN8, WSS1, PAT1, LRC6, FMP3, LYS21, MET18, MRPL50, GCR1, YOR022C, YJR012C, PDR3, YPL229W, SFK1, DUS4, IDS2, YOL036W, PHM6, YPR117W, RPB7, MCM2, MRS1, GLO2, YKL105C, RCK1, AME1, DIA3, HOM3, YDR541C, PMT6, DSE2, YJL216C, RIO1, ALB1, IBA5, YOR268C, CWC24, ARD1, UTP15, MSE1, UBS1, YNL234W, YDL025C, CAF40, YBR221W-A, ATP18, MAL33, YPT6, OAC1, YJR151W-A, YML108W, COX17, RAD52, HST3, TAZ1, YNR064C, YGL010W, MFA2, PGM3, NRM1, CRS5, CTM1, SKG6, SYF2, HYM1, IPI3, MDH1, TFB2, HST4, MRPL24, YMR166C, AYT5, YGR021W, SUV3, YNL146W, MID1, AKL1, MTR10, LAA1, HDA1, SMY2, MRPL8, PLB2, CWP1, ECM14, ECM1, GAL2, FAS1, KEL1, SET7, TSR2, FET5, DRE2, MMS4, TGS1, COQ1, SUR7, PCL2, SER2, YFL034W, MKK1, SSA42, AVO1, FMP25, YRR1, SLX5, SAF1, YPL260W, YKR096W, UTP14, PAM18, WTM1, STE18, AIM20, SYM1, SIT4, SSH4, MEI5, CYC8, DSN1, STB3, IMD4, YPL109C, ECM25, YMR102C, YDR306C, SUL2, YOL019W, PAU10, HNM1, MRPL1, CMK1, YBR196C-A, YGL226W, YPR147C, PGM2, SLM4, MSS1, YER121W, YDR381C-A, VPS72, YJL043W, PAN6, YMR086W, MDN1, HEH2, YKE4, YKL162C, ZRG8, HIP1, YPR145C-A, YCL056C, ERG1, INP54, MRPS16, MOD5, YJR008W, RMI1, YNL146C-A, RRF1, CAF130, BUD9, GWT1, BEM3, STF2, SSN3, MAS2, SLN1, TLG1, NOP6, YOR097C, HVG1, GCD11, TDP1, ATC1, CIT1, GRR1, RPA12, ADY3, CTA1, SWS12, SNF8, CIS3, MRPL4, CLB4, DBP2, APQ12, UTP5, MPD1, MRS3, AIM43, ATP11, SNU66, ARF3, YKU80, YLR422W, EGT2, MSP1, YLR218C, MRPL44, YHR127W, UBP3, SOD2, CYT1, POP6, HSP10, YHR033W, YKL161C, KIN82, YNL165W, CYC7, FYV7, TAT1, YNR040W, DEP3, SMY1, TRP3, SSL2, RPS24, UTP4, SAW1, DAN2, YPR011C, YER156C, YGL059W, TRM5, SUT2, IML2, ATP1, CKA1, ECM31, MSK1, SCC2, SYG1, RPO26, YPR114W, HIR3, YIL029C, MAC1, YOR296W, IST3, HOR2, ITT1, PRP22, ROD1, DIA4, FMP32, TOM70, DIP2, YPR159C-A, PSP1, BTS1, ECM37, AST1, SMP1, EPL1, UPS1, BAG7, NOG2, RPC10, CYB2, SMD2, RAD1, ATP3, STP2, BUD21, RRN5, YLR352W, FRE4, PAN2, APL3, SEC7, DUS1, CSE1, MAK3, MRPL19, DBP1, FMP48, JAC1, VPS54, FUR1, PUP3, FUN26, SWI1, PWP1, BUD23, ATF1, FMP16, YOL024W, IPK1, RLM1, YNG2, MSS2, FLO8, SHY1, KSP1, KNH1, DON1, KTI1, SMC5, FPS1, SHU1, RAV2, YOR356W, PFA3, ERG8, SEN1, YNL152W, YJL193W, MSH2, CYC1, YLR446W, MRPL13, ISA1, HUA1, YHL010C, NNT1, RMD8, PPR1, ECM9, BSC2, ACO1, MPS2, LEE1, COG5, MCM1, RFC1, TAT2, DML1, KRE9, SPT2, SPC19, QCR8, HXT1, DOA4, MSR1, STU1, ERG10, TFB4, ATG21, GYP6, DAD4, OAF1, YPR013C, GAS1, FAP7, CPA2, RPO31, ATG20, TEP1, YBL081W, SMP3, MCD1, ADK2, SAD1, HUA2, BUD2, YJR136C, RPS14B, MNL1, MDJ1, FLO10, REB1, DSF2, KHA1, MRPL35, YOR283W, PPG1, CIT3, FAA4, SPL2, MET8, HOP2, HFA1, HAP5, ROG1, MAM3, DPH1, RTG3, YNL195C, DCN1, YLR211C, OXA1, YET2, RSC2, MRPL28, CTT1, YAP3, BIG1, UBP8, YOL019W-A, RIB5, NOG1, VID30, MRP17, ZRT1, UAF3, SPO23, YNL122C, SNU71, CDC43, SPC29, DYS1, PRP11, SVF1, BUD20, MEK1, UBP16, PCF11, GRX4, UTP22, HRK1, RPB9, YPL272C, ERG29, DIS3, YFH1, MRM2, RRP5, PTI1, TIF6, FTH1, MPE1, FKS3, ESP1, YDL007C-A, DMC1, JHD2, LEU2, SNF3, SCJ1, YMR317W, CYK3, GPT2, FMP41, SIA1, HXL1, YGL057C, YLR287C, NSR1, YDL241W, RKR1, REX4, TIM17, TES1, RPO21, YNL300W, BSC6, YHR080C, OPI10, RPB8, UBP9, YKR011C, CRP1, RSM24, ARP1, SIK1, GCR2, YLR345W, FET4, MRPL4, THP2, AMD2, YDR524W-C, PSY4, BUD16, HPT1, YDR333C, RHO4, AHC1, YJL206C, SWT1, HEK2, ATP12, XBP1, RMD6, RPL15, NUP42, PLC1, MAD3, YPS1, MCM16, HXT4, HXK2, ERG12, MMT2, YMR321C, MUM3, HST2, ROG3, DEF1, YLR281C, SSK22, MLH3, YGR131W, CSE4, YCL002C, MRPS18, CAD1, AIF1, SFC1, OYE3, EAF5, RSC9, GYL1, YDL063C, ISA2, GBP2, IMG1, NAP1, DHH1, PHI1, CIK1, PHO89, AGX1, RPB2, MRPL17, GPX2, LYP1, VPS9, BNA3, CKA2, OPI1, YER034W, RSM26, LSM6, THI3, SMC4, SWF1, YAH1, RPF2, HFI1, PLB1, MAM33, YLR413W, PRP8, ENO1, RPC19, YGL007C-A, YMR181C, URA7, YGL108C, SRB7, DAD1, LYS4, ATG18, FMP45, VAM3, SSC1, SNU56, YHR045W, HTA2, YJL213W, RPL20A, ALD4, QCR10, YGR287C, CBP4, PCI8, MCM4, DEM1, ATO3, TPS2, TAF1, KRE6, KGD2, ARB1, NMD5, EFR3, TRP4, HLJ1, ACE2, LDB17, ATG7, OSH6, AFT1, CTF4, YDR286C, AIM44, YLR149C, MRPS9, BET1, YLF2, BOI1, BUD4, CRF1, MLP2, ARX1, RRP12, NAT2, PCL7, ARP7, SFH1, STF1, YML081W, MRP49, FOL3, SAC7, PCS60, TPA1, SSS1, ERO1, NHP2, AIM1, AMD1, VPS38, COG3, YMR244C-A, PYC1, CCC1, TAO3, YDL233W, RPE10, YBR242W, EDC2, YVC1, YDR266C, PMT3, NIS1, YDR128W, ATP15, YML002W, ATG9, IKS1, SUR2, MSD1, SMC3, SPC1, MRPS35, ZIP1, YPR022C, YKL070W, RIM4, YJL127C-B, ARV1, YML6, CYC3, COX9, RMD11, SNU23, PRS2, YNL092W, TIF4632, CBP2, STP4, YIR024C, SHE1, EMG1, NUP192, THI7, NGL1, LDB19, AFG2, ROT1, PIK1, MRPL31, RHO2, MRPL49, FMO1, LRS4, CHS3, SEC8, HXT5, GRX3, YHL042A, AAC3, WSC4, PIN2, PUB1, ERG28, PSR1, ISY1, VPS70, IRC19, DNM1, RPA190, CCR4, SSU72, MRPL7, TBF1, YPR115W, SKP2, CDC73, RPL31B, MAK16, ERB1, DCG1, RNT1, RRP7, GCD7, RAD18, OMS1, YOL048C, PPT2, SCS7, YBL028C, RSC3, TIM23, PRI1, REC102, MCH5, PST1, CLB3, QCR9, MIR1, SSP12, MEF2, RPL14B, YPR003C, RLI1, SWC4, MTM1, SKY1, TOM1, YGL079W, ROM2, TFA2, AIM3, SSQ1, DUG2, MSF1, RPS0B, SCO2, OLE1, SBE2, SAR1, YJR116W, TEF1, AIM13, DFG5, YLR012C, MCM3, RPS7B, DFR1, YBL039W-B, RML2, RSM27, MEC3, YCG1, RFX1, RPL7B, CHS2, PEX5, TIF4631, RPL18B, SMB1, HUL4, NPL6, YOL107W, TRM1, STE6, ASK1, RAD9, YDL012C, RBG2, SEC6, YLR143W, XPT1, HGH1, YIL091C, PRS3, NTC20, YPR196W, MIC17, POA1, NPY1, SNQ2, ADE3, APT2, YGL082W, YHB1, MRPL16, CSH1, GUP1, YJL171C, IDP3, VHT1, PUG1, MPM1, RRP40, DPM1, AFG3, YBP2, YPL183W-A, AIM31, YCR015C, MSN4, YPL038W-A, TSC11, SEC59, ADA2, TPM2, YHR175W-A, POM152, YJR124C, RPL22B, COG7, NEW1, GSM1, UGX2, PRK1, GPD2, LDB16, PAM16, CMC1, TOM6, MBA1, SWC5, PRM10, SAM1, TRS31, YFT2, RGT1, RPL10, KRE33, CDC1, MRPL37, KEX2, VPS13, ACN9, RSC3, PBS2, EPS1, GPI18, ADH4, YTP1, YHM2, ZIM17, LYS5, AIM22, RGM1, ECM10, RDH54, DED1, CSE2, POC4, IPI1, SOL4, YKR075C, RSM10, MAE1, ATF2, SHE4, RSC1, GNT7, MSH4, HSK3, TRS20, NBP3, YBR090C, GLO1, FYV4, AEP2, ARP4, IES3, HYP2, DNF2, GAA1, RPA135, PCL9, SPT5, EDE1, ORC3, YOR304C-A, YCL047C, YER085C, YOL014W, YPL071C, GTS1, RFC2, NDE2, PET127, PLM2, YEA6, RPN7, MDL1, TMA64, NCE103, MCM6, MAS1, TSR1, BAS1, IRC4, TIM21, HCH1, APC5, PMP1, PUF6, YER077C, SNC2, MRP21, YLR036C, YME2, SEC12, YJL062W-A, YMR031C, YAL065C, YNR047W, NHP10, YOL083W, DLS1, IGO2, PAU17, NCS2, TAF7, YDL186W, CMK2, PUS7, TIM9, PMU1, MNP1, SEC16, RIF1, KAR3, MDL2, YLR356W, DCI1, ASP1, NET1, YPL068C, MOT3, NOC3, MRP13, GUT2, ICY1, NTO1, HOS3, TIM54, COX4, UBX2, RVB2, YBL059C-A, RBS1, DCR2, NEM1, MNN9, YNR036C, NOP15, SEC61, RTT106, CCT7, OSM1, SAS5, VPS29, KTI12, POL32, PUS9, SLF1, MUQ1, HSD1, KAR4, STN1, BAT1, THI71, RPL27B, COX5A, AEP1, LPP1, PRM1, YKL222C, TIP41, RPL43B, YCR043C, STP1, AIM8, HXT9, MRP7, YPL216W, SRB6, CTK2, RIT1, NST1, RIB7, MRPL38, SRT1, CBK1, ARL3, DRS2, YLR307C-A, GPI8, SHM2, IPL1, YPL041C, ARR1, GCN2, YPL039W, MNN1, SLX9, SEO1, RMP1, PSA1, CHS6, DAN1, RPB5, SIR3, BCP1, YLL058W, TNA1, TRM13, NOP1, SLP1, PEX31, YIF1, MSA2, ADH3, MNT4, GIS1, SLD2, PIN4, NVJ1, HTS1, RAD7, YKU70, NUF2, YJL001W, ASK10, YBL010C, ATP14, CDC123, MRPL51, YGR127W, YLR392C, APC2, DEP1, APS3, RCL1, DCD1, MIG3.

Examples of terminator regions with a relative expression intensity of no more than 0.6 include ORC4, ICY2, GIC1, HLR1, ECM13, YLR108C, AQR1, YHR213W-A, SUT1, PLB3, AIM26, TPO4, YPR153W, GIS3, WSC3, FUR4, DLT1, MOT1, YNR063W, MET13, YDL156W, YJL107C, YJR154W, YNL042W-B, VHS1, GPI19, YIL057C, STD1, CTF19, RAD34, YIR021W-A, FZF1, YHK8, YGL188C-A, HCM1, CDC6, YPR157W, CLB6, YOX1, YLR285C-A, YDR114C, YHR199C-A, MPS3, MUP3, YIR014W, AAR2, YPT35, AIM33, SCW11, BDF1, YCL042W, BSC4, YGL193C, NUT2, YJL118W, YKL069W, SRB8, YOR060C, MDH2, YPR116W, YPK2, GLN3, YDL211C, RAD55, CYM1, ENT4, ULA1, YMR182W-A, YKR017C, YOR302W, YOR072W-B, VTS1, FYV12, YGL235, YHR086W-A, YEL067C, YPL257W, UBA3, YMR105W-A, YOR316C-A, TMA1, YDL159W-A, ATG29, YML037C, NSL1, YJL077W-B, POP3, WH5, MIH1, YGR240C-A, YRM1, KAR9, YJU2, SPC24, DPB2, CHL4, YMR087W, CSI1, YIL134C-A, BUR2, PTH1, SSN8, AUA1, YLR154C-G, YLR342W-A, YCL001W-A, FLC1, YLL006W-A, VAM7, YPL077C, CCZ1, PRP28, ACM1, IME4, YPR096C, FRE5, PDR8, ILV5, YIL161W, PAC11, UBR2, YRB2, YLR125W, YMR253C, DSE4, EPL1, SNP1, YMR160W, SPO77, BUB1, YFR016C, SPC97, GEM1, INO2, SPT1, YLR132C, AIM45, YJR054W, MBF1, YAL064C-A, YML054C-A, NUP1, ECM27, YIL060W, IRE1, YHR177W, YJR079W, YNL187W, YML003W, PIH1, YDR169C-A, PET111, YDL109C, YOR012W, YHR050W-A, TAR1, RIM9, YCR095W-A, RPR2, COS7, YDR049W, CUS1, JJJ3, COS10, MET1, HXT8, GLY1, SUR1, RTG1, PHM7, YJL052C-A, HXT17, YFL052W, ATG1, ECM2, YNR075C-A, YKR041W, ALD5, YHL018W, LUC7, YPS5, YLR297W, SNA4, BIO4, YBR298C-A, ECM12, SEF1, YMR247W-A, EXO1, CTF13, HUR1, SNO3, BSC5, YER175W-A, PGA1, YLR173W, YDR119W-A, IRC1, MGA1, YPR174C, IML3, YLL054C, RDS1, MDM32, PET494, YPR036W-A, GTE), ISF1, KRE29, SAP190, YHR214C-E, GTO3, YOR365C, MIP1, SIP5, YPL191C, YPL162C, YMR291W, BRN1, MDM1, NAT4, YLR406C-A, YME1, CSI2, YOR008C-A, CEF1, BUD25, DFG16, GPB1, KAR1, PPM2, DSS1, RPC37, VID24, ERV41, YGR169C-A, ECM8, YHR032W, ELA1, PEX29, LTE1, HAT2, SLI1, MUP1, ALG13, FRE7, YMR147W, ISU2, YOR1, JID1, ECM3, ATG5, MED6, YPL014W, YLR030W, AQY2, CCT2, YER067W, NRG1, SPT8, PIR1, YGR068C, YER039C-A, ELM1, ASE1, YBL095W, YNR066C, MTL1, CNE1, CAX4, NDI1, FLX1, YNL130C-A, CWC25, YNL254C, CDC13, ATP10, OCT1, ALF1, YEF1, BAP2, HTL1, PDC5, PKP1, SSK2, CAF120, SKN1, HHF1, CDC39, YFR012W, YEL048C, HAP4, PEX7, TPO1, NFT1, NGL3, YMR206W, DUS3, YAP7, CUS2, YLR415C, FUI1, SLM5, BTT1, YFR035C, RRN10, HAP3, SSY5, SFL1, KIP1, CDC1, GLT1, DOC1, MND1, AAC1, CEP3, UBC5, YNL213C, CLN3, CSF1, ECM18, MRS4, YIL046W-A, INP1, RTT105, MPT5, ATG15, RNH202, TAX4, IZH3, BDF2, COX14, YIP4, YJR120W, SAE2, YMC2, YGR035C, NDD1, HPA2, STL1, GPM3, ERF2, MMS21, YJL133C-A, YNL024C, IFH1, LIN1, ICS3, YNR014W, SPB1, YNL211C, SOL1, COS111, HSH155, NKP2, NAB3, FMT1, YPL152W-A, BOR1, SPC25, MMS1, YIL166C, MAL13, BFA1, AEP3, MTH1, YGR031W, BIT61, YMR230W-A, SKT5, YGL258W-A, PHR1, HTB2, SER1, BAP3, YER053C-A, ATG16, BIO2, MEP3, YNR073C, PCH2, APS2, MDM30, CLB5, ISR1, MRP20, GUD1, MED1, RER2, MCM10, YIR018C-A, SPO14, NUC1, MNN4, IFM1, YLR412C-A, ALT2, NNF1, YKL096C-A, RAD51, CIT2, SPT4, LRC4, USE1, YLR455, YOL164W-A, PRP18, COA2, HSP82, YER184C, DAD2, LEU1, YDL129W, YPL119C-A, YOR034C-A, PRP38, MSA1, YBR147W, BBP1, MLH1, SWC3, SOH1, HHF2, NIP1, MSL1, RIF2, SPG1, WHI3, HTA1, ARR3, YIL077C, SGF29, RAD53, YEL073C, YNR065C, NCA3, YBR296C-A, ECM23, YLR225C, SLD3, YBR197C, YBL059W, YOL075C, DNA2, SIZ1, REC114, MSN1, RGT2, CBF1, YGL176C, PTP2, GAL3, VPS62, HMS2, SMF3, APL1, SKI3, MNS1, YOR214C, TID3, KSS1, YDR194W-A, UPC2, ARG80, MRS2, ATP23, YML100W-A, YGL101W, STE12, RPI1, YDR090C, YEH1, UTP13, AMN1, YIL089W, AVL9, ATO2, HEM3, RPA14, GIP3, YGR053C, ALR2, YAP5, CDD1, SLS1, MET6, ABM1, PET20, CBP1, RAD10, SPO22, PIB1, EAF3, YFR032C-B, ELP2, YIA6, PET112, PAU7, MEI4, YEA4, SGS1, JEN1, CLB2, GIC2, SWI6, ULP2, KIN28, YIL033W, CSM4, YNL095C, RRN3, RNR1, TPO3, SUP45, ABP140, RPS28, MRF1, GLN1, OPT1, PHO4, UBP10, YOL163W, MDS3, OTU1, GAT1, HDA3, MSY1, GNP1, YFL041W-A, YPL141C, MPH2, PMA1, YNL260C, SKS1, YDL177C, SWR1, RMD5, RPL9B, MIC14, AOS1, LRG1, ROX1, PCL10, MRPL3, YER152C, EAF1, HTB1, SPA2, SSN2, YJR129C, ATG8, RHR2, TFG2, YBL100W-C, CSM2, EXG1, STE7, ADH2, SNT2, PML39, SEC2, ASI2, MNT3, BUR6, BIO5, YDR506C, RDR1, MRPL33, YGL159W, RIM8, YGR161W-C, YIG1, PDR16, YDR249C, YDR124W, HSP30, SDH2, YER130C, FAA3, BUD22, TIM22, CBP6, ICE2, SPC110, AFT2, MAM2, YPR071W, DIP5, SDS3, POP4, OCA6, PTC6, YBR201C-A, YPR127W, SEC10, ASF2, SLI1, RRN7, ORC2, GUF1, GPI2, RPS9A, RAD6, PSR2, RIP1, GZF3, CAR1, YHR151C, LEU5, YBR182C-A, LRC7, ASG7, YOR381W-A, OCA5, YHR035W, PET117, ISD11, HSP150, CCC2, YHR131C, MRK1, RXT2, PPH3, ODC2, SHE9, YCR075W-A, CYB5, YDR415C, LRO1, SOF1, YNL162W-A, PAU114, MTO1, YKL061W, MSS11, SAN1, SET2, YMR1, PHD1, YBL071C-B, MPA43, SAM37, AAT1, ASH1, UTR2, CAT8, SLX8, HXT2, COY1, TAF3, DSS4, TOR1, YMR030W-A, PAU5, SFP1, FHL1, COX10, DDR2, SWM1, HXT6, RCR2, YLR091W, RMD9, SHQ1, YLR346C, SPT21, ARE1, KAP95, YGR071C, TRL1, ECM17, YML020W, RPO41, CFT1, LRC5, THI74, TPN1, YOR059C, PRY3, YEL1, CNM67, STB6, YOR38, RRN6, COP1, PDR12, ELG1, SRP40, SRM1, YDR109C, AIM30, RPC17, YJL028W, YBR071W, APS1, KIP2, ATP22, PRM6, BUD31, IXR1, NFI1, YHL015W-A, VHS3, YNL295W, SML1, SSK1, YAE1, RIM2, YDR246W-A, YLR445W, SPT23, MTG2, SGF11, BRL1, YMR315W, MRPS28, ERG5, UTP30, MDM3, ASR1, YIL102C-A, USA1, DOT6, COX23, ADH5, DAN4, RMA1, SCT1, PHO84, SFG1, SLX4, EST1, YNL190W, SNL1, RRP15, YML082W, DOT1, PEX1, YUR1, YAP1802, YDR185C, GET2, YPL264C, YDR065W, YJR115W, MAK21, YER064C, ATR1, IDP2, KCS1, ZPR1, ITC1, OAZ1, SWC7, RPL8A, CAC2, VTH1, OCH1, BUL1, YNR004W, IST7, MRPS8, TIS11, NDC1, TOS8, ISM1, MSL5, FMP43, YJR098C, COQ3, TPC1, RIM101, ADR1, ALD6, YHR087W, VPS21, POG1, YJR005C-A, SNT1, YHR022C, MEF1, PUP2, ERP6, HHT2, YGR146C, OAR1, YOR129C, YCR045C, DBP7, MUB1, YPL236C, RIB2, YPR084W, AIM5, UTR5, HKR1, YMR010W, ALR1, LRE1, RPN4, YLR363W-A, MGM1, HTD2, NAM8, SED5, YOR161C-C, YML018C, NAB2, YER140W, PRM4, RTR1, YIR042C, THI80, FUN19, DMR1, SIP1, CGR1, MTR3, YJL144W, RIM13, SRL1, MET28, INM1, VID27, CDC34, SRO9, RRP9, YOL087C, MCM22, YMR111C, NDJ1, ATG12, MSM1, SRS2, YBR225W, YLR063W, AI1, CDC36, ASN1, MET31, SSP1, NGG1, RBA50, PUT1, YPT53, NMA2, YBR219C, CDC40, SGO1, YJL047C-A, RPC31, INP52, UGO1, RAD30, CLB1, GLO4, TPK3, GIM3, CDC9, PEX27, AIM32, YGL081W, DJP1, HMS1, JSN1, UBP112, RSM25, UBP5, GIP1, PUT3, CKI1, FAR7, LAG2, DAM1, PSD2, HMT1, COR1, MMR1, MRPL39, CTF8, AGP2, PRM7, HIT1, HAL9, GPA2, TIM44, TFB1, ECM19, MRPL32, YBR284W, NAS2, SBE22, YOR011W-A, ORT1, MRPL25, QNQ1, APC4, TYE7, YPP1, MMT1, MRP10, MRPS5, LIP5, CDC27, ESC2, CAN1, MEC1, TOP1, SLM3, SIP4, URN1, YCK3, USO1, RSM19, ASG1, ISU1, YHL008C, YNL313C, KKQ8, FCY2, GPD1, HHT1, MDJ12, SDH1, SSF1, PIP2, STE13, AZF1, VPS35, YGL146C, TAM41, MIF2, YDL118W, HFM1, PRR1, MRE11, IMP37, MLH2, BUD5, YOR342C, PCL1, DHR2, CDC5, CBP3, RLP24, LSG1, NCL1, YDR262W, PGA3, MID2, YJL027C, YOR305W, QCR6, MSC6, RSC4, PAU18, POL12, SME1, DBF2, RPS27A, NHP6A, YGK3, SLO1, AIM36, UBP13, TRI1, CTH1, PGS1, NMD4, YIL064W, BAR1, BCS1, YBL029W, CTR1, MRPL20, AGP3, YOR338W, FCF2, YOR052C, YJL147C, RSA1, PEX8, YOL159C, RRP45, YDL199C, LIA1, THI2, TRZ1, CYT2, MGM101, YNL277W-A, ARP8, MRPL36, YAR028, PAU2, SLD5, SMD1, YNL086W, QCR7, FMC1, HOS4, HEM1, NAM7, YPL108W, BUD14, BOI2, HRD1, YOL114C, RIS1, SIC1, BST1, KES1, MET4, TRS120, SYC1, NPA3, YLH47, SRL2, LRC3, MHR1, ZIP2, EAR1, RSF1, RIO2, MET2, NOP4, SAD1, PWP2, MST1, PCK1, CDC7, TOK1, PRO1, RAX2, LSM7, SHG1, TOM7, DAS2, SIP2, RRS1, EUG1, POX1, RAD61, SUN4, HAA1, YNR048W, ACO2, YOL047C, PMD1, FZO1, YEL025C, GPR1, BNI1, RSA4, YMA185W, PAU16, ECM7, YHP1, COG8, LST8, HST1, ESA1, YJL160C, MER1, CIN8, WSS1, PAT1, LRC6, FMP30, LYS21, MET18, MRPL50, GCR1, YOR022C, YJR012C, PDR3, YPL229W, SFK1, DUS4, IDS2, YOL036W, PHM6, YPR117W, RPB7, MCM2, MRS1, GLO2, YKL105C, RCK1, AME1, DIA3, HOM3, YDR541C, PMT6, DSE2, YJL216C, RIO1, ALB1, IBA5, YOR268C, CWC24, ARD1, UTP15, MSE1, UBS1, YNL234W, YDL025C, CAF40, YBR221W-A, ATP18, MAL33, YPT6, OAC1, YJR151W-A, YML108W, COX17, RAD52, HST3, TAZ1, YNR064C, YGL010W, MFA2, PGM3, NRM1, CRS15, CTM1, SKG6, SYF2, HYM1, IPI3, MDH1, TFB2, HST4, MRPL24, YMR166C, AVT1, YGR021W, SUV3, YNL146W, MID1, AKL1, MTR10, LAA1, HDA1, SMY2, MRPL8, PLB2, CWP1, ECM14, ECM1, GAL2, FAS1, KEL1, SET7, TSR2, FET5, DRE2, MMS4, TGS1, COQ1, SUR7, PCL2, SER2, YFL034W, MKK1, SSA2, AVO1, FMP2, YAR1, SLX5, SAF1, YPL260W, YKR096W, UTP14, PAM18, WTM1, STE18, AIM20, SYM1, SIT4, SSH4, MEI5, CYC8, DSN1, STB3, IMD4, YPL109C, ECM25, YMR102C, YDR306C, SUL2, YOL019W, PAU10, HNM1, MRPL1, CMK1, YBR196C-A, YGL226W, YPR147C, PGM2, SLM4, MSS1, YER121W, YDR381C-A, VPS72, YJL043W, PAN6, YMR086W, MDN1, HEH2, YKE4, YKL162C, ZRG8, HIP1, YPR145C-A, YCL056C, ERG1, INP54, MRPS16, MOD5, YJR008W, RMI1, YNL146C-A, RRF1, CAF130, BUD9, GWT1, BEM3, STF2, SSN3, MAS2, SLN1, TLG1, NOP6, YOR097C, HVG1, GCD111, TDP1, ATC1, CIT1, GRR1, RPA12, ADY3, CTA1, SWS2, SNF8, CIS3, MRPL4, CLB4, DBP2, APQ12, UTP5, MPD1, MRS3, AIM43, ATP11, SNU66, ARF3, YKU80, YLR422W, EGT2, MSP1, YLR218C, MRPL44, YHR127W, UBP3, SOD2, CYT1, POP6, HSP10, YHR033W, YKL161C, KIN82, YNL165W, CYC7, FYV7, TAT1, YNR040W, DBP3, SMY1, TRP3, SSL2, RPS24B, UTP4, SAW1, DAN2, YPR011C, YER156C, YGL059W, TRM5, SUT2, IML2, ATP1, CKA1, ECM31, MSK1, SCC2, SYG1, RPO26, YPR114W, HIR3, YIL029C, MAC1, YOR296W, IST3, HOR2, ITT1, PRP22, ROD1, DIA4, FMP32, TOM70, DIP2, YPR159C-A, PSP1, BTS1, ECM37, AST1, SMP1, BPL1, UPS1, BAG7, NOG2, RPC10, CYB2, SMD2, RAD1, ATP3, STP2, BUD2), RRN5, YLR352W, FRE4, PAN2, APL3, SEC7, DUS1, CSE1, MAK3, MRPL19, DBP1, FMP48, JAC1, VPS54, FUR1, PUP3, FUN26, SWI1, PWP1, BUD23, ATF1, FMP16, YOL024W, IPK1, RLM1, YNG2, MSS2, FLO8, SHY1, KSP1, KNH1, DON1, KTI11, SMC5, FPS1, SHU1, RAV2, YOR356W, PFA3, ERG8, SEN15, YNL152W, YJL193W, MSH2, CYC1, YLR446W, MRPL13, ISA1, HUA1, YHL010C, NNT1, RMD8, PPR1, ECM9, BSC2, ACO1, MPS2, LEE1, COG5, MCM1, RFC1, TAT2, DML1, KRE9, SPT2, SPC19, QCR8, HXT1, DOA4, MSR1, STU1, ERG10, TFB4, ATG21, GYP6, DAD4, OAF1, YPR013C, GAS1, FAP7, CPA2, RPO31, ATG20, TEP1, YBL081W, SMP3, MCD1, ADK2, SAD1, HUA2, BUD2, YJR136C, RPS14B, MNL1, MDJ1, FLO10, REB1, DSF2, KHA1, MRPL3, YOR283W, PPG1, CIT3, FAA4, SPL2, MET8, HOP2, HFA1, HAP5, ROG1, MAM3, DPH1, RTG3, YNL195C, DCN1, YLR211C, OXA1, YET2, RSC2, MRPL28, CTT1, YAP3, BIG1, UBP8, YOL019W-A, RIB5, NOG1, VID30, MRP17, ZRT1, UAF30, SPO23, YNL122C, SNU71, CDC43, SPC29, DYS1, PRP11, SVF1, BUD20, MEK1, UBP16, PCF11, GRX4, UTP22, HRK1, RPB9, YPL272C, ERG29, DIS3, YFH1, MRM2, RRP5, PTI1, TIF6, FTH1, MPE1, FKS3, ESP1, YDL007C-A, DMC1, JHD2, LEU2, SNF3, SCJ1, YMR317W, CYK3, GPT2, FMP41, SIA1, HXK1, YGL057C, YLR287, NSR1, YDL241W, RKR1, REX4, TIM17, TES1, RPO21, YNL300W, BSC6, YHR080C, OPI10, RPB8, UBP9, YKR011C, CRP1, RSM24, ARP1, SIK1, GCR2, YLR345W, FET4, MRPL40, THP2, AMD2, YDR524W-C, PSY4, BUD16, HPT1, YDR333C, RHO4, AHC1, YJL206C, SWT1, HEK2, ATP12, XBP1, RMD6, RPL15B, NUP42, PLC1, MAD3, YPS1, MCM16, HXT4, HXK2, ERG12, MMT2, YMR321C, MUM3, HST2, ROG3, DEF1, YLR281C, SSK22, MLH3, YGR131W, CSE4, YCL002C, MRPS18, CAD1, AIF1, SFC1, OYE3, EAF5, RSC9, GYL1, YDL063C, ISA2, GBP2, IMG1, NRP1, DHH1, RHB1, CIK1, PHO89, AGX1, RPB2, MRPL17, GPX2, LYP1, VPS9, BNA3, CKA2, OPI1, YER034W, RSM26, LSM6, THI3, SMC4, SWF1, YAH1, RPF2, HFI1, PLB1, MAM33, YLR413W, PRP8, ENO1, RPC19, YGL007C-A, YMR181C, URA7, YGL108C, SRB7, DAD1, LYS4, ATG18, FMP45, VAM3, SSC1, SNU56, YHR045W, HTA2, YJL213W, RPL20A, ALD4, QCR10, YGR287C, CBP4, PCI8, MCM4, DEM1, ATO3, TPS2, TAF1, KRE6, KGD2, ARB1, NMD5, EFR3, TRP4, HLJ1, ACE2, LDB17, ATG7, OSH6, AFT1, CTF4, YDR286C, AIM44, YLR149C, MRPS9, BET1, YLF2, BOI1, BUD4, CRF1, MLP2, ARK1, RRP12, NAT2, PCL7, ARP7, SFH1, STF1, YML081W, MRP49, FOL3, SAC7, PCS60, TPA1, SSS1, ERO1, NHP2, AIM1, AMD1, VPS38, COG3, YMR244C-A, PYC1, CCC1, TAO3, YDL233W.

Examples of terminator regions with a relative expression intensity of no more than 0.5 include ORC4, ICY2, GIC1, HLR1, ECM13, YLR108C, AQR1, YHR213W-A, SUT1, PLB3, AIM26, TPO4, YPR153W, GIS3, WSC3, FUR4, DLT1, MOT1, YNR063W, MET13, YDL156W, YJL107C, YJR154W, YNL042W-B, VHS1, GPI19, YIL057C, STD1, CTF19, RAD34, YIR021W-A, FZF1, YHK8, YGL188C-A, HCM1, CDC6, YPR157W, CLB86, YOX1, YLR285C-A, YDR114C, YHR199C-A, MPS3, MUP3, YIR014W, AAR2, YPT35, AIM33, SCW11, BDF1, YCL042W, BSC4, YGL193C, NUT2, YJL118W, YKL069W, SRB8, YOR060C, MDH2, YPR116W, YPK2, GLN3, YDL211C, PAD55, CYM1, ENT4, ULA1, YMR182W-A, YKR017C, YOR302W, YOR072W-B, VTS1, FYV12, YGL235W, YHR086W-A, YEL067C, YPL257W, UBA3, YMR105W-A, YOR316C-A, TMA10, YDL159W-A, ATG29, YML037C, NSL1, YJL077W-B, POP3, WHI5, MIH1, YGR240C-A, YRM1, KAR9, YJU2, SPC24, DPB2, CHL4, YMR087W, CSI1, YIL134C-A, BUR2, PTH1, SSN8, AUA1, YLR154C-G, YLR342W-A, YCL001W-A, FLC1, YLL006W-A, VAM7, YPL077C, CCZ1, PRP28, ACM1, IME4, YPR096C, FRE5, PDR8, ILV5, YIL161W, PAC11, UBR2, YRB2, YLR125W, YMR253C, DSE4, EPL1, SNP1, YMR160W, SPO77, BUB1, YFR016C, SPC97, GEM1, INO2, SPT10, YLR132C, AIM45, YJR054W, MBF1, YAL064C-A, YML054C-A, NUP1, ECM27, YIL060W, IRE1, YHR177W, YJR079W, YNL187W, YML003 W, PIH1, YDR169C-A, PET111, YDL109C, YOR022W, YHR050W-A, TAR1, RIM9, YCR095W-A, RPR2, COS7, YDR049W, CUS1, JJJ3, COS10, MET1, HXT8, GLY1, SUR1, RTG1, PHM7, YJL052C-A, HXT17, YFL052W, ATG1, ECM2, YNR075C-A, YKR041W, ALD5, YHL018, LUC7, YPS5, YLR297, SNA4, BIO4, YBR298C-A, ECM12, SEF1, YMR247W-A, EXO1, CTF13, HUR1, SNO3, BSC5, YER175W-A, PGA1, YLR173W, YDR119W-A, IRC1, MGA1, YPR174C, IML3, YLL054C, RDS1, MDM32, PET494, YPR036W-A, GTB1, ISF1, KRE29, SAP190, YHR214C-E, GTO3, YOR365C, MIP1, SIP5, YPL191C, YPL162C, YMR291W, BRN1, MDM1, NAT4, YLR406C-A, YME1, CSI2, YOR008C-A, CEF1, BUD25, DFG16, GPB1, KAR1, PPM2, DSS1, RPC37, VID24, ERV41, YGR169C-A, ECM8, YHR032W, ELA1, PEX29, LTE1, HAT2, SLI1, MIP1, ALG13, FRE7, YMR147W, ISU2, YOR1, JID1, ECM3, ATG5, MED6, YPL014W, YLR030W, AQY2, CCT2, YER067W, NRG1, SPT8, PIR1, YGR068C, YER039C-A, ELM1, ASE1, YBL095W, YNR066C, MTL1, CNE1, CAX4, NDI1, FLX1, YNL130C-A, CWC25, YNL254C, CDC13, ATP10, OCT1, ALF1, YEF1, BAP2, HTL1, PDC5, PKP1, SSK2, CAF120, SKN1, HHF1, CDC39, YFR012W, YEL048C, HAP4, PEX7, TPO1, NFT1, NGL3, YMR206W, DUS3, YAP7, CUS2, YLR415C, FUI1, SLM5, BTT11, YFR035C, RRN10, HAP3, SSY5, SFL1, KIP1, CDC1, GLT1, DOC1, MND1, AAC1, CEP3, UBC5, YNL213C, CLN3, CSF1, ECM18, MRS4, YIL046W-A, INP1, RTT105, MPT5, ATG15, RNH202, TAX4, IZH3, BDF2, COX14, YIP4, YJR120W, SAE2, YMC2, YGR035C, NDD1, HPA2, STL1, GPM3, ERF2, MMS21, YJL133C-A, YNL024C, IFH1, LIN1, ICS3, YNR014W, SPB1, YNL211C, SOL1, COS111, HSH155, NKP2, NAB3, FMT1, YPL152W-A, BOR1, SPC25, MMS1, YIL166C, MAL13, BFA1, AEP3, MTH1, YGR031W, BIT61, YMR230W-A, SKT5, YGL258W-A, PHR1, HTB2, SER1, BAP3, YER053C-A, ATG16, BIO2, MEP3, YNR073C, PCH2, APS2, MDM30, CLB5, ISR1, MRP20, GUD1, MED1, RER2, MCM1, YIR018C-A, SPO14, NUC1, MNN4, IFM1, YLR412C-A, ALT2, NNF1, YKL096C-B, RAD51, CIT2, SPT4, LRC4, USE1, YLR455W, YOL164W-A, PRP18, COA2, HSP82, YER184C, DAD2, LEU1, YDL129W, YPL119C-A, YOR034C-A, PRP38, MSA1, YBR147W, BBP1, MLH1, SWC3, SOH1, HHF2, NIP1, MSL1, RIF2, SPG1, WHI3, HTA1, ARR3, YJL077C, SGF29, RAD53, YEL073C, YNR065C, NCA3, YBR296C-A, ECM23, YLR225C, SLD3, YBR197C, YBL059W, YOL075C, DNA2, SIZ1, REC114, MSN1, RGT2, CBF1, YGL176C, PTP2, GAL3, VPS62, HMS2, SMF3, APL1, SKI3, MAS1, YOR214C, TID3, KSS1, YDR194W-A, UPC2, ARG80, MRS2, ATP23, YML100W-A, YGL101W, STE12, RPI1, YDR090C, YEH1, UTP13, AMN1, YIL089W, AVL9, ATO2, HEM3, RPA14, GIP3, YGR053C, ALR2, YAP5, CDD1, SLS1, MET6, ABM1, PET20, CBP1, RAD10, SPO22, PIB1, EAF3, YFR032C-B, ELP2, YIA6, PET112, PAU7, MEI4, YEA4, SGS1, JEN1, CLB2, GIC2, SWI6, ULP2, KIN28, YKL033W, CSM4, YNL095C, RRN3, RNR1, TPO3, SUP45, ABP140, RPS28B, MRF1, GLN1, OPT1, PHO4, UBP10, YOL163W, MDS3, OTU1, GAT1, HDA3, MSY1, GNP1, YFL041W-A, YPL141C, MPH2, PMA1, YNL260C, SKS1, YDL177C, SWR1, RMD5, RPL9B, MIC14, AOS1, LRG1, ROX1, PCL10, MRPL3, YER152C, EAF1, HTB1, SPA2, SSN2, YJR129C, ATG8, RHR2, TFG2, YBL100W-C, CSM2, EXG1, STE7, ADH2, SNT2, PML39, SEC2, ASI2, MNT3, BUR6, BIO5, YDR506C, RDR1, MRPL33, YGL159W, RIM8, YGR161W-C, YIG1, PDR16, YDR249C, YDR124W, HSP30, SDH2, YER130C, FAA3, BUD22, TIM22, CBP6, ICE2, SPC110, ASF2, NAM2, YPR071W, DIP5, SDS3, POP4, OCA6, PTC6, YBR201C-A, YPR127W, SEC10, ASF2, SLI15, RRN7, ORC2, GUF1, GPI2, RPS9A, RAD6, PSR2, RIP1, GZF3, CAR1, YHR151C, LEU5, YBR182C-A, IRC7, ASG7, YOR381W-A, OCA5, YHR035W, PET117, ISD11, HSP150, CCC2, YHR131C, MRK1, RXT2, PPH3, ODC2, SHE9, YCR075W-A, CYB5, YDR415C, LRO1, SOF1, YNL162W-A, PAU14, MTO1, YKL061W, MSS11, SAN1, SET2, YMR1, PHD1, YBL071C-B, MPA43, SAM37, AAT1, ASH1, UTR2, CAT8, SLX8, HXT2, COY1, TAF3, DSS4, TOR1, YMR030W-A, PAU5, SFP1, FHL1, COX10, DDR2, SWM1, HXT6, RCR2, YLR091W, RMD9, SHQ1, YLR346C, SPT21, ARE1, KAP95, YGR071C, TRL1, ECM17, YML020W, RPO41, CFT1, LRC5, THI74, TPN1, YOR059C, PRY3, YEL1, CNM67, STB6, YOR385W, RRN6, COP1, PDR12, ELG1, SRP40, SRM1, YDR109C, AIM30, RPC17, YJL028W, YBR071W, APS1, KIP2, ATP22, PRM6, BUD31, IXR1, NFI1, YHL015W-A, VHS3, YNL295W, SML1, SSK1, YAE1, RIM2, YDR246W-A, YLR445W, SPT23, MTG2, SGF11, BRL1, YMR315W, MRPS28, ERG5, UTP30, MDM3, ASR1, YIL102C-A, USA1, DOT6, COX23, ADH5, DAN4, RMA1, SCT1, PHO84, SFG1, SLX4, EST1, YNL190W, SNL1, RRP1, YML082W, DOT1, PEX1, YUR1, YAP1802, YDR185C, GET2, YPL264C, YDR065W, YJR115A, MAK21, YER064C, ATR1, IDP2, KCS1, ZPR1, ITC1, OAZ1, SWC7, RPL8A, CAC2, VTH1, OCH1, BUL1, YNR004W, LST7, MRPS8, TIS11, NDC1, TOS8, ISM1, MSL5, FMP43, YJR098C, COQ3, TPC1, RIM101, ADR1, ALD6, YHR087W, VPS21, POG1, YJR005C-A, SNT1, YHR022C, MEF1, PUP2, ERP6, HHT2, YGR146C, OAR1, YOR129C, YCR045C, DBP7, MUB1, YPL236C, RIB2, YPR084W, AIM5, UTR5, HKR1, YMR010W, ALR1, LRE1, RPN4, YLR363W-A, MGM1, HTD2, NAM8, SED5, YOR161C-C, YML018C, NAB2, YER140W, PRM4, RTR1, YLR042C, THI80, FUN19, DMR1, SIP1, CGR1, MTR3, YJL144W, RIM13, SRL1, MET28, INM1, VID27, CDC34, SRO9, RRP9, YOL087C, MCM22, YMR111C, NDJ1, ATG12, MSM1, SRS2, YBR225W, YLR063W, AI1, CDC36, ASN1, MET31, SSP1, NGG1, RBA50, PUT1, YPT53, NMA2, YBR219C, CDC40, SGO1, YJL047C-A, RPC31, INP52, UGO1, RAD30, CLB1, GLO4, TPK3, GIM3, CDC9, PEX27, AIM32, YGL081W, DJP1, HMS1, JSN1, UBP12, RSM25, UBP5, GIP1, PUT3, CKI1, FAR7, LAG2, DAM1, PSD2, HMT1, COR1, MMR1, MRPL39, CTF8, AGP2, PRM7, HIT1, HAL9, GPA2, TIM44, TFB1, ECM19, MRPL32, YBR284W, NAS2, SBE22, YOR011W-A, ORT1, MRPL25, QNQ1, APC4, TYE7, YPP1, MMT1, MRP10, MRPS5, LIP5, CDC27, ESC2, CAN1, MEC1, TOP1, SLM3, SIP4, URN1, YCK3, USO1, RSM19, ASG1, ISU1, YHL008C, YNL313C, KKQ8, FCY2, GPD1, HIT1, MDJ2, SDH1, SSF1, PIP2, STE13, AZF1, VPS35, YGL146C, TAM41, MIF2, YDL118W, HEM1, PRR1, MRE11, FMP37, MLH2, BUD5, YOR342C, PCL1, DHR2, CDC5, CBP3, RLP24, LSG1, NCL1, YDR262W, PGA3, MID2, YJL027C, YOR305W, QCR6, MSC6, RSC4, PAU18, POL12, SME1, DBF2, RPS27A, NHP6A, YGK3, SLO1, AIM36, UBP13, TRI1, CTH1, PGS1, NMD4, YIL064W, BAR1, BCS1, YBL029W, CTR1, MRPL20, AGP3, YOR338W, FCF2, YOR052C, YJL147C, RSA1, PEX8, YOL159C, RRP45, YDL199C, LIA1, THI2, TRZ1, CYT2, MGM101, YNL277W-A, ARP8, MRPL36, YAR028W, PAU2, SLD5, SMD1, YNL086W, QCR7, FMC1, HOS4, HEM1, NAM7, YPL108W, BUD14, BOI2, HRD1, YOL114C, RIS1, SIC1, BST1, KES1, MET4, TRS120, SYC1, NPA3, YLH47, SRL2, LRC3, MHR1, ZIP2, EAR1, RSF1, RIO2, MET2, NOP4, SRD1, PWP2, MST1, PCK1, CDC7, TOK1, PRO1, RAX2, LSM7, SHG1, TOM7, DAS2, SIP2, RRS1, EUG1, POX1, RAD6), SUN4, HAA1, YNR048W, ACO2, YOL047C, PMD1, FZO1, YEL025C, GPR1, BNI1, RSA4, YMR185W, PAU16, ECM7, YHP1, COG8, LST8, HST1, ESA1, YJL160C, MER1, CIN8, WSS1, PAT1, LRC6, FMP30, LYS21, MET18, MRPL50, GCR1, YOR022C, YJR012C, PDR3, YPL229W, SFK1, DUS4, IDS2, YOL036W, PHM6, YPR117W, RPB7, MCM2, MRS1, GLO2, YKL105C, RCK1, AME1, DIA3, HOM3, YDR541C, PMT6, DSE2, YJL216C, RIO1, ALB1, IBA57, YOR268C, CWC24, ARD1, UTP1, MSE1, UBS1, YNL234W, YDL025C, CAF40, YBR221W-A, ATP18, MAL33, YPT6, OAC1, YJR151W-A, YML108W, COX17, RAD52, HST3, TAZ1, YNR064C, YGL010W, MAF2, PGM3, NRM1, CRS15, CTM1, SKG6, SYF2, HYM1, IPI3, MDH1, TFB2, HST4, MRPL24, YMR166C, AVT5, YGR021W, SUV3, YNL146, MID1, AKL1, MTR10, LAA1, HDA1, SMY2, MRPL8, PLB2, CWP1, ECM14, ECM1, GAL2, FAS1, KEL1, SET7, TSR2, FET5, DRE2, MMS4, TGS1, COQ1, SUR7, PCL2, SER2, YFL034W, MKK1, SSA2, AVO1, FMP25, YRR1, SLX5, SAF1, YPL260W, YKR096W, UTP14, PAM18, WTM1, STE18, AIM20, SYM1, SIT4, SSH4, MEI5, CYC8, DSN1, STB3, IMD4, YPL109C, ECM25, YMR102C, YDR306C, SUL2, YOL019W, PAU10, HNM1, MRPL1, CMK1, YBR196C-A, YGL226W, YPR147C, PGM2, SLM4, MSS1, YER121W, YDR381C-A, VPS72, YJL043W, PAN6, YMR086W, MDN1, HEH2, YKE4, YKL162C, ZRG8, HIP1, YPR145C-A, YCL056C, ERG1, INP54, MRPS16, MOD5, YJR008W, RMI1, YNL146C-A, RRF1, CAF130, BUD9, GWT71, BEM3, STF2, SSN3, MAS2, SLN1, TLG1, NOP6, YOR097C, HVG1, GCD11, TDP1, ATC1, CIT1, GRR1, RPA12, ADY3, CTA1, SWS2, SNF8, CIS3, MRPL4, CLB4, DBP2, APQ12, UTP5, MPD1, MRS3, AIM43, ATP11, SNU66, ARF3, YKU80, YLR422W, EGT2, MSP1, YLR218C, MRPL44, YHR127W, UBP3, SOD2, CYT1, POP6, HSP10, YHR033W, YKL161C, KIN82, YNL165W, CYC7, FYV7, TAT1, YNR040W, DBP3, SMY1, TRP3, SSL2, RPS24B, UTP4, SAW1, DAN2, YPR011C, YER156C, YGL059W, TRM5, SUT2, IML2, ATP1, CKA1, ECM31, MSK1, SCC2, SYG1, RPO26, YPR114W, HLR3, YIL029C, MAC1, YOR296W, IST3, HOR2, ITT1, PRP22, ROD1, DIA4, FMP32, TOM70, DIP2, YPR159C-A, PSP1, BTS1.

Examples of terminator regions with a relative expression intensity of no more than 0.4 include ORC4, ICY2, GIC1, HLR1, ECM13, YLR108C, AQR1, YHR213W-A, SUT1, PLB3, AIM26, TPO4, YPR153W, GIS3, WSC3, FUR4, DLT1, MOT1, YNR063W, MET13, YDL156W, YJL107C, YJR154W, YNL042W-B, VHS1, GPI19, YJL057C, STD1, CTF19, RAD34, YIR021W-A, FZF1, YHK8, YGL188C-A, HCM1, CDC6, YPR157W, CLB6, YOX1, YLR285C-A, YDR114C, YHR199C-A, MPS3, MUP3, YJR014W, AAR2, YPT3, AIM33, SCW11, BDF1, YCL042W, BSC4, YGL193C, NUT2, YJL118W, YKL069W, SRB8, YOR060C, MDH2, YPR116W, YPK2, GLN3, YDL211C, RAD55, CYM1, ENT4, ULA1, YMR182W-A, YKR017C, YOR302W, YOR072W-B, VTS1, FYV12, YGL235W, YHR086W-A, YEL067C, YPL257W, UBA3, YMR105W-A, YOR316C-A, TMA10, YDL159W-A, ATG29, YML037C, NSL1, YJL077W-B, POP3, WHI5, MIH1, YGR240C-A, YRM1, KAR9, YJU2, SPC24, DPB2, CHL4, YMR087A, CSI1, YJL134C-A, BUR2, PTH1, SSN8, AUA1, YLR154C-G, YLR342W-A, YCL001W-A, FLC1, YLL006W-A, VAM7, YPL077C, CCZ1, PRP28, ACM1, IME4, YPR096C, FRE5, PDR8, ILV5, YIL161W, PAC11, UBR2, YRB2, YLR125W, YMR253C, DSE4, EPL1, SNP1, YMR160W, SPO77, BUB1, YFR016C, SPC97, GEM1, INO2, SPT10, YLR132C, AIM45, YJR054W, MBF1, YAL064C-A, YML054C-A, NUP1, ECM27, YIL060W, IRE1, YHR177W, YJR079W, YNL187W, YML003W, PIH1, YDR169C-A, PET111, YDL109C, YOR012W, YHR050W-A, TAR1, RIM9, YCR095W-A, RPR2, COS7, YDR049A, CUS1, JJJ3, COS10, MET1, HXT8, GLY1, SUR1, RTG1, PHM7, YJL052C-A, HXT17, YFL052W, ATG1, ECM2, YNR075C-A, YKR041W, ALD5, YHL018W, LUC7, YPS5, YLR297A, SNA4, BIO4, YBR298C-A, ECM12, SEF1, YMR247W-A, EXO1, CTF13, HUR1, SNO3, BSC5, YER175W-A, PGA1, YLR173W, YDR119W-A, IRC15, MGA1, YPR174C, IML3, YLL054C, RDS1, MDM32, PET494, YPR036W-A, GTB1, ISF1, KRE29, SAP190, YHR214C-E, GTO3, YOR365C, MIP1, SIP5, YPL191C, YPL162C, YMR291W, BRN1, MDM1, NAT4, YLR406C-A, YME1, CSI2, YOR008C-A, CEF1, BUD25, DFG16, GPB1, KAR1, PPM2, DSS1, RPC37, VID24, ERV41, YGR169C-A, ECM8, YHR032W, ELA1, PEX29, LTE1, HAT2, SLI1, MUP1, ALG13, FRE7, YMR147W, ISU2, YOR1, JID1, ECM3, ATG5, MED6, YPL014W, YLR030W, AQY2, CCT2, YER067W, NRG1, SPT8, PIR1, YGR068C, YER039C-A, ELM1, ASE1, YBL095W, YNR066C, MTL1, CNE1, CAX4, NDI1, FLX1, YNL130C-A, CWC25, YNL254C, CDC13, ATP10, OCT1, ALF1, YEF1, BAP2, HTL1, PDC5, PKP1, SSK2, CAF120, SKN1, HHF1, CDC39, YFR012W, YEL048C, HAP4, PEX7, TPO1, NFT1, NGL3, YMR206A, DUS3, YAP7, CUS2, YLR415C, FUI1, SLM5, BTT1, YFR035C, RRN10, HAP3, SSY5, SFL1, KIP1, CDC15, GLT1, DOC1, MND1, AAC1, CEP3, UBC5, YNL213C, CLN3, CSF1, ECM18, MRS4, YIL046W-A, INP1, RTT105, MPT5, ATG1, RNH202, TAX4, IZH3, BDF2, COX14, YIP4, YJR120W, SAE2, YMC2, YGR035C, NDD1, HPA2, STL1, GPM3, ERF2, MMS21, YJL133C-A, YNL024C, IFH1, LIN1, ICS3, YNR014W, SPB1, YNL211C, SOL1, COS111, HSH15, NKP2, NAB3, FMT1, YPL152W-A, BOR1, SPC25, MMS1, YIL166C, MAL13, BFA1, AEP3, MTH1, YGR031W, BIT61, YMR230W-A, SKT5, YGL258W-A, PHR1, HTB2, SER1, BAP3, YER053C-A, ATG16, BIO2, MEP3, YNR073C, PCH2, APS2, MDM30, CLA5, ISA1, MRP20, GUD1, MED1, RER2, MCM10, YIR018C-A, SPO14, NUC1, MNN4, IFM1, YLR412C-A, ALT2, NNF1, YKL096C-B, RAD51, CIT2, SPT4, LRC4, USE1, YLR455W, YOL164W-A, PRP18, COA2, HSP82, YER184C, DAD2, LEU1, YDL129W, YPL119C-A, YOR034C-A, PRP38, MSA1, YBR147W, BBP1, MLH1, SWC3, SOH1, HHF2, NIP1, MSL1, RIF2, SPG1, WHI3, HTA1, ARR3, YIL077C, SGF29, RAD53, YEL073C, YNR065C, NCA3, YBR296C-A, ECM23, YLR225C, SLD3, YBR197C, YBL059W, YOL075C, DNA2, SIZ1, REC114, MSN1, RGT2, CBF1, YGL176C, PTP2, GAL3, VPS62, HMS2, SMF3, APL1, SKI3, MNS1, YOR214C, TID3, KSS1, YDR194W-A, UPC2, ARG80, MRS2, ATP23, YML100W-A, YGL101W, STE12, RPI1, YDR090C, YEH1, UTP13, AMN1, YIL089W, AVL9, ATO2, HEM3, RPA14, GIP3, YGR053C, ALR2, YAP5, CDD1, SLS1, MET6, ABM1, PET20, CBP1, RAD10, SPO22, PIB1, EAF3, YFR032C-B, ELP2, YIA6, PET20, PAU7, MEI4, YEA4, SGS1, JEN1, CLB2, GIC2, SWI6, ULP2, KIN28, YKL033W, CSM4, YNL095C, RRN3, RNR1, TPO3, SUP45, ABP140, RPS28B, MRF1, GLN1, OPT1, PHO4, UBP10, YOL163W, MDS3, OTU1, GAT1, HDA3, MSY1, GNP1, YFL041W-A, YPL141C, MPH2, PMA1, YNL260C, SKS1, YDL177C, SWR1, RMD5, RPL9B, MIC14, AOS1, LAG1, ROX1, PCL10, MRPL3, YER152C, EAF1, HTB1, SPA2, SSN2, YJR129C, ATG8, RHR2, TFG2, YBL100W-C, CSM2, EXG1, STE7, ADH2, SNT2, PML39, SEC2, ASI2, MNT3, BUR6, BIO5, YDR506C, RDR1, MRPL33, YGL159W, RIM8, YGR161W-C, YIG1, PDR16, YDR249C, YDR124W, HSP30, SDH2, YER130C, FAA3, BUD22, TIM22, CBP6, ICE2, SPC110, AFT2, NAM2, YPR071W, DIP5, SDS3, POP4, OCA6, PTC6, YBR201C-A, YPR127W, SEC10, ASF2, SLI15, RRN7, ORC2, GUF1, GPI2, RPS9A, RAD6, PSR2, RPP1, GZF3, CAR1, YHR151C, LEU5, YBR182C-A, IRC7, ASG7, YOR381W-A, OCA5, YHR035W, PET117, ISD11, HSP150, CCC2, YHR131C, MRK1, RXT2, PPH3, ODC2, SHE9, YCR075W-A, CYB5, YDR415C, LRO1, SOF1, YNL162W-A, PAU14, MTO1, YKL061W, MSS11, SAN1, SET2, YMR1, PHD1, YBL071C-B, MPA43, SAM37, AAT1, ASH1, UTR2, CAT8, SLX8, HXT2, COY1, TAF3, DSS4, TOR1, YMR030W-A, PAU5, SFP1, FHL1, COX10, DDR2, SWM1, HXT6, RCR2, YLR091W, RMD9, SHQ1, YLR346C, SPT21, ARE1, KAP95, YGR071C, TRL1, ECM17, YML020W, RPO41, CFT1, LRC5, THI174, TPN1, YOR059C, PRY3, YEL1, CNM67, STB6, YOR385W, RRN6, COP1, PDR12, ELG1, SRP40, SRM1, YDR109C, AIM30, RPC17, YJL028W, YBR071W, APS1, KIP2, ATP22, PRM6, BUD31, IXR1, NFI1, YHL015W-A, VHS3, YNL295W, SML1, SSK1, YAE1, RIM2, YDR246W-A, YLR445W, SPT23, MTG2, SGF11, BRL1, YMR315W, MRPS28, ERG5, UTP30, MDM35, ASR1, YIL102C-A, USA1, DOT6, COX23, ADH5, DAN4, RMA1, SCT1, PHO84, SFG1, SLX4, EST1, YNL190W, SNL1, RRP15, YML082W, DOT1, PEX1, YUR1, YAP1802, YDR185C, GET2, YPL264C, YDR065W, YJR115W, MAK21, YER064C, ATR1, IDP2, KCS1, ZPR1, ITC1, OAZ1, SWC7, RPL8A, CAC2, VTH1, OCH1, BUL1, YNR004W, LST7, MRPS8, TIS11, NDC1, TOS8, ISM1, MSL5, FMP43, YJR098C, COQ3, TPC1, RIM101, ADR1, ALD6, YHR087W, VPS21, POG1, YJR005C-A, SNT1, YHR022C, MEF1, PUP2, ERP6, HHT112, YGR146C, OAR1, YOR129C, YCR045C, DBP7, MUB1, YPL236C, RIB2, YPR084W, AIM5, UTR5, HKR1, YMR010W, ALR1, LRE1, RPN4, YLR363W-A, MGM1, HTD2, NAM8, SED5, YOR161C-C, YML018C, NAB2, YER140W, PRM4, RTR1, YIR042C, THI180, FUN19, DMR1, SIP1, CGR1, MTR3, YJL144W, RIM13, SRL1, MET28, INM1, VID27, CDC34, SRO9, RRP9, YOL087C, MCM22, YMR111C, NDJ1, ATG12, MSM1, SRS2, YBR225W, YLR063W, AI1, CDC36, ASN1, MET31, SSP1, NGG1, RBA50, PUT1, YPT53, NMA2, YBR219C, CDC40, SGO1, YJL047C-A, RPC31, INP52, UGO1, RAD30, CLB1, GLO4, TPK3, GIM3, CDC9, PEX27, AIM32, YGL081W, DJP1, HMS1, JSN1, UBP12, RSM25, UBP5, GIP1, PUT3, CKI1, FAR7, LAG2, DAM1, PSD2, HMT1, COR1, MMR1, MRPL39, CTF8, AGP2, PRM7, HIT1, HAL9, GPA2, TIM44, TFB1, ECM19, MRPL32, YBR284W, NAS2, SBE22, YOR011W-A, ORT1, MRPL25, QNQ1, APC4, TYE7, YPP1, MMT1, MRP1, MRPS5, LIP5, CDC27, ESC2, CAN1, MEC1, TOP1, SLM3, SIP4, URN1, YCK3, USO1, RSM19, ASG1, ISU1, YHL008C, YNL313, KKQ8, FCY2, GPD1, HHT1, MDJ2, SDH1, SSF1, PIP2, STE13, AZF1, VPS35, YGL146C, TAM41, MIF2, YDL118W, HFM1, PRR1, MRE11, FMP37, MLH2, BUD5, YOR342C, PCL1, DHR2, CDC5, CBP3, RLP24, LSG1, NCL1, YDR262W, PGA3, MID2, YJL027, YOR305W, QCR6, MSC6, RSC4, PAU18, POL12, SME1, DBF2, RPS27A, NHP6A, YGK3.

Examples of terminator regions with a relative expression intensity of no more than 0.3 include ORC4, ICY2, GIC1, HLR1, ECM13, YLR108C, AQR1, YHR213W-A, SUT1, PLB3, AIM26, TPO4, YPR153W, GIS3, WSC3, FUR1, DLT1, MOT1, YNR063W, MET13, YDL156W, YJL107C, YJR154W, YNL042W-B, VHS1, GPI19, YIL057C, STD1, CTF19, RAD34, YIR021W-A, FZF1, YHK8, YGL188C-A, HCM1, CDC6, YPR157W, CLB6, YOX1, YLR285C-A, YDR114C, YHR199C-A, MPS3, MUP3, YIR014W, AAR2, YPT35, AIM33, SCW11, BDF1, YCL042W, BSC4, YGL193C, NUT2, YJL118W, YKL069W, SRB8, YOR060C, MDH2, YPR116W, YPK2, GLN3, YDL211C, RAD5, CYM1, ENT4, ULA1, YMR182W-A, YKR017C, YOR302W, YOR072W-B, VTS1, FYV12, YGL235W, YHR086W-A, YEL067C, YPL257W, UBA3, YMR105W-A, YOR316C-A, TMA10, YDL159W-A, ATG29, YML037C, NSL1, YJL077W-B, POP3, WHI5, MIH1, YGR240C-A, YRM1, KAR9, YJU2, SPC24, DPB2, CHL4, YMR087W, CSI1, YJL134C-A, BUR2, PTH1, SSN8, AUA1, YLR154C-G, YLR342W-A, YCL001W-A, FLC1, YLL006W-A, VAM7, YPL077C, CCZ1, PRP28, ACM1, IME4, YPR096C, FRE5, PDR8, ILV5, YIL161W, PAC11, UBR2, YRB2, YLR125W, YMR253C, DSE4, EPL1, SNP1, YMR160W, SPO77, BUB1, YFR016C, SPC97, GEM1, INO2, SPT10, YLR132C, AIM45, YJR054W, MBF1, YAL064C-A, YML054C-A, NUP1, ECM27, YIL060W, IRE1, YHR177W, YJR079W, YNL187W, YML003W, PIH1, YDR169C-A, PET111, YDL109C, YOR012W, YHR050W-A, TAR1, RIM9, YCR095W-A, RPR2, COS7, YDR049W, CUS1, JJJ3, COS10, MET1, HXT8, GLY1, SUR1, RTG1, PHM7, YJL052C-A, HXT17, YFL052W, ATG1, ECM2, YNR075C-A, YKR041W, ALD5, YHL018W, LUC7, YPS5, YLR297W, SNA4, BIO4, YBR298C-A, ECM12, SEF1, YMR247W-A, EXO1, CTF13, HUR1, SNO3, BSC5, YER175W-A, PGA1, YLR173W, YDR119W-A, IRC15, MGA1, YPR174C, IML3, YLL054C, RDS1, MDM32, PET494, YPR036W-A, GTB1, ISF1, KRE29, SAP190, YHR214C-E, GTO3, YOR365C, MIP1, SIP5, YPL191C, YPL162C, YMR291W, BRN1, MDM1, NAT4, YLR406C-A, YME1, CSI2, YOR008C-A, CEF1, BUD25, DFG16, GPB1, KAR1, PPM2, DSS1, RPC37, VID24, ERV41, YGR169C-A, ECM8, YHR032W, ELA1, PEX29, LTE1, HAT2, SLI1, MUP1, ALG13, FRE7, YMR147W, ISU2, YOR1, JID1, ECM3, ATG5, MED6, YPL014W, YLR030W, AQY2, CC-2, YER067W, NRG1, SPT8, PIR1, YGR068C, YER039C-A, ELM1, ASE1, YBL095W, YNR066C, MTL1, CNE1, CAX4, NDI1, FLX1, YNL130C-A, CWC25, YNL254C, CDC13, ATP10, OCT1, ALF1, YEF1, BAP2, HTL1, PDC5, PKP1, SSK2, CAF120, SKN1, HHF1, CDC39, YFR012W, YEL048C, HAP4, PEX7, TPO1, NFT1, NGL3, YMR206W, DUS3, YAP7, CUS2, YLR415C, FUI1, SLM5, BTT1, YFR035C, RRN10, HAP3, SSY5, SFL1, KIP1, CDC15, GLT1, DOC1, MND1, AAC1, CEP3, UBC5, YNL213C, CLN3, CSF1, ECM18, MRS4, YIL046W-A, INP1, RTT105, MPT5, ATG1, RNH202, TAX4, IZH3, BDF2, COX14, YIP4, YJR120W, SAE2, YMC2, YGR035C, NDD1, HPA2, STL1, GPM3, ERF2, MMS21, YJL133C-A, YNL024C, IFH1, LIN1, ICS3, YNR014W, SPB1, YNL211C, SOL1, COS11, HSH155, NKP2, NAB3, FMT1, YPL152W-A, BOR1, SPC25, MMS1, YIL166, MAL13, BFA1, AEP3, MTH1, YGR031W, BIT61, YMR230W-A, SKT5, YGL258W-A, PHR1, HTB2, SER1, BAP3, YER053C-A, ATG16, BIO2, MEP3, YNR073C, PCH2, APS2, MDM30, CLB5, ISR1, MRP20, GUD1, MED1, RER2, MCM10, YIR018C-A, SPO14, NUC1, MNN4, IFM1, YLR412C-A, ALT2, NNF1, YKL096C-B, RAD51, CIT2, SPT4, LRC4, USE1, YLR455, YOL164W-A, PRP18, COA2, HSP82, YER184C, DAD2, LEU1, YDL129W, YPL119C-A, YOR034C-A, PRP38, MSA1, YBR147W, BBP1, MLH1, SWC3, SOH1, HHF2, NIP1, MSL1, RIF2, SPG1, WHI3, HTA1, ARR3, YIL077C, SGF29, RAD53, YEL073C, YNR065C, NCA3, YBR296C-A, ECM23, YLR225C, SLD3, YBR197C, YBL059W, YOL075C, DNA2, SIZ1, REC114, MSN1, RGT2, CBF1, YGL176C, PTP2, GAL3, VPS62, HMS2, SMF3, APL1, SKI3, MNS1, YOR214C, TID3, KSS1, YDR194W-A, UPC2, ARG80, MRS2, ATP23, YML100W-A, YGL101W, STE12, RPI1, YDR090C, YEH1, UTP13, AMN1, YIL089W, AVL9, ATO2, HEM3, RPA14, GIP3, YGR053C, ALR2, YAP5, CDD1, SLS1, MET6, ABM1, PET20, CBP1, RAD10, SPO22, PIB1, EAF3, YFR032C-B, ELP2, YIA6, PET112, PAU7, MEI4, YEA4, SGS1, JEN1, CLB2, GIC2, SWI6, ULP2, KIN28, YKL033W, CSM4, YNL095C, RRN3, RNR1, TPO3, SUP45, ABP140, RPS28B, MRF1, GLN1, OPT1, PHO4, UBP10, YOL163W, MDS3, OTU1, GAT1, HDA3, MSY1, GNP1, YFL041W-A, YPL141C, MPH2, PMA1, YNL260C, SKS1, YDL177C, SWR1, RMD5, RPL9B, MIC14, AOS1, LRG1, ROX1, PCL10, MRPL3, YER152C, EAF1, HTB1, SPA2, SSN2, YJR129C, ATG8, RHR2, TFG2, YBL100W-C, CSM2, EXG1, STE7, ADH2, SNT2, PML39, SEC2, ASI2, MNT3, BUR6, BIO5, YDR506C, RDR1, MRPL33, YGL159W, RIM8, YGR161W-C, YIG1, PDR16, YDR249C, YDR124W, HSP30, SDH2, YER130C, FAA3, BUD22, TIM22, CBP6, ICE2, SPC110, AFT2, NAM2, YPR071W, DIP5, SDS3, POP4, OCA6, PTC6, YBR201C-A, YPR127W, SEC10, ASF2, SLI15, RRN7, ORC2, GUF1, GPI2, RPS9A, RAD6, PSR2, RIP1, GZF3, CAR1, YHR151C, LEU5, YBR182C-A, IRC7, ASG7, YOR381W-A, OCA5, YHR035W, PET17, ISD11, HSP150, CCC2, YHR131C, MRK1, RXT2, PPH3, ODC2, SHE9, YCR075W-A, CYB5, YDR415C, LRO1, SOF1, YNL162W-A, PAU14, MTO1, YKL061W, MSS11, SAN1, SET2, YMR1, PHD1, YBL071C-B, MPA43, SAM37, AAT1, ASH1, UTR2, CAT8, SLX8, HXT2, COY1, TAF3, DSS4, TOR1, YMR030W-A, PAU5, SFP1, FHL1, COX10, DDR2, SWM1, HXT6, RCR2, YLR091W, RMD9, SHQ1, YLR346C, SPT21, ARE1, KAP95, and YGR071C.

Examples of terminator regions with a relative expression intensity of no more than 0.2 include ORC4, ICY2, GIC1, HLR1, ECM13, YLR108C, AQR1, YHR213W-A, SUT1, PLB3, AIM26, TPO4, YPR153W, GIS3, WSC3, FUR4, DLT1, MOT1, YNR063W, MET13, YDL156W, YJL107C, YJR154W, YNL042W-B, VHS1, GPI19, YIL057C, STD1, CTF19, RAD34, YIR021W-A, FZF1, YHK8, YGL188C-A, HCM1, CDC6, YPR157W, CLB6, YOX1, YLR285C-A, YDR114C, YHR199C-A, MPS3, MUP3, YIR014W, AAR2, YPT35, AIM33, SCW11, BDF1, YCL042W, BSC4, YGL193C, NUT2, YJL118W, YKL069, SRB8, YOR060C, MDH2, YPR116W, YPK2, GLN3, YDL211C, RAD5, CYM1, ENT4, ULA1, YMR182W-A, YKR017C, YOR302W, YOR072W-B, VTS1, FYV12, YGL235W, YHR086W-A, YEL067C, YPL257W, UBA3, YMR105W-A, YOR316C-A, TMA10, YDL159W-A, ATG29, YML037C, NSL1, YJL077W, POP3, WHI5, MIH1, YGR240C-A, YRM1, KAR9, YJU2, SPC24, DPB2, CHL4, YMR087W, CSI1, YIL134C-A, BUR2, PTH1, SSN8, AUA1, YLR154C-C, YLR342W-A, YCL001W-A, FLC1, YLL006W-A, VAM7, YPL077C, CCZ1, PRP28, ACM1, IME4, YPR096C, FRE5, PDR8, ILV5, YIL161W, PAC11, UBR2, YRB2, YLR125W, YMR253C, DSE4, EPL1, SNP1, YMR160W, SPO77, BUB1, YFR016C, SPC97, GEM1, INO2, SPT10, YLR132C, AIM45, YJR054W, MBF1, YAL064C-A, YML054C-A, NUP1, ECM27, YIL060W, IRE1, YHR177W, YJR079W, YNL187W, YML003W, PIH1, YDR169C-A, PET111, YDL109C, YOR012W, YHR050W-A, TAR1, RIM9, YCR095W-A, RPR2, COS7, YDR049W, CUS1, JJJ3, COS10, MET1, HXT8, GLY1, SUR1, RTG1, PHM7, YJL052C-A, HXT17, YFL052W, ATG1, ECM2, YNR075C-A, YKR041W, ALD5, YHL018W, LUC7, YPS5, YLR297W, SNA4, BIO4, YBR298C-A, ECM12, SEF1, YMR247W-A, EXO1, CTF13, HUR1, SNO3, BSC5, YER175W-A, PGA1, YLR173W, YDR119W-A, IRC15, MGA1, YPR174C, IML3, YLL054C, RDS1, MDM32, PET494, YPR036W-A, GTB1, ISF1, KRE29, SAP190, YHR214C-E, GTO3, YOR365C, MIP1, SIP5, YPL191C, YPL162C, YMR291W, BRN1, MDM1, NAT4, YLR406C-A, YME1, CSI2, YOR008C-A, CEF1, BUD25, DFG16, GPB1, KAR1, PPM2, DSS1, RPC37, VID24, ERV41, YGR169C-A, ECM8, YHR032W, ELA1, PEX29, LTE1, HAT2, SLU1, MUP1, ALG13, FRE7, YMR147W, ISU2, YOR1, JID1, ECM3, ATG5, MED6, YPL014W, YLR030W, AQY2, CCT2, YER067W, NRG1, SPT8, PIR1, YGR068C, YER039C-A, ELM1, ASE1, YBL095W, YNR066C, MTL1, CNE1, CAX4, NDI1, FLX1, YNL130C-A, CWC25, YNL254C, CDC13, ATP10, OCT1, ALF1, YEF1, BAP2, HTL1, PDC5, PKP1, SSK2, CAF120, SKN1, HHF1, CDC39, YFR012W, YEL048C, HAP4, PEX7, TPO1, NFT1, NGL3, YMR206W, DUS3, YAP7, CUS2, YLR415C, FUI1, SLM5, BTT1, YFR035C, RRN10, HAP3, SSY5, SFL1, KIP1, CDC15, GLT1, DOC1, MND1, AAC1, CEP3, UBC5, YNL213C, CLN3, CSF1, ECM18, MRS4, YIL046W-A, INP1, RTT105, MPT5, ATG15, RNH202, TAX4, IZH3, BDF2, COX14, YIP4, YJR120W, SAE2, YMC2, YGR035C, NDD1, HPA2, STL1, GPM3, ERF2, MMS21, YJL133C-A, YNL024C, IFH1, LIN1, ICS3, YNR014W, SPB1, YNL211C, SOL1, COS111, HSH155, NKP2, NAB3, FMT1, YPL152W-A, BOR1, SPC2, MMS1, YIL166C, MAL13, BFA1, AEP3, MTH1, YGR031W, BIT61, YMR230W-A, SKT5, YGL258W-A, PHR1, HTB2, SER1, BAP3, YER053C-A, ATG16, BIO2, MEP3, YNR073C, PCH2, APS2, MDM30, CLB5, ISR1, MAP2, GUD1, MED1, RER2, MCM1, YIR018C-A, SPO14, NUC1, MNN4, IFM1, YLR412C-A, ALT2, NNF1, YKL096C-B, RAD51, CIT2, SPT4, LRC4, USE1, YLR455W, YOL164W, PRP1, COA2, HSP82, YER184C, DAD2, LEU1, YDL129W, YPL119C-A, YOR034C-A, and PRP38.

Examples of terminator regions with a relative expression intensity of no more than 0.1 include ORC4, ICY2, GIC1, HLR1, ECM13, YLR108C, AQR1, YHR213W-A, SUT1, PLB3, AIM26, TPO4, YPR153W, GIS3, WSC3, FUR4, DLT1, MOT1, YNR063W, MET13, YDL156W, YJL107C, YJR154W, YNL042W-B, VHS1, GPI19, YIL057C, STD1, CTF19, RAD34, YIR021W-A, FZF1, YHK8, YGL188C-A, HCM1, CDC6, YPR157W, CLB6, YOX1, YLR285C-A, YDR114C, YHR199C-A, MPS3, MUP3, YIR014W, AAR2, YPT35, AIM33, SCW11, BDF1, YCL042W, BSC4, YGL193C, NUT2, YJL118W, YKL069W, SRB8, YOR060C, MDH2, YPR116W, YPK2, GLN3, YDL211C, RAD5, CYM1, ENT4, ULA1, YMR182W-A, YKR017C, YOR302W, YOR072W-B, VTS1, FYV12, YGL235W, YHR086W-A, YEL067C, YPL257W, UBA3, YMR105W-A, YOR316C-A, TMA10, YDL159W-A, ATG29, YML037C, NSL1, YJL077W-B, POP3, VTS1, MIH1, YGR240C-A, YRM1, KAR9, YJU2, SPC24, DPB2, CHL4, YMR087W, CSI1, YIL134C-A, BUR2, PTH1, SSN8, AUA1, YLR154C-G, YLR342W-A, YCL001W-A, FLC1, YLL006W-A, VAM7, YPL077C, CCZ1, PRP28, ACM1, IME4, YPR096C, FRE5, PDR8, ILV5, YIL161W, PAC11, UBR2, YRB2, YLR125W, YMR253C, DSE4, EPL1, SNP1, YMR160W, SPO77, BUB1, YFR016C, SPC97, GEM1, INO2, SPT10, YLR132C, AIM45, YJR054W, MBF1, YAL064C-A, YML054C-A, NUP1, ECM27, YIL060W, IRE1, YHR177W, YJR079W, YNL187W, YML003W, PIH1, YDR169C-A, PET111, YDL109C, YOR012W, YHR050W-A, TAR1, RIM9, YCR095W-A, RPR2, COS7, YDR049W, CUS1, JJJ3, COS10, MET1, HXT8, GLY1, SUR1, RTG1, PHM7, YJL052C-A, HXT17, YFL052W, ATG1, ECM2, YNR075C-A, YKR041W, ALD5, YHL018W, LUC7, and YPS5.

Other examples include ORC4, ICY2, GIC1, HLR1, ECM13, YLR108C, AQR1, YHR213W-A, SUT1, PLB3, AIM26, TPO4, YPR153W, GIS3, WSC3, FUR4, DLT1, MOT1, YNR063W, MET13, YDL156W, YJL107C, YJR154W, YNL042W-B, VHS1, GPI19, YIL057C, STD1, CTF19, and RAD34.

When the aim is to make the expression output of an arbitrary gene equivalent to that obtained in the past (with a widely-used terminator region for example), or when a known terminator region is used as a benchmark, a terminator region exhibiting moderate expression intensity can be selected based on the aforementioned expression intensity data. The relative intensity in this case is preferably more than 0.8 but less than 1.2, or more preferably 0.9 to 1.1, or still more preferably 0.95 to 1.05.

Examples of terminator regions with a relative expression intensity of more than 0.8 but less than 1.2 include YLL014W, TOA1, NBA1, SLC1, IGO1, SDH3, ACS2, YOR093C, MPC54, PFY1, MLA40, YDR034C-A, RDS3, MSC3, TIM55, CSN12, GIN4, SMI1, ADE17, YGR016W, PCP1, SBA1, SRP102, SUM1, ICL1, OAF3, ZRT2, NOP10, BET2, YVH1, SPO75, DNL4, SGV1, IES4, SET4, YCL001W-B, SQT1, REI1, MRPL9, YPL066W, PET191, TEM1, UBX4, DBF20, MSB3, NUP100, RIC1, CUE4, IKI3, YEL043W, MRPL11, MPS1, EAP1, AVT1, GND1, TYW3, POP7, YDR186C, POR2, LSM5, MSH1, TOM22, YBR238C, MEP1, ILV3, YMD8, YJR061W, OSH3, TEF4, SCO1, TDH1, RIM21, YGL185C, NUS1, KTR4, RRP14, TUB4, LEU9, YLR437C, AIM7, ATX2, AI3, OST4, TRA1, MYO5, DAL4, IMG2, LTV1, YGR122W, CFT2, YMR001C-A, CDC16, YAL067W-A, YDR132C, YNL011C, TCP1, CCT3, MKK2, RRI2, ZEO1, RUD3, RTR2, YJL070C, NUP116, ENT1, SLU7, MSC2, STV1, NUP60, AIM28, YOL029C, SHE10, RSB1, SHO1, DLD2, RAX1, LCP5, ATG17, PEX17, GAL4, MET32, YOR223W, STE14, DUG3, SRX1, UFO1, YAT2, NMD3, PRP9, MSN2, PET123, SWD2, SOG2, RRP17, GPB2, YOR293C-A, TEN1, SOV1, PFK27, YIL127C, YNL024C-A, TMT1, SEC39, YER158C, ERP3, YLR257W, PKH3, YNL155W, PSO2, NOP9, GPG1, GIP4, RIB1, CYS4, ZRT3, FMP21, DAK2, ISW1, ACF4, RTT109, RTT109, FMP10, YAP6, APM4, ZAP1, ARO9, SCM4, MIM1, BRR6, SRN2, YOR287C, CLA4, RNR3, ALG8, RAD50, YBR239C, LDB7, ATP17, UGA2, ENA2, YLR408C, SAT4, BOP3, SDH4, YNL045W, RPC40, YNL134C, ARP5, MAD2, GRX6, RSM18, FES1, SGF73, ARH1, MHT1, CNS1, BDH2, YKL063C, GSH1, BOS1, THI72, BSC1, MED8, RAD5, EMP47, SIS2, TEA1, YJL185C, RTF1, CIN4, DIC1, EST2, YNK1, PUS2, PEX13, YNL217W, HOR7, MGS1, YHR009C, YML007C-A, JNM1, YHR078W, YMR155W, STB5, MRP4, STE3, CKS1, TAF13, YNL176C, PCD1, HSP26, DAS1, EDS1, CTR3, PXL1, MRS11, MET3, BDP1, CBF2, DBP6, FAR11, ERI1, MDM10, RPM2, COX13, TOA2, MYO2, PRP5, DRN1, ZDS1, IES2, FAT1, HIS1, MET16, LAS17, ACA1, HIS4, PHO12, EBP2, MRPL6, YLR271W, YBR085C-A, CRR1, SWI3, SWI4, PYK2, BUD7, PEX12, MDV1, IDH2, MRC1, TIM11, SPT1, FBP26, GUP2, NPL4, YCR007C, ABD1, YNL193W, YLR426W, YSP2, SSO2, MRPL23, YHR112C, VPS36, MET7, UTP18, MTW1, DYN1, RNH1, LST4, TAF11, RPL17A, SNA2, YGL041W-A, KAR5, YEH12, YMR118C, CUE2, URA8, YMR034C, YLR152C, YKL088W, HEM13, CAT5, KRE1, IBD2, YOL098C, AIM8, HMG1, TRM7, ADY2, LCD1, YGL194C-A, EFG1, BRX1, HIM1, TCM62, SET6, FIN1, CBF5, ASI1, DUT1, SEC65, YPL067C, RRP43, ASC1, ERG3, RTA1, NFU1, JIP4, YLR419W, YJR011C, YJL045W, ARC18, YBR287W, CAP2, NEO1, TOM5, PEP5, PCC1, PXR1, ALG11, YLR301W, ARG1, RFC4, AIM42, PPA2, DAP1, RTS1, EDC3, IRC23, YBR220C, GPI14, IML1, NIP7, YPT32, MSS18, CHO1, CST26, MOH1, PLP1, MKC7, XYL2, YMR295C, YLR003C, YIL096C, MOT2, RLP7, YSC84, NDL1, PFK1, MRD1, SAC6, REX2, RPA34, AHC2, APC1, YDR222W, VHR1, SUS1, UTH1, IRC8, SNO1, APT1, YOR352W, YMR258C, MRH1, HRP1, SRP21, MRPL22, SEC9, KAR2, YGR054W, HOF1, YDC1, YGR207C, WSC2, SRC1, YAR023C, HAM1, PER1, YKL047W, FLC3, TRM10, PAU15, RFA1, AI2, MPP10, ELC1, PHB1, OST1, LSB1, OKP1, THI22, MRP51, COX20, FCF1, PHO80, FIT1, YPL056C, KIN4, GCD1, FRT1, ACS1, LGE1, YJL136W-A, MLC2, SMF1, ISW2, HIS6, CTR2, GCV2, GAL83, IMP3, GRS1, MRS5, NCE101, BUD17, MKS1, SYF1, ACH1, ARN1, RCN2, UBC12, YER079W, YHL044W, THI20, PML1, IRC10, BMS1, SSA1, DDI2, RPC11, YDR115W, DDC1, IRC21, DUR3, PET100, SKI8, QRI5, QDR1, UBC11, MRT4, POL3, MFB1, TCO89, YDR370C, OYE2, MDM31, SLG1, YOR062C, DNF1, MEH1, AIR2, MSS116, ACB1, ADE12, ELO1, VTA1, MRPL27, YFL054C, SPC34, RGS2, DRS1, GTR1, COX8, KEL2, NUP82, GIR2, FKH2, CLG1, PEX6, HO, YHR003C, NUP84, RRB1, PSY2, BSD2, ESBP6, MED7, RSN1, YKE2, YHL012W, SHE2, RPL2A, DUO1, DST1, PET9, RSA3, GLN4, YKR015C, YJR141W, RIM20, BCK2, SPC42, TRF5, FAA2, TRS13, GUA1, HSL7, PDE2, RRP8, XRS2, SPE1, RFT1, VPS20, SEC20, PAD1, GGC1, ORC1, HMG2, STE2, ISM3, ICS2, TRM2, CDC3, HEM2, SIN4, VIK1, HIS7, RAD54, IQG1, DFG10, TIP1, BRR2, GRX2, HTZ1, BCH2, NRG2, RSC58, TMA16, RAD59, URM1, ADY4, AAP1, ABP1, YGR066C, BRE5, BFR2, ISM1, CHD1, VTI1, AIM11, RFA2, SUR4, YOR228C, DLD3, ISN1, CYC2, SNF5, YMR124W, GIP2, SVL3, SEC13, YEL047C, BEM1, RPL16A, SPR3, ATP4, WAR1, ITR1, FAR3, YOR021C, YBR028C, NOP58, RPN13, YNL035C, YJL049W, YER137C, NOC4, ALG7, MET22, SIL1, TYS1, GLK1, YDR341C, YKR045C, RAD23, BIK1, RPL27A, YOR152C, KNS1, YHR182W, EEB1, RKM1, SNG1, YIL067C, VPS66, TCB1, ADE4, YNL034W, HSP78, HEM15, PKC1, SPP2, MF(ALPHA)1, ARP6, NCS6, RTS3, SPE4, YPL199C, DAL81, SAC1, YOL131W, YHL026C, REC107, YGR174W-A, SGE1, NCB2, YNL320W, CDC20, CSG2, ECM5, NOC2, IES1, SMK1, PHO86, YHR202W, CIN1, PFS1, MCM21, ROT2, GLC7, HAT1, YDR018C, APM1, DPH2, CDH1, HNT3, ATG4, FRE3, ATP2, YMR148W, YAT1, ERG11, PGI1, FKH1, MET30, YGL140C, ARC35, SNX41, SAS2, YHR007C-A, YML083C, ABF1, YLR104W, TOS1, MF(ALPHA)2, FRM2, OPY1, MMF1, DIG1, PMI40, YIL092W, ASI3, FIR1, ERG26, YMR090W, YGL085W, CDC24, YPL113C, YPR010C-A, BIR1, AAH1, EPT1, MSW1, NOP14, CBT1, COX18, COX16, RRD1, BEM4, GEA2, FOB1, ERG7, YLR042C, SEC17, YPR063C, PUT4, MSI1, RPA43, SPE2, DAL1, RPC25, BRO1, AXL1, EAF7, RCR1, YDR338C, RGA1, LOT5, YIH1, RNA1, SKM1, PUT2, HEM4, AIM37, PHO13, YGR015C, AKR2, YKL050C, TCB2, HAC1, ADE1, RTN1, RPL8B, MDM36, JHD1, CCL1, YDR282, PRE10, PEX14, OMA1, YNR034W-A, NBP2, SPT20, PRP2, YGL041C-B, YBR255W, YOR246C, YFL012W, YLR412W, DUR1,2, RPS4A, YAL037W, ICT1, CTR86, RPN10, RME1, MSB4, SAM35, MAG2, YOL092W, PPZ1, YGL138C, YHR097C, SSZ1, SIS1, CTP1, TAF5, PDC1, YPL150W, GCD10, ENP1, TOM40, ERG6, ECM4, RLF2, RKI1, SAM3, SEC62, CRC1, UME1, TUS1, YNL046W, VTC1, TEL2, YEN1, PEX30, GSG1, NTE1, RBG1, TIM8, YNG1, PMT5, PRP16, SPT6, NIP100, THS1, HMRA1, STE20, AIM10, YGL242C, GTR2, YOL157C, LOT6, KEX1, MET14, UBA2, NUT1, SPO21, PAC10, YND1, DSE3, YJR149W, YOR378W, GSY2, YBR063C, SRV2, YCK1, YKL091C, FMS1, UTP23, YCR090C, SFT2, BNI5, SNX3, FSH2, RGD2, SST2, UNG1, YLR164W, RPS26, TRE1, MSH5, MYO3, YGL039W, SUP35, AMA1, ATP19, YGL036W, PTK2, PBP2, TRM112, SMC1, NPR1, PFK2, PDE1, RRI1, FRE2, YOR118W, FRE1, ECM38, ALD3, STT3, VMR1, RPC82, URK1, ATX1, REG1, PNT1, YMR279C, RSC8, YJR111C, YLR253W, FSH1, YDR336W, ERD1, VPS41, AYT1, VRG4, YPL009C, VID22, YDR514C, APC11, VPS74, KRE11, RRP6, FOX2, ASM4, MED11, TWF1, GRX5, MYO1, YPL107W, PET54, YLR064W, SPC2, APP1, DBP5, BPH1, YKL151C, NAF1, YKL027W, ARO3, UBX6, TIM18, BNI4, SPC98, PZF1, PIC2, UTP8, YBR235W, SMC6, RLR1, DBF4, RPB11, SHE3, SFB3, SYT1, STU2, NGL2, GDS1, NOP2, SVS19, PRY2, GDA1, BCY1, PUS1, COX7, MRPL15, RER1, SLH1, RPB3, TIF11, YDL173W, YML053C, PEX4, MIG1, CLU1, ECM32, FCY1, HSP32, MAL12, JLP2, DAT1, RMR1, KTR6, OST2, NOP12, LRC3, OPT2, YBL054W, PDX1, AMS1, YBR204C, SLM2, VPS64, PTH2, MRP1, TIF5, AAT2, CPR3, AVT6, CLF1, MDM38, COX12, ESS1, RPG1, SNF11, ERV1, YPR078C, RHO3, SUE1, CLN2, YFL040W, YLR040C, RLA1, YMR272W-B, MND2, EHD3, IMP4, PAH1, HMO1, RPL26A, PIR3, MNN5, FCY22, SMD3, YER186C, QDR2, MHP1, CRH1, LSB3, RMD1, SDA1, AXL2, NOP16, YCL058W-A, ORC6, PRR2, STH1, CCA1, FUS1, MRS6, YBP1, RPL12A, UTR4, MTF2, MAK31, BOP2, UIP5, SSL1, INO4, RPT3, YBR072C-A, YHR159W, ITR2, PUF3, ADD66, GCS1, LYS2, MTR2, TRP1, HXT11, ALG1, SPS18, YOR111W, STI1, SSD1, CRN1, CSN9, RSM22, YIL152W, TOF1, HOM2, MOB1, RAD24, IRC25, RSM23, YLR049C, YBL055C, SPP41, YMR310C, YHC1, YNL040W, AIM41, APL5, ILV2, YIR035C, REC8, MSS51, GAP1, EMP70, HAL1, CDC21, VPS7, YER066W, MCM7, CHZ1, YKL121W, MMS2, BUL2, SEC1, BEM2, YKR018C, NUP2, VPS73, YIL024C, YPL225W, FEN1, YSR3, CST9, YLR241W, MAK1, CUP2, CCP1, ERV14, YJU3, RAP1, IMP1, COA1, TFA1, FAF1, ATP1, ARG3, RVB1, RPA49, NSE4, YKT6, RRN9, APM2, GAT3, SPN1, CKB1, DTD1, TPO2, PRP4, DEG1, PTC5, TSC1, DPB11, YKR005C, RIM1, PNO1, COX15, VPS4, PKH2, MTR4, YLR053C, LEU4, YPK1, PDX3, TIF2, YDL180W, FYV8, BUD13, YBR139W, TPK2, SSH1, YGR102C, YDR348C, RPL28, QCR2, YAR1, SCP1, TIP20, UBC7, SEC11, RPN11, TGL5, HSP60, RPL42B, PRS1, YKL018C-A, TFC6, RNH201, URA1, ALG9, MSG5, AKR1, MNN11, OCA1, YGP1, PPX1, TSC3, PSF3, YAF9, YMR175W-A, LHP1, YMR252C, SLK19, YJR107W, PMC1, HCR1, SKG1, PCT1, LPE1, PGK1, HAS1, SEC23, GPI13, YDR476C, YLR073C, SUI3, RCO1, LYS20, NUP170, JJJ1, RAD27, YLL032C, GDB1, GON7, PRS4, GAL7, RAI1, MLC1, SWD3, REV1, FET3, DAL7, DAL80, COQ5, TRK2, PRP31, SYP1, RPL36A, OSH7, RPL12B, UME6, LCB4, IZH2, MDH3, OGG1, RPL1A, YGL157W, HUB1, TGL4, CAF16, NPP2, URE2, GMH1, AVT3, FAA1, BET5, YPR091C, PET8, STB1, ERG13, UTP1, MMP1, YTH1, EMI2, MES1, PDS1, NPL3, PAD1, YGR235C, PHO8, PEX22, LAP4, LCB2, YLR326W, EMP46, MRPS17, AIM1, NUP5, YER134C, YCR076C, YBL104C, SSM4, YMR187C, YEF3, PIG1, ECM16, SPO20, ILS1, MFT1, RRP46, RPS23A, ECM40, STT4, SOK2, RPL9A, SIR1, SES1, CDC26, SSU1, SAS3, YKL187C, ARG8, RPL16B, LCB3, TVP18, APJ1, GDH1, IPT1, ATP7, YAR029W, PIS1, TRS23, SEC72, CHA4, DMA2, RUP2, DCP2, KAP114, YTA12, PHO87, TPS3, RPS10B, LIP2, PAF1, MEU1, ALK1, RIM11, SLA2, RSC6, CBC2, YBR016W, FIS1, RAS1, SFA1, YOL057W, YOR292C, MCD4, CSM1, MAK32, DAP2, EXG2, DID2, HXT15, DIE2, VAC8, YBR138C, NTH2, YCR099C, RTT107, MAF1, ERG9, PPN1, SRB4, CDC55, YDR248C, YDR003W-A, GLC8, PDR11, SPB4, YSC83, YLR072W, MCH1, RPH1, DAD3, SPT3, YFR057W, IDI1, TDH3, OCA2, PEX18, FUN30, RRP3, ABC1, IWR1, YJR088C, PTR2, SEC26, AQY1, ECM21, BUD27, PFK26, YDR352W, CUP5, ATG3, AGE2, RIX7, HSE1, AGA1, GRX7, AGE1, TUB2, YHR122W, RIB4, VRP1, LAS1, OCA4, YGR277C, BUB3, LPD1, EMI5, CTF8, YOL073C, SIT1, LYS12, FTR1, TUL1, EKI1, LEO1, GAL1, VAC17, REV7, PMP2, TIM13, YMR158C-A, TLG2, YGR106C, YML079W, YFR045W, YBR056W, YLR065C, HSH49, MTF1, LAG1, ATE1, RFM1, RNH203, DBP8, TPS1, YGR205W, PIM1, RAD16, SPI1, SPP1, CHS5, MNR2, PIL1, SMT3, PEF1, SKO1, CDC4, SUC2, RXT3, RPN9, SPO12, RPE1, SEC1, HMI1, RRP4, ERG25, MUC1, TPT1, OPY2, OSH2, VNX1, PXA2, YSW1, SRP14, OST5, CDC4, RPL38, YDR520C, ARO2, DOM34, SWE1, GTO1, RPL37B, RAD3, MEP2, PKH1, ARL1, ROX3, SET1, SIM1, CIA1, COX5B, CLN1, MNE1, BRE4, UBX5, DSL1, ACK1, YHR140W, ARG82, SCS22, ADH7, HSC82, ARO80, HED1, MAD1, TRP5, RPN3, SEN54, PTM1, ATG23, GIM4, YDR089W, MON2, PEX32, PUS6, YJL038C, SGN1, PRP39, YNR070W, SPO71, SAE3, MGR2, INP53, TUP1, SHP1, INO80, CDC23, GAB1, PTC1, SKI2, DNF3, YOR389W, AIM14, ATP16, VPS51, NSE3, UTP21, MDE1, ALY1, MNI2, BNS1, ILV1, TPO5, THI21, PEX2, YMR194C-B, SFI1, ESF1, YJL068C, GPI1, ISC10, RPL23A, YDR391C, TVP1, YNL108C, YDR051C, SRP101, SAS4, ARG4, PAN5, PTK1, THI6, YOR019W, GCN5, DID4, TRM11, ABZ2, YHR210C, RPL34, POL31, RPS4B, COG4, RPS16B, LCB1, ARA2, VPH2, YET1, HSM3, YBL036C, DAL2, VTC4, RPS21B, YOR131C, ADE13, YKL215C, LSM2, FAR10, MCH2, IMD3, USV1, YAR035C-A, RAM1, SNM1, PNG1, RFC3, ARP2, TOR2, ISC1, CTS1, YSH1, AIM4, BIT2, GVP36, SED1, SPG4, KGD1, NMT1, SSY1, LSC1, NRK1, YLR177W, SCD6, YDJ210W, LAP1, URA2, PEX21, MCM5, SSE2, PYC2, GFD1, YNL247W, RAD17, BRE2, CDC48, IES5, RPL23A, PTR3, ATP20, PAU3, CPR8, ARO7, YRO2, HRB1, HSP42, RPS18B, FMP23, ADE6, DER1, PPE1, CUE3, ACF2, QNS1, IOC3, NAM9, YDL144C, ENB1, KTR3, PSD1, HOS1, FCY21, CAJ1, ERP4, LRC2, TFB5, PRM3, CPR7, MET17, SAH1, YGR149W, GAC1, TFC7, RHO5, TIF34, YPT1, MSS4, FLC2, PRE2, YCL068C, GAL8, SPG3, URB1, MGE1, STR2, RPL34A, UIP3, NPP1, FMP24, AIM23, BIO3, PRO2, TMN3, EST3, PHO5, YSP1, TUF1, ORM1, OLA1, NMA1, YMR209C, SEC27, SLA1, YCL012C, SLM1, NOP53, YLR162W-A, PAU13, ALA1, YDL133W, CDC37, HCA4, PAB1, GSY1, YIP3, TMA46, RPP1, PRP3, YBL107C, UBP14, VAM10, CBS1, YOR238W, OMI4, SEC66, CST6, SSF2, FRS1, NCA2, HMX1, NOP13, RNR2, QDR3, OTU2, SPO13, HUL5, SED4, RRP42, CDC33, MLP1, GOR1, YDL119C, YJR039W, HNT2, SCM3, MET12, VPS33, MGR1, PCM1, YUH1, CDS1, SAP185, CRT10, SNF1, CMP2, APL6, IDH1, YDR428C, SEC21, APL4, PAP2, GPI17, SCH9, HOP1, MUK1, RPS25B, NOB1, STE23, YLR243W, GRE3, CCS1, YEL1, ENO2, COG6, RPL11, HNT1, LEM3, GPI1, FSF1, SEC3, SOL2, PRS5, VPS71, ACC1, ADE8, GNA1, YNR024W, RSF2, MAL32, PAU21, SPS19, YIL002W-A, SPF1, CCT8, PRM2, PDH1, RBL2, PIF1, VBA1, AFG1, DIN7, IZH1, YPL105C, YCR051W, WWM1, SIP3, SYS1, HPC2, RLP40A, NCR1, YER078C, CAP1, GCN4, AIM38, PTC7, FUN14, COS8, MCH4, PRP24, CWC2, CLC1, SIR4, FUS3, YLR057W, ZRG17, YSA1, PTC3, UBP6, KAP122, EFT2, URA3, ALG2, POL5, RPL1B, LIP1, TMA20, NAS6, IRC5, KIN3, YPL033C, AVT4, YGR266W, CTI6, YNL050C, SDP1, ESF2, NFS1, YER078W-A, IZH4, CWC22, YGR110W, DYN2, SNF4, YMR178W, NSE5, RPL40B, TKL2, HIR1, RPS30A, HSP12, YDR539W, GCV1, NTG1, AZR1, SPO7, YNL022C, DIM1, VAM6, YNR061C, PDA1, YOR032W-A, SPC3, CSR1, COS9, YJR085C, PEX15, TGL2, SGD1, YPL278C, YIL108W, THP1, SCY1, YGR130C, UBC6, END3, UBP1, RPL35B, MSB2, YCT1, SOL3, YDL027C, KIP3, UTP11, SUB1, PRP19, DCW1, TAH18, YER010C, PIN3, GYP1, SCW10, CTK1, ARK1, FYV10, YCR016W, YDJ1, ARF1, BGL2, YHR100C, CBS2, REX3, TSA1, RNA14, RCE1, THR4, SIP18, PMS1, DSK2, CDC50, DPH5, HEM12, SER3, YML119W, ESC1, GAL11, PRE7, RPT5, ERG2, DSE1, SEC22, YFH7, HSF1, GOS1, WRS1, EXO70, TSA2, ALK2, COX6, KRI1, YGL015C, RPS17B, YDR367W, TOM20, RSP5, YBL086C, TRM44, YPR109W, PTP1, AVT7, CYR1, CIS1, FAL1, VPS28, AGA2, QRI1, ATS1, GIT1, THO1, FBP1, YJL016W, UGA3, YBR230W-A, CCE1, NDE1, SET5, HOT1, RPT1, CAR2, PRE4, ECM33, ECM11, RAD33, BUB2, SOP4, SPR1, MOG1, SPO11, YKR070W, YBR246W, YKL071W, AHP1, PRP42, GRC3, KEL3, YMR244W, YMR242W-A, HBN1, VAS1, RTT102, ZUO1, YGR250C, FRQ1, YCL049C, MCR1, UBP11, TIF35, ATG26, YKL107W, HEM14, THR1, LUG1, SPS100, VMA22, YEL020C, RPL2B, GAL10, FKS1, YPL247C, YEL057C, RPS22A, TRK1, VTC2, SNU114, SWD1, UBC8, YPT52, XDJ1, YJR142W, COQ9, ERV25, YKL075C, FPR4, SEN2, GDT1, NOP7, YOR251C, SRL1, YLL023C, IRA2, IES6, MLF3, DIA1, MTG1, FPR1, NCE102, ERG4, SIF2, NUP53, RPL14A, SEC18, SSB2, RAT1, YMR027W, GDI1, VAN1, KAP123, ICL2, LPX1, RPP2A, SCD5, EXO84, CWC21, TRE2, YGR153W, YCR061W, RAD14, CUL3, VPS53, GEA1, GET3, TAD2, POT1, MVP1, PUS4, SMC2, RFC5, TIF3, NTG2, HXT10, CDC60, ENT5, GAT4, PGU1, UFD4, RPL37A, PRE5, PDC6, GCV3, EGD1, MSC7, KEM1, APN1, APE2, YLR456W, MAK5, YPR172W, STE24, RPS9B, CRM1, STP22, DIA2, ECO1, MCX1, YKL065W-A, NTR2, HHO1, RRM3, PRE8, NYV1, RPC53, TMA23, REC104, ZTA1, TEC1, TUB3, YJL123C, AST2, SNX4, ARC1, SOD1, SMA2, RGD1, PHM8, SEM1, GGA2, YAK1, RGA2, SCS3, YTA7, MDM12, AUR1, SKN7, MDG1, RSM7, YOL038C-A, OSW2, TIR3, RSM28, NIF3, FRE6, MDM20, YNR071C, GDH2, VPS8, MVD1, GCD2, TFP3, FMP33, NUG1, CPR6, SCP160, SEC14, YNL181W, PRE6, YLR364W, HOG1, NUP49, RPL21B, RPL42A, GTT2, STR3, ARG5,6, RPS24A, PPM1, AIM46, ILM1, PEX10, PDS5, YDR042C, YDL218W, MGT1, NPC2, YLR194C, PDI1, XKS1, SIW14, KOG1, PDR15, NGR1, SMX3, FIP1, UGA4, EDC1, YDL086W, GGA1, SMM1, AIM39, UBC1, YGR203W, PRP4, YSF3, SNA3, SKI6, CDC12, VPS60, MSC1, SET1, NMA111, SKI7, KRE5, FOL2, DAL3, SAK1, RVS161, YBR141C, LHS1, YFL051C, YGR067C, NOT5, CKB2, ATG2, YJR112W-A, RKM2, RPL36B, CNB1, PRP43, LCB5, PAC1, ARP3, LRC1, RGR1, YDL157C, DPL1, GCY1, YER076C, TFB3, RPS8B, GAT2, GFD2, MRP8, VAC14, YHR138C, PHO90, PSK2, ALT1, ERP5, LAS21, AIM9, SLZ1, SGM1, FMP27, HXT3, YGR273C, RAM2, RET1, YIR007W, RPS2, MTQ2, RPS23B, COS12, RUB1, RGP1, GYP7, YOL138C, PMT2, YMR130W, SPS4, RAD28, YLR099W-A, YOR285W, MBR1, MPH1, NUP159, SEC63, RPS16A, YPL206C, BCD1, HOT13, IVY1, RNA15, YKR104W, and STE4.

Examples of terminator regions with a relative expression intensity of 0.9 to 1.1 include DNF1, MEH1, AIR2, MSS116, ACB1, ADE12, ELO1, VTA1, MRPL27, YFL054C, SPC34, RGS2, DRS1, GTR1, COX8, KEL2, NUP82, GIR2, PAC1, CLG1, PEX6, HO, YHR003C, NUP84, RRB1, PSY2, BSD2, ESBP6, MED7, RSN1, YKE2, YHL012W, SHE2, RPL2A, DUO1, DST1, PET9, RSA3, GLN4, YKR015C, YJR141W, RIM20, BCK2, SPC42, TRF5, FAA2, TRS130, GUA1, HSL7, PDE2, RRP8, XRS2, SPE1, RFT1, VPS20, SEC20, PAD1, GGC1, ORC1, HMG2, STE2, LSM3, ICS2, TRM2, CDC3, HEM2, SIN4, VIK1, HIS7, RAD54, IQG1, DFG10, TIP1, BRR2, GRX2, HTZ1, BCH2, NRG2, RSC58, TMA16, RAD59, URM1, ADY4, AAP1, ABP1, YGR066C, BRE5, BFR2, LSM1, CHD1, VTI1, AIM11, RFA2, SUR4, YOR228C, DLD3, JSN1, CYC2, SNF5, YMR124W, GIP2, SVL3, SEC13, YEL047C, BEM1, RPL16A, SPR3, ATP4, WAR1, ITR1, FAR3, YOR021C, YBR028C, NOP58, RPN13, YNL035C, YJL049W, YER137C, NOC4, ALG7, MET22, SIL1, TYS1, GLK1, YDR341C, YKR045C, RAD23, BIK1, RPL27A, YOR152C, KNS1, YHR182W, EEB1, RKM1, SNG1, YIL067C, VPS66, TCB1, ADE4, YNL034W, HSP78, HEM15, PKC1, SPP2, MF(ALPHA)1, ARP6, NCS6, RTS3, SPE4, YPL199C, DAL81, SAC1, YOL131W, YHL026C, REC107, YGR174W-A, SGE1, NCB2, YNL320W, CDC20, CSG2, ECM5, NOC2, IES1, SMK1, PHO86, YHR202W, CIN1, PFS1, MCM21, ROT2, GLC7, HRT1, YDR018C, APM1, DPH2, CDH1, HNT3, ATG4, FRE3, ATP2, YMR148W, YAT1, ERG11, PGI1, FKH1, MET30, YGL140C, ARC35, SNX41, SAS2, YHR007C-A, YML083C, ABF1, YLR104W, TOS1, MF(ALPHA)2, FRM2, OPY1, MMF1, DIG1, P914, YIL092W, ASI3, FIR1, ERG26, YMR090W, YGL085W, CDC24, YPL113C, YPR010C-A, BIR1, AAH1, EPT1, MSW1, NOP14, CBT1, COX18, COX16, RRD1, BEM4, GEA2, FOB1, ERG7, YLR042, SEC17, YPR063C, PUT4, MSI1, RPA43, SPE2, DAL1, RPC25, BRO1, AXL1, EAF7, RCR1, YDR338C, RGA1, LOT5, YIH1, RNA1, SKM1, PUT2, HEM4, AIM37, PHO13, YGR015C, AKR2, YKL050C, TCB2, HAC1, ADE1, RTN1, RPL8B, MDM36, JHD1, CCL1, YDR282C, PRE10, PEX14, OMA1, YNR034W-A, NBP2, SPT20, PRP2, YGL041C-B, YBR255W, YOR246C, YFL012W, YLR412W, DUR1,2, RPS4A, YAL037W, ICT1, CTR86, RPN1, RME1, MSB4, SAM35, MAG2, YOL092W, PPZ1, YGL138C, YHR097C, SSZ1, SIS1, CTP1, TAF5, PDC1, YPL150W, GCD10, ENP1, TOM40, ERG6, ECM4, RLF2, RKI1, SAM3, SEC62, CRC1, UME1, TUS1, YNL046W, VTC1, TEL2, YEN1, PEX30, GSG1, NTE1, RBG1, TIM8, YNG1, PMT5, PRP16, SPT6, NIP100, THS1, HMRA1, STE20, AIM10, YGL242C, GTR2, YOL157C, LOT6, KEX1, MET14, UBA2, NUT1, SPO21, PAC10, YND1, DSE3, YJR149W, YOR378W, GSY2, YBR063C, SRV2, YCK1, YKL091, FMS1, UTP23, YCR090C, SFT2, BNI5, SNX3, FSH2, RGD2, SST2, UNG1, YLR164W, RPS26B, TRE1, MSH5, MYO3, YGL039W, SUP35, AMA1, ATP19, YGL036W, PTK2, PBP2, TRM112, SMC1, NPR1, PFK2, PDE1, RRI1, FRE2, YOR118W, FRE1, ECM38, ALD3, STT3, VMR1, RPC82, URK1, ATX1, REG1, PNT1, YMR279C, RSC8, YJR111C, YLR253W, FSH1, YDR336W, ERD1, VPS41, AYT1, VRG4, YPL009C, VID22, YDR514C, APC11, VPS74, KRE11, RRP6, FOX2, ASM4, MED11, TWF1, GRX5, MYO1, YPL107W, PET54, YLR064W, SPC2, APP1, DBP5, BPH1, YKL151C, NAF1, YKL027W, ARO3, UBX6, TIM18, BNI4, SPC98, PZF1, PIC2, UTP8, YBR235W, SMC6, RLR1, DBF4, RPB11, SHE3, SFB3, SYT1, STU2, NGL2, GDS1, NOP2, SVS1, PRY2, GDA1, BCY1, PUS1, COX7, MRPL15, RER1, SLH1, RPB3, TIF11, YDL173W, YML053C, PEX4, MIG1, CLU1, ECM32, FCY1, HSP32, MAL12, JLP2, DAT1, RMA1, KTR6, OST2, NOP12, LRC3, OPT2, YBL054W, PDX1, AMS1, YBR204C, SLM2, VPS64, PTH2, MRP1, TIF5, AAT2, CPR3, AVT6, CLF1, MDM38, COX12, ESS1, RPG1, SNF11, ERV15, YPR078C, RHO3, SUE1, CLN2, YFL040W, YLR040C, RLA1, YMR272W-B, MND2, EHD3, IMP4, PAH1, HMO1, RPL26A, PIR3, MNN5, FCY22, SMD3, YER186C, QDR2, MHP1, CRH1, LSB3, RMD1, SDA1, AXL2, NOP16, YCL058W-A, ORC6, PRR2, STH1, CCA1, FUS1, MRS6, YBP1, RPL22A, UTR4, MTF2, MAK31, BOP2, UIP5, SSL1, INO4, RPT3, YER072C-A, YHR159W, ITR2, PUF3, ADD66, GCS1, LYS2, MTR2, TRP1, HXT11, ALG1, SPS18, YOR111W, STI1, SSD1, CAN1, CSN9, ASM22, YIL152W, TOF1, HOM2, MOB1, RAD24, LRC2, RSM23, YLR049C, YBL055C, SPP41, YMR310C, YHC1, YNL040W, AIM41, APL5, ILV2, YIR035C, REC8, MSS51, GAP1, EMP70, HAL1, CDC21, VPS75, YER066W, MCM7, CHZ1, YKL121W, MMS2, BUL2, SEC1, BEM2, YKR018C, NUP2, VPS73, YIL024C, YPL225W, FEN1, YSR3, CST9, YLR241W, MAK10, CUP2, CCP1, ERV14, YJU3, RAP1, IMP1, COA1, TFA1, FAF1, ATP1, ARG3, RVB1, RPA49, NSE4, YKT6, RRN9, APM2, GAT3, SPN1, CKB1, DTD1, TPO2, PRP45, DEG1, PTC5, TSC10, DPB11, YKR005C, RIM15, PNO1, COX15, VPS4, PKH2, MTR4, YLR053C, LEU4, YPK1, PDX3, TIF2, YDL180W, FYV8, BUD13, YBR139W, TPK2, SSH1, YGR102C, YDR348C, RPL28, QCR2, YAR1, SCP1, TIP20, UBC7, SEC11, RPN11, TGL5, HSP60, RPL42B, PRS1, YKL018C-A, TFC6, RNH201, URA1, ALG9, MSG5, AKR1, MNN11, OCA1, YGP1, PPX1, TSC3, PSF3, YAF9, YMR175W-A, LHP1, YMR252C, SLK19, YJR107W, PMC1, HCR1, SKG1, PCT1, LPE1, PGK1, HAS1, SEC23, GPI13, YDR476C, YLR073C, SUI3, RCO1, LYS20, NUP170, JJJ1, RAD27, YLL032C, GDB1, GON7, PRS4, GAL7, RAI1, MLC1, SWD3, REV1, FET3, DAL7, DAL80, COQ5, TRK2, PRP31, SYP1, RPL36A, OSH7, RPL12B, UME6, LCB4, IZH2, MDH3, OGG1, RPL1A, YGL157W, HUR1, TGL4, CAF16, NPP2, URE2, GMH1, AVT3, FAA1, BET5, YPR091C, PET8, STB1, ERG13, UTP10, MMP1, YTH1, EMI2, MES1, PDS1, NPL3, PRD1, YGR235C, PHO8, PEX22, LAP4, LCB2, YLR326W, EMP46, MRPS17, AIM17, NUP57, YER134C, YCR076C, YBL104C, SSM4, YMR187C, YEF3, PIG1, ECM16, SPO20, ILS1, MFT1, RRP46, RPS23A, ECM40, STT4, SOK2, RPL9A, SIR1, SES1, CDC26, SSU1, SAS3, YKL187C, ARG8, RPL16B, LCB3, TVP18, APJ1, GDH1, IPT1, ATP7, YAR029W, PIS1, TRS23, SEC72, CHA4, DMA2, RUP2, DCP2, KAP114, YTA12, PHO87, TPS3, RPS10B, LIP2, PAF1, MEU1, ALK1, RIM11, SLA2, RSC6, CBC2, YBR016W, FIS1, RAS1, SFA1, YOL057W, YOR292C, MCD4, CSM1, MAK132, DAP2, EXG2, DID2, HXT15, DIE2, VAC8, YBR138C, NTH2, YCR099C, RTT107, MAF1, ERG9, PPN1, SRB4, CDC55, YDR248C, YDR003W-A, GLC8, PDR11, SPB4, YSC83, YLR072W, MCH1, RPH1, DAD3, SPT3, YFR057W, IDI1, TDH3, OCA2, PEX18, FUN3, RRP3, ABC1, IWR1, YJR088C, PTR2, SEC26, AQY1, ECM21, BUD27, PFK26, YDR352W, CUP5, ATG3, AGE2, RIX7, HSE1, AGA1, GRX7, AGE1, TUB2, YHR122W, RIB4, VRP1, LAS1, OCA4, YGR277C, BUB3, LPD1, EMI5, CTF18, YOL073C, SIT1, LYS12, FTR1, TUL1, EKI1, LEO1, GAL1, VAC17, REV7, PMP2, TIM13, YMR158C-A, TLG2, YGR106C, YML079W, YFR045W, YBR056W, YLR065C, HSH49, MTF1, LAG1, ATE1, RFM1, RNH203, DBP8, TPS1, YGR205W, PIM1, RAD16, SPI1, SPP1, CHS5, MNR2, PIL1, SMT3, PEF1, SKO1, CDC45, SUC2, RXT3, RPN9, SPO12, RPE1, SEC15, HMI1, RRP4, ERG25, MUC1, TPT1, OPY2, OSH2, VNX1, PXA2, YSW1, SRP14, OST5, CDC4, RPL38, YDR520C, ARO2, DOM34, SWE1, GTO1, RPL37B, RAD3, MEP2, PKH1, ARL1, ROX3, SFT1, SIM1, CIA1, COX5B, CLN1, MNE1, BRE4, UBX5, DSL1, ACK1, YHR140W, ARG82, SCS22, ADH7, HSC82, ARO80, HED1, MAD1, TRP5, RPN3, SEN54, PTM1, ATG23, GIM4, YDR089W, MON2, PEX32, PUS6, YJL038C, SGN1, PRP39, YNR070W, SPO71, SAE3, MGR2, INP53, TUP1, SHP1, INO80, CDC23, GAB1, PTC1, SKI2, DNF3, YOR389W, AIM14, ATP16, VPS51, NSE3, UTP21, MDE1, ALY1, MNI2, BNS1, ILV1, TPO5, THI21, PEX2, YMR194C-B, SFI1, ESF1, YJL068C, GPI1, ISC10, RPL13A, YDR391C, TVP15, YNL108C, YDR051C, SRP101, SAS4, ARG4, PAN5, PTK1, THI6, YOR019W, GCN5, DID4, TRM11, ABZ2, YHR210C, RPL34B, POL31, RPS4B, COG4, RPS16B, LCB1, ARA2, VPH2, YBT1, HSM3, YBL036C, DAL2, VTC4, RPS21B, YOR131C, ADE13, YKL215C, LSM2, FAR10, MCH2, IMD3, USV1, YAR035C-A, RAM1, SNM1, PNG1, RFC3, ARP2, TOR2, ISC1, CTS1, YSH1, AIM4, BIT2, GVP36, SED1, SPG4, KGD1, NMT1, SSY1, LSC1, NRK1, YLR177W, SCD6, YDR210W, LRP1, URA2, PEX21, MCM5, SSE2, PYC2, GFD1, YNL247W, RAD17, BRE2, CDC48, LESS, RPL23A, PTR3, ATP20, PAU3, CPR8, ARO7, YRO2, HRB1, HSP42, RPS18B, FMP23, ADE6, DER1, PPE1, CUE3, ACF2, QNS1, IOC3, NAM9, YDL144C, ENB1, KTR3, PSD1, HOS1, FCY21, CAJ1, ERP4, LRC2, TFB5, PRM3, CPR7, MET17, SAH1, YGR149W, GAC1, TFC7, RHO5, TIF34, YPT1, MSS4, FLC2, PRE2, YCL068C, GAL80, SPG3, URB1, MGE1, STR2, RPL34A, UIP3, NPP1, FMP24, AIM23, BIO3, PRO2, TMN3, EST3, PHO5, YSP1, TUF1, ORM1, OLA1, NMA1, YMR209C, SEC27, SLA1, YCL012C, SLM1, NOP53, YLR162W-A, PAU13, ALA1, YDL133W, CDC37, HCA4, PRB1, GSY1, YIP3, TMA46, RPP1, PRP3, YBL107C, UBP14, VAM10, CBS1, YOR238W, OMI4, SEC66, CST6, SSF2, FRS1, NCA2, HMX1, NOP13, RNR2, QDR3, OTU2, SPO13, HUL5, SED4, RRP42, CDC33, MLP1, GOR1, YDL119C, YJR039W, HNT2, SCM3, MET12, VPS33, MGR1, PCM1, YUH1, CDS1, SAP185, CRT10, SNF1, CMP2, APL6, IDH1, YDR428C, SEC21, APL4, PAP2, GPI17, SCH9, HOP1, MUK1, RPS25B, NOB1, STE23, YLR243W, GRE3, CCS1, VEL1, ENO2, COG6, RPL11B, HNT1, LEM3, GPI15, FSF1, SEC3, SOL2, PRS5, VPS71, ACC1, ADE8, GNA1, YNR024W, RSF2, MAL32, PAU21, SPS19, YIL002W-A, SPF1, CCT8, PRM2, PDH1, RBL2, PIF1, VBA1, AFG1, DIN7, IZH1, YPL105C, YCR051W, WWM1, SIP3, SYS1, HPC2, RPL40A, NCR1, YER078C, CAP1, GCN4, AIM38, PTC7, FUN14, COS8, MCH4, PRP24, CWC2, CLC1, SIR4, FUS3, YLR057W, ZRG17, YSA1, PTC3, UBP6, KAP122, EFT2, URA3, ALG2, POL5, RPL1B, LIP1, TMA20, NAS6, IRC5, KIN3, YPL033C, AVT4, YGR266W, CTI6, YNL050C, SDP1, ESF2, NFS1, YER078W-A, IZH4, CWC22, YGR110W, DYN2, SNF4, YMR178W, NSE5, RPL40B, TKL2, HIR1, RPS30A, HSP12, YDR539W, GCV1, NTG1, AZR1, SPO7, YNL022C, DIM1, VAM6, YNR061C, PDA1, YOR032W-A, SPC3, CSR1, COS9, YJR085C, PEX15, TGL2, SGD1, YPL278C, YIL108W, THP1, SCY1, YGR130C, UBC6, END3, UBP15, RPL35B, and MSB2.

In this production method, the expression levels of two or more arbitrary genes can be regulated individually by using two or more corresponding terminator regions for expressing the two or more arbitrary genes. In the case of exogenous genes for example, the expression levels of multiple exogenous genes can be controlled easily and precisely by using promoters with the same or different outputs.

To cause expression of arbitrary genes with such terminator regions, a vector can be constructed having DNA (a gene) coding for an arbitrary protein under the control of a promoter that functions in a yeast, and also having DNA comprising a terminator region disposed so as to transcriptionally control the gene, known yeast transformation techniques can then be used to obtain a recombinant yeast carrying this DNA, and this yeast can then be cultured.

The type of gene is not specified, and any gene may be used. For example, in the case of biomass including cellulose decomposition to produce a decomposition product that is used as is by a yeast for fermentation, the gene may be a cellobiohydrolase, endoglucanase or other cellulase gene, or a gene for a hemicellulase that decomposes hemicellulose. Other examples include genes for beta-glucosidase, xylose isomerase, and various other enzymes suited to using biomass including cellulose decomposition products. Other examples include enzymes for producing useful substances that may be industrial raw materials and the like by yeast fermentation. Scaffolding proteins for presenting such cellulases and the like on the yeast surface are also possible. Scaffolding proteins of various cellulose-producing microorganisms are known as scaffolding proteins.

A gene introduced from the outside into a host yeast is considered an exogenous gene even if it was originally intrinsic to the yeast. An exogenous gene may be expressed within a yeast, or may secretorily expressed outside the yeast. The mode of production may be selected as necessary. In the case of secretory expression, necessary gene modifications may be performed by known methods.

Methods of preparing and culturing (fermenting) such recombinant yeasts are well-known to those skilled in the art, and the present production method can be implemented by a person skilled in the art with reference to known techniques. Promoters that function in yeasts can be selected appropriately according to the desired expression intensity. When strong expression intensity is desired, a known high-output promoter such as a TEF1 promoter, ADH1 promoter, TPI1 promoter, HXT7 promoter, TDH3 promoter, PGK1 promoter, PYK1 promoter or the like can be selected appropriately. For induced expression, a GAL1 promoter, GAL10 promoter or other known inducible promoter can be used.

Various known yeasts can be used as host yeasts. For purposes of ethanol fermentation and the like, examples include *Saccharomyces cerevisiae* and other *Saccharomyces yeasts*, *Schizosaccharomyces pombe* and other *Schizosaccharomyces* yeasts, *Candida shehatae* and other *Candida yeasts*, *Pichia stipites* and other *Pichia* yeasts, *Hansenula* yeasts,

*Trichosporon* yeasts, *Brettanomyces* yeasts, *Pachysolen* yeasts, *Yamadazyma* yeasts, and *Kluyveromyces marxianus*, *Kluyveromyces lactis* and other *Kluyveromyces* yeasts and the like. Of these, a *Saccharomyces* yeast is preferred from the standpoint of industrial utility and the like, and *Saccharomyces cerevisiae* is especially desirable.

The recombination techniques and recombinant yeasts disclosed in the present Description as explained above can be achieved in accordance with the methods described in Molecular Cloning 3rd Edition and Current Protocols in Molecular Biology and the like. Various well-known conventional methods can also be used for transformation, such as transformation methods, transfection methods, conjugation methods, protoplast methods, electroporation methods, lipofection methods, lithium acetate methods and the like, which are similarly well-known to those skilled in the art.

(Regulator of Expression in a Yeast)

The regulator of expression in a yeast of the present teaching may include a yeast gene terminator region having the aforementioned expression intensity data. This expression regulator can enhance or suppress the expression output of an arbitrary gene when incorporated and used in an expression cassette, expression vector or the like. Suitable terminator regions for use in this expression regulator were explained above, and can be selected based on the aforementioned expression intensity data.

(Cassette for Gene Expression in Yeast)

The yeast expression cassette of the present teaching is provided with a promoter that functions in a yeast and the expression regulator of the present teaching, disposed downstream from this promoter. The expression cassette may also be provided with a multicloning site or other insertion site for introducing an exogenous gene that can be controlled by a promoter and the expression regulator of the present teaching. Moreover, this gene expression cassette may also be provided in advance with a suitable exogenous gene. Promoters and exogenous genes that can be used in this gene expression cassette were described above, and can be selected appropriately based on known techniques.

(Recombinant Yeast)

The recombinant yeast of the present teaching may be provided with a promoter that functions in the yeast, an exogenous gene controlled by this promoter, and the expression regulator of the present teaching disposed downstream from the exogenous gene. The exogenous gene is provided in such a way that it can be transcriptionally controlled by the expression regulator of the present teaching. Promoters and genes that can be used in the recombinant yeast are described above, and can be selected appropriately based on known techniques.

A recombinant yeast in which the expression intensity of one or two or more kinds of genes selected from the endogenous genes and exogenous genes has been modified using the terminator regions of one or two or more kinds of yeast genes each selected from the previously-described yeast genes with high expression intensity and yeast genes with low expression intensity is also provided as a recombinant yeast. The expression of another gene can also be regulated using the terminator region of a yeast gene with moderate expression intensity as described above.

(Method for Screening Regulators of Expression in Yeast)

The method of screening regulators of expression in a yeast of the present teaching comprises a step of evaluating the amount of an arbitrary protein produced by a recombinant yeast carrying DNA comprising a promoter that functions in the yeast, a coding region coding for the protein and a terminator region from a yeast gene, and a step of evaluating the expression intensity of the terminator region based on the amount of the protein.

Terminator regions suitable for regulating the expression of an arbitrary gene in a yeast can be screened by this method. Conventionally, it was not clear that terminator regions had this kind of expression regulating ability. With this screening method it is possible to provide a new means for regulating expression systems in a yeast, thereby facilitating more precise expression regulation of genes in a yeasts.

In the screening process, terminator regions in yeasts are obtained, recombinant yeasts are obtained each having introduced DNA comprising a promoter that functions in the yeast, one of the obtained terminator regions and a coding region encoding an arbitrary protein, which is disposed so that it can be expressed, and the amount of the protein obtained by the operation of the promoter and terminator region under fixed conditions is evaluated. The promoter is preferably one that is common to the terminator regions being evaluated. The arbitrary protein is also preferably one that is common to the terminator regions being evaluated. A protein the amount of which can be easily evaluated, such as GFP or another fluorescent protein, is preferably adopted as the arbitrary protein. The recombinant yeast is prepared and the terminator regions are obtained as explained above. Known conditions may be adopted for culturing the recombinant yeast when evaluating the amount of the protein.

Next, the expression intensity of the terminator regions is evaluated based on the amounts of the proteins produced by the recombinant yeasts. In the evaluation, the amount of the protein can be compared with the amount of protein produced under the same conditions using a terminator region for comparison, such as a known terminator region for example. When the protein is a fluorescent protein, relative intensity in comparison with a known terminator region or the like can be obtained by an evaluation using fluorescence intensity obtained with a fluorescence measurement device. The expression intensity of multiple terminator regions can also be compared by evaluating the amounts of proteins produced under identical conditions.

Expression of an exogenous gene with the desired intensity can be achieved by obtaining such terminator regions with various expression intensities. More precise expression regulation is facilitated by providing terminator regions as a new means for regulating output in an expression system.

(Method for Regulating Expression Intensity of Gene in a Yeast)

The disclosures of this Description provide a method for regulating the expression intensity of a gene in a yeast, whereby the expression intensity of one or two or more kinds of genes selected from the endogenous genes and exogenous genes is regulated by using the terminator regions of one or two or more kinds of yeast genes selected from yeast genes with high expression intensity and yeast genes with low expression intensity. This regulation method facilitates regulation of an arbitrary gene, such as raising or lowering the expression intensity of the gene. The expression intensity of an arbitrary gene can be regulated more easily and precisely by applying a new means of regulating gene expression, in addition to the type of promoter, the number of gene copies and the like. Yeast genes with high expression intensity and yeast genes with low expression intensity were explained above.

Moreover, the expression intensity of other endogenous genes and exogenous genes can also be regulated by using the terminator region of a yeast gene with moderate expression intensity as described above.

(Drug Screening Method Using Yeast)

The disclosures of this Description provide a method comprising a step of using the terminator regions of one or two or more kinds of yeast genes selected from yeast genes with high expression intensity and yeast genes with low expression intensity to obtain one or two or more kinds of recombinant yeasts in which the expression intensity of one or two or more kinds of genes selected from the endogenous genes and exogenous genes associated with a drug has been modified, and a step of using the one or two or more kinds of recombinant genes to screen that drug. With this screening method, drugs can be screened efficiently because it is possible to use a yeast in which the expression intensity of an arbitrary gene is regulated. Moreover, because the expression intensity of the arbitrary gene is regulated, it is possible to evaluate the relationship between the expression intensity or expression product quantity of this gene and the effect of the drug or the like.

EXAMPLE

The present teachings is not limited by these examples. The genetic recombination operations discussed below were performed in accordance with the published Molecular Cloning or the like.

Example 1

Preparation of Transformation Vector

In this example, a vector was prepared for causing expression of an exogenous gene using an arbitrary terminator in a yeast as shown in FIG. 1.

The vector prepared in this example was a CEN-type shuttle vector having at least one selection marker, one or two copies of which are carried in the yeast cell. That is, a TDH3 promoter having SacI sites added to both ends and a yeast codon-optimized GFP gene having KpnI sites added to both ends were cloned in that order between the SacI site and KpnI site of Takara Bio pAUR112.

Example 2

Design of Primers for Terminator Sequence Amplification

In this example, PCR primers were designed capable of amplifying the respective terminator regions of about 5295 genes selected from a yeast, and these primers were used to amplify terminator sequences from a genome. Using the public PCR primer design software Primer3 (primer3.sourceforge.net), forward primers and reverse primers for amplifying roughly 300 to 700 bp terminator regions downstream from the ORF of each gene were designed based on published yeast genome data available by ftp at ncbi.nih.gov/genomes/Fungi/Saccharomyces cerevisiae_uid128. The nucleotide sequences of the designed primers are shown by SEQ ID NOS:1-10590.

In each terminator-specific primer, 5'-GAATTG-TATAACTGAGGTACC-3' (SEQ ID NO:15886) was added to the 5' end of the forward primer and 5'-ATCAGTTATTAC-CCGGGTACC-3' (SEQ ID NO:15887) to the 5' end of the reverse primer as sequences for annealing with the 2nd PCR primers used in amplification, to ultimately synthesize 1st PCR primers. (Operon Biotechnologies, Inc.).

Example 3

Amplification of Terminator Sites from Yeast Genome

In this example, the respective terminator sites were amplified by a gene amplification reaction from a yeast genome using the primers prepared in Example 2. That is, genome DNA was extracted from the wild yeast W303-1a strain, and used as the template in a PCR reaction using PRIMESTAR® HS DNA Polymerase (Takara Bio Inc.).

The PCR reaction was performed under the following conditions using the terminator-specific 1st PCR primers on a 96-well plate with 10 µl per well. 10 seconds at 98° C. was followed by 35 cycles of a cycle of 10 seconds at 98° C., 15 seconds at 55° C. and 15 seconds at 72° C. The samples at the four corner of the 96-well plate were electophoresed to confirm amplification.

Using 1 µl of the 1st PCR reaction solution diluted to 1/200 as the template, 2nd PCR was performed with 10 µl per well. DNA with the following nucleotide sequences was used as the forward primer and reverse primer for 2nd PCR.

Forward Primer:

(SEQ ID NO: 15888)
5'-CCGCTGCTGGCATTACCCATGGTATGGATGAATTGTATAACTGAG

GTAC-3'

Reverse Primer:

(SEQ ID NO: 15889)
5'-CTCACAAATTAGAGCTTCAATTTAATTATATCAGTTATTACCCGG

GTAC-3'

The PCR reaction was performed under the following conditions. 15 seconds at 98° C. was followed by 30 cycles of a cycle of 10 seconds at 98° C., 15 seconds at 61° C. and 15 seconds at 72° C. The samples at the four corner of the 96-well plate were electrophoresed to confirm amplification. The 96-well plate was dried with a vacuum pump, and stored at 4° C.

Example 4

In this example, each terminator site was cloned to a yeast by the gap repair cloning method.

Because homologous recombination occurs and DNA fragments can be linked in the cells of budding yeasts if there are homologous regions of roughly tens of bp, (Ma H, Kunes S, Schatz P J, Botstein D, Gene, 58, 201-216 (1987)), the PCR amplified vector fragments were cleaved with a restriction enzyme, mixed, and transformed into a yeast using the aforementioned vector homologous parts of the 2nd PCR primers, and the terminator sites were cloned downstream from the GFP gene.

A wild strain of yeast (W303-1a) was cultured in YPD liquid medium, and then treated with a FROZEN-EZ YEAST TRANSFORMATION II KIT™ (Zymo Research) to prepare competent cells. The aforementioned transformation vector was cleaved with KpnI, and 40 ng of the cleaved vector and 10 µl of competent cells per sample were added to the 2nd PCR product dried on the 96-well plate, and mixed well at room temperature.

Transformation was performed for 45 minutes at room temperature, and the transformation solution was added to 1 ml of uracil-deficient medium (2% glucose, 0.67% Yeast Nitrogen base w/o amino acids (Difco Laboratories, Inc.), 0.082% Complete Supplement Mixture (CSM)+40Ade (ForMedium Ltd.)), and then added to a 96 deep well plate and shaking cultured for 60 hours at 30° C., 160 rpm with a Bioshaker (TAITEC CORPORATION).

Example 5

In this example, terminator activity was evaluated by evaluating the GFP protein produced by the yeasts prepared in Example 4 by flow cytometry (FCM).

The fluorescence of the GFP protein inside the yeast cells was excited with a 488 nm laser using a 510/10 filter set in a CELL LAB QUANTA™ SC MPL flow cytometer (Beckman-Coulter Inc.). About 5300 individual fluorescence intensities were measured in transformed yeasts each having a different terminator.

The average value of fluorescence intensity was determined with Igor Pro ver. 6.1 (WaveMetrics) based on the measured values of fluorescence intensity, and standardized using 1 as the value for the commonly-used PGK1 terminator. The standard deviation was determined for the 5295 terminators for which activity could be measured, as shown in FIG. 2. The average values for fluorescence activity were converted to relative expression intensity, and given as follows.

ORC4 (0.030), ICY2 (0.044), GIC1 (0.047), HLR1 (0.053), ECM13 (0.057), YLR108C (0.060), AQR1 (0.064), YHR213W-A (0.065), SUT1 (0.068), PLB3 (0.070), AIM26 (0.072), TPO4 (0.073), YPR153W (0.073), GIS3 (0.073), WSC3 (0.079), FUR4 (0.079), DLT1 (0.080), MOT1 (0.080), YNR063W (0.081), MET13 (0.081), YDL156W (0.082), YJL107C (0.082), YJR154W (0.082), YNL042W-B (0.082), VHS1 (0.083), GPH9 (0.084), YIL057C (0.084), STD1 (0.085), CTF19 (0.088), RAD34 (0.088), YIR021W-A (0.088), FZF1 (0.089), YHK8 (0.089), YGL188C-A (0.089), HCM1 (0.090), CDC6 (0.090), YPR157W (0.091), CLB6 (0.091), YOX1 (0.091), YLR285C-A (0.091), YDR114C (0.092), YHR199C-A (0.092), MPS3 (0.092), MUP3 (0.093), YIR014W (0.094), AAR2 (0.094), YPT35 (0.094), AIM33 (0.095), SCW1 (0.095), BDF1 (0.095), YCL042W (0.096), BSC4 (0.096), YGL193C (0.096), NUT2 (0.097), YJL118W (0.098), YKL069W (0.099), SRB8 (0.099), YOR060C (0.099), MDH2 (0.099), YPR116W (0.100), YPK2 (0.101), GLN3 (0.101), YDL211C (0.101), RAD55 (0.102), CYM1 (0.102), ENT4 (0.102), ULA1 (0.103), YMR182W-A (0.104), YKR017C (0.104), YOR302W (0.106), YOR072W-B (0.107), VTS1 (0.107), FYV12 (0.107), YGL235W (0.108), YHR086W-A (0.108), YEL067C (0.109), YPL257W (0.109), UBA3 (0.109), YMR105W-A (0.109), YOR316C-A (0.110), TMA10 (0.10), YDL159W-A (0.112), ATG29 (0.113), YML037C (0.113), NSL1 (0.113), YJL077W-B (0.113), POP3 (0.113), WHI5 (0.113), MIH1 (0.114), YGR240C-A (0.115), YRM1 (0.115), KAR9 (0.115), YJU2 (0.116), SPC24 (0.116), DPB2 (0.117), CHL4 (0.117), YMR087W (0.118), CSI1 (0.118), YIL134C-A (0.118), BUR2 (0.118), PTH1 (0.119), SSN8 (0.119), AUA1 (0.119), YLR154C-G (0.120), YLR342W-A (0.120), YCL001W-A (0.120), FLC1 (0.121), YLL006W-A (0.121), VAM7 (0.121), YPL077C (0.121), CCZ1 (0.123), PRP28 (0.123), ACM1 (0.123), IME4 (0.123), YPR096C (0.123), FRE5 (0.124), PDR8 (0.125), ILV5 (0.125), YIL161W (0.126), PAC11 (0.126), UBR2 (0.126), YRB2 (0.128), YLR125W (0.128), YMR253C (0.128), DSE4 (0.128), EPL1 (0.128), SNP1 (0.128), YMR160W (0.128), SPO77 (0.129), BUB1 (0.129), YFR016C (0.129), SPC97 (0.130), GEM1 (0.130), INO2 (0.130), SPT10 (0.130), YLR132C (0.131), AIM45 (0.131), YJR054W (0.132), MBF1 (0.132), YAL064C-A (0.132), YML054C-A (0.132), NUP1 (0.132), ECM27 (0.132), YIL060W (0.133), IRE1 (0.133), YHR177W (0.134), YJR079W (0.134), YNL187W (0.136), YML003W (0.136), PIH1 (0.136), YDR169C-A (0.136), PET111 (0.137), YDL109C (0.137), YOR012W (0.138), YHR050W-A (0.138), TAR1 (0.139), RIM9 (0.139), YCR095W-A (0.140), RPR2 (0.140), COS7 (0.140), YDR049W (0.142), CUS1 (0.142), JJJ3 (0.142), COS10 (0.143), MET1 (0.144), HXT8 (0.145), GLY1 (0.146), SUR1 (0.146), RTG1 (0.147), PHM7 (0.147), YJL052C-A (0.147), HXT17 (0.147), YFL052W (0.148), ATG1 (0.148), ECM2 (0.148), YNR075C-A (0.148), YKR041W (0.149), ALD5 (0.149), YHL018W (0.149), LUC7 (0.149), YPS5 (0.149), YLR297W (0.150), SNA4 (0.150), BIO4 (0.150), YBR298C-A (0.150), ECM12 (0.152), SEF1 (0.152), YMR247W-A (0.152), EXO1 (0.153), CTF13 (0.154), HUR1 (0.154), SNO3 (0.154), BSC5 (0.154), YER175W-A (0.155), PGA1 (0.155), YLR173W (0.156), YDR119W-A (0.157), IRC15 (0.157), MGA1 (0.157), YPR174C (0.159), IML3 (0.159), YLL054C (0.159), RDS1 (0.159), MDM32 (0.160), PET494 (0.160), YPR036W-A (0.160), GTB1 (0.160), ISF1 (0.161), KRE29 (0.161), SAP190 (0.161), YHR214C-E (0.162), GTO3 (0.163), YOR365C (0.163), MIP1 (0.163), SIP5 (0.164), YPL191C (0.164), YPL162C (0.164), YMR291W (0.165), BRN1 (0.166), MDM1 (0.166), NAT4 (0.166), YLR406C-A (0.166), YME1 (0.166), CSI2 (0.166), YOR008C-A (0.167), CEF1 (0.169), BUD25 (0.169), DFG16 (0.170), GPB1 (0.170), KAR1 (0.170), PPM2 (0.171), DSS1 (0.171), RPC37 (0.172), VID24 (0.172), ERV41 (0.172), YGR169C-A (0.172), ECM8 (0.173), YHR032W (0.173), ELA1 (0.173), PEX29 (0.173), LTE1 (0.173), HAT2 (0.174), SLI1 (0.174), MUP1 (0.175), ALG13 (0.176), FRE7 (0.176), YMR147W (0.177), ISU2 (0.177), YOR1 (0.178), JID1 (0.179), ECM3 (0.179), ATG5 (0.179), MED6 (0.180), YPL014W (0.180), YLR030W (0.180), AQY2 (0.180), CCT2 (0.180), YER067W (0.181), NRG1 (0.181), SPT8 (0.181), PIR1 (0.181), YGR068C (0.182), YER039C-A (0.182), ELM1 (0.182), ASE1 (0.182), YBL095W (0.183), YNR066C (0.183), MTL1 (0.183), CNE1 (0.183), CAX4 (0.183), NDI1 (0.184), FLX1 (0.184), YNL130C-A (0.184), CWC25 (0.186), YNL254C (0.186), CDC13 (0.186), ATP10 (0.187), OCT1 (0.187), ALF1 (0.187), YEF1 (0.187), BAP2 (0.187), HTL1 (0.188), PDC5 (0.189), PKP1 (0.190), SSK2 (0.191), CAF120 (0.192), SKN1 (0.192), HHF1 (0.193), CDC39 (0.194), YFR012W (0.194), YEL048C (0.194), HAP4 (0.195), PEX7 (0.195), TPO1 (0.196), NFT1 (0.196), NGL3 (0.198), YMR206W (0.199), DUS3 (0.200), YAP7 (0.200), CUS2 (0.201), YLR415C (0.201), FUI1 (0.202), SLM5 (0.203), BTT1 (0.203), YFR035C (0.203), RRN10 (0.203), HAP3 (0.204), SSY5 (0.204), SFL1 (0.204), KIP1 (0.205), CDC15 (0.206), GLT1 (0.207), DOC1 (0.208), MND1 (0.209), AAC1 (0.209), CEP3 (0.209), UBC5 (0.209), YNL213C (0.209), CLN3 (0.210), CSF1 (0.210), ECM18 (0.210), MRS4 (0.210), YIL046W-A (0.211), INP1 (0.211), RTT105 (0.211), MPT5 (0.211), ATG15 (0.212), RNH202 (0.212), TAX4 (0.213), IZH3 (0.213), BDF2 (0.214), COX14 (0.214), YIP4 (0.214), YJR120W (0.214), SAE2 (0.215), YMC2 (0.216), YGR035C (0.216), NDD1 (0.216), HPA2 (0.216), STL1 (0.216), GPM3 (0.216), ERF2 (0.217), MMS21 (0.217), YJL133C-A (0.218), YNL024C (0.218), IFH1 (0.219), LIN1 (0.220), ICS3 (0.220), YNR014W (0.220), SPB1 (0.220), YNL211C (0.221), SOL1 (0.221), COS111 (0.221), HSH155 (0.221), NKP2 (0.221), NAB3 (0.221), FMT1 (0.222), YPL152W-A (0.222), BOR1 (0.222), SPC25 (0.222), MMS1 (0.222), YIL166C (0.223), MAL13 (0.223),

BFA1 (0.223), AEP3 (0.224), MTH1 (0.225), YGR031W (0.225), BIT61 (0.227), YMR230W-A (0.227), SKT5 (0.227), YGL258W-A (0.227), PHR1 (0.227), HTB2 (0.228), SER1 (0.229), BAP3 (0.230), YER053C-A (0.230), ATG6 (0.231), BIO2 (0.231), MEP3 (0.232), YNR073C (0.232), PCH2 (0.232), APS2 (0.232), MDM30 (0.233), CLB5 (0.233), ISR1 (0.234), MRP20 (0.234), GUD1 (0.235), MED1 (0.235), RER2 (0.236), MCM10 (0.236), YIR018C-A (0.236), SPO14 (0.236), NUC1 (0.237), MNN4 (0.237), IFM1 (0.237), YLR412C-A (0.237), ALT2 (0.237), NNF1 (0.238), YKL096C-B (0.239), RAD51 (0.239), CIT2 (0.239), SPT4 (0.239), LRC4 (0.240), USE1 (0.240), YLR455W (0.241), YOL164W-A (0.241), PRP18 (0.242), COA2 (0.242), HSP82 (0.243), YER184C (0.244), DAD2 (0.246), LEU1 (0.247), YDL129W (0.247), YPL119C-A (0.248), YOR034C-A (0.249), PRP38 (0.249), MSA1 (0.250), YBR147W (0.250), BBP1 (0.250), MLH1 (0.250), SWC3 (0.251), SOH1 (0.251), HHF2 (0.251), NIP1 (0.251), MSL1 (0.251), RIF2 (0.252), SPG1 (0.252), WHI3 (0.253), HTA1 (0.253), ARR3 (0.253), YIL077C (0.253), SGF29 (0.254), RAD53 (0.255), YEL073C (0.257), YNR065C (0.258), NCA3 (0.258), YBR296C-A (0.259), ECM23 (0.259), YLR225C (0.259), SLD3 (0.259), YBR197C (0.259), YBL059W (0.260), YOL075C (0.262), DNA2 (0.263), SIZ7 (0.263), REC114 (0.263), MSN1 (0.264), RGT2 (0.264), CBF1 (0.264), YGL176C (0.265), PTP2 (0.265), GAL3 (0.265), VPS62 (0.266), HMS2 (0.266), SMF3 (0.267), APL1 (0.268), SKI3 (0.268), MNS1 (0.268), YOR214C (0.268), TID3 (0.269), KSS1 (0.269), YDR194W-A (0.270), UPC2 (0.270), ARG80 (0.270), MRS2 (0.271), ATP23 (0.272), YML100W-A (0.272), YGL101W (0.272), STE12 (0.272), RPI1 (0.273), YDR090C (0.273), YEH1 (0.273), UTP13 (0.273), AMN1 (0.275), YIL089W (0.275), AVL9 (0.276), ATO2 (0.276), HEM3 (0.276), RPA14 (0.277), GIP3 (0.277), YGR053C (0.278), ALR2 (0.278), YAP1 (0.278), CDD1 (0.279), SLS1 (0.279), MET6 (0.279), ABM1 (0.279), PET20 (0.280), CBP1 (0.280), RAD10 (0.280), SPO22 (0.281), PIB1 (0.281), EAF3 (0.281), YFR032C-B (0.282), ELP2 (0.282), YIA6 (0.282), PET112 (0.282), PAU7 (0.283), MEI4 (0.283), YEA4 (0.283), SGS1 (0.284), JEN1 (0.284), CLB2 (0.284), GIC2 (0.284), SWI6 (0.284), ULP2 (0.286), KIN28 (0.286), YKL033W (0.286), CSM4 (0.286), YNL095C (0.286), RRN3 (0.286), RNR1 (0.286), TPO3 (0.286), SUP45 (0.287), ABP140 (0.288), RPS28B (0.289), MRF1 (0.289), GLN1 (0.290), OPT1 (0.291), PHO4 (0.291), UBP10 (0.291), YOL163W (0.291), MDS3 (0.292), OTU1 (0.292), GAT1 (0.292), HDA3 (0.293), MSY1 (0.294), GNP1 (0.295), YFL041W-A (0.295), YPL141C (0.295), MPH2 (0.295), PMA1 (0.296), YNL260C (0.296), SKS1 (0.296), YDL177C (0.296), SWR1 (0.296), RMD5 (0.297), RPL9B (0.297), MIC14 (0.297), AOS1 (0.297), LRG1 (0.297), ROX1 (0.298), PCL10 (0.298), MRPL3 (0.298), YER152C (0.298), EAF1 (0.298), HTB1 (0.298), SPA2 (0.299), SSN2 (0.299), YJR129C (0.300), ATG8 (0.300), RHR2 (0.300), TFG2 (0.300), YBL100W-C (0.301), CSM2 (0.301), EXG1 (0.301), STE7 (0.301), ADH2 (0.302), SNT2 (0.302), PML39 (0.302), SEC2 (0.303), ASI2 (0.305), MNT3 (0.306), BUR6 (0.306), BIO5 (0.306), YDR506C (0.306), RDR1 (0.307), MRPL33 (0.307), YGL159W (0.307), RIM8 (0.309), YGR161W-C (0.310), YIG1 (0.310), PDR16 (0.310), YDR249C (0.311), YDR124W (0.311), HSP30 (0.311), SDH2 (0.313), YER130C (0.313), FAA3 (0.314), BUD22 (0.314), TIM22 (0.315), CBP6 (0.316), ICE2 (0.316), SPC110 (0.316), AFT2 (0.316), NAM2 (0.316), YPR071W (0.317), DIP5 (0.317), SDS3 (0.317), POP4 (0.317), OCA6 (0.317), PTC6 (0.317), YBR201C-A (0.318), YPR127W (0.318), SEC10 (0.318), ASF2 (0.318), SLI15 (0.319), RRN7 (0.320), ORC2 (0.320), GUF1 (0.320), GPI2 (0.323), RPS9A (0.324), RAD6 (0.324), PSR2 (0.325), RIP1 (0.325), GZF3 (0.325), YBR182C-A (0.326), IRC7 (0.326), ASG7 (0.327), YOR381W-A (0.327), OCA5 (0.327), YHR035W (0.328), PET17 (0.329), ISD11 (0.329), HSP150 (0.329), CCC2 (0.329), YHR131C (0.329), MRK1 (0.330), RXT2 (0.330), PPH3 (0.330), ODC2 (0.331), SHE9 (0.331), YCR075W-A (0.331), CYB5 (0.332), YDR415C (0.332), LRO1 (0.333), SOF1 (0.333), YNL162W-A (0.334), PAU4 (0.335), MTO1 (0.336), YKL061W (0.336), MSS11 (0.336), SAN1 (0.336), SET2 (0.336), YMR1 (0.336), PHD1 (0.338), YBL071C-B (0.338), MPA43 (0.339), SAM37 (0.339), AAT1 (0.339), ASH1 (0.340), UTR2 (0.340), CAT8 (0.341), SLX8 (0.341), HXT2 (0.342), COY1 (0.342), TAF3 (0.342), DSS4 (0.342), TOR1 (0.342), YMR030W-A (0.343), PAU5 (0.343), SFP1 (0.343), FHL1 (0.344), COX10 (0.344), DDR2 (0.344), SWM1 (0.345), HXT6 (0.346), RCR2 (0.346), YLR091W (0.346), RMD9 (0.346), SHQ1 (0.346), YLR346C (0.347), SPT21 (0.347), ARE1 (0.348), KAP95 (0.349), YGR071C (0.349), TRL1 (0.350), ECM17 (0.350), YML020W (0.350), RPO41 (0.351), CFT1 (0.351), LRC5 (0.352), THI74 (0.352), TPN1 (0.352), YOR059C (0.352), PRY3 (0.352), YEL1 (0.352), CNM67 (0.353), STB6 (0.354), YOR385W (0.354), RRN6 (0.354), COP1 (0.354), PDR12 (0.355), ELG1 (0.355), SRP40 (0.355), SRM1 (0.355), YDR109C (0.356), AIM30 (0.356), RPC17 (0.356), YJL028W (0.356), YBR071W (0.357), APS1 (0.357), KIP2 (0.358), ATP22 (0.358), PRM6 (0.358), BUD31 (0.359), IXR1 (0.359), NFI1 (0.359), YHL015W-A (0.359), VHS3 (0.360), YNL295W (0.361), SML1 (0.361), SSK1 (0.361), YAE1 (0.361), RIM2 (0.361), YDR246W-A (0.362), YLR445W (0.362), SPT23 (0.362), MTG2 (0.363), SGF11 (0.363), BRL1 (0.363), YMR315W (0.364), MRPS28 (0.365), ERG5 (0.365), UTP30 (0.365), MDM35 (0.365), ASR1 (0.366), YIL102C-A (0.366), USA1 (0.366), DOT6 (0.368), COX23 (0.369), ADH5 (0.370), DAN4 (0.370), RMA1 (0.370), SCT1 (0.370), PHO84 (0.371), SFG1 (0.371), SLX4 (0.372), EST1 (0.373), YNL190W (0.373), SNL1 (0.374), RRP15 (0.374), YML082W (0.375), DOT1 (0.375), PEX1 (0.375), YUR1 (0.376), YAP1802 (0.376), YDR185C (0.376), GET2 (0.376), YPL264C (0.377), YDR065W (0.377), YJR115W (0.378), MAK21 (0.378), YER064C (0.378), ATR1 (0.378), IDP2 (0.378), KCS1 (0.379), ZPR1 (0.379), ITC1 (0.379), OAZ1 (0.379), SWC7 (0.380), RPL8A (0.380), CAC2 (0.380), VTH1 (0.382), OCH1 (0.382), BUL1 (0.382), YNR004W (0.382), LST7 (0.382), MRPS8 (0.383), TIS11 (0.383), NDC1 (0.384), TOS8 (0.385), ISM1 (0.385), MSL5 (0.385), FMP43 (0.386), YJR098C (0.386), COQ3 (0.387), TPC1 (0.388), RIM101 (0.388), ADR1 (0.388), ALD6 (0.389), YHR087W (0.389), VPS21 (0.389), POG1 (0.389), YJR005C-A (0.389), SNT1 (0.390), YHR022C (0.390), MEF1 (0.390), PUP2 (0.391), ERP6 (0.391), HHT2 (0.392), YGR146C (0.392), OAR1 (0.392), YOR129C (0.392), YCR045C (0.392), DBP7 (0.393), MUB1 (0.393), YPL236C (0.393), RIB2 (0.394), YPR084W (0.394), AIM5 (0.395), UTR5 (0.395), HKR1 (0.396), YMR010W (0.397), ALR1 (0.398), LRE1 (0.399), RPN4 (0.399), YLR363W-A (0.399), MGM1 (0.399), HTD2 (0.399), NAM8 (0.399), SED5 (0.400), YOR161C-C (0.401), YML018C (0.401), NAB2 (0.401), YER140W (0.402), PRM4 (0.402), RTR1 (0.402), YIR042C (0.402), THI80 (0.402), FUN19 (0.402), DMR1 (0.402), SIP1 (0.403), CGR1 (0.403), MTR3 (0.404), YJL144W (0.404), RIM13 (0.404), SAL1 (0.405), MET28 (0.405), INM1 (0.405), VID27 (0.405), CDC34 (0.406), SRO9 (0.406), RRP9 (0.406), YOL087C (0.406), MCM22 (0.406), YMR111C (0.406),

NDJ1 (0.407), ATG12 (0.407), MSM1 (0.408), SRS2 (0.408), YBR225W (0.409), YLR063W (0.410), AI1 (0.410), CDC36 (0.410), ASN1 (0.410), MET3 (0.410), SSP1 (0.410), NGG1 (0.410), RBA50 (0.411), PUT1 (0.412), YPT53 (0.412), NMA2 (0.412), YBR219C (0.413), CDC40 (0.413), SGO1 (0.414), YJL047C-A (0.414), RPC31 (0.414), INP52 (0.414), UGO1 (0.414), RAD30 (0.415), CLB1 (0.415), GLO4 (0.415), TPK3 (0.416), GIM3 (0.416), CDC9 (0.417), PEX27 (0.417), AIM32 (0.417), YGL081W (0.418), DJP1 (0.418), HMS1 (0.419), JSN1 (0.419), UBP12 (0.420), RSM25 (0.420), UBP5 (0.420), GIP1 (0.420), PUT3 (0.421), CKI1 (0.421), FAR7 (0.421), LAG2 (0.421), DAM1 (0.422), PSD2 (0.423), HMT1 (0.423), COR1 (0.423), MMR1 (0.424), MRPL39 (0.424), CTF8 (0.424), AGP2 (0.425), PRM7 (0.425), HIT1 (0.425), HAL9 (0.426), GPA2 (0.426), TIM44 (0.426), TFB1 (0.426), ECM19 (0.428), MRPL32 (0.428), YBR284W (0.428), NAS2 (0.429), SBE22 (0.429), YOR011W-A (0.430), ORT1 (0.430), MRPL25 (0.430), QNQ1 (0.430), APC4 (0.430), TYE7 (0.431), YPP1 (0.431), MMT1 (0.431), MRP10 (0.431), MRPS5 (0.431), LIP5 (0.431), CDC27 (0.432), ESC2 (0.432), CAN1 (0.433), MEC1 (0.433), TOP1 (0.433), SLM3 (0.433), SIP4 (0.434), URN1 (0.434), YCK3 (0.434), USO1 (0.434), RSM19 (0.434), ASG1 (0.434), ISU1 (0.435), YHL008C (0.435), YNL313C (0.435), KKQ8 (0.436), FCY2 (0.436), GPD1 (0.436), HHT1 (0.437), MDJ2 (0.437), SDH1 (0.437), SSF1 (0.437), PIP2 (0.438), STE13 (0.438), AZF1 (0.438), VPS35 (0.438), YGL146C (0.439), TAM41 (0.440), MIF2 (0.441), YDL118W (0.441), HFM1 (0.441), PRR1 (0.441), MRE1 (0.442), FMP37 (0.442), MLH2 (0.442), BUD5 (0.443), YOR342C (0.443), PCL1 (0.443), DHR2 (0.444), CDC5 (0.444), CBP3 (0.444), RLP24 (0.444), LSG1 (0.444), NCL1 (0.444), YDR262W (0.445), PGA3 (0.445), MID2 (0.445), YJL027C (0.446), YOR305W (0.446), QCR6 (0.447), MSC6 (0.447), RSC4 (0.447), PAU18 (0.448), POL12 (0.448), SME1 (0.448), DBF2 (0.448), RPS27A (0.448), NHP6A (0.449), YGK3 (0.449), SLO1 (0.452), AIM36 (0.452), UBP13 (0.452), TRI1 (0.453), CTH1 (0.453), PGS1 (0.454), NMD4 (0.455), YIL064W (0.455), BAR1 (0.456), BCS1 (0.456), YBL029W (0.456), CTR1 (0.456), MRPL20 (0.457), AGP3 (0.457), YOR338W (0.457), FCF2 (0.457), YOR052C (0.457), YJL147C (0.457), RSA1 (0.457), PEX8 (0.458), YOL159C (0.459), RRP45 (0.459), YDL199C (0.459), LIA1 (0.459), THI2 (0.459), TRZ1 (0.459), CYT2 (0.460), MGM101 (0.460), YNL277W-A (0.460), ARP8 (0.460), MRPL36 (0.460), YAR028W (0.460), PAU2 (0.461), SLD5 (0.462), SMD1 (0.462), YNL086W (0.463), QCR7 (0.463), FMC1 (0.463), HOS4 (0.463), HEM1 (0.463), NAM7 (0.464), YPL108W (1.465), BUD14 (0.465), BOI2 (0.465), HRD1 (0.465), YOL114C (0.466), RIS1 (0.466), SIC1 (0.467), BST1 (0.467), KES1 (0.467), MET4 (0.467), TRS120 (0.467), SYC1 (0.468), NPA3 (0.469), YLH47 (0.469), SRL2 (0.469), LRC3 (0.469), MHR1 (0.470), ZIP2 (0.470), EAR1 (0.470), RSF1 (0.470), RIO2 (0.471), MET2 (0.471), NOP4 (0.471), SRD1 (0.471), PWP2 (0.472), MST1 (0.472), PCK1 (0.472), CDC7 (0.472), TOK1 (0.472), PRO1 (0.473), RAX2 (0.473), LSM7 (0.473), SHG1 (0.474), TOM7 (0.474), DAS2 (0.474), SIP2 (0.475), RRS1 (0.475), EUG1 (0.475), POX1 (0.475), RAD61 (0.476), SUN4 (0.476), HAA1 (0.476), YNR048W (0.477), ACO2 (0.477), YOL047C (0.477), PMD1 (0.477), FZO1 (0.477), YEL025C (0.477), GPR1 (0.478), BNI1 (0.478), RSA4 (0.478), YMR185W (0.478), PAU16 (0.479), ECM7 (0.479), YHP1 (0.479), COG8 (0.479), LST8 (0.479), HST1 (0.479), ESA1 (0.480), YJL160C (0.480), MER1 (0.480), CIN8 (0.480), WSS1 (0.481), PAT1 (0.481), LRC6 (0.482), FMP30 (0.482), LYS21 (0.483), MET18 (0.483), MRPL50 (0.483), GCR1 (0.484), YOR022C (0.484), YJR012C (0.484), PDR3 (0.485), YPL229W (0.485), SFK1 (0.485), DUS4 (0.485), IDS2 (0.486), YOL036W (0.486), PHM6 (0.486), YPR117W (0.486), RPB7 (0.486), MCM2 (0.487), MRS1 (0.487), GLO2 (0.487), YKL105C (0.487), RCK1 (0.487), AME1 (0.488), DIA3 (0.488), HOM3 (0.488), YDR541C (0.488), PMT6 (0.488), DSE2 (0.489), YJL216C (0.489), RIO1 (0.489), ALB1 (0.490), IBA57 (0.490), YOR268C (0.490), CWC24 (0.491), ARD1 (0.491), UTP15 (0.491), MSE1 (0.491), UBS1 (0.491), YNL234W (0.492), YDL025C (0.492), CAF40 (0.492), YBR221W-A (0.493), ATP18 (0.493), MAL33 (0.493), YPT6 (0.493), OAC1 (0.493), YJR151W-A (0.493), YML108W (0.494), COX17 (0.494), RAD52 (0.495), HST3 (0.495), TAZ1 (0.495), YNR064C (0.495), YGL010W (0.496), MFA2 (0.496), PGM3 (0.496), NRM1 (0.496), CRS5 (0.496), CTM1 (0.496), SKG6 (0.497), SYF2 (0.497), HYM1 (0.497), IPI3 (0.498), MDH1 (0.499), TFB2 (0.499), HST4 (0.499), MRPL24 (0.499), YMR166C (0.500), AVT5 (0.501), YGR021W (0.501), SUV3 (0.501), YNL146W (0.502), MID1 (0.502), AKL1 (0.503), MTR100 (0.503), LAA1 (0.503), HDA1 (0.504), SMY2 (0.504), MRPL8 (0.505), PLB2 (0.505), CWP1 (0.506), ECM14 (0.506), ECM1 (0.506), GAL2 (0.506), FAS1 (0.506), KEL1 (0.506), SET7 (0.506), TSR2 (0.507), FET5 (0.507), DRE2 (0.507), MMS4 (0.508), TGS1 (0.508), COQ1 (0.508), SUR7 (0.508), PCL2 (0.508), SER2 (0.509), YFL034W (0.509), MKK1 (0.509), SSA2 (0.510), AVO1 (0.510), FMP25 (0.511), YRR1 (0.511), SLX5 (0.511), SAF1 (0.511), YPL260W (0.511), YKR096W (0.511), UTP14 (0.511), PAM18 (0.512), WTM1 (0.512), STE18 (0.512), AIM20 (0.512), SYM1 (0.512), SIT4 (0.513), SSH4 (0.513), MEI5 (0.513), CYC8 (0.514), DSN1 (0.514), STB3 (0.514), IMD4 (0.514), YPL109C (0.514), ECM25 (0.514), YMR102C (0.515), YDR306C (0.516), SUL2 (0.516), YOL019W (0.516), PAU10 (0.516), HNM1 (0.516), MRPL1 (0.516), CMK1 (0.516), YBR196C-A (0.517), YGL226W (0.517), YPR147C (0.517), PGM2 (0.519), SLM4 (0.519), MSS1 (0.520), YER121W (0.520), YDR381C-A (0.520), VPS72 (0.520), YJL043W (0.520), PAN6 (0.520), YMR086W (0.521), MDN1 (0.521), HEH2 (0.521), YKE4 (0.521), YKL162C (0.522), ZRG8 (0.522), HIP1 (0.523), YPR145C-A (0.523), YCL056C (0.523), ERG1 (0.523), INP54 (0.523), MRPS16 (0.524), MOD5 (0.524), YJR008W (0.524), RMI1 (0.524), YNL146C-A (0.525), RRF1 (0.525), CAF130 (0.525), BUD9 (0.526), GWT1 (0.526), BEM3 (0.527), STF2 (0.527), SSN3 (0.527), MAS2 (0.527), SLN1 (0.528), TLG1 (0.528), NOP6 (0.528), YOR097C (0.528), HVG1 (0.528), GCD11 (0.528), TDP1 (0.528), ATC1 (0.529), CIT1 (0.529), GRR1 (0.529), RPA12 (0.530), ADY3 (0.530), CTA1 (0.530), SWS2 (0.530), SNF8 (0.530), CIS3 (0.530), MRPL4 (0.531), CLB4 (0.531), DBP2 (0.532), APQ12 (0.532), UTP5 (0.532), MPD1 (0.532), MRS3 (0.532), AIM43 (0.532), ATP11 (0.533), SNU66 (0.533), ARF3 (0.533), YKU80 (0.534), YLR422W (0.534), EGT2 (0.534), MSP1 (0.535), YLR218C (0.535), MRPL44 (0.535), YHR127W (0.536), UBP3 (0.536), SOD2 (0.536), CYT1 (0.536), POP6 (0.536), HSP10 (0.536), YHR033W (0.536), YKL161C (0.538), KIN82 (0.538), YNL165W (0.538), CYC7 (0.538), FYV7 (0.538), TAT1 (0.539), YNR040W (0.539), DBP3 (0.539), SMY1 (0.539), TRP3 (0.540), SSL2 (0.540), RPS24B (0.540), UTP4 (0.540), SAW1 (0.540), DAN2 (0.541), YPR011C (0.541), YER156C (0.541), YGL059W (0.541), TRM5 (0.541), SUT2 (0.541), IML2 (0.542), ATP1 (0.542), CKA1 (0.542), ECM31 (0.542), MSK1 (0.542), SCC2 (0.543), SYG1 (0.543), RPO26 (0.543), YPR114W (0.544), HIR3 (0.544), YIL029C (0.544), MAC1 (0.545), YOR296W (0.545), IST3 (0.546), HOR2

(0.546), ITT1 (0.547), PRP22 (0.547), ROD1 (0.548), DIA4 (0.548), FMP32 (0.548), TOM70 (0.548), DIP2 (0.548), YPR159C-A (0.549), PSP1 (0.549), BTS1 (0.549), ECM37 (0.550), AST1 (0.550), SMP1 (0.550), BPL1 (0.550), UPS1 (0.551), BAG7 (0.551), NOG2 (0.551), RPC10 (0.552), CYB2 (0.552), SMD2 (0.552), RAD1 (0.552), ATP3 (0.553), STP2 (0.553), BUD21 (0.553), RRN5 (0.553), YLR352W (0.553), FRE4 (0.553), PAN2 (0.554), APL3 (0.555), SEC7 (0.555), DUS1 (0.555), CSE1 (0.555), MAK3 (0.556), MRPL19 (0.556), DBP1 (0.556), FMP48 (0.556), JAC1 (0.556), VPS54 (0.556), FUR1 (0.557), PUP3 (0.557), FUN26 (0.558), SWI1 (0.558), PWP1 (0.559), BUD23 (0.559), ATF1 (0.559), FMP16 (0.559), YOL024W (0.560), IPK1 (0.560), RLM1 (0.560), YNG2 (0.560), MSS2 (0.561), FLO8 (0.561), SHY1 (0.561), KSP1 (0.561), KNH1 (0.562), DON1 (0.562), KTI1 (0.562), SMC5 (0.562), FPS1 (0.562), SHU1 (0.563), RAV2 (0.563), YOR356W (0.563), PFA3 (0.564), ERG8 (0.564), SEN15 (0.565), YNL152W (0.565), YJL193W (0.565), MSH2 (0.565), CYC1 (0.565), YLR446W (0.566), MRPL13 (0.566), ISA1 (0.566), HUA1 (0.567), YHL010C (0.567), NNT1 (0.567), RMD8 (0.567), PPR1 (0.568), ECM9 (0.568), BSC2 (0.568), ACO1 (0.568), MPS2 (0.568), LEE1 (0.568), COG5 (0.568), MCM1 (0.569), RFC1 (0.569), TAT2 (0.569), DML1 (0.569), KRE9 (0.570), SPT2 (0.571), SPC19 (0.571), QCR8 (0.571), HXT1 (0.572), DOA4 (0.572), MSR1 (0.572), STU1 (0.572), ERG10 (0.573), TFB4 (0.573), ATG21 (0.573), GYP6 (0.574), DAD4 (0.574), OAF1 (0.574), YPR013C (0.574), GAS1 (0.574), FAP7 (0.575), CPA2 (0.575), RPO31 (0.575), ATG20 (0.575), TEP1 (0.575), YBL081W (0.575), SMP3 (0.575), MCD1 (0.576), ADK2 (0.576), SAD1 (0.576), HUA2 (0.577), BUD2 (0.577), YJR136C (0.577), RPS14B (0.578), MNL1 (0.578), MDJ1 (0.578), FLO10 (0.578), REB1 (0.578), DSF2 (0.579), KHA1 (0.580), MRPL35 (0.580), YOR283W (0.580), PPG1 (0.581), CIT3 (0.581), FAA4 (0.581), SPL2 (0.581), MET8 (0.581), HOP2 (0.582), HFA1 (0.582), HAP5 (0.583), ROG1 (0.584), MAM3 (0.584), DPH1 (0.584), RTG3 (0.584), YNL195C (0.584), DCN1 (0.584), YLR211C (0.585), OXA1 (0.585), YET2 (0.585), RSC2 (0.586), MRPL28 (0.586), CTT1 (0.586), YAP3 (0.586), BIG1 (0.587), UBP8 (0.587), YOL019W-A (0.587), RIB5 (0.587), NOG1 (0.588), VID30 (0.588), MRP17 (0.588), ZRT1 (0.588), UAF30 (0.588), SPO23 (0.589), YNL122C (0.589), SNU71 (0.590), CDC43 (0.591), SPC29 (0.591), DYS1 (0.591), PRP1 (0.591), SYF1 (0.591), BUD20 (0.591), MEK1 (0.592), UBP16 (0.592), PCF11 (0.592), GRX4 (0.593), UTP22 (0.593), HRK1 (0.593), RPB9 (0.593), YPL272C (0.593), ERG29 (0.594), DIS3 (0.594), YFH1 (0.594), MRM2 (0.595), RRP5 (0.595), PTI1 (0.595), TIF6 (0.595), FTH1 (0.595), MPE1 (0.595), FKS3 (0.595), ESP1 (0.596), YDL007C-A (0.596), DMC1 (0.596), JHD2 (0.597), LEU2 (0.597), SNF3 (0.597), SCJ1 (0.597), YMR317W (0.598), CYK3 (0.598), GPT2 (0.598), FMP41 (0.598), SIA1 (0.598), HXK1 (0.598), YGL057C (0.599), YLR287C (0.599), NSR1 (0.599), YDL241W (0.599), RKR1 (0.599), REX4 (0.600), TIM17 (0.600), TES1 (0.600), RPO21 (0.600), YNL300W (0.601), BSC6 (0.601), YHR080C (0.601), OPI10 (0.602), RPB8 (0.602), UBP9 (0.602), YKR011C (0.602), CRP1 (0.602), RSM24 (0.602), ARP1 (0.603), SIK1 (0.603), GCR2 (0.603), YLR345W (0.603), FET4 (0.603), MRPL40 (0.605), THP2 (0.606), AMD2 (0.607), YDR524W-C (0.607), PSY4 (0.607), BUD16 (0.607), HPT1 (0.608), YDR333C (0.608), RHO4 (0.609), AHC1 (0.609), YJL206C (0.609), SWT1 (0.610), HEK2 (0.610), ATP12 (0.610), XBP1 (0.610), RMD6 (0.611), RPL15B (0.611), NUP42 (0.611), PLC1 (0.611), MAD3 (0.612), YPS1 (0.612), MCM16 (0.612), HXT4 (0.612), HXK2 (0.612), ERG12 (0.613), MMT2 (0.613), YMR321C (0.613), MUM3 (0.613), HST2 (0.613), ROG3 (0.613), DEF1 (0.615), YLR281C (0.615), SSK22 (0.616), MLH3 (0.617), YGR1311 (0.617), CSE4 (0.617), YCL002C (0.617), MRPS18 (0.618), CAD1 (0.618), AIF1 (0.618), SFC1 (0.618), OYE3 (0.619), EAF5 (0.619), RSC9 (0.620), GYL1 (0.620), YDL063C (0.620), ISA2 (0.621), GBP2 (0.621), IMG1 (0.621), NRP1 (0.621), DHH1 (0.622), RHB1 (0.622), CIK1 (0.623), PHO89 (0.623), AGX1 (0.623), RPB2 (0.624), MRPL17 (0.624), GPX2 (0.625), LYP1 (0.625), VPS9 (0.625), BNA3 (0.626), CKA2 (0.626), OPI1 (0.626), YER034W (0.626), RSM26 (0.626), ISM6 (0.627), THI3 (0.627), SMC4 (0.627), SWF1 (0.627), YAH1 (0.628), RPF2 (0.628), HFI1 (0.628), PLB1 (0.628), MAM33 (0.628), YLR413W (0.628), PRP8 (0.628), ENO1 (0.629), RPC19 (0.629), YGL007C-A (0.629), YMR181C (0.629), URA7 (0.629), YGL108C (0.629), SRB7 (0.630), DAD1 (0.630), LYS4 (0.630), ATG18 (0.630), FMP45 (0.630), VAM3 (0.630), SSC1 (0.631), SNU56 (0.631), YIR045W (0.631), HTA2 (0.631), YJL213W (0.631), RPL20A (0.632), ALD4 (0.632), QCR10 (0.632), YGR287C (0.632), CBP4 (0.632), PCI8 (0.632), MCM4 (0.632), DEM1 (0.633), ATO3 (0.633), TPS2 (0.633), TAF1 (0.633), KRE6 (0.634), KGD2 (0.634), ARB1 (0.635), NMD5 (0.636), EFR3 (0.637), TRP4 (0.637), HLJ1 (0.638), ACE2 (0.638), LDB17 (0.638), ATG7 (0.639), OSH6 (0.639), AFT1 (0.639), CTF4 (0.639), YDR286C (0.639), AIM44 (0.639), YLR149C (0.640), MRPS9 (0.640), BET1 (0.641), YLF2 (0.641), BOI1 (0.642), BUD4 (0.642), CRF1 (0.642), MLP2 (0.643), ARX1 (0.643), RRP12 (0.644), NAT2 (0.645), PCL7 (0.645), ARP7 (0.645), SFH1 (0.645), STF1 (0.645), YML081W (0.646), MRP49 (0.646), FOL3 (0.646), SAC7 (0.646), PCS60 (0.647), TPA1 (0.647), SSS1 (0.647), ERO1 (0.647), NHP2 (0.648), AIM1 (0.648), AMD1 (0.648), VPS38 (0.648), COG3 (0.648), YMR244C-A (0.648), PYC1 (0.648), CCC1 (0.648), TAO3 (0.649), YDL233W (0.649), RPB10 (0.650), YBR242W (0.650), EDC2 (0.650), YVC1 (0.650), YDR266C (0.651), PMT3 (0.651), NIS1 (0.651), YDR128W (0.65), ATP5 (0.651), YML002W (0.652), ATG9 (0.652), IKS1 (0.652), SUR2 (0.652), MSD1 (0.652), SMC3 (0.653), SPC1 (0.653), MRPS35 (0.653), ZIP1 (0.653), YPR022C (0.654), YKL070W (0.654), RIM4 (0.654), YJL127C-B (0.654), ARV1 (0.655), YML6 (0.655), CYC3 (0.656), COX9 (0.656), RMD11 (0.656), SNU23 (0.657), PRS2 (0.657), YNL092W (0.657), TIF4632 (0.657), CBP2 (0.658), STP4 (0.658), YIR024C (0.658), SHE1 (0.658), EMG1 (0.659), NUP92 (0.659), THI17 (0.659), NGL1 (0.659), LDB19 (0.659), AFG2 (0.660), ROT1 (0.660), PIK1 (0.660), MRPL31 (0.660), RHO2 (0.660), MRPL49 (0.660), FMO1 (0.661), LRS4 (0.661), CHS3 (0.661), SEC8 (0.662), HXT5 (0.662), GRX3 (0.663), YHL042W (0.663), AAC3 (0.663), WSC4 (0.663), PIN2 (0.663), PUB1 (0.663), ERG28 (0.663), PSR1 (0.663), ISY1 (0.664), VPS70 (0.664), IRC19 (0.664), DNM1 (0.665), RPA190 (0.665), CCR4 (0.665), SSU72 (0.665), MRPL7 (0.665), TBF1 (0.666), YPR115W (0.666), SKP2 (0.666), CDC73 (0.666), RPL31B (0.666), MAK16 (0.666), ERB1 (0.666), DCG1 (0.666), RNT1 (0.667), RRP7 (0.667), GCD7 (0.667), RAD18 (0.667), OMS1 (0.668), YOL048C (0.668), PPT2 (0.668), SCS7 (0.668), YBL028C (0.668), RSC30 (0.668), TIM23 (0.668), PRI1 (0.669), REC102 (0.669), MCH5 (0.669), PST1 (0.669), CLB3 (0.669), QCR9 (0.670), MIR1 (0.670), SSP120 (0.670), MEF2 (0.672), RPL14B (0.672), YPR003C (0.672), RLI1 (0.672), SWC4 (0.672), MTM1 (0.673), SKY1 (0.674), TOM1 (0.674), YGL079W (0.674), ROM2 (0.674), TFA2 (0.674), AIM3 (0.674), SSQ1 (0.675), DUG2 (0.675), MSF1 (0.675), RPS0B (0.675), SCO2 (0.675), OLE1 (0.676), SBE2

(0.676), SAR1 (0.676), YJR116W (0.676), TEF1 (0.677), AIM13 (0.677), DFG5 (0.677), YLR012C (0.677), MCM3 (0.677), RPS7B (0.678), DFR1 (0.678), YBL039W-B (0.678), RML2 (0.679), RSM27 (0.679), MEC3 (0.679), YCG1 (0.679), RFX1 (0.680), RPL7B (0.680), CHS2 (0.681), PEX5 (0.681), TIF4631 (0.681), RPL18B (0.681), SMB1 (0.682), HUL4 (0.682), NPL6 (0.682), YOL107W (0.683), TRM1 (0.683), STE6 (0.683), ASK1 (0.684), RAD9 (0.684), YDL012C (0.684), RBG2 (0.684), SEC6 (0.684), YLR143W (0.685), XPT1 (0.685), HGH1 (0.685), YIL091C (0.685), PRS3 (0.686), NTC20 (0.686), YPR196W (0.686), MIC17 (0.686), POA1 (0.687), NPY1 (0.687), SNQ2 (0.687), ADE3 (0.687), APT2 (0.688), YGL082W (0.688), YHB1 (0.689), MRPL16 (0.689), CSH1 (0.690), GUP1 (0.690), YJL171C (0.690), IDP3 (0.690), VHT1 (0.691), PUG1 (0.691), MPM1 (0.691), RRP40 (0.691), DPM1 (0.691), AFG3 (0.691), YBP2 (0.691), YPL183W-A (0.692), AIM31 (0.692), YCR015C (0.692), MSN4 (0.692), YPL038W-A (0.692), TSC1 (0.692), SEC59 (0.693), ADA2 (0.693), TPM2 (0.693), YHR175W-A (0.693), POM152 (0.694), YJR124C (0.694), RPL22B (0.694), COG7 (0.694), NEW1 (0.695), GSM1 (0.695), UGX2 (0.696), PRK1 (0.696), GPD2 (0.696), LDB16 (0.697), PAM16 (0.697), CMC1 (0.697), TOM6 (0.698), MBA1 (0.698), SWC5 (0.698), PRM10 (0.698), SAM1 (0.699), TRS31 (0.699), YFT2 (0.699), RGT1 (0.700), RPL10 (0.700), KRE33 (0.700), CDC1 (0.700), MRPL37 (0.700), KEX2 (0.701), VPS13 (0.701), ACN9 (0.701), RSC3 (0.701), PBS2 (0.702), EPS1 (0.702), GPI18 (0.702), ADH4 (0.702), YTP1 (0.702), YHM2 (0.703), ZIM17 (0.703), LYS5 (0.703), AIM22 (0.703), RGM1 (0.703), ECM10 (0.703), RDH54 (0.703), DED1 (0.704), CSE2 (0.704), POC4 (0.704), IPI1 (0.704), SOL4 (0.705), YKR075C (0.706), RSM10 (0.707), MAE1 (0.707), ATF2 (0.707), SHE4 (0.707), RSC1 (0.708), GNT1 (0.708), MSH4 (0.708), HSK3 (0.708), TRS20 (0.709), NBP35 (0.709), YBR090C (0.709), GLO1 (0.709), FYV4 (0.709), AEP2 (0.709), ARP4 (0.710), IES3 (0.710), HYP2 (0.710), DNF2 (0.711), GAA1 (0.711), RPA135 (0.711), PCL9 (0.711), SPT5 (0.711), EDE1 (0.711), ORC3 (0.711), YOR304C-A (0.711), YCL047C (0.711), YER085C (0.711), YOL014W (0.711), YPL071C (0.712), GTS1 (0.712), RFC2 (0.712), NDE2 (0.712), PET127 (0.713), PLM2 (0.713), YEA6 (0.713), RPN7 (0.713), MDL1 (0.713), TMA64 (0.714), NCE103 (0.714), MCM6 (0.714), MAS1 (0.715), TSR1 (0.715), BAS1 (0.715), IRC4 (0.716), TIM21 (0.716), HCH1 (0.716), APC5 (0.716), PMP1 (0.716), PUF6 (0.716), YER077C (0.716), SNC2 (0.716), MRP21 (0.716), YLR036C (0.717), YME2 (0.717), SEC12 (0.717), YJL062W-A (0.718), YMR031C (0.718), YAL065C (0.718), YNR047W (0.718), NHP10 (0.718), YOL083W (0.719), DLS1 (0.719), IGO2 (0.719), PAU17 (0.719), NCS2 (0.720), TAF7 (0.720), YDL186W (0.720), CMK2 (0.721), PUS7 (0.721), TIM9 (0.721), PMU1 (0.722), MNP1 (0.722), SEC16 (0.722), RIF1 (0.723), KAR3 (0.723), MDL2 (0.723), YLR356W (0.724), DCI1 (0.724), ASP1 (0.724), NET1 (0.725), YPL068C (0.725), MOT3 (0.725), NOC3 (0.725), MRP13 (0.725), GUT2 (0.725), ICY1 (0.725), NTO1 (0.726), HOS3 (0.726), TIM54 (0.726), COX4 (0.726), UBX2 (0.727), RVB2 (0.727), YBL059C-A (0.727), RBS1 (0.727), DCR2 (0.727), NEM1 (0.727), MNN9 (0.728), YNR036C (0.728), NOP15 (0.728), SEC61 (0.728), RTT106 (0.729), CCT7 (0.729), OSM1 (0.729), SAS5 (0.729), VPS29 (0.729), KTI12 (0.729), POL32 (0.729), PUS9 (0.730), SLF1 (0.730), MUQ1 (0.730), HSD1 (0.730), KAR4 (0.730), STN1 (0.731), BAT1 (0.731), THI71 (0.731), RPL27B (0.732), COX5A (0.732), AEP1 (0.732), LPP1 (0.732), PRM1 (0.732), YKL222C (0.732), TIP41 (0.733), RPL43B (0.733), YCR043C (0.733), STP1 (0.734), AIM8 (0.734), HXT9 (0.734), MRP7 (0.734), YPL216W (0.735), SRB6 (0.735), CTK2 (0.736), RIT1 (0.736), NST1 (0.737), RIB7 (0.737), MRPL38 (0.737), SRT1 (0.737), CBK1 (0.738), ARL3 (0.738), DRS2 (0.738), YLR307C-A (0.738), GPI8 (0.738), SHM2 (0.739), IPL1 (0.739), YPL041C (0.739), ARR1 (0.739), GCN20 (0.740), YPL039W (0.740), MNN1 (0.740), SLX9 (0.740), SEO1 (0.741), RMP1 (0.741), PSA1 (0.741), CHS6 (0.741), DAN1 (0.742), RPB5 (0.742), SIR3 (0.742), BCP1 (0.742), YLL058W (0.742), TNA1 (0.742), TRM13 (0.743), NOP1 (0.743), SLP1 (0.743), PEX31 (0.743), YIF1 (0.743), MSA2 (0.743), ADH3 (0.744), MNT4 (0.744), GIS1 (0.744), SLD2 (0.745), PIN4 (0.745), NVJ1 (0.745), HTS1 (0.745), RAD7 (0.745), YKU70 (0.745), NUF2 (0.745), YIL001W (0.745), ASK10 (0.745), YBL010C (0.745), ATP14 (0.746), CDC123 (0.746), MRPL51 (0.746), YGR127W (0.747), YLR392C (0.747), APC2 (0.747), DEP1 (0.747), APS3 (0.747), RCL1 (0.747), DCD1 (0.747), MIG3 (0.747), BSP1 (0.749), YLL014W (0.750), TOA1 (0.750), NBA1 (0.750), SL C1 (0.750), IGO1 (0.752), SDH3 (0.752), ACS2 (0.752), YOR093C (0.752), MPC54 (0.752), PFY1 (0.753), MIA40 (0.753), YDR034C-A (0.753), RDS3 (0.753), MSC3 (0.753), TIM50 (0.753), CSN12 (0.753), GIN4 (0.753), SMI1 (0.753), ADE17 (0.754), YGR016W (0.754), PCP1 (0.754), SBA1 (0.754), SRP102 (0.754), SUM1 (0.754), ICL1 (0.754), OAF3 (0.754), ZRT2 (0.754), NOP10 (0.755), BET2 (0.755), YVH1 (0.756), SPO75 (0.756), DNL4 (0.756), SGV1 (0.756), IES4 (0.757), SET4 (0.757), YCL001W-B (0.757), SQT1 (0.757), REI1 (0.757), MRPL9 (0.757), YPL066W (0.758), PET191 (0.758), TEM1 (0.758), UBX4 (0.759), DBF20 (0.760), MSB3 (0.760), NUP100 (0.760), RIC1 (0.760), CUE4 (0.761), IKI3 (0.761), YEL043W (0.761), MRPL11 (0.761), MPS1 (0.761), EAP1 (0.762), AVT2 (0.762), GND1 (0.762), TYW3 (0.762), POP7 (0.762), YDR186C (0.762), POR2 (0.762), LSM5 (0.763), MSH1 (0.763), TOM22 (0.763), YBR238C (0.764), MEP1 (0.764), ILV3 (0.764), YMD8 (0.764), YJR061W (0.764), OSH3 (0.764), TEF4 (0.765), SCO1 (0.765), TDH1 (0.765), RIM21 (0.766), YGL185C (0.766), NUS1 (0.766), KTR4 (0.767), RRP14 (0.767), TUB4 (0.767), LEU9 (0.767), YLR437C (0.768), AIM7 (0.768), ATX2 (0.768), AI3 (0.769), OST4 (0.769), TRA1 (0.769), MYO5 (0.769), DAL4 (0.769), IMG2 (0.769), LTV1 (0.769), YGR122W (0.770), CFT2 (0.770), YMR001C-A (0.771), CDC16 (0.771), YAL067W-A (0.771), YDR132C (0.771), YNL011C (0.772), TCP1 (0.772), CCT3 (0.772), MKK2 (0.772), RRI2 (0.772), ZEO1 (0.772), RUD3 (0.772), RTR2 (0.772), YJL070C (0.773), NUP116 (0.773), ENT1 (0.774), SLU7 (0.774), MSC2 (0.774), STV1 (0.774), NUP60 (0.775), AIM28 (0.776), YOL029C (0.776), SHE10 (0.776), RSB1 (0.776), SHO1 (0.776), DLD2 (0.777), RAX1 (0.777), LCP5 (0.777), ATG17 (0.777), PEX17 (0.778), GAL4 (0.778), MET32 (0.778), YOR223W (0.779), STE14 (0.779), DUG3 (0.780), SRX1 (0.780), UFO1 (0.780), YAT2 (0.780), NMD3 (0.780), PRP9 (0.780), MSN2 (0.781), PET123 (0.781), SWD2 (0.781), SOG2 (0.781), RRP17 (0.781), GPB2 (0.781), YOR293C-A (0.781), TEN1 (0.781), SOV1 (0.782), PFK27 (0.782), YIL127C (0.782), YNL024C-A (0.782), TMT1 (0.783), SEC39 (0.783), YER158C (0.783), ERP3 (0.783), YLR257W (0.783), PKH3 (0.783), YNL155W (0.783), PSO2 (0.783), NOP9 (0.783), GPG1 (0.784), GIP4 (0.784), RIB1 (0.784), CYS4 (0.784), ZRT3 (0.784), FMP21 (0.785), DAK2 (0.785), ISW1 (0.785), ACF4 (0.785), RTT10 (0.785), RTT109 (0.785), FMP10 (0.785), YAP6 (0.785), APM4 (0.785), ZAP1 (0.785), ARO9 (0.786), SCM4 (0.786), MIM1 (0.786), BRR6 (0.787), SRN2 (0.787), YOR287C (0.787), CLA4 (0.787), RNR3 (0.787), ALG8 (0.787), RAD50

(0.787), YBR239C (0.788), LDB7 (0.788), ATP17 (0.788), UGA2 (0.788), ENA2 (0.788), YLR408C (0.788), SAT4 (0.788), BOP3 (0.788), SDH4 (0.789), YNL045W (0.789), RPC40 (0.790), YNL134C (0.790), ARP5 (0.790), MAD2 (0.790), GRX6 (0.790), RSM18 (0.790), FES1 (0.791), SGF73 (0.791), ARH1 (0.791), MHT1 (0.791), CNS1 (0.791), BDH2 (0.792), YKL063C (0.792), GSH1 (0.792), BOS1 (0.792), THI72 (0.792), BSC1 (0.792), MED8 (0.793), RAD5 (0.793), EMP47 (0.793), SIS2 (0.793), TEA1 (0.793), YJL185C (0.793), RTF1 (0.793), CIN4 (0.794), DIC1 (0.794), EST2 (0.795), YNK1 (0.795), PUS2 (0.795), PEX13 (0.795), YNL217W (0.795), HOR7 (0.795), MGS1 (0.796), YHR009C (0.796), YML007C-A (0.796), JNM1 (0.796), YHR078W (0.796), YMR155W (0.796), STB5 (0.796), MRP4 (0.796), STE3 (0.797), CKS1 (0.797), TAF13 (0.797), YNL176C (0.797), PCD1 (0.797), HSP26 (0.797), DAS1 (0.798), EDS1 (0.798), CTR3 (0.798), PXL1 (0.798), MRS1 (0.799), MET3 (0.799), BDP1 (0.799), CBF2 (0.799), DBP6 (0.799), FAR11 (0.799), ERI1 (0.800), MDM10 (0.801), RPM2 (0.801), COX13 (0.801), TOA2 (0.801), MYO2 (0.802), PRP5 (0.802), DRN1 (0.802), ZDS1 (0.802), IES2 (0.803), FAT1 (0.803), HIS1 (0.803), MET16 (0.803), LAS17 (0.803), ACA1 (0.803), HIS4 (0.803), PHO12 (0.804), EBP2 (0.804), MRPL6 (0.804), YLR271W (0.804), YBR085C-A (0.804), CRR1 (0.805), SWI3 (0.805), SWI4 (0.805), PYK2 (0.805), BUD7 (0.806), PEX12 (0.806), MDV1 (0.806), IDH2 (0.807), MRC1 (0.807), TIM11 (0.807), SPT15 (0.808), FBP26 (0.808), GUP2 (0.808), NPL4 (0.808), YCR007C (0.809), ABD1 (0.809), YNL193W (0.809), YLR426W (0.810), YSP2 (0.810), SSO2 (0.810), MRPL23 (0.810), YHR112C (0.810), VPS36 (0.811), MET7 (0.811), UTP18 (0.811), MTW1 (0.811), DYN1 (0.812), RNH1 (0.812), LST4 (0.812), TAF11 (0.812), RPL17A (0.812), SNA2 (0.812), YGL041W-A (0.813), KAR5 (0.813), YEH2 (0.814), YMR118C (0.814), CUE2 (0.814), URA8 (0.814), YMR034C (0.814), YLR152C (0.815), YKL088W (0.815), HEM13 (0.815), CAT5 (0.815), KRE1 (0.815), IBD2 (0.817), YOL098C (0.817), AIM18 (0.817), HMG1 (0.817), TRM7 (0.817), ADY2 (0.818), LCD1 (0.818), YGL194C-A (0.818), EFG1 (0.818), BRX1 (0.819), HIM1 (0.819), TCM62 (0.819), SET6 (0.819), FIN1 (0.819), CBF5 (0.820), ASI1 (0.820), DUT1 (0.820), SEC65 (0.820), YPL067C (0.820), RRP43 (0.820), ASC1 (0.821), ERG3 (0.821), RTA1 (0.821), NFU1 (0.821), JIP4 (0.821), YLR419W (0.822), YJR011C (0.822), YJL045W (0.822), ARC18 (0.822), YBR287W (0.822), CAP2 (0.822), NEO1 (0.823), TOM5 (0.823), PEP5 (0.823), PCC1 (0.823), PXR1 (0.823), ALG1 (0.823), YLR301W (0.824), ARG1 (0.824), RFC4 (0.824), AIM42 (0.824), PPA2 (0.824), DAP1 (0.824), RTS1 (0.825), EDC3 (0.825), IRC23 (0.825), YBR220C (0.825), GPI14 (0.825), IML1 (0.825), NIP7 (0.826), YPT32 (0.826), MSS18 (0.826), CHO1 (0.826), CST26 (0.826), MOH1 (0.826), PLP1 (0.827), MKC7 (0.827), XYL2 (0.827), YMR295C (0.828), YLR003C (0.828), YIL096C (0.828), MOT2 (0.828), RLP7 (0.828), YSC84 (0.828), NDL1 (0.828), PFK1 (0.828), MRD1 (0.829), SAC6 (0.829), REX2 (0.829), RPA34 (0.829), AHC2 (0.829), APC1 (0.829), YDR222W (0.829), VHR1 (0.829), SUS1 (0.829), UTH1 (0.829), IRC8 (0.830), SNO1 (0.830), APT1 (0.830), YOR352W (0.830), YMR258C (0.831), MRH1 (0.831), HRP1 (0.831), SRP21 (0.831), MRPL22 (0.831), SEC9 (0.831), KAR2 (0.832), YGR054W (0.832), HOF1 (0.832), YDC1 (0.832), YGR207C (0.833), WSC2 (0.833), SRC1 (0.833), YAR023C (0.834), HAM1 (0.834), PER1 (0.834), YKL047W (0.834), FLC3 (0.834), TRM10 (0.834), PAU15 (0.834), RFA1 (0.835), AI2 (0.835), MPP10 (0.835), ELC1 (0.835), PHB1 (0.836), OST1 (0.836), LSB1 (0.836), OKP1 (0.836), THI22 (0.836), MRP5 (0.836), COX200 (0.837), FCF1 (0.837), PHO80 (0.837), FIT1 (0.837), YPL056C (0.838), KIN4 (0.838), GCD1 (0.839), FRT1 (0.839), ACS1 (0.839), LGE1 (0.839), YJL136W-A (0.840), MLC2 (0.840), SMF1 (0.840), ISW2 (0.840), HIS6 (0.841), CTR2 (0.841), GCV2 (0.841), GAL83 (0.841), IMP3 (0.842), GRS1 (0.842), MRS5 (0.842), NCE101 (0.843), BUD17 (0.843), MKS1 (0.843), SYF1 (0.843), ACH1 (0.844), ARN1 (0.844), RCN2 (0.844), UBC12 (0.844), YER079W (0.845), YHL044W (0.845), THI20 (0.845), PML1 (0.845), IRC10 (0.846), BMS1 (0.846), SSA1 (0.846), DDI2 (0.846), RPC1 (0.846), YDR115W (0.847), DDC1 (0.847), IRC21 (0.847), DUR3 (0.847), PET100 (0.847), SKI8 (0.847), QRI5 (0.847), QDR1 (0.847), UBC11 (0.848), MRT4 (0.848), POL3 (0.848), MFB1 (0.848), TC089 (0.848), YDR370C (0.848), OYE2 (0.848), MDM31 (0.849), SLG1 (0.849), YOR062C (0.849), DNF1 (0.850), MEH1 (0.850), AIR2 (0.850), MSS116 (0.850), ACB1 (0.850), ADE12 (0.851), ELO1 (0.851), VTA1 (0.851), MRPL27 (0.852), YFL054C (0.852), SPC34 (0.852), RGS2 (0.853), DRS1 (0.853), GTR1 (0.853), COX8 (0.853), KEL2 (0.854), NUP82 (0.854), GIR2 (0.855), FKH2 (0.855), CLG1 (0.855), PEX6 (0.855), HO (0.855), YHR003C (0.855), NUP84 (0.856), RRB1 (0.856), PSY2 (0.856), BSD2 (0.856), ESBP6 (0.856), MED7 (0.857), RSN1 (0.857), YKE2 (0.857), YHL012W (0.857), SHE2 (0.858), RPL2A (0.858), DUO1 (0.858), DST1 (0.858), PET9 (0.858), RSA3 (0.858), GLN4 (0.858), YKR015C (0.858), YJR141W (0.858), RIM20 (0.858), BCK2 (0.859), SPC42 (0.859), TRF5 (0.859), FAA2 (0.859), TRS130 (0.859), GUA1 (0.860), HSL7 (0.860), PDE2 (0.860), RRP8 (0.860), XRS2 (0.860), SPE1 (0.860), RFT1 (0.860), VPS20 (0.860), SEC20 (0.860), PAD1 (0.861), GGC1 (0.861), ORC1 (0.861), HMG2 (0.861), STE2 (0.861), LSM3 (0.861), ICS2 (0.861), TRM2 (0.861), CDC3 (0.862), HEM2 (0.862), SIN4 (0.862), VIK1 (0.862), HIS7 (0.863), RAD54 (0.863), IQG1 (0.863), DFG10 (0.863), TIP1 (0.864), BRR2 (0.864), GRX2 (0.864), HTZ1 (0.864), BCH2 (0.864), NRG2 (0.865), RSC58 (0.865), TMA16 (0.865), RAD59 (0.866), URM1 (0.866), ADY4 (0.866), AAP1 (0.866), ABP1 (0.866), YGR066C (0.867), BRE5 (0.868), BFR2 (0.868), LSM1 (0.868), CHD1 (0.868), VTI1 (0.868), AIM11 (0.868), RFA2 (0.869), SUR4 (0.869), YOR228C (0.869), DLD3 (0.870), ISN1 (0.870), CYC2 (0.870), SNF5 (0.870), YMR124W (0.870), GIP2 (0.870), SVL3 (0.870), SEC13 (0.870), YEL047C (0.870), BEM1 (0.871), RPL16A (0.871), SPR3 (0.873), ATP4 (0.873), WAR1 (0.873), ITR1 (0.873), FAR3 (0.873), YOR021C (0.874), YBR028C (0.874), NOP58 (0.875), RPN13 (0.877), YNL035C (0.878), YJL049W (0.878), YER137C (0.878), NOC4 (0.879), ALG7 (0.879), MET22 (0.880), SIL1 (0.880), TYS1 (0.880), GLK1 (0.880), YDR341C (0.880), YKR045C (0.880), RAD23 (0.880), BIK1 (0.881), RPL27A (0.881), YOR152C (0.881), KNS1 (0.881), YHR182W (0.881), EEB1 (0.881), RKM1 (0.881), SNG1 (0.882), YIL067C (0.882), VPS66 (0.883), TCB1 (0.883), ADE4 (0.883), YNL034W (0.883), HSP78 (0.883), HEM15 (0.883), PKC1 (0.883), SPP2 (0.883), MF(AL-PHA)1 (0.883), ARP6 (0.884), NCS6 (0.884), RTS3 (0.884), SPE4 (0.884), YPL199C (0.884), DAL81 (0.884), SAC1 (0.884), YOL131W (0.884), YHL026C (0.884), REC107 (0.884), YGR174W-A (0.885), SGE1 (0.885), NCB2 (0.885), YNL320W (0.885), CDC20 (0.885), CSG2 (0.886), ECM5 (0.886), NOC2 (0.886), IES1 (0.886), SMK1 (0.887), PHO86 (0.887), YHR202W (0.887), CIN1 (0.887), PFS1 (0.887), MCM21 (0.887), ROT2 (0.888), GLC7 (0.888), HRT1 (0.888), YDR018C (0.888), APM1 (0.888), DPH2 (0.888), CDH1 (0.889), HNT3 (0.889), ATG4 (0.889), FRE3 (0.889), ATP2 (0.889), YMR148W (0.890), YAT1 (0.890), ERG1

(0.890), PGI1 (0.890), FKH1 (0.890), MET30 (0.890), YGL140C (0.890), ARC35 (0.890), SNX41 (0.890), SAS2 (0.890), YHR007C-A (0.890), YML083C (0.891), ABF1 (0.891), YLR104W (0.892), TOS1 (0.892), MF(ALPHA)2 (0.892), FRM2 (0.892), OPY1 (0.892), MMF1 (0.893), DIG1 (0.893), PMI4 (0.894), YIL092W (0.894), ASI3 (0.895), FIR1 (0.895), ERG26 (0.895), YMR090W (0.895), YGL085W (0.896), CDC24 (0.896), YPL113C (0.896), YPR010C-A (0.896), BIR1 (0.896), AAH1 (0.896), EPT1 (0.896), MSW1 (0.896), NOP4 (0.897), CBT1 (0.897), COX18 (0.897), COX16 (0.898), RRD1 (0.898), BEM4 (0.898), GEA2 (0.898), FOB1 (0.898), ERG7 (0.898), YLR042C (0.899), SEC17 (0.899), YPR063C (0.899), PUT4 (0.900), MSI1 (0.900), RPA43 (0.900), SPE2 (0.900), DAL1 (0.901), RPC25 (0.901), BOR1 (0.901), AXL1 (0.901), EAF7 (0.901), RCR1 (0.901), YDR338C (0.901), RGA1 (0.902), LOT5 (0.902), YIH1 (0.902), RNA1 (0.902), SKM1 (0.903), PUT2 (0.903), HEM4 (0.904), AIM37 (0.904), PHO13 (0.904), YGR015 (0.904), AKR2 (0.904), YKL050C (0.904), TCB2 (0.904), HAC1 (0.904), ADE1 (0.905), RTN1 (0.905), RPL8B (0.905), MDM36 (0.905), JHD1 (0.905), CCL1 (0.905), YDR282C (0.906), PRE10 (0.906), PFX14 (0.906), OMA1 (0.906), YNR034W-A (0.906), NBP2 (0.906), SPT20 (0.906), PRP2 (0.907), YGL041C-B (0.907), YBR255W (0.907), YOR246C (0.907), YFL012W (0.907), YLR412W (0.908), DUR1,2 (0.908), RPS4A (0.908), YAL037W (0.908), ICT1 (0.908), CTR86 (0.909), RPN10 (0.909), RME1 (0.909), MSB4 (0.909), SAM35 (0.909), MAG2 (0.909), YOL092W (0.909), PPZ1 (0.909), YGL138C (0.910), YHR097C (0.910), SSZ1 (0.910), SIS1 (0.910), CTP1 (0.910), TAF5 (0.910), PDC1 (0.910), YPL150W (0.910), GCD100 (0.911), ENP1 (0.911), TOM40 (0.911), ERG6 (0.912), ECM4 (0.912), RLF2 (0.913), RKI1 (0.913), SAM3 (0.913), SEC62 (0.913), CRC1 (0.914), UME1 (0.914), TUS1 (0.915), YNL046W (0.916), VTC1 (0.916), TEL2 (0.916), YEN1 (0.916), PEX30 (0.917), GSG1 (0.917), NTE1 (0.918), RBG1 (0.918), TIM8 (0.918), YNG1 (0.918), PMT5 (0.918), PRP16 (0.918), SPT6 (0.918), NIP100 (0.919), THS1 (0.919), HMRA1 (0.920), STE20 (0.920), AIM10 (0.921), YGL242C (0.921), GTR2 (0.921), YOL157C (0.921), LOT6 (0.92), KEX1 (0.921), MET14 (0.922), UBA2 (0.922), NUT1 (0.922), SPO21 (0.923), PAC10 (0.923), YND1 (0.923), DSE3 (0.923), YJR149W (0.923), YOR378W (0.923), GSY2 (0.923), YBR063C (0.924), SRV2 (0.924), YCK1 (0.924), YKL091C (0.925), FMS1 (0.925), UTP23 (0.925), YCR090C (0.925), SFT2 (0.925), BNI5 (0.925), SNX3 (0.925), FSH2 (0.926), RGD2 (0.926), SST2 (0.926), UNG1 (0.927), YLR164W (0.927), RPS26B (0.927), TRE1 (0.927), MSH5 (0.927), MYO3 (0.928), YGL039W (0.928), SUP35 (0.929), AMA1 (0.929), ATP19 (0.929), YGL036W (0.930), PTK2 (0.930), PBP2 (0.930), TRM112 (0.931), SMC1 (0.931), NPR1 (0.931), PFK2 (0.932), PDE1 (0.932), RRI1 (0.932), FRE2 (0.932), YOR118W (0.933), FRE1 (0.933), ECM38 (0.933), ALD3 (0.933), S773 (0.934), VMR1 (0.934), RPC82 (0.934), URK1 (0.934), ATX1 (0.934), REG1 (0.935), PNT1 (0.935), YMR279C (0.935), RSC8 (0.935), YJR111C (0.935), YLR253W (0.935), FSH1 (0.935), YDR336W (0.935), ERD1 (0.935), VPS41 (0.936), AYT1 (0.936), VRG4 (0.936), YPL009C (0.936), VID22 (0.936), YDR514C (0.936), APC11 (0.937), VPS74 (0.937), KRE1 (0.937), RRP6 (0.938), FOX2 (0.938), ASM4 (0.938), MED1 (0.938), TWF1 (0.939), GRX5 (0.939), MYO1 (0.939), YPL107W (0.939), PET54 (0.939), YLR064W (0.940), SPC2 (0.940), APP1 (0.940), DBP5 (0.940), BPH1 (0.941), YKL151C (0.941), NAF1 (0.941), YKL027W (0.941), ARO3 (0.941), UBX6 (0.942), TIM18 (0.942), BNI4 (0.942), SPC98 (0.943), PZF1 (0.943), PIC2 (0.943), UTP8 (0.943), YBR235W (0.943), SMC6 (0.943), RLR1 (0.943), DBF4 (0.943), RPB11 (0.944), SHE3 (0.944), SFB3 (0.944), SYT1 (0.944), STU2 (0.945), NGL2 (0.945), GDS1 (0.945), NOP2 (0.945), SVS1 (0.945), PRY2 (0.946), GDA1 (0.946), BCY1 (0.947), PUS1 (0.947), COX7 (0.947), MRPL15 (0.947), RER1 (0.948), SLH1 (0.948), RPB3 (0.948), TIF11 (0.948), YDL173W (0.948), YML053C (0.948), PEX4 (0.949), MIG1 (0.949), CLU1 (0.950), ECM32 (0.950), FCY1 (0.950), HSP32 (0.950), MAL12 (0.950), JLP2 (0.950), DAT1 (0.950), RMR1 (0.950), KTR6 (0.950), OST2 (0.951), NOP12 (0.951), IRC3 (0.951), OPT2 (0.952), YBL054W (0.952), PDX1 (0.952), AMS1 (0.952), YBR204C (0.953), SLM2 (0.953), VPS64 (0.953), PTH2 (0.953), MRP1 (0.953), TIF5 (0.954), AAT2 (0.954), CPR3 (0.954), AVT6 (0.954), CLF1 (0.954), MDM38 (0.954), COX12 (0.954), ESS1 (0.954), RPG1 (0.955), SNF11 (0.955), ERV15 (0.955), YPR078C (0.955), RHO3 (0.956), SUE1 (0.956), CLN2 (0.956), YFL040W (0.956), YLR040C (0.956), RLA1 (0.957), YMR272W-B (0.957), MND2 (0.957), EHD3 (0.957), IMP4 (0.957), PAH1 (0.958), HMO1 (0.958), RPL26A (0.958), PIR3 (0.959), MNN5 (0.959), FCY22 (0.959), SMD3 (0.959), YER186C (0.959), QDR2 (0.959), MHP1 (0.960), CRH1 (0.960), LSB3 (0.960), RMD1 (0.960), SDA1 (0.960), AXL2 (0.961), NOP16 (0.961), YCL058W-A (0.962), ORC6 (0.962), PRR2 (0.963), STH1 (0.963), CCA1 (0.963), FUS1 (0.963), MRS6 (0.963), YBP1 (0.963), RPL12A (0.963), UTR4 (0.964), MTF2 (0.964), MAK31 (0.964), BOP2 (0.964), UIP5 (0.964), SSL1 (0.965), INO4 (0.965), RPT3 (0.965), YBR072C-A (0.966), YIR159W (0.966), ITR2 (0.966), PUF3 (0.967), ADD66 (0.967), GCS1 (0.968), LYS2 (0.968), MTR2 (0.968), TRP1 (0.968), HXT11 (0.968), ALG1 (0.969), SPS18 (0.969), YOR111W (0.969), STI1 (0.969), SSD1 (0.969), CRN1 (0.969), CSN9 (0.970), RSM22 (0.970), YIL152W (0.970), TOF1 (0.970), HOM2 (0.970), MOB1 (0.971), RAD24 (0.971), IRC25 (0.971), RSM23 (0.971), YLR049C (0.971), YBL055C (0.971), SPP41 (0.972), YMR310C (0.972), YHC1 (0.972), YNL040W (0.973), AIM41 (0.973), APL5 (0.973), ILV2 (0.974), YIR035C (0.974), REC8 (0.974), MSS51 (0.974), GAP1 (0.975), EMP70 (0.975), HAL1 (0.975), CDC21 (0.975), VPS75 (0.975), YER066W (0.975), MCM7 (0.975), CHZ1 (0.976), YKL121W (0.977), MMS2 (0.977), BUL2 (0.977), SEC1 (0.977), BEM2 (0.977), YKR018C (0.978), NUP2 (0.978), VPS73 (0.978), YIL024C (0.978), YPL225W (0.979), FEN1 (0.979), YSR3 (0.979), CST9 (0.979), YLR241W (0.979), MAK10 (0.980), CUP2 (0.980), CCP1 (0.980), ERV14 (0.980), YJU3 (0.980), RAP1 (0.980), IMP1 (0.980), COA1 (0.981), TFA1 (0.981), FAF1 (0.981), ATP5 (0.981), ARG3 (0.982), RVB1 (0.982), RPA49 (0.982), NSE4 (0.982), YKT6 (0.982), RRN9 (0.983), APM2 (0.983), GAT3 (0.983), SPN1 (0.983), CKB1 (0.983), DTD1 (0.983), TPO2 (0.983), PRP45 (0.984), DEG1 (0.984), PTC5 (0.984), TSC10 (0.984), DPB1 (0.984), YKR005C (0.985), RIM15 (0.985), PNO1 (0.985), COX15 (0.985), VPS4 (0.985), PKH2 (0.986), MTR4 (0.986), YLR053C (0.986), LEU4 (0.986), YPK1 (0.987), PDX3 (0.987), TIF2 (0.988), YDL180W (0.988), FYV8 (0.988), BUD13 (0.988), YBR139W (0.988), TPK2 (0.988), SSH1 (0.989), YGR102C (0.989), YDR348C (0.989), RPL28 (0.990), QCR2 (0.990), YAR1 (0.990), SCP1 (0.990), TIP20 (0.990), UBC7 (0.990), SEC1 (0.991), RPN1 (0.993), TGL5 (0.993), HSP60 (0.993), RPL42B (0.994), PRS1 (0.994), YKL018C-A (0.994), TFC6 (0.994), RNH201 (0.994), URA1 (0.995), ALG9 (0.995), MSG5 (0.995), AKR1 (0.995), MNN11 (0.996), OCA1 (0.996), YGP1 (0.997), PPX1 (0.997), TSC3 (0.997), PSF3 (0.998), YAF9 (0.998), YMR175W-A (0.998), LHP1 (0.998),

YMR252C (0.999), SLK19 (0.999), YJR107W (0.999), PMC1 (0.999), HCR1 (0.999), SKG1 (0.999), PCT1 (0.999), LPE10 (1.000), PGK1 (1.000), HAS1 (1.000), SEC23 (1.000), GPI3 (1.000), YDR476C (1.001), YLR073C (1.001), SUI3 (1.001), RCO1 (1.001), LYS20 (1.002), NUP170 (1.002), JJJ1 (1.002), RAD27 (1.002), YLL032C (1.002), GDB1 (1.002), GON7 (1.002), PRS4 (1.002), GAL7 (1.002), RAI1 (1.003), MLC1 (1.003), SWD3 (1.003), REV1 (1.003), FET3 (1.003), DAL7 (1.004), DAL80 (1.004), COQ5 (1.004), TRK2 (1.005), PRP31 (1.005), SYP1 (1.005), RPL36A (1.005), OSH7 (1.005), RPL2B (1.005), UME6 (1.006), LCB4 (1.006), IZH2 (1.006), MDH3 (1.006), OGG1 (1.006), RPL1A (1.007), YGL157W (1.007), HUB1 (1.007), TGL4 (1.007), CAF16 (1.007), NPP2 (1.007), URE2 (1.007), GMH1 (1.007), AVT3 (1.007), FAA1 (1.007), BET5 (1.008), YPR091C (1.008), PET8 (1.009), STB1 (1.009), ERG13 (1.009), UTP10 (1.009), MMP1 (1.010), YTH1 (1.010), EMI2 (1.010), MES1 (1.010), PDS1 (1.010), NPL3 (1.010), PRD1 (1.010), YGR235C (1.011), PHO8 (1.011), PEX22 (1.011), LAP4 (1.011), LCB2 (1.011), YLR326W (1.011), EMP46 (1.011), MRPS17 (1.011), AIM17 (1.011), NUP57 (1.011), YER134C (1.012), YCR076C (1.012), YBL104C (1.012), SSM4 (1.012), YMR187C (1.012), YEF3 (1.012), PIG1 (1.012), ECM16 (1.012), SPO20 (1.013), ILS1 (1.013), MFT1 (1.014), RRP46 (1.014), RPS23A (1.015), ECM40 (1.015), STT4 (1.015), SOK2 (1.016), RPL9A (1.016), SIR1 (1.017), SES1 (1.017), CDC26 (1.018), SSU1 (1.018), SAS3 (1.019), YKL187C (1.019), ARG8 (1.019), RPL16B (1.019), LCB3 (1.020), TVP18 (1.020), APJ1 (1.021), GDH1 (1.021), IPT1 (1.021), ATP7 (1.021), YAR029W (1.021), PIS1 (1.022), TRS23 (1.022), SEC72 (1.022), CHA4 (1.022), DMA2 (1.023), RUP2 (1.023), DCP2 (1.024), KAP14 (1.024), YTA12 (1.024), PHO87 (1.024), TPS3 (1.024), RPS10B (1.024), LIP2 (1.025), PAF1 (1.026), MEU1 (1.026), ALK1 (1.026), RIM1 (1.026), SLA2 (1.026), RSC6 (1.027), CBC2 (1.027), YBR016W (1.027), FIS1 (1.027), RAS1 (1.027), SFA1 (1.028), YOL057W (1.028), YOR292C (1.028), MCD4 (1.028), CSM1 (1.028), MAK32 (1.028), DAP2 (1.028), EXG2 (1.028), DID2 (1.029), HXT15 (1.029), DIE2 (1.029), VAC8 (1.030), YBR138C (1.030), NTH2 (1.030), YCR099C (1.031), RTT107 (1.031), MAF1 (1.031), ERG9 (1.031), PPN1 (1.031), SRB4 (1.032), CDC55 (1.032), YDR248C (1.032), YDR003W-A (1.032), GLC8 (1.033), PDR11 (1.033), SPB4 (1.033), YSC83 (1.034), YLR072W (1.034), MCH1 (1.035), RPH1 (1.035), DAD3 (1.035), SPT3 (1.036), YFR057W (1.036), IDI1 (1.036), TDH3 (1.036), OCA2 (1.036), PEX18 (1.036), FUN30 (1.037), RRP3 (1.037), ABC1 (1.037), IWR1 (1.037), YJR088C (1.037), PTR2 (1.038), SEC26 (1.039), AQY1 (1.040), ECM21 (1.040), BUD27 (1.040), PFK26 (1.041), YDR352W (1.041), CUP5 (1.041), ATG3 (1.042), AGE2 (1.042), RIX7 (1.042), HSE1 (1.042), AGA1 (1.043), GRX7 (1.043), AGE1 (1.043), TUB2 (1.043), YHR122W (1.043), RIB4 (1.043), VRP1 (1.043), LAS1 (1.043), OCA4 (1.044), YGR277C (1.044), BUB3 (1.044), LPD1 (1.044), EMI5 (1.044), CTF18 (1.044), YOL073C (1.044), SIT1 (1.045), LYS12 (1.045), FTR1 (1.045), TUL1 (1.045), EKI1 (1.046), LEO1 (1.046), GAL1 (1.046), VAC17 (1.046), REV7 (1.046), PMP2 (1.046), TIM3 (1.047), YMR158C-A (1.047), TLG2 (1.047), YGR106C (1.047), YML079W (1.048), YFR045W (1.048), YBR056W (1.048), YLR065C (1.048), HSH49 (1.048), MTF1 (1.049), LAG1 (1.049), ATE1 (1.049), RFM1 (1.049), RNH203 (1.050), DBP8 (1.050), TPS1 (1.050), YGR205W (1.050), PIM1 (1.050), RAD16 (1.050), SPI1 (1.051), SPP1 (1.05), CHS5 (1.051), MNR2 (1.051), PIL1 (1.052), SMT3 (1.052), PEF1 (1.052), SKO1 (1.052), CDC45 (1.052), SUC2 (1.052), RXT3 (1.052), RPN9 (1.053), SPO12 (1.053), RPE1 (1.053), SEC15 (1.053), HMI1 (1.054), RRP4 (1.054), ERG25 (1.054), MUC1 (1.055), TPT1 (1.055), OPY2 (11.055), OSH2 (1.055), VNX1 (1.055), PXA2 (1.055), YSW1 (1.057), SRP14 (1.057), OST5 (1.058), CDC4 (1.058), RPL38 (1.058), YDR520C (1.058), ARO2 (1.059), DOM34 (1.059), SWE1 (1.059), GTO1 (1.059), RPL37B (1.060), RAD3 (1.060), MEP2 (1.060), PKH1 (1.061), ARL1 (1.061), ROX3 (1.061), SFT1 (1.062), SIM1 (1.062), CIA1 (1.062), COX5B (1.062), CLN1 (1.062), MNE1 (1.062), BRE4 (1.062), UBX5 (1.063), DSL1 (1.063), ACK1 (1.063), YHR140W (1.063), ARG82 (1.063), SCS22 (1.063), ADH7 (1.063), HSC82 (1.063), ARO80 (1.063), HED1 (1.063), MAD1 (1.064), TRP5 (1.064), RPN3 (1.065), SEN54 (1.065), PTM1 (1.065), ATG23 (1.065), GIM4 (1.065), YDR089W (1.066), MON2 (1.066), PEX32 (1.066), PUS6 (1.066), YJL038C (1.066), SGN1 (1.066), PRP39 (1.066), YNR070W (1.067), SPO71 (1.067), SAE3 (1.067), MGR2 (1.068), INP53 (1.068), TUP1 (1.068), SHP1 (1.068), 1N080 (1.068), CDC23 (1.068), GAB1 (1.068), PTC1 (1.069), SKI2 (1.069), DNF3 (1.069), YOR389W (1.070), AIM14 (1.071), ATP16 (1.071), VPS51 (1.071), NSE3 (1.071), UTP21 (1.071), MDE1 (1.072), ALY1 (1.072), MNI2 (1.072), BNS1 (1.072), ILV1 (1.073), TPO5 (1.073), THI21 (1.074), PEX2 (1.074), YMR194C-B (1.074), SFI1 (1.074), ESF1 (1.074), YJL068C (1.075), GPI1 (1.075), ISC10 (1.075), RPL13A (1.076), YDR391C (1.076), TVP15 (1.076), YNL108C (1.076), YDR051C (1.076), SRP01 (1.076), SAS4 (1.076), ARG4 (1.077), PAN5 (1.077), PTK1 (1.077), THI6 (1.077), YOR019W (1.077), GCN5 (1.077), DID4 (1.078), TRM11 (1.078), ABZ2 (1.079), YHR210C (1.079), RPL34B (1.079), POL31 (1.079), RPS4B (1.080), COG4 (1.080), RPS16B (1.080), LCB1 (1.080), ARA2 (1.080), VPH2 (1.081), YBT1 (1.081), HSM3 (1.081), YBL036C (1.081), DAL2 (1.081), VTC4 (1.081), RPS21B (1.081), YOR131C (1.081), ADE13 (1.081), YKL215C (1.081), LSM2 (1.082), FAR10 (1.082), MCH2 (1.082), IMD3 (1.082), USV1 (1.082), YAR035C-A (1.082), RAM1 (1.083), SNM1 (1.083), PNG1 (1.083), RFC3 (1.084), ARP2 (1.084), TOR2 (1.084), ISC1 (1.084), CTS1 (1.085), YSH1 (1.085), AIM4 (1.085), BIT2 (1.085), GVP36 (1.086), SED1 (1.086), SPG4 (1.086), KGD1 (1.086), NMT1 (1.086), SSY1 (1.086), LSC1 (1.086), NRK1 (1.086), YLR177W (1.086), SCD6 (1.087), YDR210W (1.087), LRP1 (1.087), URA2 (1.087), PEX21 (1.088), MCM5 (1.088), SSE2 (1.088), PYC2 (1.088), GFD1 (1.088), YNL247W (1.088), RAD17 (1.089), BRE2 (1.089), CDC48 (1.089), IES5 (1.089), RPL23A (1.089), PTR3 (1.089), ATP20 (1.089), PAU3 (1.089), CPR8 (1.090), ARO7 (1.090), YRO2 (1.090), HRB1 (1.091), HSP42 (1.091), RPS18B (1.091), FMP23 (1.091), ADE6 (1.091), DER1 (1.092), PPE1 (1.092), CUE3 (1.092), ACF2 (1.092), QNS1 (1.092), IOC3 (1.093), NAM9 (1.093), YDL144C (1.094), ENB1 (1.094), KTR3 (1.095), PSD1 (1.095), HOS1 (1.096), FCY21 (1.096), CAJ1 (1.096), ERP4 (1.096), LRC2 (1.097), TFB5 (1.098), PRM3 (1.098), CPR7 (1.098), MET17 (1.098), SAH11 (1.098), YGR149W (1.099), GAC1 (1.099), TFC7 (1.099), RHO5 (1.099), TIF34 (1.099), YPT1 (1.099), MSS4 (1.100), FLC2 (1.100), PRE2 (1.100), YCL068C (1.101), GAL80 (1.101), SPG3 (1.101), URB1 (1.101), MGE1 (1.102), STR2 (1.102), RPL34A (1.102), UIP3 (1.102), NPP1 (1.102), FMP24 (1.102), AIM23 (1.102), BIO3 (1.103), PRO2 (1.103), TMN3 (1.103), EST3 (1.103), PHO5 (1.104), YSP1 (1.104), TUF1 (1.104), ORM1 (1.104), OLA1 (1.0105), NMA1 (1.105), YMR209C (1.105), SEC27 (1.105), SLA1 (1.105), YCL012C (1.105), SLM1 (1.106), NOP53 (1.106), YLR162W-A (1.106), PAU13 (1.106), ALA1 (1.106), YDL133W (1.107), CDC37 (1.107), HCA4 (1.107), PRB1

(1.107), GSY1 (1.107), YIP3 (1.108), TMA46 (1.108), RPP1 (1.109), PRP3 (1.109), YBL107C (1.109), UBP14 (1.110), VAM10 (1.110), CBS1 (1.110), YOR238W (1.110), OMI4 (1.110), SEC66 (1.111), CST6 (1.111), SSF2 (1.111), FRS1 (1.111), NCA2 (1.112), HMX1 (1.112), NOP13 (1.112), RNR2 (1.114), QDR3 (1.114), OTU2 (1.114), SPO13 (1.114), HUL5 (1.115), SED4 (1.115), RRP42 (1.115), CDC33 (1.116), MLP1 (1.116), GOR1 (1.116), YDL119C (1.116), YJR039W (1.116), HNT2 (1.116), SCM3 (1.116), MET12 (1.117), VPS33 (1.117), MGR1 (1.117), PCM1 (1.117), YUH1 (1.117), CDS1 (1.117), SAP85 (1.118), CRT10 (1.118), SNF1 (1.118), CMP2 (1.118), APL6 (1.118), IDH1 (1.119), YDR428C (1.119), SEC21 (1.119), APL4 (1.119), PAP2 (1.119), GPI17 (1.119), SCH9 (1.120), HOP1 (1.120), MUK1 (1.120), RPS25B (1.120), NOB1 (1.120), STE23 (1.121), YLR243W (1.122), GRE3 (1.122), CCS1 (1.122), VEL1 (1.122), ENO2 (1.123), COG6 (1.123), RPL11B (1.123), HNT1 (1.123), LEM3 (1.123), GPI15 (1.124), FSF1 (1.124), SEC3 (1.124), SOL2 (1.124), PRS5 (1.124), VPS71 (1.124), ACC1 (1.124), ADE8 (1.124), GNA1 (1.124), YNR024W (1.126), RSF2 (1.126), MAL32 (1.126), PAU21 (1.126), SPS19 (1.127), YIL002W-A (1.127), SPF1 (1.127), CCT8 (1.127), PRM2 (1.128), PDH1 (1.128), RBL2 (1.128), PIF1 (1.128), VBA1 (1.128), AFG1 (1.129), DIN7 (1.129), IZH1 (1.129), YPL105C (1.130), YCR051W (1.130), WWM1 (1.130), SIP3 (1.130), SYS1 (1.131), HPC2 (1.131), RPL40A (1.131), NCR1 (1.131), YER078C (1.131), CAP1 (1.131), GCN4 (1.131), AIM38 (1.131), PTC7 (1.132), FUN14 (1.132), COS8 (1.132), MCH4 (1.132), PRP24 (1.132), CWC2 (1.132), CLC1 (1.132), SIR4 (1.133), FUS3 (1.133), YLR057W (1.133), ZRG7 (1.133), YSA1 (1.133), PTC3 (1.134), UBP6 (1.134), KAP122 (1.134), EFT2 (1.134), URA3 (1.135), ALG2 (1.135), POL5 (1.135), RPL1B (1.136), LIP1 (1.136), TMA20 (1.137), NAS6 (1.137), IRC5 (1.137), KIN3 (1.137), YPL033C (1.137), AVT4 (1.137), YGR266W (1.137), CTI6 (1.138), YNL050C (1.138), SDP1 (1.139), ESF2 (1.139), NFS1 (1.140), YER078W-A (1.140), IZH4 (1.140), CWC22 (1.140), YGR110W (1.140), DYN2 (1.140), SNF4 (1.141), YMR178W (1.141), NSE5 (1.142), RPL40B (1.142), TKL2 (1.142), HIR1 (1.142), RPS30A (1.142), HSP12 (1.142), YDR539W (1.143), GCV1 (1.144), NTG1 (1.144), AZR1 (1.144), SPO7 (1.144), YNL022C (1.144), DIM1 (1.145), VAM6 (1.145), YNR061C (1.145), PDA1 (1.145), YOR032W-A (1.145), SPC3 (1.146), CSR1 (1.146), COS9 (1.147), YJR085C (1.147), PEX15 (1.147), TGL2 (1.147), SGD1 (1.147), YPL278C (1.147), YIL108W (1.148), THP1 (1.148), SCY1 (1.149), YGR130C (1.149), UBC6 (1.149), END3 (1.149), UBP15 (1.149), RPL35B (1.149), MSB2 (1.149), YCT1 (1.150), SOL3 (1.150), YDL027C (1.151), KIP3 (1.151), UTP11 (1.151), SUB1 (1.152), PRP19 (1.152), DCW1 (1.152), TAH18 (1.152), YER010C (1.152), PIN3 (1.152), GYP1 (1.152), SCW10 (1.152), CTK1 (1.153), ARK1 (1.153), FYV10 (1.153), YCR016W (1.153), YDJ1 (1.153), ARF1 (1.153), BGL2 (1.153), YHR100C (1.154), CBS2 (1.154), REX3 (1.154), TSA1 (1.155), RNA14 (1.155), RCE1 (1.155), THR4 (1.155), SIP18 (1.156), PMS1 (1.156), DSK2 (1.156), CDC50 (1.156), DPH5 (1.156), HEM12 (1.156), SER3 (1.157), YML119W (1.157), ESC1 (1.157), GAL11 (1.158), PRE7 (1.158), RPT5 (1.158), ERG2 (1.158), DSE1 (1.158), SEC22 (1.159), YFH7 (1.159), HSF1 (1.159), GOS1 (1.160), WRS1 (1.161), EXO70 (1.161), TSA2 (1.162), ALK2 (1.162), COX6 (1.162), KRI1 (1.162), YGL015C (1.162), RPS17B (1.163), YDR367W (1.163), TOM20 (1.163), RSP5 (1.163), YBL086C (1.163), TRM44 (1.163), YPR109W (1.164), PTP1 (1.164), AVT7 (1.164), CYR1 (1.164), CIS1 (1.164), FAL1 (1.164), VPS28 (1.165), AGA2 (1.165), QRI1 (1.165), ATS1 (1.165), GIT1 (1.166), THO1 (1.166), FBP1 (1.166), YJL016W (1.166), UGA3 (1.166), YBR230W-A (1.167), CCE1 (1.167), NDE1 (1.167), SET5 (1.168), HOT1 (1.168), RPT1 (1.168), CAR2 (1.168), PRE4 (1.169), ECM33 (1.169), ECM1 (1.169), RAD33 (1.169), BUB2 (1.169), SOP4 (1.169), SPR1 (1.170), MOG1 (1.170), SPO11 (1.171), YKR070W (1.171), YBR246W (1.171), YKL071W (1.172), AHP1 (1.172), PRP42 (1.172), GRC3 (1.173), KEL3 (1.173), YMR244W (1.174), YMR242W-A (1.174), HBN1 (1.174), VAS1 (1.174), RTT102 (1.174), ZUO1 (1.175), YGR250C (1.175), FRQ1 (1.175), YCL049C (1.175), MCR1 (1.175), UBP11 (1.175), TIF35 (1.176), ATG26 (1.176), YKL107W (1.177), HEM14 (1.177), THR1 (1.178), LUG1 (1.178), SPS100 (1.178), VMA22 (1.179), YEL020C (1.179), RPL2B (1.179), GAL10 (1.180), FKS1 (1.180), YPL247C (1.180), YEL057C (1.180), RPS22A (1.181), TRK1 (1.181), VTC2 (1.181), SNU114 (1.181), SWD1 (1.181), UBC8 (1.181), YPT52 (1.181), XDJ1 (1.182), YJR142W (1.182), COQ9 (1.183), ERV25 (1.184), YKL075C (1.184), FPR4 (1.184), SEN2 (1.184), GDT1 (1.184), NOP7 (1.184), YOR251C (1.184), SRL1 (1.184), YLL023C (1.185), IRA2 (1.185), IES6 (1.185), MLF3 (1.186), DIA1 (1.186), MTG1 (1.186), FPR1 (1.186), NCE102 (1.186), ERG4 (1.187), SIF2 (1.187), NUP53 (1.187), RPL14A (1.187), SEC18 (1.187), SSB2 (1.188), RAT1 (1.188), YMR027W (1.188), GDI1 (1.189), VAN1 (1.189), KAP123 (1.189), ICL2 (1.189), LPX1 (1.189), RPP2A (1.190), SCD5 (1.190), EXO84 (1.190), CWC21 (1.191), TRE2 (1.191), YGR153W (1.191), YCR061W (1.191), RAD14 (1.192), CUL3 (1.192), VPS53 (1.192), GEA1 (1.192), GET3 (1.192), TAD2 (1.193), POT1 (1.193), MVP1 (1.193), PUS4 (1.194), SMC2 (1.194), RFC5 (1.194), TIF3 (1.195), NTG2 (1.195), HXT10 (1.195), CDC60 (1.195), ENT5 (1.196), GAT4 (1.196), PGU1 (1.196), UFD4 (1.197), RPL37A (1.198), PRE5 (1.198), PDC6 (1.198), GCV3 (1.198), EGD1 (1.199), MSC7 (1.200), KEM1 (1.200), APN1 (1.200), APE2 (1.200), YLR456W (1.200), MAK5 (1.201), YPR172W (1.202), STE24 (1.202), RPS9B (1.203), CRM1 (1.203), STP22 (1.204), DIA2 (1.205), ECO1 (1.205), MCX1 (1.205), YKL065W-A (1.205), NTR2 (1.205), HHO1 (1.206), RRM3 (1.206), PRE8 (1.206), NYV1 (1.206), RPC53 (1.207), TMA23 (1.208), REC104 (1.208), ZTA1 (1.209), TEC1 (1.209), TUB3 (1.209), YJL123C (1.209), AST2 (1.209), SNX4 (1.210), ARC1 (1.210), SOD1 (1.210), SMA2 (1.211), RGD1 (1.211), PHM8 (1.211), SEM1 (1.211), GGA2 (1.211), YAK1 (1.211), RGA2 (1.211), SCS3 (1.212), YTA7 (1.213), MDM12 (1.213), AUR1 (1.213), SKN7 (1.213), MDG1 (1.213), RSM7 (1.214), YOL038C-A (1.214), OSW2 (1.214), TIR3 (1.214), RSM28 (1.214), NIF3 (1.215), FRE6 (1.215), MDM20 (1.215), YNR071C (1.215), GDH2 (1.215), VPS8 (1.216), MVD1 (1.216), GCD2 (1.216), TFP3 (1.216), FMP33 (1.216), NUG1 (1.217), CPR6 (1.219), SCP160 (1.219), SEC14 (1.219), YNL181W (1.219), PRE6 (1.220), YLR364W (1.220), HOG1 (1.221), NUP49 (1.221), RPL21B (1.221), RPL42A (1.221), GTT2 (1.221), STR3 (1.222), ARG5,6 (1.222), RPS24A (1.222), PPM1 (1.222), AIM46 (1.222), ILM1 (1.222), PEX10 (1.222), PDS5 (1.223), YDR042C (1.223), YDL218W (1.223), MGT1 (1.223), NPC2 (1.223), YLR194C (1.223), PDI1 (1.223), XKS1 (1.223), SIW14 (1.224), KOG1 (1.224), PDR15 (1.224), NGR1 (1.225), SMX3 (1.225), FIP1 (1.225), UGA4 (1.225), EDC1 (1.225), YDL086W (1.225), GGA1 (1.226), SMM1 (1.227), AIM39 (1.227), UBC1 (1.227), YGR203W (1.227), PRP4 (1.227), YSF3 (1.227), SNA3 (1.228), SKI6 (1.228), CDC12 (1.228), VPS60 (1.228), MSC1 (1.229), SET1 (1.229), NMA111 (1.229), SKI7 (1.229), KRE5

(1.229), FOL2 (1.229), DAL3 (1.230), SAK1 (1.230), RVS161 (1.230), YBR141C (1.231), LHS1 (1.231), YFL051C (1.231), YGR067C (1.231), NOT5 (1.231), CKB2 (1.231), ATG2 (1.232), YJR112W-A (1.232), RKM2 (1.232), RPL36B (1.232), CNB1 (1.232), PRP43 (1.233), LCB5 (1.233), PAC1 (1.233), ARP3 (1.234), LRC1 (1.234), RGR1 (1.234), YDL157C (1.234), DPL1 (1.234), GCY1 (1.235), YER076C (1.235), TFB3 (1.235), RPS8B (1.235), GAT2 (1.235), GFD2 (1.235), MRP8 (1.236), VAC14 (1.236), YHR138C (1.237), PHO90 (1.237), PSK2 (1.238), ALT1 (1.238), ERP5 (1.238), LAS21 (1.238), AIM9 (1.239), SLZ1 (1.240), SGM1 (1.240), FMP27 (1.241), HXT3 (1.241), YGR273C (1.241), RAM2 (1.241), RET1 (1.241), YIR007W (1.241), RPS2 (1.242), MTQ2 (1.242), RPS23B (1.242), COS12 (1.242), RUB1 (1.242), RGP1 (1.242), GYP7 (1.243), YOL138C (1.243), PMT2 (1.243), YMR130W (1.243), SPS4 (1.244), RAD28 (1.244), YLR099W-A (1.245), YOR285W (1.245), MBR1 (1.245), MPH1 (1.246), NUP159 (1.246), SEC63 (1.246), RPS16A (1.247), YPL206C (1.247), BCD1 (1.247), HOT13 (1.248), IVY1 (1.248), RNA15 (1.248), YKR104W (1.248), STE4 (1.249), PUP1 (1.250), SFB2 (1.251), YCK2 (1.251), ODC11 (1.251), FMP42 (1.251), VPS24 (1.251), YKL098W (1.252), YSY6 (1.252), RTG2 (1.252), LYS9 (1.253), UTR1 (1.253), HRR25 (1.253), YBR261C (1.254), RPS26A (1.254), KTR5 (1.254), CHL1 (1.255), MNN10 (1.255), GLE2 (1.255), CPD1 (1.255), SNZ1 (1.256), PAM17 (1.256), HIR2 (1.256), CDC28 (1.257), YDR061W (1.257), ENA5 (1.257), APM3 (1.258), YLR118C (1.258), AYT1 (1.258), PEP12 (1.258), PET18 (1.258), MAM1 (1.258), DOA1 (1.259), FPR2 (1.259), PIB2 (1.259), PRP21 (1.260), TOP2 (1.261), YBL044W (1.261), OST6 (1.261), AIM24 (1.262), IRC18 (1.262), OSW1 (1.263), COT1 (1.263), YOR387C (1.263), SKP1 (1.263), STM1 (1.263), YDL176W (1.263), YLR137W (1.263), ALF1 (1.264), PBP1 (1.264), YNL200C (1.264), YBL029C-A (1.265), SPE3 (1.265), RRD2 (1.265), CNN1 (1.266), SPR6 (1.266), PAN3 (1.267), YRB1 (1.268), YDL057W (1.268), YOR051C (1.268), POL4 (1.268), ORC5 (1.269), IMP2 (1.269), ATG19 (1.269), ARO8 (1.269), YJL163C (1.269), SWI5 (1.270), LSP1 (1.270), TMA19 (1.270), YET3 (1.271), RAD26 (1.271), MGA2 (1.271), IME1 (1.272), OXR1 (1.272), GSF2 (1.273), RPS18A (1.273), RUP1 (1.273), YLR126C (1.273), KRE27 (1.273), TVP23 (1.273), INO1 (1.273), ALG14 (1.274), PUS5 (1.274), VMA10 (1.275), SPT16 (1.275), YLL053C (1.276), CHC1 (1.276), MSH6 (1.276), SDS24 (1.277), PTC4 (1.278), PSP2 (1.278), VBA2 (1.278), TSR4 (1.278), CPR4 (1.278), DPP1 (1.279), TFG1 (1.279), ARN2 (1.279), YGL230C (1.279), NBP1 (1.280), YKL077W (1.280), MOB2 (1.280), DYN3 (1.280), UBC13 (1.280), RFA3 (1.281), SPG5 (1.281), GYP5 (1.281), YPI1 (1.281), YDR179W-A (1.281), CHA1 (1.282), TOS4 (1.282), ADH1 (1.282), SPO1 (1.282), JJJ2 (1.283), ADK1 (1.283), SOK1 (1.284), GOT1 (1.285), TIR4 (1.285), ERP2 (1.285), SEN1 (1.285), PHO81 (1.285), ARF2 (1.285), YOR227W (1.285), TVP38 (1.286), YDL089W (1.286), ZDS2 (1.286), GCD6 (1.286), SUI2 (1.286), VAC7 (1.287), TAH11 (1.288), CTR9 (1.288), YKL100C (1.289), NUP188 (1.289), GRE1 (1.289), PHB2 (1.289), BUD3 (1.290), SMA1 (1.290), RPL20B (1.290), NSP1 (1.291), PPZ2 (1.291), STO1 (1.291), ETR1 (1.291), SUL1 (1.292), RPL6B (1.292), CPR5 (1.292), YAL018C (1.292), ELP6 (1.292), ACP1 (1.293), SHR3 (1.293), KAP120 (1.293), YBR137W (1.293), IME2 (1.293), SNF7 (1.293), YCR023C (1.293), GIS2 (1.294), YIP1 (1.294), TFC3 (1.294), CUE1 (1.295), YLR283W (1.295), FUN12 (1.296), BMH1 (1.296), RIM1 (1.297), YMC1 (1.297), KIC1 (1.297), NAR1 (1.298), YBR184W (1.298), CAF4 (1.298), CTK3 (1.298), NUP157 (1.299), PRY1 (1.299), MFA1 (1.300), POL2 (1.300), YDL114W (1.300), STP3 (1.301), IRC20 (1.301), ZPS1 (1.302), POP1 (1.303), DUN1 (1.303), SLY1 (1.303), UTP6 (1.303), TAL1 (1.303), DIB1 (1.303), PAC2 (1.303), YNR029C (1.304), SPC72 (1.305), RPC34 (1.305), KTR7 (1.305), KRR1 (1.305), YBR062C (1.306), SSA4 (1.306), VMA9 (1.308), ATG22 (1.308), NRD1 (1.309), INH1 (1.309), REF2 (1.312), TSC13 (1.312), UTP7 (1.312), AIM15 (1.313), ARC19 (1.313), EHT1 (1.313), YHL017W (1.313), NNF2 (1.313), YPR027C (1.314), TGL3 (1.314), PEX28 (1.314), TEL1 (1.315), PGM1 (1.315), PAN1 (1.315), HRD3 (1.315), RPL26B (1.316), SDT1 (1.316), YER128W (1.317), PSY3 (1.317), VPS52 (1.318), RPB4 (1.318), AIM2 (1.318), NUD1 (1.318), RPS29B (1.320), PRO3 (1.320), RPL32 (1.321), PXA1 (1.321), GID8 (1.322), TRM3 (1.322), SLX1 (1.322), PEA2 (1.322), UBR1 (1.322), AIP1 (1.322), RPS10A (1.323), CFD1 (1.324), YOR114W (1.324), LEA1 (1.324), MSN5 (1.324), RPL6A (1.324), PTC2 (1.324), YER071C (1.325), RAS2 (1.325), ATG14 (1.326), CDC11 (1.326), RPS6B (1.326), URA6 (1.326), RPN1 (1.327), SFH5 (1.329), YAP801 (1.329), FLR1 (1.329), DDR48 (1.329), YRA2 (1.329), APN2 (1.330), ELF1 (1.330), YJL217W (1.331), YPR089W (1.331), GSP2 (1.331), BUG1 (1.331), PSE1 (1.331), SUA5 (1.332), GPM2 (1.332), POS5 (1.332), PRM5 (1.334), TAF4 (1.334), GIM5 (1.336), BNR1 (1.336), YPS7 (1.337), HAL5 (1.337), RPS27B (1.337), CAK1 (1.337), PGA2 (1.337), SSP2 (1.338), PMR1 (1.338), NUP85 (1.339), LSB6 (1.339), TMA7 (1.340), TGL1 (1.340), ASN2 (1.340), SEI1 (1.341), VMA7 (1.341), MDR1 (1.341), HBS1 (1.341), PMT1 (1.342), PHO2 (1.342), YHR113W (1.342), SSO1 (1.342), RET2 (1.342), UBA1 (1.342), ALD2 (1.342), SEC28 (1.343), SEH1 (1.343), YMR144W (1.343), HOC1 (1.343), PRT1 (1.344), RPS19B (1.344), GCN2 (1.345), SAP4 (1.345), YLR179C (1.346), COQ6 (1.346), LYS14 (1.346), LSM12 (1.347), YGL117W (1.347), RED1 (1.348), VPS34 (1.348), VTC3 (1.348), BRF1 (1.348), ARR2 (1.350), VMA21 (1.350), PSF1 (1.351), SRL3 (1.351), YDR379C-A (1.351), ALG12 (1.352), RPS25A (1.352), SDS23 (1.352), DGA1 (1.352), YDR196C (1.353), LOC1 (1.354), RPN2 (1.355), ANB1 (1.355), NAN1 (1.355), STB2 (1.355), CUE5 (1.356), CDC8 (1.356), SPH1 (1.357), GID7 (1.357), UBC4 (1.357), RPS22B (1.358), ACT1 (1.360), RPS8A (1.360), YNR068C (1.360), FRS2 (1.360), TAF8 (1.361), THI4 (1.361), RBK1 (1.362), SET3 (1.362), YNL305C (1.362), TPP1 (1.362), MSO1 (1.363), NSA1 (1.364), YMR210W (1.364), ERG24 (1.364), YMR31 (1.364), MAK11 (1.364), URB2 (1.364), FAD1 (1.365), AGC1 (1.366), OM45 (1.366), APD1 (1.367), GSH2 (1.367), SPT14 (1.367), YGR210C (1.368), RPS11A (1.368), SWH1 (1.369), ANT1 (1.369), SAP30 (1.369), HRT3 (1.369), NSG1 (1.370), BAT2 (1.370), SOM1 (1.371), IPP1 (1.372), HIS2 (1.372), RSE1 (1.372), RTT101 (1.372), CRG1 (1.373), YJR096W (1.374), IMH1 (1.374), SPT7 (1.374), MKT1 (1.374), GTT3 (1.375), PEX11 (1.375), YDR374W-A (1.377), YPD1 (1.377), DOS2 (1.377), YEL023C (1.378), RPF1 (1.378), BNA2 (1.380), ATG27 (1.380), RPL29 (1.382), YPS6 (1.382), RPL19B (1.382), YDR357C (1.382), ARO4 (1.383), YBR096W (1.384), PEP8 (1.384), RPL39 (1.385), SCC4 (1.386), HXT7 (1.386), HSV2 (1.386), APA2 (1.386), TFC1 (1.386), SEC53 (1.386), PDR5 (1.386), MUD2 (1.387), RPL19A (1.387), TAF9 (1.387), MXR1 (1.388), RIX1 (1.388), PKR1 (1.389), CWC27 (1.390), BFR1 (1.390), YDR387C (1.390), UIP4 (1.390), OST3 (1.391), BUD6 (1.392), GFA1 (1.393), RPS0A (1.395), CRZ1 (1.396), SLT2 (1.396), SNC1 (1.396), SEC5 (1.397), PCL6 (1.397), DAL5 (1.398), MSB1 (1.399), CSL4 (1.399), COQ4 (1.400), IAH1 (1.400), YPL245W (1.400),

PRI2 (1.400), LOS1 (1.400), SQS1 (1.401), PBA1 (1.401), YFR017C (1.402), HPA3 (1.402), SCL1 (1.403), YGR168C (1.404), SAP155 (1.405), MON1 (1.405), SGA1 (1.405), MNI1 (1.406), TFC8 (1.407), FAB1 (1.407), MED2 (1.407), GCN3 (1.408), PRE1 (1.408), BBC1 (1.409), GPA1 (1.409), DIG2 (1.409), IRS4 (1.409), SXM1 (1.410), SHU2 (1.410), SRO7 (1.411), GEF1 (1.412), RPL24A (1.413), TMN2 (1.413), RIB3 (1.414), UBC9 (1.414), MAL11 (1.415), ARO10 (1.415), LAC1 (1.415), RCN1 (1.416), MVB12 (1.418), TBS1 (1.418), CTL1 (1.419), NTF2 (1.419), BZZ1 (1.420), HXT14 (1.421), YGR125W (1.421), YNR062C (1.422), STE50 (1.422), YLL056C (1.423), HIS3 (1.423), CIN2 (1.423), TCB3 (1.423), NUM1 (1.424), CPA1 (1.425), PRP40 (1.425), TRR1 (1.425), TRP2 (1.426), ADE16 (1.427), EFT1 (1.427), BET3 (1.428), SUA7 (1.430), RPS14A (1.430), FOL1 (1.431), DPB4 (1.431), VPS16 (1.431), ANP1 (1.431), YMR099C (1.432), VHS2 (1.432), BMH2 (1.432), ADH6 (1.432), GSC2 (1.433), DBR1 (1.433), ADP1 (1.433), CEG1 (1.434), MBP1 (1.434), FCP1 (1.434), SRY1 (1.434), YNL008C (1.435), AVO2 (1.435), YMR196W (1.435), RPL35A (1.435), HIF1 (1.435), YLR050C (1.436), YER187W (1.436), YOR186W (1.436), RAD57 (1.437), ATH1 (1.437), PEP7 (1.437), YJL055W (1.438), YBR259W (1.439), UBX7 (1.439), ILV6 (1.439), SAM4 (1.441), MRM1 (1.441), PHO23 (1.441), MYO4 (1.443), BRE1 (1.443), YFR032C (1.444), GAS4 (1.444), MIP6 (1.444), ERV46 (1.444), YPR097W (1.444), PET10 (1.445), HDA2 (1.445), TRX2 (1.445), MED4 (1.446), SPO16 (1.446), NSG2 (1.446), GND2 (1.447), PDB1 (1.448), BDH1 (1.448), NIT3 (1.449), MUD1 (1.449), ERG20 (1.450), RPL18A (1.451), PAI3 (1.452), TMA108 (1.452), SAM50 (1.452), SLY41 (1.452), YDR461C-A (1.454), YMR265C (1.454), YJL132W (1.454), BLM10 (1.454), SPO73 (1.454), CWC15 (1.455), ALO1 (1.456), MAP1 (1.456), YKR023W (1.456), PET130 (1.456), YCS4 (1.458), CWH41 (1.458), ARP9 (1.458), CHK1 (1.459), PAM1 (1.459), TAF10 (1.459), ARA1 (1.461), CGI121 (1.461), YIL014C-A (1.461), CHS7 (1.461), RPS21A (1.463), VMA13 (1.463), NAT3 (1.464), ARG2 (1.464), DOG1 (1.465), TMS1 (1.465), PSF2 (1.465), YHR126C (1.465), KAP104 (1.466), DPS1 (1.466), IRR1 (1.466), YAL044W-A (1.466), RPL23B (1.467), YDR307W (1.467), RPL33A (1.468), NAB6 (1.468), APA1 (1.469), ALG6 (1.469), MEX67 (1.470), DAK1 (1.471), ARC15 (1.471), YOS1 (1.472), GAD1 (1.472), ECM22 (1.473), CYS3 (1.473), PBI2 (1.474), YBR271W (1.474), GPI10 (1.474), WBP1 (1.477), ZRC1 (1.477), FIG2 (1.477), YOR262W (1.477), MSH3 (1.478), IOC2 (1.478), YGR201C (1.479), NAP1 (1.479), KAE1 (1.479), CHS1 (1.480), GDE1 (1.480), YTM1 (1.480), YHR162W (1.480), TAD3 (1.480), ALP1 (1.481), TRM8 (1.482), NMD2 (1.482), YIM1 (1.483), BCH1 (1.483), RRP1 (1.483), VCX1 (1.483), UGA1 (1.484), HOL1 (1.484), GRX1 (1.484), EMP24 (1.484), YGR237C (1.485), FAP1 (1.485), KTR2 (1.486), PBP4 (1.486), YER163C (1.486), RFS1 (1.486), PTA1 (1.487), MPD2 (1.487), SGT2 (1.487), IKI1 (1.487), ECM29 (1.488), REV3 (1.489), TPD3 (1.489), YDL124W (1.490), MUM2 (1.491), YFR026C (1.491), PHS1 (1.491), MLS1 (1.493), POR1 (1.494), PFD1 (1.494), EGD2 (1.494), GYP8 (1.495), RPT2 (1.495), TEX1 (1.495), RPS5 (1.496), TPK1 (1.496), DOT5 (1.497), LSB5 (1.498), DMA1 (1.498), BNA6 (1.498), VAB2 (1.499), AML1 (1.500), SEC31 (1.500), KIN1 (1.501), STB4 (1.502), GSP1 (1.502), AAD4 (1.502), MNN2 (1.503), RPP1B (1.503), GUK1 (1.506), MCK1 (1.506), HSP31 (1.506), SBP1 (1.506), ZWF1 (1.507), IST2 (1.508), GPI16 (1.508), CDC42 (1.508), AHA1 (1.509), UBP2 (1.510), YNL115C (1.510), CCW14 (1.510), YDL121C (1.510), MCA1 (1.510), RPT4 (1.511), ERP1 (1.512), TMA7 (1.513), WHI4 (1.513), YDR131C (1.513), PDR1 (1.514), TSR3 (1.516), ATG11 (1.516), DDP1 (1.516), COQ2 (1.516), RPP1A (1.517), PMP3 (1.517), CRD1 (1.517), PHO85 (1.517), YGR017W (1.517), YIL055C (1.518), LAP3 (1.518), YOR291W (1.519), GAS5 (1.519), YKR043C (1.520), YIL083C (1.520), CHO2 (1.521), ELP4 (1.521), BIM1 (1.522), CAM1 (1.522), DAL82 (1.523), UMP1 (1.524), YBR241C (1.524), LTP1 (1.524), PHO91 (1.525), RPP0 (1.526), YOR164C (1.526), TOM71 (1.527), FAS2 (1.528), FMP46 (1.528), TMA22 (1.528), YML131W (1.528), YCF1 (1.530), OPI3 (1.530), ROM1 (1.530), IRC24 (1.530), FYV6 (1.531), ATG13 (1.534), TRX3 (1.534), ENP2 (1.534), CEX1 (1.534), VPS3 (1.535), TRX1 (1.536), DIT2 (1.536), SEC4 (1.536), GDH3 (1.537), PRE9 (1.537), UBP1 (1.537), AYR1 (1.537), NIT2 (1.537), PDR17 (1.538), TUB1 (1.539), KEG1 (1.539), CDC25 (1.539), PIG2 (1.539), NSE1 (1.541), VPS25 (1.541), YLR414C (1.541), CWH43 (1.541), COG2 (1.545), RCY1 (1.545), VPS68 (1.546), RPL7A (1.548), TAF14 (1.549), SRB5 (1.553), UPF3 (1.553), YML096W (1.555), ARG81 (1 (1.555), NPR2 (1.555), PSH1 (1.556), TAF6 (1.557), MCT1 (1.557), SBH1 (1.557), PBN1 (1.558), VPS45 (1.560), SRP68 (1.560), SAY1 (1.561), PEP1 (1.562), CCT4 (1.563), COQ10 (1.565), GPX1 (1.565), SSE1 (1.566), YSP3 (1.567), ABZ1 (1.567), PNS1 (1.567), DPB3 (1.568), YDL073W (1.568), ATM1 (1.568), RBD2 (1.568), YFR006W (1.569), DDI1 (1.569), DCP1 (1.570), SAS10 (1.570), RMT2 (1.571), FIG1 (1.572), MUS81 (1.573), UBI4 (1.573), YBR285W (1.574), DLD1 (1.576), RPS15 (1.576), YPR170W-B (1.576), SRP1 (1.577), PSK1 (1.577), RAD4 (1.578), PGD1 (1.580), PMT4 (1.581), ABF2 (1.582), SEC24 (1.584), URA10 (1.585), CWC23 (1.585), RPS1B (1.586), TPM1 (1.586), YLR290C (1.588), TRM9 (1.588), YAP1 (1.589), UGP1 (1.589), SPS2 (1.590), PDR10 (1.591), POM34 (1.591), PNC1 (1.591), STE11 (1.593), GRH1 (1.596), YMR018W (1.596), TRS33 (1.596), HEF3 (1.597), LAT1 (1.597), BDS1 (1.597), HMF1 (1.598), PRP6 (1.600), FSH3 (1.600), SRB2 (1.601), DUG1 (1.601), ERD2 (1.602), CDA2 (1.602), RPS6A (1.602), HUT1 (1.604), SHS1 (1.604), IRA1 (1.605), SSA3 (1.606), ELP3 (1.606), PRP46 (1.606), CSM3 (1.606), PEP4 (1.607), YHC3 (1.610), MDY2 (1.610), RPL43A (1.613), HRQ1 (1.613), YKL023W (1.613), DFM1 (1.614), PCL8 (1.614), SKG3 (1.614), GPH1 (1.615), NEJ1 (1.616), URA4 (1.617), GPX1 (1.620), HOS2 (1.622), YDR531W (1.623), PEP3 (1.624), MAL31 (1.625), YGR283C (1.626), HFD1 (1.627), SPR28 (1.627), SWP82 (1.628), FUM1 (1.629), CDA1 (1.629), HOM6 (1.630), NHX1 (1.631), SNF6 (1.632), ECI1 (1.632), CDC10 (1.632), MIS1 (1.632), YIL165C (1.632), GTT1 (1.636), PLP2 (1.636), PFA4 (1.636), RPL30 (1.637), PRE3 (1.640), MTD1 (1.640), MNT72 (1.642), ECM30 (1.643), YNL208W (1.645), YCR024C-B (1.645), PCA1 (1.646), HCS1 (1.648), DCC1 (1.650), FAR8 (1.652), PPH22 (1.654), DED81 (1.656), GPM1 (1.657), COF1 (1.658), YGR042W (1.658), YPR148C (1.659), VPS55 (1.659), JLP1 (1.660), CAT2 (1.661), GCN1 (1.664), YGL231C (1.664), GUS1 (1.665), YGR111W (1.667), VMA4 (1.671), YDR056C (1.671), SCS2 (1.672), NQM1 (1.675), UFE1 (1.677), COG1 (1.677), PAA1 (1.677), IRC22 (1.682), KTR1 (1.682), TYW1 (1.683), SSB1 (1.683), SVP26 (1.686), ESC8 (1.687), YNL010W (1.687), TIF1 (1.689), EAF6 (1.690), SHC1 (1.690), KIN2 (1.692), DCS2 (1.692), RPS1B (1.692), URA5 (1.692), DSD1 (1.693), YJL218W (1.694), NPT1 (1.694), SRO77 (1.695), FMN1 (1.695), CMD1 (1.695), YTA6 (1.697), RPL21A (1.699), ALG3 (1.699), KRE2 (1.703), PCL5 (1.704), MDM34 (1.705), PFS2 (1.708), SNF12 (1.708), BNA1 (1.709), AIM29 (1.710), SNU13 (1.712),

RNR4 (1.712), MAP2 (1.713), DCS1 (1.716), RPN5 (1.716), PDC2 (1.722), DOP1 (1.723), SPO74 (1.725), PAP1 (1.728), RPL24B (1.732), RPN8 (1.734), FPR3 (1.734), ERS1 (1.735), CPR1 (1.736), FIT3 (1.740), HUG1 (1.742), VPS5 (1.742), PEX3 (1.742), RPS29A (1.743), ERV29 (1.743), CAF20 (1.743), DOG2 (1.743), RPL4A (1.744), YCP4 (1.745), PBY1 (1.746), FUS2 (1.750), SNF2 (1.752), SUI1 (1.752), YMR262W (1.759), BUD8 (1.761), TED1 (1.763), TAH1 (1.765), YCL048W-A (1.769), RPL41A (1.774), YDR374C (1.776), VMA8 (1.777), YKR051W (1.777), YFL042C (1.778), ORM2 (1.778), TAF12 (1.778), APE3 (1.781), YDR239C (1.782), ERV2 (1.784), SHR5 (1.785), YHR192W (1.787), YRB30 (1.791), PHO88 (1.791), WHI2 (1.792), LYS1 (1.793), RHO1 (1.795), VPS27 (1.797), VMA6 (1.797), PAB1 (1.806), YJR015W (1.807), SIR2 (1.809), FAR1 (1.809), CPT1 (1.814), ECM15 (1.815), ROK1 (1.815), YFR018C (1.820), HYR1 (1.821), POL1 (1.821), CTS2 (1.830), UBA4 (1.832), SRP72 (1.833), RTN2 (1.834), HAP1 (1.835), ARE2 (1.836), RCK2 (1.837), INM2 (1.839), AFR1 (1.840), YOS9 (1.840), RTT103 (1.842), RPS12 (1.845), RNY1 (1.847), PPA1 (1.848), LEU3 (1.849), ERG27 (1.850), TMA29 (1.851), UBX3 (1.852), VPS15 (1.854), RPT6 (1.855), LDB18 (1.859), YPL088W (1.862), RPL5 (1.863), RVS167 (1.870), TIR2 (1.871), PHA2 (1.873), ERJ5 (1.873), VPS30 (1.876), IMD2 (1.878), PES4 (1.879), EMI1 (1.897), YPR085C (1.901), YBR200W-A (1.903), FMP40 (1.909), REH1 (1.909), SGT1 (1.911), CPS1 (1.913), YOP1 (1.917), TRR2 (1.919), STS1 (1.920), VPH1 (1.931), SWA2 (1.933), YGR026W (1.938), CDC53 (1.938), FMP52 (1.941), YDR119W (1.945), RNQ1 (1.953), SAG1 (1.956), RPS20 (1.974), TRM82 (1.979), VPS1 (1.981), YIP5 (1.987), YPR1 (1.988), ENT2 (1.992), YPT31 (1.997), PRX1 (2.003), YHL039W (2.003), YHI9 (2.022), BUD32 (2.035), YLR361C-A (2.037), APL2 (2.043), PTP3 (2.046), YMR114C (2.049), LSC2 (2.054), ATG10 (2.056), SRP54 (2.065), ENT3 (2.077), RPL3 (2.080), TYR1 (2.095), NAT1 (2.106), YNR021W (2.114), EBS1 (2.126), HBT1 (2.132), RPL15A (2.145), RPL41B (2.149), RPP2B (2.166), CBR1 (2.178), BNA4 (2.233), PRC1 (2.240), DIT1 (2.244), RPS28A (2.260), ASP3-1 (2.300), IDP1 (2.304), SCW4 (2.321), VMA2 (2.369), ALY2 (2.382), and NAT5 (2.449).

These results show that the yeast gene terminators exhibited an extremely wide and diverse range of expression intensities relative to the intensity of the PGK1 terminator, and that therefore exogenous genes can be expressed with the desired expression intensity by expressing one or two or more kinds of arbitrary genes in a yeast using a combination of one or two or more kinds of these terminators as necessary.

Example 6

Regulation of Excretory Expression Levels of Cellulase in a Yeast

In this example, different terminators were used to regulate the excretory expression levels of cellulase.

(Plasmid Preparation)

A TDH3 promoter sequence, a known *Rhizopus oryzae* secretory signal sequence, a *Trichoderma* endoglucanase 2 (TrEG2) gene and a terminator sequence were linked in that order to the SmaI site of Takara Bio pAUR112 to prepare a plasmid. NAT5 and RPI41B (for which increased GFP expression was confirmed in Example 5) and ICY2 (for which decreased GFP expression was confirmed in Example 5) were used as the terminators in this example, and PGK1 and a sequence from MFA2 were used as controls.

(Excretory Expression of Cellulase in a Yeast and Cellulose Decomposition Reaction)

Each of the plasmids prepared above was introduced into the BJ5464 yeast strain using a FROZEN-EZ YEAST TRANSFORMATION II KIT™ (Zymo Research). 3 each of the yeast clones obtained above were pre-cultured in SD-Ura medium (30° C., 24 hours), and then planted at a 20% seed rate in SD-Ura medium and sub-cultured (30° C., 24 hours). 10 µl of centrifugation supernatant was added to 90 µl of phosphoric acid-swollen cellulose (PSC) containing 50 m phosphate buffer (pH 5.0) and agitated, after which a decomposition reaction was performed for 3 hours at 40° C. After the reaction, 5 µl of centrifugation supernatant was taken and the amount of reducing sugar was measured by TZ assay (Journal of Biochemical and Biophysical Methods, 11 (1985), 109-115).

As in the measurement of GFP expression, the terminators of the NAT5 and RPL41B genes produced higher secretory levels than the terminator of the PGK1 gene as a control, while the terminator of the ICY2 gene produced a lower cellulase secretory level than the PGK1 terminator gene.

Example 7

Figure 3:
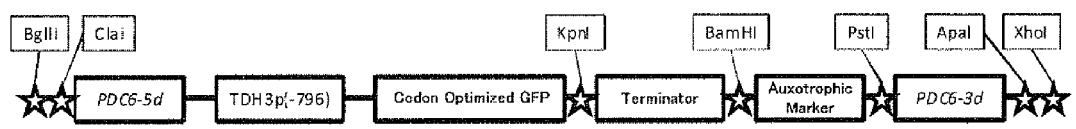
FIG. 3 shows an outline of an evaluation construct prepared in Example 7.

Based on the previous results, constructs were prepared for evaluating the top 44 terminators, including the standard SAG1t terminator. The evaluation constructs were configured as shown in FIG. 3, and specific genes were inserted at one location on the genome to prepare recombinant yeasts. The culture conditions were matched to $OD_{660}=0.7$, activity measurement was repeated 3 times with 10000 cells for each recombinant yeast, and the top 30 terminators were determined. The top 5 terminators were also determined under various culture conditions.

(1) Selection of Terminators for Evaluation

An attempt was made to prepare constructs for evaluating 44 terminators that exhibited higher activity than the standard SAG1t terminator (NAT5t, ALY2t, SCW4t, IDP1t, ASP3-1t, RPS28At, DIT1t, PRC1t, BNA4t, CBR1t, VMA2t, RPP2Bt, RPL41Bt, RPL15At, HBT1t, EBS1t, YNR021W, NAT1t, TYR1t, RPL3t, ENT3t, SRP54t, ATG10, LSC2t, YMR114Ct, APL2t, YLR361C-At, BUD32t, PRX1t, YHL039W, YPT31t, ENT2t, YIP5t, YPR1t, TRM82t, VPS1t, RPS20t, RNQ1t, YDR119Wt, YGR026Wt, CDC53t, FMP52t. SWA2t and SAG1t in order from the one with the highest activity), and 40 were obtained as a result, excluding the four terminators YPR1t, VPS1t, RPS20t and SWA2t. The final total was 44 because four terminators (YHI9t, PPA1t, GUS1t and BUD6t) were originally judged to have lower activity than SAG1t, but actually exhibited higher activity than SAG1t in the course of screening.

(2) Preparation of Transformation Vectors

As shown in FIG. 3, evaluation constructs were obtained having the following configuration between the BglII site and the XhoI site of pSP73 (Promega). That is, each genome insertion construct comprised a 5' upstream sequence of PDC6 (−821 to −177 from initiation codon), a TDH3 promoter (−796 to −1), a yeast codon-optimized GFP gene, the respective terminator region, an auxotrophic marker and a 3' downstream sequence of PDC6 (+4 to +599 from termination codon) in that order. The auxotrophic marker was TRP1 or URA3. The construct shown in FIG. 3 is similar to a vector used in the reference literature (Yamanishi, M, Katahira S, Matsuyama T, TPS1 terminator increases mRNA and protein yield in *Saccharomyces cerevisiae* expression system, *Bioscience, Biotechnology and Biochemistry*, 75, 2234-2236 (2011)), except that the reporter gene is codon-optimized GFP (Yamanishi M, Matsuyama T, A modified Cre-lox genetic switch to dynamically control metabolic flow in transgenic *Saccharomyces cerevisiae, ACS Synthetic Biology*, 1, 172-180 (2012)). Each terminator region was cloned by ordinary methods using the KpnI site and BamHI site parts as a cassette.

(3) Preparation of Recombinant Yeast

Evaluation constructs corresponding to each of the terminators were introduced into the wild-type yeast W303-1a to prepare recombinant yeasts, which were then cultured under culture conditions conforming to $OD_{660}$=0.7, and the fluorescence intensity was measured by flow cytometry (FCM). Specifically, the wild-type yeast W303-1a was first cultured in YPD liquid medium, and then treated with a FROZEN-EZ YEAST TRANSFORMATION II KIT™ (Zymo Research) to prepare competent cells. The construct prepared in (2) was treated with the insertion site terminal restriction enzyme BglII or ClaI, and also with ApaI or XhoI to obtain fragments that were then added to the competent cells and diluted with PEG buffer. This was heated for 45 minutes to obtain a transformant. The transformant was cultured in tryptophan selection medium, and strains that maintained stable growth capacity were selected. These were then subjected to colony PCR to confirm proper introduction of the target gene.

(4) Ranking of Terminator Activity

Figure 4:
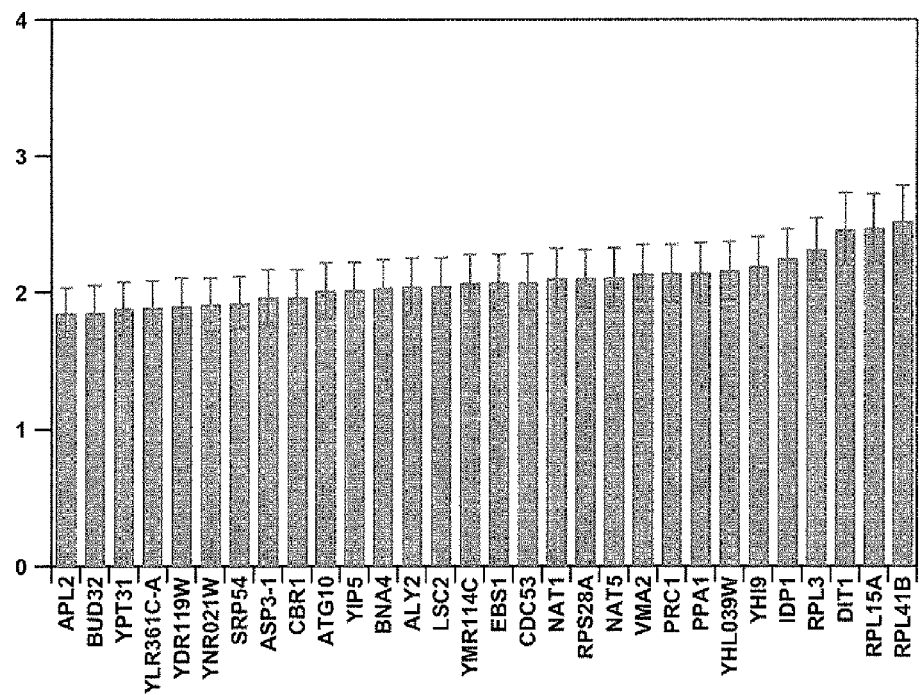
FIG. 4 shows the top 30 terminator regions selected in Example 7.

The respective strains of transformed yeast were pre-cultured in SD medium (2% glucose, 0.67% Yeast Nitrogen base w/o amino acids (Difco Laboratories, Inc.), 0.082% Complete Supplement Mixture (CSM)+40Ade (ForMedium Ltd.), inoculated in SD medium at about $OD_{660}$=0.1 and cultured to $OD_{660}$=0.7, and fluorescence intensity was measured. Using the fluorescence intensity emitted by the GFP fluorescent protein (reporter gene) as a marker of terminator activity, the GFP fluorescence intensity of 10000 cells emitting GFP fluorescence was measured for each sample using a flow cytometer (CELL LAB QUANTA™ SC MPL flow-cytometer, Beckman Coulter, Inc.). Excitation light with a wavelength of 488 nm was used together with a 510 nm/10 nm bandpass filter. The relative fluorescence intensity of each was determined given 1 as the fluorescence intensity of the PGK1t control strain. The experiment was repeated 3 times, and the average and standard deviation were calculated. All data were processed with IgorPro (ver. 6.1, WaveMetrics). The top 30 selected candidates are shown in FIGS. 4 and 5. As shown in FIGS. 4 and 5, there was some change in the order of activity, but relative expression intensity was at least 1.9.

Example 8

A terminator may have different activity under different culture conditions. Therefore, in this example 5 recombinant yeasts were prepared comprising the activity evaluation constructs for the top 5 terminators (RPL41B, RPL15A, DIT1, RPL3 and IDP1) introduced into a wild-type yeast (W303-1a), and terminator activity was measured under various culture conditions.

Figure 6:
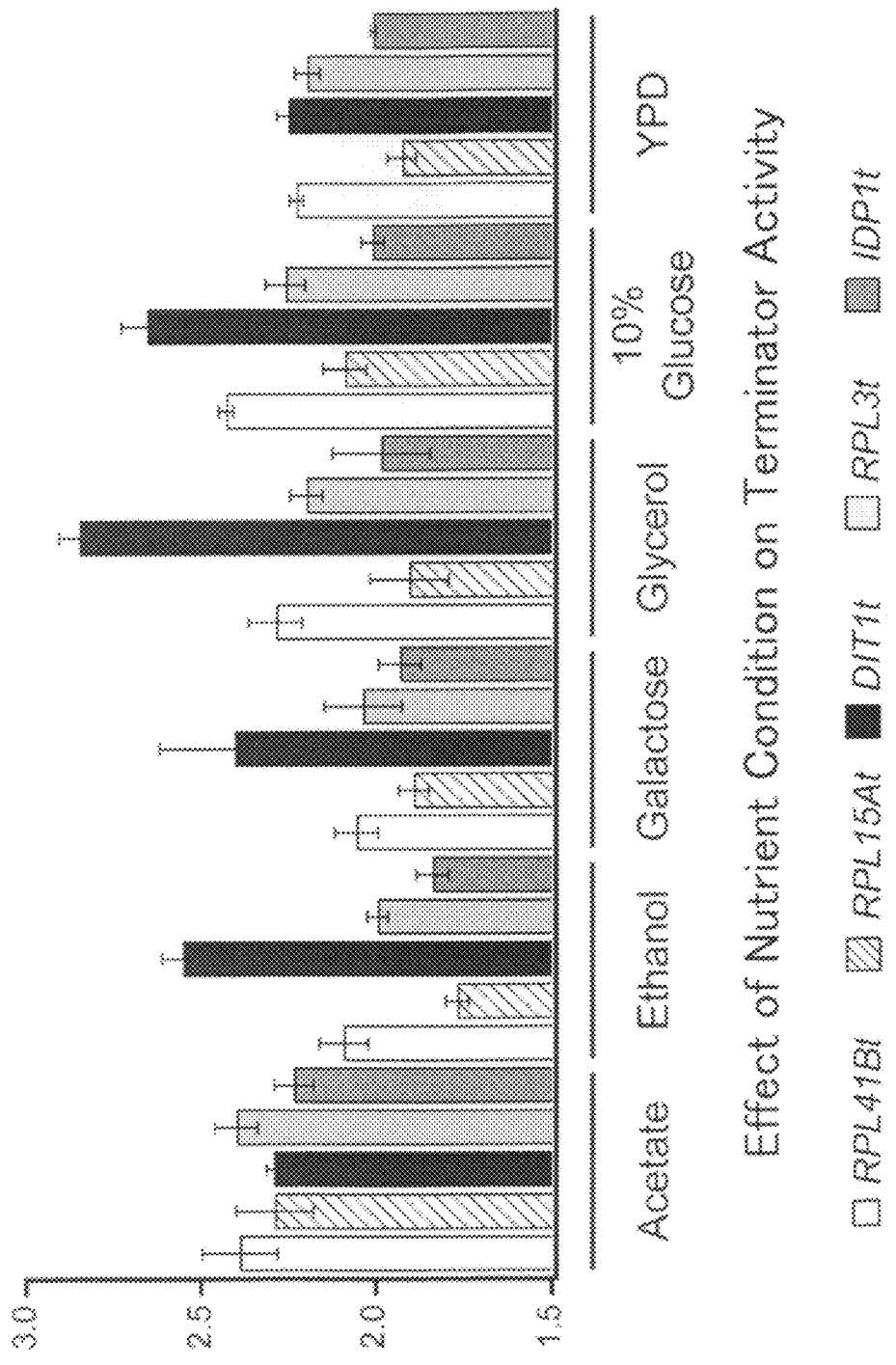
FIG. 6 shows the relationship between terminator activity and the type of carbon source using yeasts with the top 5 terminator regions introduced therein.

(1) Wild-type yeasts W303-1a having the top 5 terminators introduced therein and a W303-1a strain with PGK1t introduced as a control were pre-cultured in SD medium, seeded on SD medium at about $OD_{6660}$=0.1, and cultured for 6 hours (about $OD_{660}$=0.7), after which the medium was replaced. After a further 6 hours of culture, fluorescence intensity was measured. To investigate the effect of the carbon source (nutrient conditions) in particular, the following media were used as replacement media. Basic medium (0.67% Yeast Nitrogen base w/o amino acids (Difco Laboratories, Inc.), 0.082% Complete Supplement Mixture (CSM)+40Ade (ForMedium Ltd.)) was used with 2% acetic acid, 2% ethanol, 2% galactose, 2% glycerol and 10% glucose added as carbon sources. YPAD 2% (2% glucose, 2% peptone, 1% yeast extract, 20 mg/L adenine) was used as a nutrient-rich medium. As in Example 7, the relative fluorescence intensity of each was determined given 1 as the GFP fluorescence intensity of the PGK1t control strain. The experiment was repeated 3 times, and the average value and standard deviation were calculated. The results are shown in FIG. 6. As shown in FIG. 6, changing the carbon source had very little effect on terminator activity. Moreover, DIT1t had the highest specific activity except in acetic acid medium, and RPL41B and RPL3 tended to be ranked next.

Figure 7:
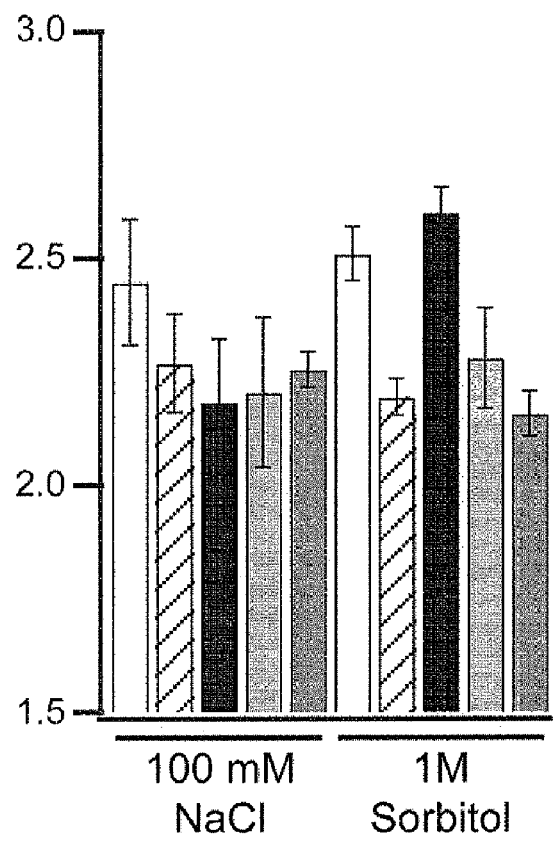
FIG. 7 shows the relationship between terminator activity and salt and osmotic stress using yeasts with the top 5 terminator regions introduced therein.

(2) Next, the same operations were performed as in (1) above except that SD+100 mM NaCl medium was used as the replacement medium for salt stress and SD+1M Sorbitol medium as the replacement medium for osmotic stress, and fluorescence intensity was measured. The results are shown in FIG. 7. As shown in FIG. 7, salt stress suppressed DIT1t activity somewhat. However, osmotic stress was shown to have virtually no effect.

Example 9

A terminator may have different activity in different wild-type yeasts. Therefore, in this example activity evaluation constructs for the top 5 terminators in FIGS. 4 and 5 were introduced into 5 kinds of wild-type yeast to prepare 25 recombinant yeasts, and terminator activity was measured.

(1) To evaluate terminator activity according to differences in the wild-type yeast used as the host, activity evaluation constructs for the top 5 terminators (RPL41B, RPL15A, DJT1, RPL3 and IDP1) were introduced into 5 different wild-type yeasts (A451, BY4741, TDO2, W303-1a and YPH499) to prepare 25 different recombinant yeasts, which were cultured until the stationary phase, and fluorescence activity was measured by flow cytometry (FCM) after 6, 12 and 24 hours.

(2) Constructs having a URA3 marker together with the top 5 terminator regions (RPL41B, RPL15A, DIT1, RPL3 and IDP1) and the standard PGK1 terminator region were prepared as in Example 7, Recombinant yeasts using 5 different wild-type yeasts as hosts were also prepared as in Example 7, The selection medium was uracil selection medium.

Figure 8:
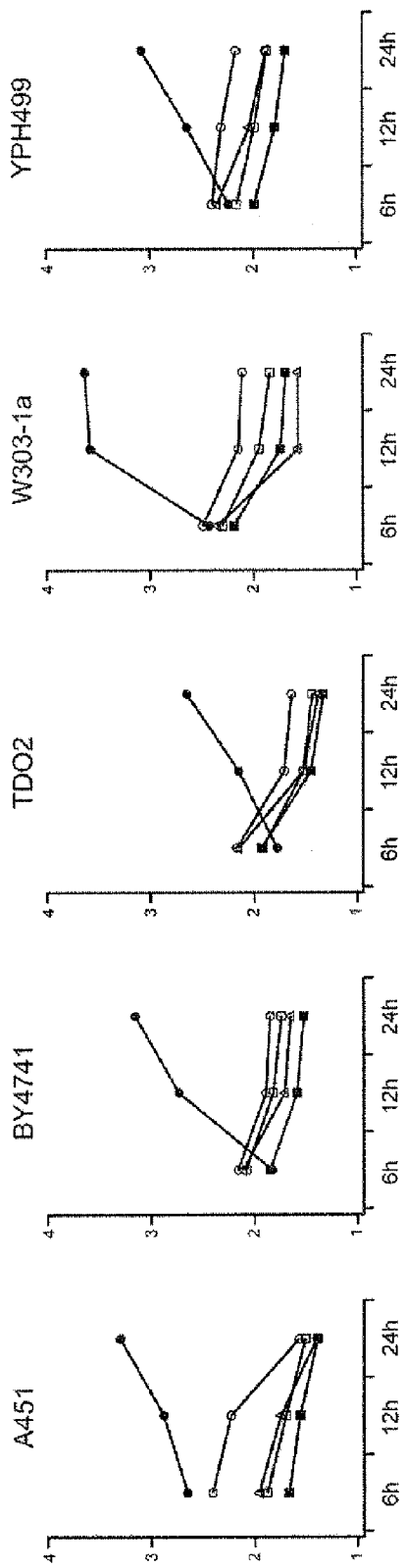
FIG. 8 shows the relationship between terminator activity and type of host (wild-type yeast) using yeasts with the top 5 terminator regions introduced therein.

(3) The respective strains of recombinant yeast were pre-cultured in SD medium (2% glucose, 0.67% Yeast Nitrogen base w/o amino acids (Difco Laboratories, Inc.), 0.082% Complete Supplement Mixture (CSM) 440Ade (ForMedium Ltd.), inoculated in SD medium at about $OD_{660}$=0.1 and cultured, and fluorescence intensity was measured after 6 hours (early logarithmic growth phase), 12 hours (middle logarithmic growth phase) and 24 hours (early stationary phase). The results are shown in FIG. 8. As shown in FIG. 8, the activity of the top terminators was double that of the standard terminator regardless of the yeast strain, so it is appears that these terminators are not selective of budding yeast hosts. It was also shown that specific activity increases as DIT1t activity approaches the stationary phase.

It has thus been confirmed that expression levels in yeasts can be regulated by changing a terminator sequence.

Example 10

This example confirmed the effect of a reporter gene disposed upstream from the terminator region. Eight strains carrying eight different constructs (RPL41Bt, YIP5t, TYR1t, PGK1t, MFA2t, STD1t, FUR4t, GIC1t) having varying terminator intensities were obtained from a comprehensive evaluation, and recombinant strains were prepared by substituting the mKO2 gene for the GFP gene in each construct. Specifically, the GFP gene was altered by using SacI and KpnI to insert the mKO2 gene into the TDH3 promoter-GFP gene-terminator constructs used in the comprehensive evaluation.

PCR amplification was performed using the following primer set on a vector containing the construct, and the amplified DNA fragments were cloned by an In Fusion reaction (IN-FUSION® Advantage PCR Cloning Kit, Clontech) into the eight strains used in the comprehensive evaluation to thereby obtain eight strains having the mKO2 gene substituted for the GFP gene.

```
5'primer:
                                        (SEQ ID NO: 15890)
5'-CATAAACAAACAAAGAGCTCATGGTCTCCGTTATCAAACC-3'

3'primer:
                                        (SEQ ID NO: 15891)
5'-GAAAAGGGGCCTGTGGTACCTTATGAATGGGCGACAGCATC-3'
```

Figure 9:
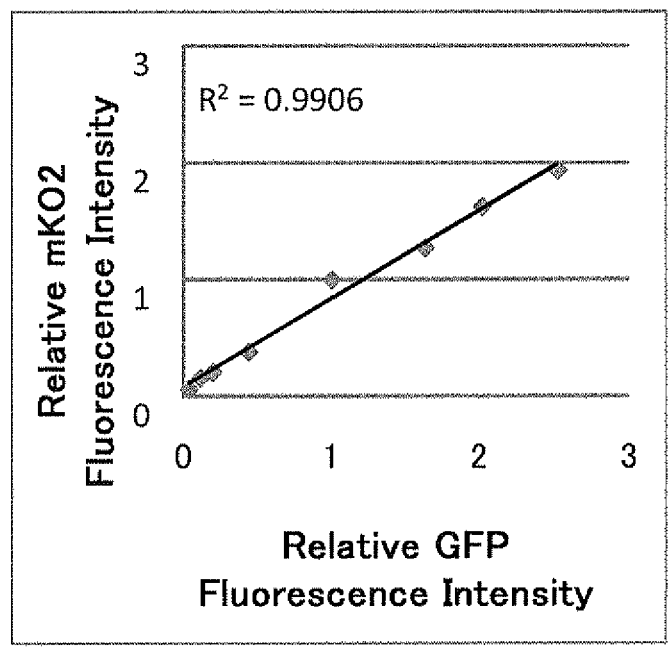
FIG. 9 shows the effect of reporter gene exchange on terminator region activity.

The fluorescent intensity of each of the resulting eight strains of yeast was measured by flow cytometry in accordance with Example 5 except for a filter set (570/15) as a red fluorescence detection, and relative fluorescent intensity was evaluated in comparison with the fluorescent intensity of a transformed yeast that was identical apart from the PGK1 terminator region. The results are shown in FIG. 9. As shown in FIG. 9, the mKO2 gene exhibited a relative fluorescent intensity (r=0.99) roughly equivalent to that of the GFP gene. These results show that the expression level of a gene can be regulated regardless of the type of gene disposed upstream from the terminator region.

Example 11

This example confirmed the effect of a promoter disposed upstream from the terminator region. Terminator activity was evaluated using a high-expression TDH3 promoter in the comprehensive evaluation. With a strong promoter like the TDH3 promoter as used in this analysis, we might have overlooked or underestimated the subtle effects of the terminator regions because of overproduction of transcript and their functional cis-elements. To avoid this limitation, the terminator was evaluated with the ACT1 promoter, which is known as a low-expression promoter.

Constructs were prepared by replacing the TDH3 promoter sequences of fourteen different constructs (RPL41Bt, RPL15At, DIT1t, RPL3t, IDP1t, VMA2t, BNA4t, YIP5t, TUB1t, TYR1t, TPS1t, FMP52t, SCW4t, PGK1t) obtained from the comprehensive evaluation and having varying terminator intensities with the ACT1 promoter. Specifically, constructs were prepared from the TDH3 promoter-GFP gene-terminator constructs used in the comprehensive evaluation by using the EcoRI and SacI restriction enzyme sites to substitute the ACT1 promoter.

PCR amplification was performed using the following primer set on a vector containing the construct, and the amplified DNA fragments were cloned by an In Fusion reaction (IN-FUSION® Advantage PCR Cloning Kit, Clontech) into the fourteen strains used in the comprehensive evaluation to thereby obtain fourteen strains having the ACT1 promoter substituted for the TDH promoter.

```
5'primer:
                                        (SEQ ID NO: 15892)
5'-TGTATCTGCACCTAGATCGAATTCACAAGCGCGCCTCTACCTTGC
AGAC-3'

3'primer:
                                        (SEQ ID NO: 15893)
5'-CACCTTTAGAAGCCATGAGCTCTGTTAATTCAGTAAATTTTCGAT
CTTG-3'
```

Figure 10:
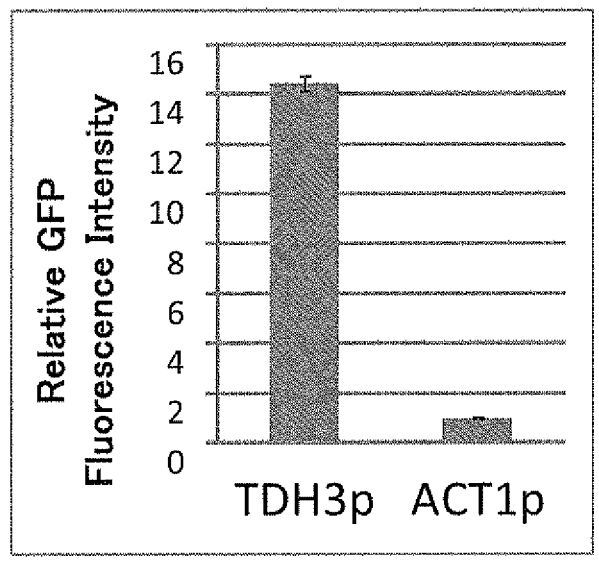
FIG. 10 shows the effect of promoter exchange on relative GFP fluorescence intensity.

An intensity evaluation of the ACT1 promoter and TDH3 promoter was performed prior to the evaluation. Constructs were prepared comprising the GFP gene and PGK1 terminator disposed downstream from each promoter, and introduced into the PDC6 gene locus of the yeast W303-1a strain. Then, the GFP fluorescent intensities of the strains were compared by flow cytometry. As a result, as shown in FIG. 10, the GFP fluorescent intensity of the ACT1 promoter strain was roughly 14 times less than that of the TDH3 promoter strain.

Figure 11:
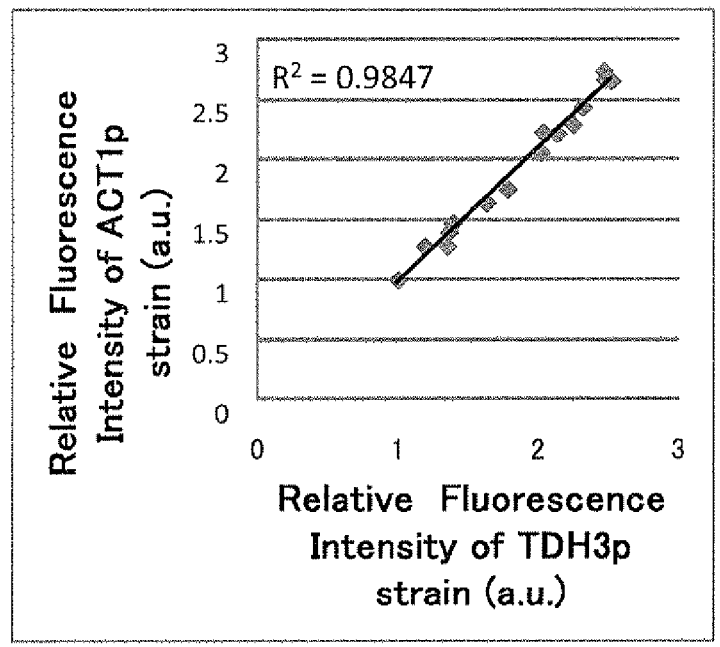
FIG. 11 shows the effect of promoter exchange on terminator region activity.

Then, the fluorescent intensity of each of the resulting fourteen strains of yeast was measured by flow cytometry in accordance with Example 5, and relative fluorescent intensity was evaluated in comparison with the fluorescent intensity of a transformed yeast that was identical apart from the PGK1 terminator region. The results are shown in FIG. 11. As shown in FIG. 11, the relative fluorescent intensities of yeasts carrying the GFP gene driven by the ACT1 promoter and under the control of fourteen different terminator regions correlated highly (r=0.98) with the relative fluorescent intensities of yeasts carrying the corresponding TDH3 promoter-driven GFP genes.

These results show that regulation of expression intensity by the terminator region is effective regardless of the type (expression intensity) of the promoter disposed upstream from the terminator region. They also show that the intrinsic expression regulation ability of the terminator region can be realized regardless of the type (expression intensity) of the promoter disposed upstream from the terminator region.

Example 12

This example investigated whether regulation of expression levels by differences in terminator sequence is possible in inducible promoter-driven systems. Strains were prepared having the GFP gene followed by the RPL15A and PGK1 terminator regions downstream from the GAL1 promoter, which is often used as an inducible promoter. Specifically, constructs were prepared by replacing the TDH3 promoter sequences of constructs (RPL15At, PGK1t) having two different terminator regions with the GAL1 promoter, which is known as an inducible promoter. Using a construct designed to allow galactose induction of GFP using the GAL1 promoter ("pGAL2pro-GFP; square", Matsuyama et al. (2010) J. Biotech. Bioeng. 111, 175-177), these were prepared by replacing the terminator region (CYC1t) of this construct with RPL15At and PGK1t, respectively.

PCR amplification was performed using the following primer sets together with fragments obtained by cleaving the construct described in the aforementioned literature with the restriction enzymes EcoNI and SalII, and the resulting amplified DNA fragments were cloned to a yeast harboring HIS3pro-GAL1-GAL2 and GAL10pro-GAL4 by an In-Fusion reaction.

```
Primers for RPL15At
5'primer:
                                    (SEQ ID NO: 15894)
5'-TGGATGAACTGTACAACTGAGGTACCTAAGCTGGTTGATG-3'

3'primer:
                                    (SEQ ID NO: 15895)
5'-GCTTCCTATATTATATATATAGTAATGTCGT-3'

Primers for PGK1t
5'primer:
                                    (SEQ ID NO: 15896)
5'-TGGATGAACTGTACAACTGAGGTACCGAATTGAATTGAAATCGA
TAG-3'

3'primer:
                                    (SEQ ID NO: 15897)
5'-GCTTCCTATATTATATATATAGTAATGTCGT-3'
```

A galactose induction test was performed on the resulting yeasts, and the relative fluorescent intensity of each yeast four hours after galactose induction was evaluated in accordance with Example 5. The results are shown in FIG. 12.

Figure 12:
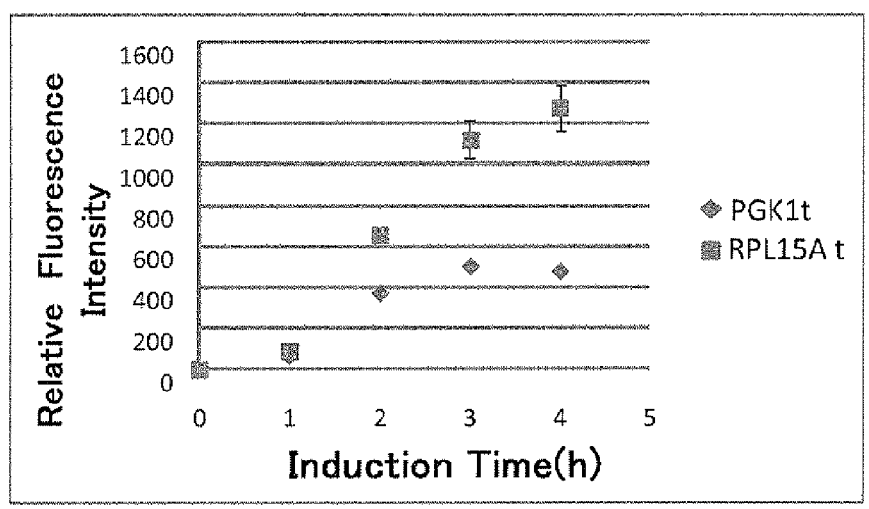
FIG. 12 shows the effect of promoter exchange between constitutive promoter and inducible promoter on region activity.

As shown in FIG. 12, (GFP fluorescent intensity was at the leakage level immediately (0 hours) after induction, but had increased by roughly 1300 times after 4 hours. The GFP fluorescent intensity of the RPL15At strain was roughly 2.7 times that of the PGK1t strain after 4 hours, which is roughly the same as the value of 2.5 times found in the comprehensive evaluation. These results show that a terminator region obtained in the comprehensive evaluation regulated expression levels of a target protein even in a galactose induction test. Moreover, it was also shown that expression regulation by the terminator region is effective with either a constitutive promoter or inducible promoter, and is about the same regardless of the mode of operation of the promoter.

As shown above, the reliability of the comprehensive evaluation data was confirmed by substituting other sequences for the reporter protein located upstream from the terminator and the promoter upstream from the reporter protein. The reporter proteins of multiple strains used in the comprehensive evaluation were changed from GFP to mKO2, the low-expression ACT1 promoter and the inducible GAL1 promoter were substituted for the high-expression TDH3 promoter, and fluorescent intensity of the terminator strains was compared between systems. As a result, a strong correlation was seen between the test results from the comprehensive evaluation and the relative fluorescent intensities of the respective substituted strains. This suggests that the terminator intensity as measured in the comprehensive evaluation is attributable not to the effects of the surrounding sequences (in particular, the promoter, reporter protein gene sequence and other upstream sequences), but to the sequence of the terminator region itself. In other words, it was shown that the sequence of the terminator region affects the expression level of a protein located upstream from that sequence.

Contents of all of the references cited herein are incorporated by reference to this application.

SEQ ID NOS 1-10590, 15886-15897: primers

SEQUENCE LISTING (15897 sequences)

SEQ ID NO: 1 - DNA, 27 bp, Saccharomyces cerevisiae
atcttgggaacaatatacagacatttt

SEQ ID NO: 2 - DNA, 24 bp, Saccharomyces cerevisiae
cgcattttaccacatctctacttg

SEQ ID NO: 3 - DNA, 26 bp, Saccharomyces cerevisiae
actagttttcttctttcctcctcttc

SEQ ID NO: 4 - DNA, 26 bp, Saccharomyces cerevisiae
aagatatatagaccactcgatacccc

SEQ ID NO: 5 - DNA, 27 bp, Saccharomyces cerevisiae
attaaaatgaaggaaataacacaactt

SEQ ID NO: 6 - DNA, 25 bp, Saccharomyces cerevisiae
aaaaacctttctcttctgtttgaca

SEQ ID NO: 7 - DNA, 26 bp, Saccharomyces cerevisiae
cataattaattggcattcttcaattt

SEQ ID NO: 8 - DNA, 23 bp, Saccharomyces cerevisiae
ttctcgtcaggaataggatgttg

SEQ ID NO: 9 - DNA, 25 bp, Saccharomyces cerevisiae
acaaaggcatctctaatgaatagca

SEQ ID NO: 10 - DNA, 27 bp, Saccharomyces cerevisiae
tatctcttgcgtaataacggtatacaa

SEQ ID NO: 11 - DNA, 26 bp, Saccharomyces cerevisiae
atctaaacaaacaacaaagttcttcc

SEQ ID NO: 12 - DNA, 22 bp, Saccharomyces cerevisiae
agaatggtttgaaaaggtctta

SEQ ID NO: 13 - DNA, 24 bp, Saccharomyces cerevisiae
atgtgaaagcttctgtcaagaaaa

SEQ ID NO: 14 - DNA, 21 bp, Saccharomyces cerevisiae
aggtttctctgatagaccccc

SEQ ID NO: 15 - DNA, 23 bp, Saccharomyces cerevisiae
aaaactcgcataaactctcaaca

SEQ ID NO: 16 - DNA, 26 bp, Saccharomyces cerevisiae
gctctccatatctacatcactttctg

SEQ ID NO: 17 - DNA, 27 bp, Saccharomyces cerevisiae
cattagaaactctgatcaatagcatag

SEQ ID NO: 18 - DNA, 22 bp, Saccharomyces cerevisiae
cgataaacaaattcttgcattg

SEQ ID NO: 19 - DNA, 21 bp, Saccharomyces cerevisiae
accgtttcctagctgattttt

SEQ ID NO: 20 - DNA, 26 bp, Saccharomyces cerevisiae
taacacagacaacgataacagttctt

SEQ ID NO: 21 - DNA, 20 bp, Saccharomyces cerevisiae
aaacatctcagttacccgca

SEQ ID NO: 22 - DNA, 21 bp, Saccharomyces cerevisiae
ttgtttcatttggtgatgcaa

SEQ ID NO: 23 - DNA, 24 bp, Saccharomyces cerevisiae
tcattgtaacgggaaaacatatca

SEQ ID NO: 24 - DNA, 24 bp, Saccharomyces cerevisiae
ggagaccagtaaaactatatgggg

SEQ ID NO: 25 - DNA, 18 bp, Saccharomyces cerevisiae
ccccctcctttttggcac

SEQ ID NO: 26 - DNA, 20 bp, Saccharomyces cerevisiae
cttttctcagcacctgtcca

SEQ ID NO: 27 - DNA, 22 bp, Saccharomyces cerevisiae
gtttggggagctgtttttatga

SEQ ID NO: 28 - DNA, 25 bp, Saccharomyces cerevisiae
taaatttttacaacaacgcaaaaac

SEQ ID NO: 29 - DNA, 19 bp, Saccharomyces cerevisiae
tgttccatttgccattgcc

SEQ ID NO: 30 - DNA, 25 bp, Saccharomyces cerevisiae
tgactacatcgtatttcaccttttc

SEQ ID NO: 31 - DNA, 25 bp, Saccharomyces cerevisiae
gggagttagcacaagatgaatctaa

SEQ ID NO: 32 - DNA, 22 bp, Saccharomyces cerevisiae
acgccatagaagagcaatttcc

SEQ ID NO: 33 - DNA, 24 bp, Saccharomyces cerevisiae
tttttttgcatattttttcctttg

SEQ ID NO: 34 - DNA, 23 bp, Saccharomyces cerevisiae
aatcactagaagtgtgccaatca

SEQ ID NO: 35 - DNA, 27 bp, Saccharomyces cerevisiae
ctttttttttttttttttttcattttc

SEQ ID NO: 36 - DNA, 27 bp, Saccharomyces cerevisiae
ttccttcactagtcagctaatagattt

SEQ ID NO: 37 - DNA, 25 bp, Saccharomyces cerevisiae
tgaagaactttatgacaacagaatg

SEQ ID NO: 38 - DNA, 25 bp, Saccharomyces cerevisiae
aacatagatcaaaattatagccagc

SEQ ID NO: 39 - DNA, 28 bp, Saccharomyces cerevisiae
tctaatctctagtcattatttattcgca

SEQ ID NO: 40 - DNA, 18 bp, Saccharomyces cerevisiae
tgagaatgccaattccgc

SEQ ID NO: 41 - DNA, 24 bp, Saccharomyces cerevisiae
ggttggatttattttacggataac

SEQ ID NO: 42 - DNA, 26 bp, Saccharomyces cerevisiae
ttagttcgtataatggaccctttctc

SEQ ID NO: 43 - DNA, 23 bp, Saccharomyces cerevisiae
aaaaattaaacgttctaaccccc

SEQ ID NO: 44 - DNA, 25 bp, Saccharomyces cerevisiae
tgtctgtgttagtttttccttttct

SEQ ID NO: 45 - DNA, 25 bp, Saccharomyces cerevisiae
taaattcaagaaaggaaaagaaaaa

SEQ ID NO: 46 - DNA, 18 bp, Saccharomyces cerevisiae
tgcggcgctatcatcaaa

SEQ ID NO: 47 - DNA, 20 bp, Saccharomyces cerevisiae
ctcaccatccctatccaacc

SEQ ID NO: 48 - DNA, 25 bp, Saccharomyces cerevisiae
tcaactgtttacgattgatgatttt

SEQ ID NO: 49 - DNA, 25 bp, Saccharomyces cerevisiae
ttctaaatcgaatagagaaacatgc

SEQ ID NO: 50 - DNA, 27 bp, Saccharomyces cerevisiae
tgactgaattttgaatttgattatctt

SEQ ID NO: 51 - DNA, 23 bp, Saccharomyces cerevisiae
ctgcttacttcatcgaacaaatg

SEQ ID NO: 52 - DNA, 25 bp, Saccharomyces cerevisiae
caactacatttttgtgcaacttttg

SEQ ID NO: 53 - DNA, 21 bp, Saccharomyces cerevisiae
aggattctcgatgttctttgg

SEQ ID NO: 54 - DNA, 27 bp, Saccharomyces cerevisiae
tagtaatttttctgattttttttctcg

SEQ ID NO: 55 - DNA, 24 bp, Saccharomyces cerevisiae
cctataactgaaaattcacacccg

SEQ ID NO: 56 - DNA, 26 bp, Saccharomyces cerevisiae
gagttttgagaacgaacaagtattta

SEQ ID NO: 57 - DNA, 26 bp, Saccharomyces cerevisiae
cattgatctcagaatatatccaaatg

SEQ ID NO: 58 - DNA, 20 bp, Saccharomyces cerevisiae
tcaacggggattttcagtat

SEQ ID NO: 59 - DNA, 21 bp, Saccharomyces cerevisiae
tcatcttaatgagcatcggac

SEQ ID NO: 60 - DNA, 20 bp, Saccharomyces cerevisiae
aactgattgcggaagaaaaa

SEQ ID NO: 61 - DNA, 18 bp, Saccharomyces cerevisiae
aagcaagccgaagcaagc

SEQ ID NO: 62 - DNA, 27 bp, Saccharomyces cerevisiae
ccgcgtattatcattatcattattctt

SEQ ID NO: 63 - DNA, 23 bp, Saccharomyces cerevisiae
aaagtggattccaagattttcgt

SEQ ID NO: 64 - DNA, 20 bp, Saccharomyces cerevisiae
aaaaccgaaaaccgaaaaca

SEQ ID NO: 65 - DNA, 27 bp, Saccharomyces cerevisiae
atcctgtaaatatactgcttcaaagtt

SEQ ID NO: 66 - DNA, 25 bp, Saccharomyces cerevisiae
ttttagagtcttccttgaccaatca

SEQ ID NO: 67 - DNA, 19 bp, Saccharomyces cerevisiae
tttttcgtcagctctccga

SEQ ID NO: 68 - DNA, 21 bp, Saccharomyces cerevisiae
ccgcaaaggttaccataaagg

SEQ ID NO: 69 - DNA, 27 bp, Saccharomyces cerevisiae
atgttttgttttagtattgttttggtt

SEQ ID NO: 70 - DNA, 24 bp, Saccharomyces cerevisiae
tcccactaatttcattgcttaata

SEQ ID NO: 71 - DNA, 24 bp, Saccharomyces cerevisiae
acaaagaaatttcacaaagtgagc

SEQ ID NO: 72 - DNA, 27 bp, Saccharomyces cerevisiae
atctggcataataaagttgattgtctt

SEQ ID NO: 73 - DNA, 24 bp, Saccharomyces cerevisiae
acaaagacattaaggagcctttga

SEQ ID NO: 74 - DNA, 21 bp, Saccharomyces cerevisiae
ggcgtttagctggtattctgc

SEQ ID NO: 75 - DNA, 24 bp, Saccharomyces cerevisiae
tttcgttttctcacaaataaatcc

SEQ ID NO: 76 - DNA, 27 bp, Saccharomyces cerevisiae
tacaaaagtgaagaactacaatggttt

SEQ ID NO: 77 - DNA, 20 bp, Saccharomyces cerevisiae
tggaatggtagtcgaaaggt

SEQ ID NO: 78 - DNA, 24 bp, Saccharomyces cerevisiae
tactaatgaataataccatccgcc

SEQ ID NO: 79 - DNA, 23 bp, Saccharomyces cerevisiae
ctgtggtgacgaaaacataactc

SEQ ID NO: 80 - DNA, 24 bp, Saccharomyces cerevisiae
tgcagaatatccgtacaataaagg

SEQ ID NO: 81 - DNA, 18 bp, Saccharomyces cerevisiae
atctaaccgacccgaccg

SEQ ID NO: 82 - DNA, 25 bp, Saccharomyces cerevisiae
tcactgtcctcgttataagtgattc

SEQ ID NO: 83 - DNA, 24 bp, Saccharomyces cerevisiae
tttacatctttcacaagcacaatc

SEQ ID NO: 84 - DNA, 27 bp, Saccharomyces cerevisiae
aagaaaatataatagatgcttgtaggc

SEQ ID NO: 85 - DNA, 26 bp, Saccharomyces cerevisiae
aataacatataagacagtcaacctcg

SEQ ID NO: 86 - DNA, 20 bp, Saccharomyces cerevisiae
gaactgtttcatcggcccta

SEQ ID NO: 87 - DNA, 20 bp, Saccharomyces cerevisiae
tagacaaaattacccgcgca

SEQ ID NO: 88 - DNA, 27 bp, Saccharomyces cerevisiae
acgtcttaatgtggtagtacgagtttt

SEQ ID NO: 89 - DNA, 27 bp, Saccharomyces cerevisiae
tacatgtgcatgaagtattatgaaaaa

SEQ ID NO: 90 - DNA, 27 bp, Saccharomyces cerevisiae
atctcagtttcttcttgaaatttagca

SEQ ID NO: 91 - DNA, 23 bp, Saccharomyces cerevisiae
acgcagtagaggagaagttcttt

SEQ ID NO: 92 - DNA, 25 bp, Saccharomyces cerevisiae
ccaacttattgatactaacctaaaa

SEQ ID NO: 93 - DNA, 25 bp, Saccharomyces cerevisiae
aaatgacctagaaaagtaaggaacg

SEQ ID NO: 94 - DNA, 25 bp, Saccharomyces cerevisiae
ttaggaaagtgaaaattgagatcat

SEQ ID NO: 95 - DNA, 27 bp, Saccharomyces cerevisiae
atgcatcaaaataagaacacttaaaca

SEQ ID NO: 96 - DNA, 26 bp, Saccharomyces cerevisiae
aaaactactgtgttctgttatcgctt

SEQ ID NO: 97 - DNA, 25 bp, Saccharomyces cerevisiae
taaagtctattttcaatttttcaag

SEQ ID NO: 98 - DNA, 27 bp, Saccharomyces cerevisiae
tattacacagaattattttcttcactt

SEQ ID NO: 99 - DNA, 20 bp, Saccharomyces cerevisiae
tgcaacagtcgtgaggtgat

SEQ ID NO: 100 - DNA, 27 bp, Saccharomyces cerevisiae
agtacaagttatgtttaattggaggga

SEQ ID NO: 101 - DNA, 22 bp, Saccharomyces cerevisiae
cccatcttcaacaacaataccg

SEQ ID NO: 102 - DNA, 26 bp, Saccharomyces cerevisiae
tcatgcgaagaataaatttaaaaacc

SEQ ID NO: 103 - DNA, 19 bp, Saccharomyces cerevisiae
ctccacctaacaaacccgc

SEQ ID NO: 104 - DNA, 24 bp, Saccharomyces cerevisiae
aaatccacaggaaggaatagtttt

SEQ ID NO: 105 - DNA, 20 bp, Saccharomyces cerevisiae
ctagatagttgcgagcccca

SEQ ID NO: 106 - DNA, 24 bp, Saccharomyces cerevisiae
taatattatgctcccctggatttt

SEQ ID NO: 107 - DNA, 27 bp, Saccharomyces cerevisiae
tatttgtaagctttgtcgatgggataa

SEQ ID NO: 108 - DNA, 21 bp, Saccharomyces cerevisiae
tgcccctcataattttctcaa

SEQ ID NO: 109 - DNA, 27 bp, Saccharomyces cerevisiae
attaatgagttactatccgggttacaa

SEQ ID NO: 110 - DNA, 20 bp, Saccharomyces cerevisiae
tagggccaaaacacaactga

SEQ ID NO: 111 - DNA, 27 bp, Saccharomyces cerevisiae
agggaaatttaaaaatgtaacgtttag

SEQ ID NO: 112 - DNA, 27 bp, Saccharomyces cerevisiae
agttatattattttctttctttttttt

SEQ ID NO: 113 - DNA, 22 bp, Saccharomyces cerevisiae
ataatgtacacagttagcgtct

SEQ ID NO: 114 - DNA, 24 bp, Saccharomyces cerevisiae
gctcagtaaagcgttaaataatcc

SEQ ID NO: 115 - DNA, 22 bp, Saccharomyces cerevisiae
attcttttgacatcgcaaggtt

SEQ ID NO: 116 - DNA, 20 bp, Saccharomyces cerevisiae
catttcaatccgccctatca

SEQ ID NO: 117 - DNA, 27 bp, Saccharomyces cerevisiae
atgtatttatgattgatgtattttttt

SEQ ID NO: 118 - DNA, 25 bp, Saccharomyces cerevisiae
agaggaaaataatatcaagtgctgg

SEQ ID NO: 119 - DNA, 26 bp, Saccharomyces cerevisiae
atatgagcataataaaaagggagaat

SEQ ID NO: 120 - DNA, 18 bp, Saccharomyces cerevisiae
tcctaacgccgcttcgag

SEQ ID NO: 121 - DNA, 25 bp, Saccharomyces cerevisiae
tgtctagtcattcaaaattgctacg

SEQ ID NO: 122 - DNA, 23 bp, Saccharomyces cerevisiae
gtaaagagaaataacgttaaaaa

SEQ ID NO: 123 - DNA, 23 bp, Saccharomyces cerevisiae
ggttgattatgaagaaaattcca

SEQ ID NO: 124 - DNA, 26 bp, Saccharomyces cerevisiae
gacgagtataaaattcctcagtttct

SEQ ID NO: 125 - DNA, 21 bp, Saccharomyces cerevisiae
aaagagaacttggcaagcagg

SEQ ID NO: 126 - DNA, 22 bp, Saccharomyces cerevisiae
gcagcacaactttgtacctctc

SEQ ID NO: 127 - DNA, 27 bp, Saccharomyces cerevisiae
cttaaactctgctacttgttgtctatg

SEQ ID NO: 128 - DNA, 20 bp, Saccharomyces cerevisiae
atatagcggaccgcgtaaca

SEQ ID NO: 129 - DNA, 18 bp, Saccharomyces cerevisiae
tgacgcagcgataaaacc

SEQ ID NO: 130 - DNA, 24 bp, Saccharomyces cerevisiae
tgaataaatatgccttcatctccc

SEQ ID NO: 131 - DNA, 23 bp, Saccharomyces cerevisiae
agcttaagcgcgctacgtaacta

SEQ ID NO: 132 - DNA, 19 bp, Saccharomyces cerevisiae
acgcggcgttatgtcacta

SEQ ID NO: 133 - DNA, 26 bp, Saccharomyces cerevisiae
tcaaaataattaatgcccaaatttct

SEQ ID NO: 134 - DNA, 27 bp, Saccharomyces cerevisiae
gctcatacaagctattagtgatgaaaa

SEQ ID NO: 135 - DNA, 21 bp, Saccharomyces cerevisiae
tattaaattgcgactctgcca

SEQ ID NO: 136 - DNA, 23 bp, Saccharomyces cerevisiae
tagtgttataggaatagccgccc

SEQ ID NO: 137 - DNA, 27 bp, Saccharomyces cerevisiae
cttctaaatatattcatctcttcgctt

SEQ ID NO: 138 - DNA, 21 bp, Saccharomyces cerevisiae
taataggctggcaaaagccct

SEQ ID NO: 139 - DNA, 23 bp, Saccharomyces cerevisiae
agaggtcttctttcatttgttcc

SEQ ID NO: 140 - DNA, 26 bp, Saccharomyces cerevisiae
tccttcaaaacatactactagcacca

SEQ ID NO: 141 - DNA, 27 bp, Saccharomyces cerevisiae
tacttgaaactacttcctcaataatcg

SEQ ID NO: 142 - DNA, 27 bp, Saccharomyces cerevisiae
tcggttatgtaattaggtattgtgttg

SEQ ID NO: 143 - DNA, 19 bp, Saccharomyces cerevisiae
agcttgcaagagtgcctcc

SEQ ID NO: 144 - DNA, 25 bp, Saccharomyces cerevisiae
cctacgtcgaaatcaaattctgcta

SEQ ID NO: 145 - DNA, 18 bp, Saccharomyces cerevisiae
catgttcatgcccctctg

SEQ ID NO: 146 - DNA, 24 bp, Saccharomyces cerevisiae
aagatcagcatcctttcaattgct

SEQ ID NO: 147 - DNA, 18 bp, Saccharomyces cerevisiae
aagtttggggcagccaga

SEQ ID NO: 148 - DNA, 19 bp, Saccharomyces cerevisiae
aaacggcaaacccgtattc

SEQ ID NO: 149 - DNA, 26 bp, Saccharomyces cerevisiae
accagttgttgacagatttttactca

SEQ ID NO: 150 - DNA, 25 bp, Saccharomyces cerevisiae
actaacatttcgagtattcttttgg

SEQ ID NO: 151 - DNA, 23 bp, Saccharomyces cerevisiae
aatacggccaaaattatgaaccc

SEQ ID NO: 152 - DNA, 26 bp, Saccharomyces cerevisiae
tcttttcagttatttaccttcctttc

SEQ ID NO: 153 - DNA, 22 bp, Saccharomyces cerevisiae
ctgtctatcttgacgtcatccc

SEQ ID NO: 154 - DNA, 21 bp, Saccharomyces cerevisiae
ccatcccgaaattagaggttc

SEQ ID NO: 155 - DNA, 20 bp, Saccharomyces cerevisiae
tagcggagataaacagccga

SEQ ID NO: 156 - DNA, 18 bp, Saccharomyces cerevisiae
gcttttgccgcttcactc

SEQ ID NO: 157 - DNA, 24 bp, Saccharomyces cerevisiae
gtaacatcatgtgtcattttgcac

SEQ ID NO: 158 - DNA, 19 bp, Saccharomyces cerevisiae
acaggtcaggagcagccac

SEQ ID NO: 159 - DNA, 21 bp, Saccharomyces cerevisiae
ggttattggtagggttttgga

SEQ ID NO: 160 - DNA, 21 bp, Saccharomyces cerevisiae
gaacgcccttctggacttaaa

SEQ ID NO: 161 - DNA, 27 bp, Saccharomyces cerevisiae
attcaaatttttaggatttttcttagc

SEQ ID NO: 162 - DNA, 27 bp, Saccharomyces cerevisiae
ctaaatatcgcataggtacttcagttt

SEQ ID NO: 163 - DNA, 19 bp, Saccharomyces cerevisiae
tgaaaatgggaggggaaat

SEQ ID NO: 164 - DNA, 28 bp, Saccharomyces cerevisiae
ccataaagatagaaacatttattttgac

SEQ ID NO: 165 - DNA, 27 bp, Saccharomyces cerevisiae
tataaagacaagatatcattcaaacgc

SEQ ID NO: 166 - DNA, 18 bp, Saccharomyces cerevisiae
accggtgaaaacacacgc

SEQ ID NO: 167 - DNA, 19 bp, Saccharomyces cerevisiae
tgcgttccagttgcatcat

SEQ ID NO: 168 - DNA, 25 bp, Saccharomyces cerevisiae
taagagaatggtatgactccaacaa

SEQ ID NO: 169 - DNA, 27 bp, Saccharomyces cerevisiae
ttctgactctcactattgctatgttgt

SEQ ID NO: 170 - DNA, 25 bp, Saccharomyces cerevisiae
tgaattagcttcattcttcacttct

SEQ ID NO: 171 - DNA, 18 bp, Saccharomyces cerevisiae
aaaagcgcgattatgggc

SEQ ID NO: 172 - DNA, 23 bp, Saccharomyces cerevisiae
tgatcatagagtgcatatgcttg

SEQ ID NO: 173 - DNA, 24 bp, Saccharomyces cerevisiae
gtaaacacattgctacttgcattt

SEQ ID NO: 174 - DNA, 27 bp, Saccharomyces cerevisiae
aattaagtgatgcataatatggttttc

SEQ ID NO: 175 - DNA, 24 bp, Saccharomyces cerevisiae
atgaaacgtaagaaaaatcatggg

SEQ ID NO: 176 - DNA, 23 bp, Saccharomyces cerevisiae
atttaagaccctcgttcagaagc

SEQ ID NO: 177 - DNA, 22 bp, Saccharomyces cerevisiae
tgaaaaagtggaactagacccc

SEQ ID NO: 178 - DNA, 20 bp, Saccharomyces cerevisiae
cgttgaagtaactcaggccc

SEQ ID NO: 179 - DNA, 20 bp, Saccharomyces cerevisiae
taaggcagggcaggtctaaa

SEQ ID NO: 180 - DNA, 23 bp, Saccharomyces cerevisiae
ggccatacataaaaaaatgatgc

SEQ ID NO: 181 - DNA, 21 bp, Saccharomyces cerevisiae
aaggaacctatggtacggacg

SEQ ID NO: 182 - DNA, 26 bp, Saccharomyces cerevisiae
aaaaatagatataatagatggcaccg

SEQ ID NO: 183 - DNA, 22 bp, Saccharomyces cerevisiae
tgaagctacagcaaggaaaatg

SEQ ID NO: 184 - DNA, 23 bp, Saccharomyces cerevisiae
aaaagttgcaaggctttcatcag

SEQ ID NO: 185 - DNA, 26 bp, Saccharomyces cerevisiae
atcctgtaaacttaaacttaaacccc

SEQ ID NO: 186 - DNA, 20 bp, Saccharomyces cerevisiae
tctaaattgcctggcgagaa

SEQ ID NO: 187 - DNA, 27 bp, Saccharomyces cerevisiae
ggtttttaacgcctatattcttctaat

SEQ ID NO: 188 - DNA, 23 bp, Saccharomyces cerevisiae
ggctaaccttagtggtttattgc

SEQ ID NO: 189 - DNA, 27 bp, Saccharomyces cerevisiae
aagttaagtactgcacgtttcatatcg

SEQ ID NO: 190 - DNA, 18 bp, Saccharomyces cerevisiae
aaatgtggaaaaccggcg

SEQ ID NO: 191 - DNA, 22 bp, Saccharomyces cerevisiae
cctaacagagacagtccaacgg

SEQ ID NO: 192 - DNA, 27 bp, Saccharomyces cerevisiae
aagggacgtatagtatagttatggaga

SEQ ID NO: 193 - DNA, 26 bp, Saccharomyces cerevisiae
tctgaagaagataaaattcaaactga

SEQ ID NO: 194 - DNA, 27 bp, Saccharomyces cerevisiae
acattagcaaattattctaggtggtat

SEQ ID NO: 195 - DNA, 18 bp, Saccharomyces cerevisiae
tatggaagcctgagcccc

SEQ ID NO: 196 - DNA, 27 bp, Saccharomyces cerevisiae
gtcacgtgaacgtctatctatttattt

SEQ ID NO: 197 - DNA, 26 bp, Saccharomyces cerevisiae
agaaaagcatgagtttgataagaaaa

SEQ ID NO: 198 - DNA, 21 bp, Saccharomyces cerevisiae
gcaaacgttgcagatctcctt

SEQ ID NO: 199 - DNA, 24 bp, Saccharomyces cerevisiae
attattttcaacagaacacatcgc

SEQ ID NO: 200 - DNA, 21 bp, Saccharomyces cerevisiae
tagaaacacaacacgtcatgg

SEQ ID NO: 201 - DNA, 26 bp, Saccharomyces cerevisiae
accagcgagtaacactataaagaata

SEQ ID NO: 202 - DNA, 21 bp, Saccharomyces cerevisiae
acaatccacaattcttgggaa

SEQ ID NO: 203 - DNA, 22 bp, Saccharomyces cerevisiae
gaatacggatatttggaaaggc

SEQ ID NO: 204 - DNA, 21 bp, Saccharomyces cerevisiae
gccatggtttgactattgctt

SEQ ID NO: 205 - DNA, 27 bp, Saccharomyces cerevisiae
taaaacatgtaaatatgtacctcccaa

SEQ ID NO: 206 - DNA, 24 bp, Saccharomyces cerevisiae
gtgttgtacacgagaattagcaca

SEQ ID NO: 207 - DNA, 24 bp, Saccharomyces cerevisiae
ctggaaaatgagtagttaggcttt

SEQ ID NO: 208 - DNA, 22 bp, Saccharomyces cerevisiae
ttctccaattgaaaacgaaaca

SEQ ID NO: 209 - DNA, 24 bp, Saccharomyces cerevisiae
tgatgactgaacattgatctgttg

SEQ ID NO: 210 - DNA, 24 bp, Saccharomyces cerevisiae
ggaaatgtccatgtttatttcagt

SEQ ID NO: 211 - DNA, 21 bp, Saccharomyces cerevisiae
accagtaattacatgtgcggc

SEQ ID NO: 212 - DNA, 20 bp, Saccharomyces cerevisiae
ttttctttcgattagcacgc

SEQ ID NO: 213 - DNA, 27 bp, Saccharomyces cerevisiae
ataaataaaatcgtgactaatacgtcc

SEQ ID NO: 214 - DNA, 22 bp, Saccharomyces cerevisiae
taggcaaaatctgcattagctt

SEQ ID NO: 215 - DNA, 21 bp, Saccharomyces cerevisiae
ccatagcatcacagtttgaca

SEQ ID NO: 216 - DNA, 23 bp, Saccharomyces cerevisiae
gagctgttcacttgtttttatcg

SEQ ID NO: 217 - DNA, 22 bp, Saccharomyces cerevisiae
tattccaaggataaggaaagca

SEQ ID NO: 218 - DNA, 23 bp, Saccharomyces cerevisiae
atgcagatatagtgttgaatgat

SEQ ID NO: 219 - DNA, 23 bp, Saccharomyces cerevisiae
gcgtcatagttgatgatcttttt

SEQ ID NO: 220 - DNA, 27 bp, Saccharomyces cerevisiae
aaataaaacttgactaagtaccgaaca

SEQ ID NO: 221 - DNA, 18 bp, Saccharomyces cerevisiae
aagccgacagggacaacg

SEQ ID NO: 222 - DNA, 19 bp, Saccharomyces cerevisiae
aaatgaagcgcagccagat

SEQ ID NO: 223 - DNA, 26 bp, Saccharomyces cerevisiae
tctaagaagttaaacgtatgaaggaa

SEQ ID NO: 224 - DNA, 20 bp, Saccharomyces cerevisiae
ttgcgtccccacctttctac

SEQ ID NO: 225 - DNA, 26 bp, Saccharomyces cerevisiae
agttgactactttcgtagaattcctt

SEQ ID NO: 226 - DNA, 25 bp, Saccharomyces cerevisiae
tcttccatatagcattagtatagca

SEQ ID NO: 227 - DNA, 25 bp, Saccharomyces cerevisiae
atcggcatctattacatctttgttt

SEQ ID NO: 228 - DNA, 18 bp, Saccharomyces cerevisiae
taaggcaggcccagtgga

SEQ ID NO: 229 - DNA, 18 bp, Saccharomyces cerevisiae
taattaattccgcggggc

SEQ ID NO: 230 - DNA, 27 bp, Saccharomyces cerevisiae
accatataaaggttagtacatgaagaa

SEQ ID NO: 231 - DNA, 18 bp, Saccharomyces cerevisiae
tgctcctatcgggattcg

SEQ ID NO: 232 - DNA, 26 bp, Saccharomyces cerevisiae
aaagggactctttttccaaatataaa

SEQ ID NO: 233 - DNA, 23 bp, Saccharomyces cerevisiae
taatgcatcatgaagaaagaaca

SEQ ID NO: 234 - DNA, 26 bp, Saccharomyces cerevisiae
tgtgtgatatattcgtttttacctgc

SEQ ID NO: 235 - DNA, 26 bp, Saccharomyces cerevisiae
aaaagaaaagagaatgcagtataccc

SEQ ID NO: 236 - DNA, 26 bp, Saccharomyces cerevisiae
atttgaagaatcttagccttatagcg

SEQ ID NO: 237 - DNA, 23 bp, Saccharomyces cerevisiae
tattcaccatcctagcgaagaaa

SEQ ID NO: 238 - DNA, 20 bp, Saccharomyces cerevisiae
cgcgttggtaatgatgagtg

SEQ ID NO: 239 - DNA, 20 bp, Saccharomyces cerevisiae
cagtaacccaactccgaagg

SEQ ID NO: 240 - DNA, 26 bp, Saccharomyces cerevisiae
acttgatttgttatactatatgttca

SEQ ID NO: 241 - DNA, 21 bp, Saccharomyces cerevisiae
ggtattgtgccactttcctcc

SEQ ID NO: 242 - DNA, 21 bp, Saccharomyces cerevisiae
tttttattgtttctttggcga

SEQ ID NO: 243 - DNA, 24 bp, Saccharomyces cerevisiae
cagcacttcactagctcaaataca

SEQ ID NO: 244 - DNA, 23 bp, Saccharomyces cerevisiae
ccaaaaaggtacttaccatctca

SEQ ID NO: 245 - DNA, 27 bp, Saccharomyces cerevisiae
gtaagattttaaaagacgaaaagaacg

SEQ ID NO: 246 - DNA, 21 bp, Saccharomyces cerevisiae
taggaaacagatggcatccac

SEQ ID NO: 247 - DNA, 26 bp, Saccharomyces cerevisiae
taatgaacaggcacagtatagaaaaa

SEQ ID NO: 248 - DNA, 27 bp, Saccharomyces cerevisiae
aagagaggcgatacgataatatgataa

SEQ ID NO: 249 - DNA, 26 bp, Saccharomyces cerevisiae
atattatttgttgcatgatttttctc

SEQ ID NO: 250 - DNA, 19 bp, Saccharomyces cerevisiae
aatcacctattgcgccgct

SEQ ID NO: 251 - DNA, 27 bp, Saccharomyces cerevisiae
tcgttaaggaagaaacaagatctattc

SEQ ID NO: 252 - DNA, 26 bp, Saccharomyces cerevisiae
tatacgcatttaaaagtgtcattcaa

SEQ ID NO: 253 - DNA, 23 bp, Saccharomyces cerevisiae
ccatggcaattgcatatatcttt

SEQ ID NO: 254 - DNA, 21 bp, Saccharomyces cerevisiae
atagtgccgaacagtcaggag

SEQ ID NO: 255 - DNA, 21 bp, Saccharomyces cerevisiae
tcactgagattatacgcctcg

SEQ ID NO: 256 - DNA, 20 bp, Saccharomyces cerevisiae
tgctatgactccaggcaagg

SEQ ID NO: 257 - DNA, 26 bp, Saccharomyces cerevisiae
gatatacctcgaaaataataaaccgc

SEQ ID NO: 258 - DNA, 26 bp, Saccharomyces cerevisiae
aggttgtgtcatagagaatgtgttag

SEQ ID NO: 259 - DNA, 21 bp, Saccharomyces cerevisiae
ttgacggtatacccgtgtttt

SEQ ID NO: 260 - DNA, 25 bp, Saccharomyces cerevisiae
gacttagaatagtgagttgtaataa

SEQ ID NO: 261 - DNA, 26 bp, Saccharomyces cerevisiae
tcataagtttacctctcatagtcgca

SEQ ID NO: 262 - DNA, 18 bp, Saccharomyces cerevisiae
gactgatccccgctctcg

SEQ ID NO: 263 - DNA, 24 bp, Saccharomyces cerevisiae
tctttgaacaggacagatgtaaaa

SEQ ID NO: 264 - DNA, 26 bp, Saccharomyces cerevisiae
ggtcaaatatagatgaaactacagga

SEQ ID NO: 265 - DNA, 23 bp, Saccharomyces cerevisiae
atttcttaaaagcgcattcattt

SEQ ID NO: 266 - DNA, 21 bp, Saccharomyces cerevisiae
aaaagcatgcctgtctcaaaa

SEQ ID NO: 267 - DNA, 21 bp, Saccharomyces cerevisiae
atctcaaatcctactgccgga

SEQ ID NO: 268 - DNA, 23 bp, Saccharomyces cerevisiae
tattaaatcatagcgaaagcagc

SEQ ID NO: 269 - DNA, 25 bp, Saccharomyces cerevisiae
acatagtggacaagtgttagtttat

SEQ ID NO: 270 - DNA, 27 bp, Saccharomyces cerevisiae
taggttgaacatttcatttttcttatt

SEQ ID NO: 271 - DNA, 24 bp, Saccharomyces cerevisiae
atgaaattaacatgcccttttctg

SEQ ID NO: 272 - DNA, 27 bp, Saccharomyces cerevisiae
aaggctatatgatagatttaatttctt

SEQ ID NO: 273 - DNA, 27 bp, Saccharomyces cerevisiae
agttattgtttacattttgactccatc

SEQ ID NO: 274 - DNA, 23 bp, Saccharomyces cerevisiae
actttccttttcttagagcttgg

SEQ ID NO: 275 - DNA, 25 bp, Saccharomyces cerevisiae
acaggtagtatattgccgtttgttg

SEQ ID NO: 276 - DNA, 20 bp, Saccharomyces cerevisiae
acctcgtaagacatgatccg

SEQ ID NO: 277 - DNA, 18 bp, Saccharomyces cerevisiae
agttgacgctttgtgcgg

SEQ ID NO: 278 - DNA, 25 bp, Saccharomyces cerevisiae
agaacagagtaggtgcttaatcgag

SEQ ID NO: 279 - DNA, 21 bp, Saccharomyces cerevisiae
tgaatttgtgcagaattagcg

SEQ ID NO: 280 - DNA, 18 bp, Saccharomyces cerevisiae
cgatttcccacatcctgc

SEQ ID NO: 281 - DNA, 25 bp, Saccharomyces cerevisiae
acttaactacaccactcaggtctgg

SEQ ID NO: 282 - DNA, 22 bp, Saccharomyces cerevisiae
aggaaaaagtaggaaaacgcaa

SEQ ID NO: 283 - DNA, 26 bp, Saccharomyces cerevisiae
cataaaactcatgattcaacgtttgt

SEQ ID NO: 284 - DNA, 24 bp, Saccharomyces cerevisiae
cagtgctaaatttcctcgtaaagc

SEQ ID NO: 285 - DNA, 27 bp, Saccharomyces cerevisiae
gagtagttaagttgagaaggtttgttg

SEQ ID NO: 286 - DNA, 20 bp, Saccharomyces cerevisiae
ctcgaccgactggttgtaat

SEQ ID NO: 287 - DNA, 27 bp, Saccharomyces cerevisiae
tttttcaactggttaaaacctactatc

SEQ ID NO: 288 - DNA, 26 bp, Saccharomyces cerevisiae
agctaattctaagaaaacggtaacaa

SEQ ID NO: 289 - DNA, 25 bp, Saccharomyces cerevisiae
aaaaactgcatttatttatatacga

SEQ ID NO: 290 - DNA, 27 bp, Saccharomyces cerevisiae
agagaacgtagacagtattctcaaact

SEQ ID NO: 291 - DNA, 27 bp, Saccharomyces cerevisiae
ataatttattagtcgattctttcacga

SEQ ID NO: 292 - DNA, 23 bp, Saccharomyces cerevisiae
aataggcatgttgcaataaaacg

SEQ ID NO: 293 - DNA, 26 bp, Saccharomyces cerevisiae
ggttgacacatattctttttacacaa

SEQ ID NO: 294 - DNA, 25 bp, Saccharomyces cerevisiae
taagaaaaagaaaagcagaaatcat

SEQ ID NO: 295 - DNA, 18 bp, Saccharomyces cerevisiae
tagttggatgcggggcta

SEQ ID NO: 296 - DNA, 27 bp, Saccharomyces cerevisiae
tataaacaacctacatttgtgtttgaa

SEQ ID NO: 297 - DNA, 27 bp, Saccharomyces cerevisiae
ctatagctaaataatcatttcattggg

SEQ ID NO: 298 - DNA, 27 bp, Saccharomyces cerevisiae
agagattcctaaatagaaaatcaagtg

SEQ ID NO: 299 - DNA, 19 bp, Saccharomyces cerevisiae
taacatctcatgtgcccgc

SEQ ID NO: 300 - DNA, 25 bp, Saccharomyces cerevisiae
aaaatgtattacccccatatctttg

SEQ ID NO: 301 - DNA, 27 bp, Saccharomyces cerevisiae
aagaaactagatcaagatcatacaacg

SEQ ID NO: 302 - DNA, 21 bp, Saccharomyces cerevisiae
ttaacaacgcaagtagcacct

SEQ ID NO: 303 - DNA, 26 bp, Saccharomyces cerevisiae
tattccatttgtttcttatctccttc

SEQ ID NO: 304 - DNA, 25 bp, Saccharomyces cerevisiae
tgacatagttcataataattgccag

SEQ ID NO: 305 - DNA, 20 bp, Saccharomyces cerevisiae
tatgtggtaggcgaaaggct

SEQ ID NO: 306 - DNA, 21 bp, Saccharomyces cerevisiae
tgaatgtagcaaaaacctggc

SEQ ID NO: 307 - DNA, 22 bp, Saccharomyces cerevisiae
gaagacaaaaccaggtggtaga

SEQ ID NO: 308 - DNA, 26 bp, Saccharomyces cerevisiae
gactgtaactaaaattcaatgggaca

SEQ ID NO: 309 - DNA, 27 bp, Saccharomyces cerevisiae
tctttgcctttttaatctctagttgtc

SEQ ID NO: 310 - DNA, 22 bp, Saccharomyces cerevisiae
caataaggggatatagccattg

SEQ ID NO: 311 - DNA, 25 bp, Saccharomyces cerevisiae
caaacataatgtaggaattgcatgt

SEQ ID NO: 312 - DNA, 27 bp, Saccharomyces cerevisiae
aaagcttgagttattatttattttatg

SEQ ID NO: 313 - DNA, 27 bp, Saccharomyces cerevisiae
taatatgccgtttatgatattttcttc

SEQ ID NO: 314 - DNA, 25 bp, Saccharomyces cerevisiae
ccttcatgcactatacacgaaagaa

SEQ ID NO: 315 - DNA, 25 bp, Saccharomyces cerevisiae
aaaaagaaaacaacaaacgaataaa

SEQ ID NO: 316 - DNA, 25 bp, Saccharomyces cerevisiae
ctgcaaccatatttcatatcctttg

SEQ ID NO: 317 - DNA, 22 bp, Saccharomyces cerevisiae
ttaatttgggctaacggataaa

SEQ ID NO: 318 - DNA, 25 bp, Saccharomyces cerevisiae
aaacaataacacttttgagggattt

SEQ ID NO: 319 - DNA, 20 bp, Saccharomyces cerevisiae
actcgctgaaacgacaaaaa

SEQ ID NO: 320 - DNA, 27 bp, Saccharomyces cerevisiae
tctcgttcctaattatattcaaaagtc

SEQ ID NO: 321 - DNA, 24 bp, Saccharomyces cerevisiae
tagcaaccaaatcaagtagcaaag

SEQ ID NO: 322 - DNA, 20 bp, Saccharomyces cerevisiae
tttttccccttttcgaggtc

SEQ ID NO: 323 - DNA, 19 bp, Saccharomyces cerevisiae
tagcacgtgatcgggaagc

SEQ ID NO: 324 - DNA, 24 bp, Saccharomyces cerevisiae
atgaagttcaaagcataactgcac

SEQ ID NO: 325 - DNA, 22 bp, Saccharomyces cerevisiae
tggcatcattgctattacagaa

SEQ ID NO: 326 - DNA, 26 bp, Saccharomyces cerevisiae
tttttctttctttttctttccttctt

SEQ ID NO: 327 - DNA, 24 bp, Saccharomyces cerevisiae
gacccatacatctattatgaccct

SEQ ID NO: 328 - DNA, 27 bp, Saccharomyces cerevisiae
ttaaacagcaatttgaatgctataact

SEQ ID NO: 329 - DNA, 21 bp, Saccharomyces cerevisiae
ctggcattatttgcagaagtt

SEQ ID NO: 330 - DNA, 27 bp, Saccharomyces cerevisiae
tggtatgactgactacctttacttaca

SEQ ID NO: 331 - DNA, 19 bp, Saccharomyces cerevisiae
caatcgaaatgggcttcat

SEQ ID NO: 332 - DNA, 20 bp, Saccharomyces cerevisiae
actgcgagaacccagtgcta

SEQ ID NO: 333 - DNA, 27 bp, Saccharomyces cerevisiae
catatgtataaaacccaatatcatgga

SEQ ID NO: 334 - DNA, 21 bp, Saccharomyces cerevisiae
cccctcataaacgaagacaaa

SEQ ID NO: 335 - DNA, 18 bp, Saccharomyces cerevisiae
acgccagcgatcatcatt

SEQ ID NO: 336 - DNA, 27 bp, Saccharomyces cerevisiae
ggggaagagtaggagagtatatatgaa

SEQ ID NO: 337 - DNA, 20 bp, Saccharomyces cerevisiae
caaccctgaggtcaatgtgc

SEQ ID NO: 338 - DNA, 24 bp, Saccharomyces cerevisiae
tattaaccaaacttgcatctcacc

SEQ ID NO: 339 - DNA, 27 bp, Saccharomyces cerevisiae
aaacactaattacctcagtagtatgga

SEQ ID NO: 340 - DNA, 22 bp, Saccharomyces cerevisiae
ttcacacacaactcacaaatca

SEQ ID NO: 341 - DNA, 22 bp, Saccharomyces cerevisiae
aagaatccatgaatagttttta

SEQ ID NO: 342 - DNA, 27 bp, Saccharomyces cerevisiae
ggaagtatagatataaagaactcagcg

SEQ ID NO: 343 - DNA, 25 bp, Saccharomyces cerevisiae
caaaattattgtttctcttatccga

SEQ ID NO: 344 - DNA, 27 bp, Saccharomyces cerevisiae
gcgtatcttaattatgctcttttcttt

SEQ ID NO: 345 - DNA, 27 bp, Saccharomyces cerevisiae
cctgacacagtgaatttatctcttaat

SEQ ID NO: 346 - DNA, 25 bp, Saccharomyces cerevisiae
ttacaatgagctattttgcattttt

SEQ ID NO: 347 - DNA, 25 bp, Saccharomyces cerevisiae
gttgaaattattcaagagaattgcc

SEQ ID NO: 348 - DNA, 19 bp, Saccharomyces cerevisiae
ggtcctgttccgtgctctg

SEQ ID NO: 349 - DNA, 21 bp, Saccharomyces cerevisiae
ttatccattcgtccatccatc

SEQ ID NO: 350 - DNA, 26 bp, Saccharomyces cerevisiae
taacaaagagcattatttttccattc

SEQ ID NO: 351 - DNA, 24 bp, Saccharomyces cerevisiae
ttcatccttgtctgatgtacaagt

SEQ ID NO: 352 - DNA, 23 bp, Saccharomyces cerevisiae
tttttgggttctttttctttctg

SEQ ID NO: 353 - DNA, 21 bp, Saccharomyces cerevisiae
tgacgcctgctctcttttaac

SEQ ID NO: 354 - DNA, 27 bp, Saccharomyces cerevisiae
gagcatataaataaccacaacttgtaa

SEQ ID NO: 355 - DNA, 18 bp, Saccharomyces cerevisiae
cagcagacatcccggtca

SEQ ID NO: 356 - DNA, 23 bp, Saccharomyces cerevisiae
tttcaatcttttccatttcttgt

SEQ ID NO: 357 - DNA, 20 bp, Saccharomyces cerevisiae
cccggctctacattcctctt

SEQ ID NO: 358 - DNA, 27 bp, Saccharomyces cerevisiae
ctaaaagtaccatttaggtaggtgctg

SEQ ID NO: 359 - DNA, 24 bp, Saccharomyces cerevisiae
acgcagttaggatgtacaaaagtc

SEQ ID NO: 360 - DNA, 21 bp, Saccharomyces cerevisiae
cgcctttatacgcatctgttc

SEQ ID NO: 361 - DNA, 22 bp, Saccharomyces cerevisiae
ttccctcatttccaataacatt

SEQ ID NO: 362 - DNA, 26 bp, Saccharomyces cerevisiae
aagttttcgtgtattaaaatttttgc

SEQ ID NO: 363 - DNA, 25 bp, Saccharomyces cerevisiae
ttaattttcatttttgtgcatctca

SEQ ID NO: 364 - DNA, 26 bp, Saccharomyces cerevisiae
ccctttagccttcttataactgtttc

SEQ ID NO: 365 - DNA, 18 bp, Saccharomyces cerevisiae
tgagggaggcataagtgc

SEQ ID NO: 366 - DNA, 25 bp, Saccharomyces cerevisiae
agatactaaaaagaaaccttcccga

SEQ ID NO: 367 - DNA, 18 bp, Saccharomyces cerevisiae
gattaaaggcaagcgccc

SEQ ID NO: 368 - DNA, 27 bp, Saccharomyces cerevisiae
aaagcatctaacactttatttcaatct

SEQ ID NO: 369 - DNA, 18 bp, Saccharomyces cerevisiae
tgatcccttcaagaacgc

SEQ ID NO: 370 - DNA, 25 bp, Saccharomyces cerevisiae
gattgttttcattctttataggtgc

SEQ ID NO: 371 - DNA, 26 bp, Saccharomyces cerevisiae
aagtgttgtagatattcagtttccag

SEQ ID NO: 372 - DNA, 24 bp, Saccharomyces cerevisiae
atgtgagaataacgtctcctgatt

SEQ ID NO: 373 - DNA, 25 bp, Saccharomyces cerevisiae
gcctaagtcactcactaggtattgt

SEQ ID NO: 374 - DNA, 21 bp, Saccharomyces cerevisiae
tatcagcggaatatgcctgta

SEQ ID NO: 375 - DNA, 26 bp, Saccharomyces cerevisiae
tggtgttagtgcataataaatagcat

SEQ ID NO: 376 - DNA, 27 bp, Saccharomyces cerevisiae
tttaaatcagctaatctgcttactgcc

SEQ ID NO: 377 - DNA, 21 bp, Saccharomyces cerevisiae
tgcatcagttgtcaaatcgtc

SEQ ID NO: 378 - DNA, 27 bp, Saccharomyces cerevisiae
agatagggatatgtggataattctacg

SEQ ID NO: 379 - DNA, 22 bp, Saccharomyces cerevisiae
atcaactccccagtaactgctc

SEQ ID NO: 380 - DNA, 25 bp, Saccharomyces cerevisiae
caagtgtgattttaaaggtgatctg

SEQ ID NO: 381 - DNA, 20 bp, Saccharomyces cerevisiae
cggaggagctttttcctttt

SEQ ID NO: 382 - DNA, 27 bp, Saccharomyces cerevisiae
atatgtacagatcctcctagaagaacg

SEQ ID NO: 383 - DNA, 24 bp, Saccharomyces cerevisiae
tcatatttaaggaggtttccaaaa

SEQ ID NO: 384 - DNA, 26 bp, Saccharomyces cerevisiae
agtactagtaatgctcatgaattcgc

SEQ ID NO: 385 - DNA, 27 bp, Saccharomyces cerevisiae
tatacatgtctatgaaatcgaaaaccc

SEQ ID NO: 386 - DNA, 19 bp, Saccharomyces cerevisiae
aaggtttcccattccaccc

SEQ ID NO: 387 - DNA, 27 bp, Saccharomyces cerevisiae
tttagagggctactatatcttgttcca

SEQ ID NO: 388 - DNA, 19 bp, Saccharomyces cerevisiae
ggaggtacggagtggctca

SEQ ID NO: 389 - DNA, 25 bp, Saccharomyces cerevisiae
ttgaattaagaaaggtctgcatttt

SEQ ID NO: 390 - DNA, 24 bp, Saccharomyces cerevisiae
ataagtattggtgtgcttttcagg

SEQ ID NO: 391 - DNA, 19 bp, Saccharomyces cerevisiae
cgtctcaaaatatggcggc

SEQ ID NO: 392 - DNA, 22 bp, Saccharomyces cerevisiae
gggaatataaaaacgaccagga

SEQ ID NO: 393 - DNA, 25 bp, Saccharomyces cerevisiae
aggaattgaatgtactgaaaaactg

SEQ ID NO: 394 - DNA, 21 bp, Saccharomyces cerevisiae
aagtcggagaacctgactgaa

SEQ ID NO: 395 - DNA, 26 bp, Saccharomyces cerevisiae
ataagtacatccagtcgaatcctttt

SEQ ID NO: 396 - DNA, 20 bp, Saccharomyces cerevisiae
gatgccgcaaatgaaagaat

SEQ ID NO: 397 - DNA, 27 bp, Saccharomyces cerevisiae
atgaaaaaaaaaaactaatgataatgg

SEQ ID NO: 398 - DNA, 26 bp, Saccharomyces cerevisiae
atttcataagtgacgtataaggaacc

SEQ ID NO: 399 - DNA, 23 bp, Saccharomyces cerevisiae
aacgttacatttctctgtttggc

SEQ ID NO: 400 - DNA, 27 bp, Saccharomyces cerevisiae
taggtatttggtctcttgtctctattt

SEQ ID NO: 401 - DNA, 26 bp, Saccharomyces cerevisiae
ttggattacatcctacttttacaccc

SEQ ID NO: 402 - DNA, 23 bp, Saccharomyces cerevisiae
gttgagtaaaaccttccgttctg

SEQ ID NO: 403 - DNA, 26 bp, Saccharomyces cerevisiae
ataatatcttaatctctcgtcgttcg

SEQ ID NO: 404 - DNA, 27 bp, Saccharomyces cerevisiae
tgtaattataacgatggaatgatgttt

SEQ ID NO: 405 - DNA, 23 bp, Saccharomyces cerevisiae
cctacgccttgataataatactt

SEQ ID NO: 406 - DNA, 20 bp, Saccharomyces cerevisiae
gacaaattgggctgcaaact

SEQ ID NO: 407 - DNA, 24 bp, Saccharomyces cerevisiae
ttgaactattgttttcgttatcgc

SEQ ID NO: 408 - DNA, 20 bp, Saccharomyces cerevisiae
acaggtacgggctatctgga

SEQ ID NO: 409 - DNA, 25 bp, Saccharomyces cerevisiae
gtagaacatcatggccttgaatagg

SEQ ID NO: 410 - DNA, 23 bp, Saccharomyces cerevisiae
aaaccaagtatgcacctaaacaa

SEQ ID NO: 411 - DNA, 24 bp, Saccharomyces cerevisiae
gaatgaacagaaagaaaaggatct

SEQ ID NO: 412 - DNA, 22 bp, Saccharomyces cerevisiae
acagtgaaaaacaacgtccaaa

SEQ ID NO: 413 - DNA, 27 bp, Saccharomyces cerevisiae
tatgctagaaaaaaatattattgaacg

SEQ ID NO: 414 - DNA, 24 bp, Saccharomyces cerevisiae
taaatcttgaattttgcaatttgg

SEQ ID NO: 415 - DNA, 26 bp, Saccharomyces cerevisiae
tcttctctttttcgcttctttatttt

SEQ ID NO: 416 - DNA, 22 bp, Saccharomyces cerevisiae
acctcttcttggccttttattc

SEQ ID NO: 417 - DNA, 27 bp, Saccharomyces cerevisiae
tagtcatagattcatgaaaacgatatg

SEQ ID NO: 418 - DNA, 26 bp, Saccharomyces cerevisiae
ctagttggcttctattaatctttcca

SEQ ID NO: 419 - DNA, 20 bp, Saccharomyces cerevisiae
gacaggactccattccacaa

SEQ ID NO: 420 - DNA, 21 bp, Saccharomyces cerevisiae
aacgttttggctgtaatacca

SEQ ID NO: 421 - DNA, 23 bp, Saccharomyces cerevisiae
ggtgttcggttactttattctgc

SEQ ID NO: 422 - DNA, 27 bp, Saccharomyces cerevisiae
acacacctaattataactacattcgca

SEQ ID NO: 423 - DNA, 23 bp, Saccharomyces cerevisiae
taaacaatcggtggttaaacaat

SEQ ID NO: 424 - DNA, 27 bp, Saccharomyces cerevisiae
tgatcaataaaatcaaaaactacttcg

SEQ ID NO: 425 - DNA, 22 bp, Saccharomyces cerevisiae
tgactggcttaacgctctattc

SEQ ID NO: 426 - DNA, 22 bp, Saccharomyces cerevisiae
taaattaccaaggtcttttgaa

SEQ ID NO: 427 - DNA, 22 bp, Saccharomyces cerevisiae
gggaatttgtacttggttccct

SEQ ID NO: 428 - DNA, 20 bp, Saccharomyces cerevisiae
aaaaatggttccgcaaaaac

SEQ ID NO: 429 - DNA, 25 bp, Saccharomyces cerevisiae
gatcggttctggtattttaaagaag

SEQ ID NO: 430 - DNA, 24 bp, Saccharomyces cerevisiae
aatagaaattaattgttgactcac

SEQ ID NO: 431 - DNA, 24 bp, Saccharomyces cerevisiae
acgacggagtaataatagcgtatg

SEQ ID NO: 432 - DNA, 24 bp, Saccharomyces cerevisiae
aaatagcaatggtggttaacattt

SEQ ID NO: 433 - DNA, 23 bp, Saccharomyces cerevisiae
ccaaggacaaatacccatagaaa

SEQ ID NO: 434 - DNA, 21 bp, Saccharomyces cerevisiae
atggctcacaaaagtgcattg

SEQ ID NO: 435 - DNA, 26 bp, Saccharomyces cerevisiae
aatagactaaataatcgtatgtttgc

SEQ ID NO: 436 - DNA, 26 bp, Saccharomyces cerevisiae
tattaagtcattcttcttttcggtaa

SEQ ID NO: 437 - DNA, 25 bp, Saccharomyces cerevisiae
cttcgtagaatcgaacaatatctca

SEQ ID NO: 438 - DNA, 26 bp, Saccharomyces cerevisiae
agtttgtaaagatggtatattcagcg

SEQ ID NO: 439 - DNA, 23 bp, Saccharomyces cerevisiae
aaaaaatgaaatttgactataca

SEQ ID NO: 440 - DNA, 22 bp, Saccharomyces cerevisiae
aataagaaactgcgagaccacc

SEQ ID NO: 441 - DNA, 23 bp, Saccharomyces cerevisiae
tgatgacatgtatgggttgaaaa

SEQ ID NO: 442 - DNA, 25 bp, Saccharomyces cerevisiae
tgttataccatagtagtagtttcaa

SEQ ID NO: 443 - DNA, 26 bp, Saccharomyces cerevisiae
tgattggaaaaatacttatagacctg

SEQ ID NO: 444 - DNA, 21 bp, Saccharomyces cerevisiae
tgacagggggaataagaagag

SEQ ID NO: 445 - DNA, 21 bp, Saccharomyces cerevisiae
aaacgaggctaaaattggacg

SEQ ID NO: 446 - DNA, 23 bp, Saccharomyces cerevisiae
tttttgcaattcctttttacact

SEQ ID NO: 447 - DNA, 24 bp, Saccharomyces cerevisiae
catttgcttcttgtgtattcacct

SEQ ID NO: 448 - DNA, 25 bp, Saccharomyces cerevisiae
caataaaaaccaatagcatcttacg

SEQ ID NO: 449 - DNA, 27 bp, Saccharomyces cerevisiae
gaggcttgagagttaaaaatagatagc

SEQ ID NO: 450 - DNA, 20 bp, Saccharomyces cerevisiae
tttagcccaccgagattttt

SEQ ID NO: 451 - DNA, 26 bp, Saccharomyces cerevisiae
ccttgttaatagaattgtttttctcc

SEQ ID NO: 452 - DNA, 24 bp, Saccharomyces cerevisiae
cactaaacaccttcttggaacaac

SEQ ID NO: 453 - DNA, 20 bp, Saccharomyces cerevisiae
tgaatatttgggcgtttttc

SEQ ID NO: 454 - DNA, 19 bp, Saccharomyces cerevisiae
aaacctgcctctgagggtc

SEQ ID NO: 455 - DNA, 25 bp, Saccharomyces cerevisiae
tggaacctatttattgtcaagtgtg

SEQ ID NO: 456 - DNA, 25 bp, Saccharomyces cerevisiae
tgactgcaaatgatactaattcctg

SEQ ID NO: 457 - DNA, 24 bp, Saccharomyces cerevisiae
aaatttggattcgagatagtcaat

SEQ ID NO: 458 - DNA, 25 bp, Saccharomyces cerevisiae
gttagtgtgctatatagtggccaga

SEQ ID NO: 459 - DNA, 23 bp, Saccharomyces cerevisiae
agttcggcagtcatataatcaaa

SEQ ID NO: 460 - DNA, 27 bp, Saccharomyces cerevisiae
aataaatgatatataatacccgagcaa

SEQ ID NO: 461 - DNA, 23 bp, Saccharomyces cerevisiae
tattcacaagaacatttctgcca

SEQ ID NO: 462 - DNA, 26 bp, Saccharomyces cerevisiae
acgatatatcacgatacacgactctc

SEQ ID NO: 463 - DNA, 26 bp, Saccharomyces cerevisiae
tgatagaaaatttaaaagtgcagaat

SEQ ID NO: 464 - DNA, 22 bp, Saccharomyces cerevisiae
acatgcgagagtaagagatgcc

SEQ ID NO: 465 - DNA, 21 bp, Saccharomyces cerevisiae
aagaaaaattgaaaggcgatt

SEQ ID NO: 466 - DNA, 23 bp, Saccharomyces cerevisiae
agatgaaccaatgtaataaatga

SEQ ID NO: 467 - DNA, 20 bp, Saccharomyces cerevisiae
tatggcgtatttgggattgc

SEQ ID NO: 468 - DNA, 23 bp, Saccharomyces cerevisiae
taatgtggccttttgaaagaaaa

SEQ ID NO: 469 - DNA, 27 bp, Saccharomyces cerevisiae
gcaacctgatataatataatttttgaa

SEQ ID NO: 470 - DNA, 22 bp, Saccharomyces cerevisiae
agtatgtatcgggaagtctcca

SEQ ID NO: 471 - DNA, 25 bp, Saccharomyces cerevisiae
cgaatctgagtcctttttagttagc

SEQ ID NO: 472 - DNA, 25 bp, Saccharomyces cerevisiae
tgaagaggaagcatgatatataggt

SEQ ID NO: 473 - DNA, 25 bp, Saccharomyces cerevisiae
aagctattctaggcagtaagtccaa

SEQ ID NO: 474 - DNA, 27 bp, Saccharomyces cerevisiae
atggtttttgtgactttacctataaat

SEQ ID NO: 475 - DNA, 24 bp, Saccharomyces cerevisiae
tttcgatagtatcttgaatctgga

SEQ ID NO: 476 - DNA, 26 bp, Saccharomyces cerevisiae
tactatttgttagcaatcgcgctaag

SEQ ID NO: 477 - DNA, 22 bp, Saccharomyces cerevisiae
aaacacaaaagtgcaggctaaa

SEQ ID NO: 478 - DNA, 24 bp, Saccharomyces cerevisiae
acaccattaatttgatcagtccaa

SEQ ID NO: 479 - DNA, 20 bp, Saccharomyces cerevisiae
gacctgtagcagcagccttg

SEQ ID NO: 480 - DNA, 26 bp, Saccharomyces cerevisiae
agatacatgaatccttctcttcactg

SEQ ID NO: 481 - DNA, 26 bp, Saccharomyces cerevisiae
tttgcatgttaatacgatatacaaga

SEQ ID NO: 482 - DNA, 21 bp, Saccharomyces cerevisiae
catgaccgctatggtaggtcg

SEQ ID NO: 483 - DNA, 26 bp, Saccharomyces cerevisiae
atccactgaagagagagaacttctta

SEQ ID NO: 484 - DNA, 21 bp, Saccharomyces cerevisiae
cagcaatctttatttggctgc

SEQ ID NO: 485 - DNA, 26 bp, Saccharomyces cerevisiae
gtttaacggaaaagagtaatgacaaa

SEQ ID NO: 486 - DNA, 26 bp, Saccharomyces cerevisiae
ggttttaaaaaggaagcaaagtaatg

SEQ ID NO: 487 - DNA, 19 bp, Saccharomyces cerevisiae
tgcggattctctccgtagc

SEQ ID NO: 488 - DNA, 23 bp, Saccharomyces cerevisiae
cttgagggatgattattgaaacg

SEQ ID NO: 489 - DNA, 19 bp, Saccharomyces cerevisiae
acggccaaacgcacattta

SEQ ID NO: 490 - DNA, 25 bp, Saccharomyces cerevisiae
ttcttttaataaatctgttccatgc

SEQ ID NO: 491 - DNA, 26 bp, Saccharomyces cerevisiae
attccatttactgtcgtttatactgg

SEQ ID NO: 492 - DNA, 22 bp, Saccharomyces cerevisiae
cgataactcccaatttgctttt

SEQ ID NO: 493 - DNA, 25 bp, Saccharomyces cerevisiae
gacgtttatattctagcttgggatt

SEQ ID NO: 494 - DNA, 21 bp, Saccharomyces cerevisiae
ggtgcgctgagtggcatatag

SEQ ID NO: 495 - DNA, 25 bp, Saccharomyces cerevisiae
gcaatatctatatcatttctcatgt

SEQ ID NO: 496 - DNA, 21 bp, Saccharomyces cerevisiae
agccttaaaattcacacacgc

SEQ ID NO: 497 - DNA, 20 bp, Saccharomyces cerevisiae
tggtaaaatataaacgccgc

SEQ ID NO: 498 - DNA, 24 bp, Saccharomyces cerevisiae
gctgctcacccaactgaaacttat

SEQ ID NO: 499 - DNA, 22 bp, Saccharomyces cerevisiae
tttttcttttgcagtaggaggc

SEQ ID NO: 500 - DNA, 27 bp, Saccharomyces cerevisiae
acacacattataaactaaccttaaatc

SEQ ID NO: 501 - DNA, 27 bp, Saccharomyces cerevisiae
ggaagaaagtgaagagtagaaaaataa

SEQ ID NO: 502 - DNA, 25 bp, Saccharomyces cerevisiae
taatcacttttcattgctctctagg

SEQ ID NO: 503 - DNA, 21 bp, Saccharomyces cerevisiae
gaagaggggcagatgcttaaa

SEQ ID NO: 504 - DNA, 25 bp, Saccharomyces cerevisiae
taagctaaggacagaaaatgaaaaa

SEQ ID NO: 505 - DNA, 21 bp, Saccharomyces cerevisiae
gggcatgtgatttcattgcat

SEQ ID NO: 506 - DNA, 20 bp, Saccharomyces cerevisiae
aagcactcgcacgcatagtt

SEQ ID NO: 507 - DNA, 27 bp, Saccharomyces cerevisiae
ataaaatttgtagaatctgtgttattg

SEQ ID NO: 508 - DNA, 24 bp, Saccharomyces cerevisiae
aattaaacttatgtggctaaacat

SEQ ID NO: 509 - DNA, 26 bp, Saccharomyces cerevisiae
actttcaataagtggctaatgatttc

SEQ ID NO: 510 - DNA, 23 bp, Saccharomyces cerevisiae
atgaacctttagttttaatccat

SEQ ID NO: 511 - DNA, 24 bp, Saccharomyces cerevisiae
ggtcttttttcataggtatcttcg

SEQ ID NO: 512 - DNA, 25 bp, Saccharomyces cerevisiae
tgagggctaagtttttatttcttca

SEQ ID NO: 513 - DNA, 24 bp, Saccharomyces cerevisiae
gagtaacgattttacgaatcgagc

SEQ ID NO: 514 - DNA, 25 bp, Saccharomyces cerevisiae
taaataaataaaagggggagaaaaa

SEQ ID NO: 515 - DNA, 25 bp, Saccharomyces cerevisiae
gaagttctgagacaagtaccacctc

SEQ ID NO: 516 - DNA, 26 bp, Saccharomyces cerevisiae
cgtttgcgttaaaggtatattaaaaa

SEQ ID NO: 517 - DNA, 23 bp, Saccharomyces cerevisiae
cgaacgtaacttttcgtttcttg

SEQ ID NO: 518 - DNA, 24 bp, Saccharomyces cerevisiae
taagcataatacaatggtgcaaaa

SEQ ID NO: 519 - DNA, 26 bp, Saccharomyces cerevisiae
tcatgaaaacataataataaacctgc

SEQ ID NO: 520 - DNA, 18 bp, Saccharomyces cerevisiae
acgtgaccgtgcaccaat

SEQ ID NO: 521 - DNA, 23 bp, Saccharomyces cerevisiae
aaaaactcgatattcctggattt

SEQ ID NO: 522 - DNA, 23 bp, Saccharomyces cerevisiae
cctatctacttgatgggcctttt

SEQ ID NO: 523 - DNA, 20 bp, Saccharomyces cerevisiae
accgctacgtcccaggatag

SEQ ID NO: 524 - DNA, 20 bp, Saccharomyces cerevisiae
taaaatacgcatttggcgtt

SEQ ID NO: 525 - DNA, 24 bp, Saccharomyces cerevisiae
ctgaatttatagatcccccaaaaa

SEQ ID NO: 526 - DNA, 27 bp, Saccharomyces cerevisiae
taatgcagtgttaataaaacgttagtt

SEQ ID NO: 527 - DNA, 22 bp, Saccharomyces cerevisiae
aaagggaggtatataaagtaca

SEQ ID NO: 528 - DNA, 22 bp, Saccharomyces cerevisiae
agcagaaatcacgattcaaaaa

SEQ ID NO: 529 - DNA, 27 bp, Saccharomyces cerevisiae
aggtgtttatagaatttatcgaactgt

SEQ ID NO: 530 - DNA, 27 bp, Saccharomyces cerevisiae
tacctatctcatttgacaataatatcc

SEQ ID NO: 531 - DNA, 24 bp, Saccharomyces cerevisiae
gctaatgaacatttatcgacacag

SEQ ID NO: 532 - DNA, 25 bp, Saccharomyces cerevisiae
tcctgttgaagtagcatttaatcat

SEQ ID NO: 533 - DNA, 25 bp, Saccharomyces cerevisiae
gaataccaagtgaagaacattatcg

SEQ ID NO: 534 - DNA, 25 bp, Saccharomyces cerevisiae
gcaggtctcacctttatactcactg

SEQ ID NO: 535 - DNA, 24 bp, Saccharomyces cerevisiae
cttccttaaatatcacccttacca

SEQ ID NO: 536 - DNA, 23 bp, Saccharomyces cerevisiae
aggaccaggttctactcttcacc

SEQ ID NO: 537 - DNA, 26 bp, Saccharomyces cerevisiae
tgactgaaatttttgcataggttttt

SEQ ID NO: 538 - DNA, 24 bp, Saccharomyces cerevisiae
gaagacatgtaaatggaacaaaaa

SEQ ID NO: 539 - DNA, 27 bp, Saccharomyces cerevisiae
attaataggcttcctttgtttatttcc

SEQ ID NO: 540 - DNA, 27 bp, Saccharomyces cerevisiae
tacctactatactgtagtttcagccaa

SEQ ID NO: 541 - DNA, 24 bp, Saccharomyces cerevisiae
actgtaagtttcccctcattttcc

SEQ ID NO: 542 - DNA, 22 bp, Saccharomyces cerevisiae
ttttccatttcttctttccgtt

SEQ ID NO: 543 - DNA, 25 bp, Saccharomyces cerevisiae
tgtgtatagttgatacaagtatttt

SEQ ID NO: 544 - DNA, 23 bp, Saccharomyces cerevisiae
ttctgtgtttgccattttgtaga

SEQ ID NO: 545 - DNA, 25 bp, Saccharomyces cerevisiae
aaggaatacgtatataggtgaacgg

SEQ ID NO: 546 - DNA, 27 bp, Saccharomyces cerevisiae
cctaactttacgactttacgatactga

SEQ ID NO: 547 - DNA, 25 bp, Saccharomyces cerevisiae
taatgaaatcacttcctttggttat

SEQ ID NO: 548 - DNA, 26 bp, Saccharomyces cerevisiae
tatctagaggagaaagaaaaggaaga

SEQ ID NO: 549 - DNA, 20 bp, Saccharomyces cerevisiae
actttttccggcaacgtttt

SEQ ID NO: 550 - DNA, 26 bp, Saccharomyces cerevisiae
gatacatgtgcaagtacaagttcaaa

SEQ ID NO: 551 - DNA, 25 bp, Saccharomyces cerevisiae
tttatatgaaaagaaatgaagcgtt

SEQ ID NO: 552 - DNA, 27 bp, Saccharomyces cerevisiae
tttttgataaaactactacgctaaaaa

SEQ ID NO: 553 - DNA, 24 bp, Saccharomyces cerevisiae
gatgtcgtttagttgacaatcaga

SEQ ID NO: 554 - DNA, 22 bp, Saccharomyces cerevisiae
tggaaaaattaagaccaatgga

SEQ ID NO: 555 - DNA, 25 bp, Saccharomyces cerevisiae
ctacataagtgcaattaaagcatcg

SEQ ID NO: 556 - DNA, 18 bp, Saccharomyces cerevisiae
taagtcgccctcagtccg

SEQ ID NO: 557 - DNA, 24 bp, Saccharomyces cerevisiae
atgcatgcgataacattagttagg

SEQ ID NO: 558 - DNA, 23 bp, Saccharomyces cerevisiae
gcggatctcttatgtctttacga

SEQ ID NO: 559 - DNA, 26 bp, Saccharomyces cerevisiae
tcaagccagtaagtgatagttacctt

SEQ ID NO: 560 - DNA, 27 bp, Saccharomyces cerevisiae
aatacattatccaaattctcatatgct

SEQ ID NO: 561 - DNA, 26 bp, Saccharomyces cerevisiae
tatttaattttatgtgtcctaatgga

SEQ ID NO: 562 - DNA, 20 bp, Saccharomyces cerevisiae
ttctgatgatgaatccacga

SEQ ID NO: 563 - DNA, 27 bp, Saccharomyces cerevisiae
aaaaagtgaaaaggaaatgagagtatt

SEQ ID NO: 564 - DNA, 18 bp, Saccharomyces cerevisiae
agtgcctgagcagaacgg

SEQ ID NO: 565 - DNA, 24 bp, Saccharomyces cerevisiae
gatgctgttgaaagaaaaacagtc

SEQ ID NO: 566 - DNA, 21 bp, Saccharomyces cerevisiae
tcacatccatttctcccaact

SEQ ID NO: 567 - DNA, 27 bp, Saccharomyces cerevisiae
gattatgtgtatcgagaagcaaattga

SEQ ID NO: 568 - DNA, 22 bp, Saccharomyces cerevisiae
aacagcgaaaataaggcaactg

SEQ ID NO: 569 - DNA, 24 bp, Saccharomyces cerevisiae
attgcatcttggcttctagttttt

SEQ ID NO: 570 - DNA, 24 bp, Saccharomyces cerevisiae
taaaaagtgcaggtaacaagtcat

SEQ ID NO: 571 - DNA, 20 bp, Saccharomyces cerevisiae
acgcctgatgcgagctatac

SEQ ID NO: 572 - DNA, 27 bp, Saccharomyces cerevisiae
aggttaaggaaatgtaaataaaaaaaa

SEQ ID NO: 573 - DNA, 22 bp, Saccharomyces cerevisiae
accgtgtaaaggcaaatttaga

SEQ ID NO: 574 - DNA, 27 bp, Saccharomyces cerevisiae
aattacttagtattaagattctgcccc

SEQ ID NO: 575 - DNA, 25 bp, Saccharomyces cerevisiae
gaaaaatttcaaagcaaagaaaaga

SEQ ID NO: 576 - DNA, 24 bp, Saccharomyces cerevisiae
agcagcttgagattgtcttaatca

SEQ ID NO: 577 - DNA, 23 bp, Saccharomyces cerevisiae
actatcagaaaaacagctagccc

SEQ ID NO: 578 - DNA, 25 bp, Saccharomyces cerevisiae
tgaaattttaaagatacggaaattg

SEQ ID NO: 579 - DNA, 25 bp, Saccharomyces cerevisiae
agagaagcttattaccttccccttc

SEQ ID NO: 580 - DNA, 26 bp, Saccharomyces cerevisiae
acataacgtcttcatctcctaacttc

SEQ ID NO: 581 - DNA, 20 bp, Saccharomyces cerevisiae
atagccaatttcgacgaacg

SEQ ID NO: 582 - DNA, 25 bp, Saccharomyces cerevisiae
agagcacattattttctaagcttgt

SEQ ID NO: 583 - DNA, 22 bp, Saccharomyces cerevisiae
agctgatgcattgtcaaaagag

SEQ ID NO: 584 - DNA, 26 bp, Saccharomyces cerevisiae
tggtagtatcgcttactctatcatca

SEQ ID NO: 585 - DNA, 25 bp, Saccharomyces cerevisiae
tttagttttcaactcattaaaacgg

SEQ ID NO: 586 - DNA, 23 bp, Saccharomyces cerevisiae
tcatatgacgccatgaatttacc

SEQ ID NO: 587 - DNA, 26 bp, Saccharomyces cerevisiae
acgctatagcttaacctcgattaaaa

SEQ ID NO: 588 - DNA, 23 bp, Saccharomyces cerevisiae
atgcctttttaatcaaagcctta

SEQ ID NO: 589 - DNA, 24 bp, Saccharomyces cerevisiae
tttattttatgctgcaaaccttcc

SEQ ID NO: 590 - DNA, 27 bp, Saccharomyces cerevisiae
taagagttattacgtacttccatttgc

SEQ ID NO: 591 - DNA, 23 bp, Saccharomyces cerevisiae
atgtaaaattcagggataaattc

SEQ ID NO: 592 - DNA, 19 bp, Saccharomyces cerevisiae
ccctgggtggaaacaagtc

SEQ ID NO: 593 - DNA, 25 bp, Saccharomyces cerevisiae
agtctttcgaaaatatgggttatca

SEQ ID NO: 594 - DNA, 24 bp, Saccharomyces cerevisiae
ggttaaaaaagtgaatctccattg

SEQ ID NO: 595 - DNA, 27 bp, Saccharomyces cerevisiae
tagcgtacatagagtattcacgttttt

SEQ ID NO: 596 - DNA, 26 bp, Saccharomyces cerevisiae
atataaatacgaagcggtagagatca

SEQ ID NO: 597 - DNA, 22 bp, Saccharomyces cerevisiae
attcgattaccccagaaaagaa

SEQ ID NO: 598 - DNA, 24 bp, Saccharomyces cerevisiae
ctccttttaaattattctcgctgg

SEQ ID NO: 599 - DNA, 26 bp, Saccharomyces cerevisiae
cacgaacaattgtaatagtactaggc

SEQ ID NO: 600 - DNA, 26 bp, Saccharomyces cerevisiae
cgttagcattgcatattattgttatt

SEQ ID NO: 601 - DNA, 21 bp, Saccharomyces cerevisiae
gattagcgcaatcaagaacat

SEQ ID NO: 602 - DNA, 27 bp, Saccharomyces cerevisiae
gaataattgtgctgatttttatttctt

SEQ ID NO: 603 - DNA, 24 bp, Saccharomyces cerevisiae
gcagactgagaaaaatcaaaagaa

SEQ ID NO: 604 - DNA, 26 bp, Saccharomyces cerevisiae
atttctcagtaacataaaaagcaggc

SEQ ID NO: 605 - DNA, 21 bp, Saccharomyces cerevisiae
taggtttgtttttcgtcctcg

SEQ ID NO: 606 - DNA, 20 bp, Saccharomyces cerevisiae
aaaggaggatagatcttttt

SEQ ID NO: 607 - DNA, 26 bp, Saccharomyces cerevisiae
tcatcatcccttttatcaaaataagc

SEQ ID NO: 608 - DNA, 24 bp, Saccharomyces cerevisiae
aaatcactttttttctgacacttt

SEQ ID NO: 609 - DNA, 21 bp, Saccharomyces cerevisiae
ttatgcatcgcattttgtttt

SEQ ID NO: 610 - DNA, 26 bp, Saccharomyces cerevisiae
cttttacaccacatcgttattgtttt

SEQ ID NO: 611 - DNA, 21 bp, Saccharomyces cerevisiae
aaaagcttcaacatggcctta

SEQ ID NO: 612 - DNA, 27 bp, Saccharomyces cerevisiae
cgttaggtagatctaaagacagaaaat

SEQ ID NO: 613 - DNA, 18 bp, Saccharomyces cerevisiae
tgaggcaaatgcgatcat

SEQ ID NO: 614 - DNA, 25 bp, Saccharomyces cerevisiae
agctctctttgaaaagttgaaatta

SEQ ID NO: 615 - DNA, 23 bp, Saccharomyces cerevisiae
ctcgctaaatattcttgctgcac

SEQ ID NO: 616 - DNA, 20 bp, Saccharomyces cerevisiae
acacctgtcggcagtagttt

SEQ ID NO: 617 - DNA, 21 bp, Saccharomyces cerevisiae
aacctggcctaactggtcatt

SEQ ID NO: 618 - DNA, 27 bp, Saccharomyces cerevisiae
tagttcttttatcctgatgactttttc

SEQ ID NO: 619 - DNA, 27 bp, Saccharomyces cerevisiae
gtcttgtaaataacaggtaagtctaat

SEQ ID NO: 620 - DNA, 24 bp, Saccharomyces cerevisiae
gctgtgatgcagtaatcttgtttt

SEQ ID NO: 621 - DNA, 27 bp, Saccharomyces cerevisiae
tgatatatctcatccttcaaatttctt

SEQ ID NO: 622 - DNA, 25 bp, Saccharomyces cerevisiae
agagcctaaattgacaaaacaaaaa

SEQ ID NO: 623 - DNA, 26 bp, Saccharomyces cerevisiae
atttttaacaggcactctaattgtca

SEQ ID NO: 624 - DNA, 27 bp, Saccharomyces cerevisiae
atagaatacctctttcctcttcaatct

SEQ ID NO: 625 - DNA, 24 bp, Saccharomyces cerevisiae
atactgcgcaagaatatcgttaaa

SEQ ID NO: 626 - DNA, 21 bp, Saccharomyces cerevisiae
attctttccttccctttcgac

SEQ ID NO: 627 - DNA, 21 bp, Saccharomyces cerevisiae
tttttcttccagaatagccca

SEQ ID NO: 628 - DNA, 20 bp, Saccharomyces cerevisiae
tccgcttggtaaaagtcagt

SEQ ID NO: 629 - DNA, 22 bp, Saccharomyces cerevisiae
taaatgaccgacattgactcac

SEQ ID NO: 630 - DNA, 23 bp, Saccharomyces cerevisiae
ttattctgttttatgttgtctgt

SEQ ID NO: 631 - DNA, 23 bp, Saccharomyces cerevisiae
agcaaaccataaaatagttgcac

SEQ ID NO: 632 - DNA, 21 bp, Saccharomyces cerevisiae
agacaaacgccaattttacga

SEQ ID NO: 633 - DNA, 26 bp, Saccharomyces cerevisiae
ccagtcatgtaaatatcctttaatcg

SEQ ID NO: 634 - DNA, 22 bp, Saccharomyces cerevisiae
ccaaaatgagctatcaaaaacg

SEQ ID NO: 635 - DNA, 27 bp, Saccharomyces cerevisiae
aacctattaaacaacaaaaagtgtttc

SEQ ID NO: 636 - DNA, 24 bp, Saccharomyces cerevisiae
acaataccgcttctgaagtatgtt

SEQ ID NO: 637 - DNA, 26 bp, Saccharomyces cerevisiae
acatcatcataattaaccagacatgc

SEQ ID NO: 638 - DNA, 21 bp, Saccharomyces cerevisiae
tctggttaacggcaaagaaga

SEQ ID NO: 639 - DNA, 26 bp, Saccharomyces cerevisiae
gcacataacataatccgttaactctt

SEQ ID NO: 640 - DNA, 24 bp, Saccharomyces cerevisiae
acacaccaggacaaaaagtatgtg

SEQ ID NO: 641 - DNA, 26 bp, Saccharomyces cerevisiae
ttaatcaatcaaagtctatcccttcg

SEQ ID NO: 642 - DNA, 27 bp, Saccharomyces cerevisiae
aaataaacaaaataatgcagaaaggtg

SEQ ID NO: 643 - DNA, 23 bp, Saccharomyces cerevisiae
tttcaccttacagttcacctttg

SEQ ID NO: 644 - DNA, 26 bp, Saccharomyces cerevisiae
tacatggataactgaatctctttcaa

SEQ ID NO: 645 - DNA, 23 bp, Saccharomyces cerevisiae
gaggatctgcatctaagaacaaa

SEQ ID NO: 646 - DNA, 27 bp, Saccharomyces cerevisiae
gccaaataattctttatttcatagtgt

SEQ ID NO: 647 - DNA, 25 bp, Saccharomyces cerevisiae
ctgtcaataaccgagtgttctcttt

SEQ ID NO: 648 - DNA, 27 bp, Saccharomyces cerevisiae
tccgaggaataagagattatacttaaa

SEQ ID NO: 649 - DNA, 28 bp, Saccharomyces cerevisiae
atgcctttattcactaaattctaatagc

SEQ ID NO: 650 - DNA, 22 bp, Saccharomyces cerevisiae
aacgacatttctgcattttctt

SEQ ID NO: 651 - DNA, 23 bp, Saccharomyces cerevisiae
tttggtaggcactagaacaaaaa

SEQ ID NO: 652 - DNA, 21 bp, Saccharomyces cerevisiae
ctgcggtgtcatttttcattt

SEQ ID NO: 653 - DNA, 26 bp, Saccharomyces cerevisiae
gtgctctaatgacagttctactgtgt

SEQ ID NO: 654 - DNA, 26 bp, Saccharomyces cerevisiae
attgcaaattagagatagattccctt

SEQ ID NO: 655 - DNA, 24 bp, Saccharomyces cerevisiae
attgtttctttactgaattgattt

SEQ ID NO: 656 - DNA, 28 bp, Saccharomyces cerevisiae
atagtattagcatattcgaagtagaagc

SEQ ID NO: 657 - DNA, 27 bp, Saccharomyces cerevisiae
tagtacaatgagataaagagacaacgc

SEQ ID NO: 658 - DNA, 19 bp, Saccharomyces cerevisiae
gaaaaacgccgcttactgc

SEQ ID NO: 659 - DNA, 20 bp, Saccharomyces cerevisiae
cagtcacgatgagcagaacg

SEQ ID NO: 660 - DNA, 26 bp, Saccharomyces cerevisiae
atttttattaattcatgatcacgctc

SEQ ID NO: 661 - DNA, 26 bp, Saccharomyces cerevisiae
gtgagtaagtgatttttcgtttaatg

SEQ ID NO: 662 - DNA, 23 bp, Saccharomyces cerevisiae
ttgttgttggctgttatactgga

SEQ ID NO: 663 - DNA, 21 bp, Saccharomyces cerevisiae
tactagcgcattcattctccc

SEQ ID NO: 664 - DNA, 25 bp, Saccharomyces cerevisiae
agatcatttgaatgtttagcgtaga

SEQ ID NO: 665 - DNA, 24 bp, Saccharomyces cerevisiae
tgtcacaatcatgttaagctatcg

SEQ ID NO: 666 - DNA, 27 bp, Saccharomyces cerevisiae
tattacatgaacttattcctagcacag

SEQ ID NO: 667 - DNA, 20 bp, Saccharomyces cerevisiae
tgaactgccaccataccacg

SEQ ID NO: 668 - DNA, 27 bp, Saccharomyces cerevisiae
ttacgatagaacttacaagctgatttt

SEQ ID NO: 669 - DNA, 25 bp, Saccharomyces cerevisiae
tgacataatattccaaaggaaagga

SEQ ID NO: 670 - DNA, 19 bp, Saccharomyces cerevisiae
gcggtctggctgtcttaaa

SEQ ID NO: 671 - DNA, 24 bp, Saccharomyces cerevisiae
tgatagcatatgacatagtaggac

SEQ ID NO: 672 - DNA, 24 bp, Saccharomyces cerevisiae
aaaatacatccagcatgataccag

SEQ ID NO: 673 - DNA, 23 bp, Saccharomyces cerevisiae
tgagccgtgaactacaaactaaa

SEQ ID NO: 674 - DNA, 26 bp, Saccharomyces cerevisiae
aaggatatttaatgctaactagcccg

SEQ ID NO: 675 - DNA, 21 bp, Saccharomyces cerevisiae
gactcgctgttcacttggttg

SEQ ID NO: 676 - DNA, 26 bp, Saccharomyces cerevisiae
cgtgattatttcttctttttatgcaa

SEQ ID NO: 677 - DNA, 26 bp, Saccharomyces cerevisiae
ggtcgttaattgaaatgacataagta

SEQ ID NO: 678 - DNA, 22 bp, Saccharomyces cerevisiae
tgagcacttgatttacacgaaa

SEQ ID NO: 679 - DNA, 20 bp, Saccharomyces cerevisiae
actcctcgaacaacacccaa

SEQ ID NO: 680 - DNA, 27 bp, Saccharomyces cerevisiae
aagatataaatataaagactgcgctga

SEQ ID NO: 681 - DNA, 27 bp, Saccharomyces cerevisiae
gtgaagtaatttttattaacggagtca

SEQ ID NO: 682 - DNA, 24 bp, Saccharomyces cerevisiae
aagcttcctcatttcgttactgct

SEQ ID NO: 683 - DNA, 27 bp, Saccharomyces cerevisiae
aaaaagaaacagaaacagaaatagaaa

SEQ ID NO: 684 - DNA, 20 bp, Saccharomyces cerevisiae
ggtataatgcgtgcacaggt

SEQ ID NO: 685 - DNA, 24 bp, Saccharomyces cerevisiae
atgctattttgcctattgattttc

SEQ ID NO: 686 - DNA, 23 bp, Saccharomyces cerevisiae
acgaagaaataaacaagcaagca

SEQ ID NO: 687 - DNA, 21 bp, Saccharomyces cerevisiae
cactgatatgaaattgcgtgc

SEQ ID NO: 688 - DNA, 26 bp, Saccharomyces cerevisiae
ttccaagattaaaagaataggaaaca

SEQ ID NO: 689 - DNA, 27 bp, Saccharomyces cerevisiae
acaaagataaataaaagaaaatcgaca

SEQ ID NO: 690 - DNA, 24 bp, Saccharomyces cerevisiae
agataaacaaaggcaatcatgtta

SEQ ID NO: 691 - DNA, 22 bp, Saccharomyces cerevisiae
agatacaaattccttgatcccg

SEQ ID NO: 692 - DNA, 25 bp, Saccharomyces cerevisiae
gtgtacagtgctttgaattgatttg

SEQ ID NO: 693 - DNA, 20 bp, Saccharomyces cerevisiae
agcgttgtcttcctcgttcc

SEQ ID NO: 694 - DNA, 26 bp, Saccharomyces cerevisiae
tataacctaccataggacacactttg

SEQ ID NO: 695 - DNA, 23 bp, Saccharomyces cerevisiae
aaaacaatggaatgaagaagaaa

SEQ ID NO: 696 - DNA, 20 bp, Saccharomyces cerevisiae
tgattaggtgagggtcccag

SEQ ID NO: 697 - DNA, 25 bp, Saccharomyces cerevisiae
tacagataataaaagaccaaggctg

SEQ ID NO: 698 - DNA, 20 bp, Saccharomyces cerevisiae
taaatgtaaacgaagctttt

SEQ ID NO: 699 - DNA, 25 bp, Saccharomyces cerevisiae
agcacagactaacgactatatgcac

SEQ ID NO: 700 - DNA, 27 bp, Saccharomyces cerevisiae
caaataaacaactttagttttccactg

SEQ ID NO: 701 - DNA, 24 bp, Saccharomyces cerevisiae
ttaaccgtcttttgatttctttcc

SEQ ID NO: 702 - DNA, 19 bp, Saccharomyces cerevisiae
taaagagcgccaaatctgc

SEQ ID NO: 703 - DNA, 27 bp, Saccharomyces cerevisiae
ataggactaatttcattattgtaaaac

SEQ ID NO: 704 - DNA, 24 bp, Saccharomyces cerevisiae
ttttgcattgagtacttatccact

SEQ ID NO: 705 - DNA, 26 bp, Saccharomyces cerevisiae
agttcctttcatactcttttcttttc

SEQ ID NO: 706 - DNA, 23 bp, Saccharomyces cerevisiae
gtttggttgtaccgtgtagagga

SEQ ID NO: 707 - DNA, 27 bp, Saccharomyces cerevisiae
agttgttttaaatggagttgatttcac

SEQ ID NO: 708 - DNA, 25 bp, Saccharomyces cerevisiae
ctatcgtagccttgaaatctaaaaa

SEQ ID NO: 709 - DNA, 22 bp, Saccharomyces cerevisiae
taccaaagtgtaacccaaaagg

SEQ ID NO: 710 - DNA, 24 bp, Saccharomyces cerevisiae
gatgatagatgagccatactcaaa

SEQ ID NO: 711 - DNA, 27 bp, Saccharomyces cerevisiae
cgagtcaattaaagacatttttctagc

SEQ ID NO: 712 - DNA, 27 bp, Saccharomyces cerevisiae
tgttaaagaaaaagatgtttaagtgtg

SEQ ID NO: 713 - DNA, 21 bp, Saccharomyces cerevisiae
cactaggtggtggtttatggg

SEQ ID NO: 714 - DNA, 23 bp, Saccharomyces cerevisiae
attgtgctatctgggacagtaac

SEQ ID NO: 715 - DNA, 24 bp, Saccharomyces cerevisiae
ttaccgttttacgatgtaacgctt

SEQ ID NO: 716 - DNA, 27 bp, Saccharomyces cerevisiae
ttgaatcatatgtagaaaagcttgtaa

SEQ ID NO: 717 - DNA, 20 bp, Saccharomyces cerevisiae
tggggaaaaacagaactttg

SEQ ID NO: 718 - DNA, 25 bp, Saccharomyces cerevisiae
aaattgtaaaattaaagcatcatct

SEQ ID NO: 719 - DNA, 26 bp, Saccharomyces cerevisiae
tttagcacagaatgtgcattattcaa

SEQ ID NO: 720 - DNA, 25 bp, Saccharomyces cerevisiae
tgcaatataacattaaaacaagata

SEQ ID NO: 721 - DNA, 23 bp, Saccharomyces cerevisiae
taatctaagccttaagaggctcg

SEQ ID NO: 722 - DNA, 19 bp, Saccharomyces cerevisiae
taattgcaatgcgatgtgg

SEQ ID NO: 723 - DNA, 23 bp, Saccharomyces cerevisiae
tgaggggaaaacttaaaatgaaa

SEQ ID NO: 724 - DNA, 21 bp, Saccharomyces cerevisiae
ggcagccttttcttcttgttt

SEQ ID NO: 725 - DNA, 24 bp, Saccharomyces cerevisiae
tcttttgtaacgaatttgatgaat

SEQ ID NO: 726 - DNA, 25 bp, Saccharomyces cerevisiae
tgatacaatataatcttcacaagca

SEQ ID NO: 727 - DNA, 26 bp, Saccharomyces cerevisiae
tgatcatatcctacaatgcaattacc

SEQ ID NO: 728 - DNA, 20 bp, Saccharomyces cerevisiae
atgccatttactgacggtga

SEQ ID NO: 729 - DNA, 22 bp, Saccharomyces cerevisiae
aagcctcaaagatgcactaaaa

SEQ ID NO: 730 - DNA, 27 bp, Saccharomyces cerevisiae
ctaggttctttttcttctaatttgttg

SEQ ID NO: 731 - DNA, 20 bp, Saccharomyces cerevisiae
tgccgaatgattgagaattt

SEQ ID NO: 732 - DNA, 23 bp, Saccharomyces cerevisiae
gagaacaagtaatggtgagggaa

SEQ ID NO: 733 - DNA, 23 bp, Saccharomyces cerevisiae
taagctttgaattggatttgaga

SEQ ID NO: 734 - DNA, 26 bp, Saccharomyces cerevisiae
tttagtttatagataacggctcttgc

SEQ ID NO: 735 - DNA, 24 bp, Saccharomyces cerevisiae
tcaacatgttcatgtcaaaagaag

SEQ ID NO: 736 - DNA, 25 bp, Saccharomyces cerevisiae
caaaagaaggaagataggcatagtg

SEQ ID NO: 737 - DNA, 20 bp, Saccharomyces cerevisiae
ggcactttgaacggctttta

SEQ ID NO: 738 - DNA, 24 bp, Saccharomyces cerevisiae
aaaggaagaagaaaagaacaaagc

SEQ ID NO: 739 - DNA, 24 bp, Saccharomyces cerevisiae
aatcctgtcctttttcctgttaaa

SEQ ID NO: 740 - DNA, 26 bp, Saccharomyces cerevisiae
tgagcgatagatactacagttttttg

SEQ ID NO: 741 - DNA, 27 bp, Saccharomyces cerevisiae
aaaatacatcttttctcaagcattttt

SEQ ID NO: 742 - DNA, 27 bp, Saccharomyces cerevisiae
agttcagtaatataatacattgttctc

SEQ ID NO: 743 - DNA, 27 bp, Saccharomyces cerevisiae
taagtgatacctgtacactatggttcc

SEQ ID NO: 744 - DNA, 20 bp, Saccharomyces cerevisiae
gtgcaaaagttgcgtgaatc

SEQ ID NO: 745 - DNA, 20 bp, Saccharomyces cerevisiae
ttagcatgcattttcccctt

SEQ ID NO: 746 - DNA, 27 bp, Saccharomyces cerevisiae
aaaataataatacattaactaaacact

SEQ ID NO: 747 - DNA, 19 bp, Saccharomyces cerevisiae
ataggcccgcttgcatcat

SEQ ID NO: 748 - DNA, 20 bp, Saccharomyces cerevisiae
cggaaagcggttattaaggt

SEQ ID NO: 749 - DNA, 26 bp, Saccharomyces cerevisiae
gcattgtaaacttactcaatgacaga

SEQ ID NO: 750 - DNA, 26 bp, Saccharomyces cerevisiae
tgaaaagaaaggatagaactaatgaa

SEQ ID NO: 751 - DNA, 19 bp, Saccharomyces cerevisiae
tcgttggcctcggtatcac

SEQ ID NO: 752 - DNA, 24 bp, Saccharomyces cerevisiae
aaaaacttcctttgtaactgatgg

SEQ ID NO: 753 - DNA, 27 bp, Saccharomyces cerevisiae
tgctaagcagttatattcagttagaag

SEQ ID NO: 754 - DNA, 22 bp, Saccharomyces cerevisiae
tacgtataacacgatgatcaaa

SEQ ID NO: 755 - DNA, 26 bp, Saccharomyces cerevisiae
gcttaaattgaaaatgagaaattttg

SEQ ID NO: 756 - DNA, 25 bp, Saccharomyces cerevisiae
tatttaatgcggtacataagaatgc

SEQ ID NO: 757 - DNA, 24 bp, Saccharomyces cerevisiae
gtaggtctttttaaacgaacgaaa

SEQ ID NO: 758 - DNA, 20 bp, Saccharomyces cerevisiae
cgaggctctcctttcatcat

SEQ ID NO: 759 - DNA, 25 bp, Saccharomyces cerevisiae
aaaaacattagaaaaaattctcgtt

SEQ ID NO: 760 - DNA, 27 bp, Saccharomyces cerevisiae
taaagtgtgttcactcatctaatatgc

SEQ ID NO: 761 - DNA, 26 bp, Saccharomyces cerevisiae
ctcaaataaactgagataaatgctgg

SEQ ID NO: 762 - DNA, 27 bp, Saccharomyces cerevisiae
aaatgaatagaacaatcacatatgacc

SEQ ID NO: 763 - DNA, 19 bp, Saccharomyces cerevisiae
tggtgaaacaattcctggc

SEQ ID NO: 764 - DNA, 20 bp, Saccharomyces cerevisiae
tacaattcaaccgaggagca

SEQ ID NO: 765 - DNA, 22 bp, Saccharomyces cerevisiae
tttcggaattacctaaaatggg

SEQ ID NO: 766 - DNA, 25 bp, Saccharomyces cerevisiae
tgaatgacatgtacctttcctgtat

SEQ ID NO: 767 - DNA, 22 bp, Saccharomyces cerevisiae
cccggattataatacactccca

SEQ ID NO: 768 - DNA, 26 bp, Saccharomyces cerevisiae
ttacgtaaacgataatatgttcctga

SEQ ID NO: 769 - DNA, 25 bp, Saccharomyces cerevisiae
aaggctttttattcctttgtttact

SEQ ID NO: 770 - DNA, 25 bp, Saccharomyces cerevisiae
aatcaaacgaaaagtaggtatctga

SEQ ID NO: 771 - DNA, 24 bp, Saccharomyces cerevisiae
tttttgtcacatgtacacactcat

SEQ ID NO: 772 - DNA, 26 bp, Saccharomyces cerevisiae
tatggattgtcggatattttattctt

SEQ ID NO: 773 - DNA, 20 bp, Saccharomyces cerevisiae
cgattatgtctcgttgctga

SEQ ID NO: 774 - DNA, 22 bp, Saccharomyces cerevisiae
tgtaccaacctgcatttctttc

SEQ ID NO: 775 - DNA, 22 bp, Saccharomyces cerevisiae
gtagcttttccttctgtctgga

SEQ ID NO: 776 - DNA, 25 bp, Saccharomyces cerevisiae
agttgttagagaggggaaaataaat

SEQ ID NO: 777 - DNA, 25 bp, Saccharomyces cerevisiae
cgtgcagtaattttcatttttatca

SEQ ID NO: 778 - DNA, 22 bp, Saccharomyces cerevisiae
aatgacggaaaacgagaatatg

SEQ ID NO: 779 - DNA, 18 bp, Saccharomyces cerevisiae
acaaacggctgagacggg

SEQ ID NO: 780 - DNA, 24 bp, Saccharomyces cerevisiae
gggtttataatcaagatgtatccg

SEQ ID NO: 781 - DNA, 19 bp, Saccharomyces cerevisiae
tcaagtcctcatgggcaaa

SEQ ID NO: 782 - DNA, 26 bp, Saccharomyces cerevisiae
ttacataaaggtaaataccaacgtca

SEQ ID NO: 783 - DNA, 22 bp, Saccharomyces cerevisiae
aaaaattgaatccttagcaggc

SEQ ID NO: 784 - DNA, 22 bp, Saccharomyces cerevisiae
tgaatataaagcgggaattttt

SEQ ID NO: 785 - DNA, 20 bp, Saccharomyces cerevisiae
acggcttcacttgcttcgta

SEQ ID NO: 786 - DNA, 23 bp, Saccharomyces cerevisiae
acgtaaaagaaaatcgaaacaaa

SEQ ID NO: 787 - DNA, 21 bp, Saccharomyces cerevisiae
taacgccgtatcgtgattaac

SEQ ID NO: 788 - DNA, 26 bp, Saccharomyces cerevisiae
ttgtagtgtttttctctttctctcat

SEQ ID NO: 789 - DNA, 25 bp, Saccharomyces cerevisiae
tactaaatagacaagaacaagcatt

SEQ ID NO: 790 - DNA, 21 bp, Saccharomyces cerevisiae
agtacaaggggatttcgatga

SEQ ID NO: 791 - DNA, 20 bp, Saccharomyces cerevisiae
tgatcggttttgcttctcaa

SEQ ID NO: 792 - DNA, 24 bp, Saccharomyces cerevisiae
gacaaagcttagactatttagcat

SEQ ID NO: 793 - DNA, 26 bp, Saccharomyces cerevisiae
aaataattgatagagggaagaactcc

SEQ ID NO: 794 - DNA, 24 bp, Saccharomyces cerevisiae
cgagctttctatttctcctactgt

SEQ ID NO: 795 - DNA, 25 bp, Saccharomyces cerevisiae
tgaagttagctagttccttttacga

SEQ ID NO: 796 - DNA, 23 bp, Saccharomyces cerevisiae
cgaaaaatgattattgactgtgc

SEQ ID NO: 797 - DNA, 24 bp, Saccharomyces cerevisiae
aaattttcaggtttgcaaataaaa

SEQ ID NO: 798 - DNA, 27 bp, Saccharomyces cerevisiae
tacgactgattagtgatgtgataaaga

SEQ ID NO: 799 - DNA, 27 bp, Saccharomyces cerevisiae
aataataagtaataaaaaggtgaatcg

SEQ ID NO: 800 - DNA, 25 bp, Saccharomyces cerevisiae
gtcatgggttaattaaggttacaaa

SEQ ID NO: 801 - DNA, 22 bp, Saccharomyces cerevisiae
tttcaagtgaataagattcgcc

SEQ ID NO: 802 - DNA, 27 bp, Saccharomyces cerevisiae
tgtaaaataaatagtgtcattagagaa

SEQ ID NO: 803 - DNA, 25 bp, Saccharomyces cerevisiae
tgactaccagtaattgtctctctgc

SEQ ID NO: 804 - DNA, 20 bp, Saccharomyces cerevisiae
atgtttgcttgagccacacg

SEQ ID NO: 805 - DNA, 27 bp, Saccharomyces cerevisiae
gtcaattaaaagcaaagtaaaagaaaa

SEQ ID NO: 806 - DNA, 22 bp, Saccharomyces cerevisiae
agcaatgttgtccttaccaaga

SEQ ID NO: 807 - DNA, 24 bp, Saccharomyces cerevisiae
tcttaaaaaaaaaaaaaatagaaa

SEQ ID NO: 808 - DNA, 25 bp, Saccharomyces cerevisiae
ttactattaaaatcacggaacgaaa

SEQ ID NO: 809 - DNA, 21 bp, Saccharomyces cerevisiae
tctaagatccgcatttatcgc

SEQ ID NO: 810 - DNA, 24 bp, Saccharomyces cerevisiae
tttgttatcactcctatcgacgag

SEQ ID NO: 811 - DNA, 20 bp, Saccharomyces cerevisiae
ccggctatatcaatgcacct

SEQ ID NO: 812 - DNA, 20 bp, Saccharomyces cerevisiae
aaactcgccctctctttcat

SEQ ID NO: 813 - DNA, 27 bp, Saccharomyces cerevisiae
agtaaggcatgtgttctttaactattc

SEQ ID NO: 814 - DNA, 22 bp, Saccharomyces cerevisiae
tacacatggtggtatgcatttt

SEQ ID NO: 815 - DNA, 20 bp, Saccharomyces cerevisiae
tcattagactaaaagtgatt

SEQ ID NO: 816 - DNA, 23 bp, Saccharomyces cerevisiae
aatctcaattcgcaatgattctc

SEQ ID NO: 817 - DNA, 26 bp, Saccharomyces cerevisiae
cgttagatcgaaattctttctcaaaa

SEQ ID NO: 818 - DNA, 23 bp, Saccharomyces cerevisiae
acacgagattatcctagtcggaa

SEQ ID NO: 819 - DNA, 27 bp, Saccharomyces cerevisiae
actccagcattataaagcatatctaac

SEQ ID NO: 820 - DNA, 24 bp, Saccharomyces cerevisiae
ctgtgctttatctcaagaactgtc

SEQ ID NO: 821 - DNA, 24 bp, Saccharomyces cerevisiae
aatctggagtagtgataataacat

SEQ ID NO: 822 - DNA, 18 bp, Saccharomyces cerevisiae
gcgggcctgatgtcttgt

SEQ ID NO: 823 - DNA, 20 bp, Saccharomyces cerevisiae
tgatcgtcagcacattaggc

SEQ ID NO: 824 - DNA, 27 bp, Saccharomyces cerevisiae
ttcttattttcaaggttttaaagttgt

SEQ ID NO: 825 - DNA, 27 bp, Saccharomyces cerevisiae
aaaagaacagtaagaaagaagacaaaa

SEQ ID NO: 826 - DNA, 21 bp, Saccharomyces cerevisiae
aggcctctcacacttgcaaaa

SEQ ID NO: 827 - DNA, 23 bp, Saccharomyces cerevisiae
attgctgatattgccgtaatttt

SEQ ID NO: 828 - DNA, 27 bp, Saccharomyces cerevisiae
tgtttatttaaattatattttggggtc

SEQ ID NO: 829 - DNA, 27 bp, Saccharomyces cerevisiae
gtaatacttcgtagtcaaagtgtgctt

SEQ ID NO: 830 - DNA, 21 bp, Saccharomyces cerevisiae
aggaaatggaacaacgaattt

SEQ ID NO: 831 - DNA, 22 bp, Saccharomyces cerevisiae
aacgggctatccatattacatc

SEQ ID NO: 832 - DNA, 19 bp, Saccharomyces cerevisiae
gcgtttggttaaatacccg

SEQ ID NO: 833 - DNA, 24 bp, Saccharomyces cerevisiae
tgaaaaaggtacttactgcactgt

SEQ ID NO: 834 - DNA, 23 bp, Saccharomyces cerevisiae
tagcactttcatgcctgactacg

SEQ ID NO: 835 - DNA, 18 bp, Saccharomyces cerevisiae
taattgtgccgccgttcc

SEQ ID NO: 836 - DNA, 24 bp, Saccharomyces cerevisiae
caggctttatgacgttttactgtt

SEQ ID NO: 837 - DNA, 25 bp, Saccharomyces cerevisiae
ttaatgatactcaatatggaaagcc

SEQ ID NO: 838 - DNA, 24 bp, Saccharomyces cerevisiae
ggtagacagagaaacgaaagaagt

SEQ ID NO: 839 - DNA, 25 bp, Saccharomyces cerevisiae
ataacattaaaaaatagaaaaagaa

SEQ ID NO: 840 - DNA, 23 bp, Saccharomyces cerevisiae
ttgtaaggctagaggaaaacgta

SEQ ID NO: 841 - DNA, 26 bp, Saccharomyces cerevisiae
aaaacaaacgaatatagtttgaacac

SEQ ID NO: 842 - DNA, 27 bp, Saccharomyces cerevisiae
aatatacgaactctaaggaaaaatacg

SEQ ID NO: 843 - DNA, 24 bp, Saccharomyces cerevisiae
ataatagtacatacaggtgcgccg

SEQ ID NO: 844 - DNA, 27 bp, Saccharomyces cerevisiae
atatactccaatttcaaagacaaacca

SEQ ID NO: 845 - DNA, 20 bp, Saccharomyces cerevisiae
actgcaagcaaaacaacagc

SEQ ID NO: 846 - DNA, 23 bp, Saccharomyces cerevisiae
agcaaagagtgagtttattacaa

SEQ ID NO: 847 - DNA, 22 bp, Saccharomyces cerevisiae
gtaagaagtactccccatcgga

SEQ ID NO: 848 - DNA, 26 bp, Saccharomyces cerevisiae
ctattcactcggaatgttacttgaaa

SEQ ID NO: 849 - DNA, 23 bp, Saccharomyces cerevisiae
tatatagtctttttgccctggtg

SEQ ID NO: 850 - DNA, 19 bp, Saccharomyces cerevisiae
acctcttgcagcacgaatc

SEQ ID NO: 851 - DNA, 24 bp, Saccharomyces cerevisiae
ttgaaaatttataccgctttacca

SEQ ID NO: 852 - DNA, 26 bp, Saccharomyces cerevisiae
attgtgttactaaaattacgcattta

SEQ ID NO: 853 - DNA, 20 bp, Saccharomyces cerevisiae
actgggatagtcccccattt

SEQ ID NO: 854 - DNA, 27 bp, Saccharomyces cerevisiae
cctattccaaatagacaattatatggc

SEQ ID NO: 855 - DNA, 22 bp, Saccharomyces cerevisiae
aggtgctagcctacacagaaaa

SEQ ID NO: 856 - DNA, 20 bp, Saccharomyces cerevisiae
taactggcatgcagtctaaa

SEQ ID NO: 857 - DNA, 21 bp, Saccharomyces cerevisiae
ggaggttcagtgggataattg

SEQ ID NO: 858 - DNA, 23 bp, Saccharomyces cerevisiae
aacactcattaaagtgtgggctg

SEQ ID NO: 859 - DNA, 25 bp, Saccharomyces cerevisiae
atgtgcacactatttttctcaatta

SEQ ID NO: 860 - DNA, 22 bp, Saccharomyces cerevisiae
caacagatgaccaagttcgttg

SEQ ID NO: 861 - DNA, 22 bp, Saccharomyces cerevisiae
tcgatgaattaaaacggtttcc

SEQ ID NO: 862 - DNA, 27 bp, Saccharomyces cerevisiae
taattttataacccagttctatattgc

SEQ ID NO: 863 - DNA, 25 bp, Saccharomyces cerevisiae
acatgaagttagcaatcatctcttg

SEQ ID NO: 864 - DNA, 26 bp, Saccharomyces cerevisiae
taatacttgaacaacaaaatgtttca

SEQ ID NO: 865 - DNA, 20 bp, Saccharomyces cerevisiae
cgtccccatgttttctttta

SEQ ID NO: 866 - DNA, 21 bp, Saccharomyces cerevisiae
tcgccagaataatgacatgag

SEQ ID NO: 867 - DNA, 19 bp, Saccharomyces cerevisiae
gtgggctgcctcttttctc

SEQ ID NO: 868 - DNA, 21 bp, Saccharomyces cerevisiae
tgaatcaaattaccggtttgc

SEQ ID NO: 869 - DNA, 27 bp, Saccharomyces cerevisiae
gaggagagcaactaagcaagtactatt

SEQ ID NO: 870 - DNA, 26 bp, Saccharomyces cerevisiae
caccattacaaagacaaagaagaaaa

SEQ ID NO: 871 - DNA, 25 bp, Saccharomyces cerevisiae
tacgtatacgaattccttcaacaaa

SEQ ID NO: 872 - DNA, 20 bp, Saccharomyces cerevisiae
aactttgcccttttgcttcc

SEQ ID NO: 873 - DNA, 26 bp, Saccharomyces cerevisiae
atagttttataccaaatacatcatgc

SEQ ID NO: 874 - DNA, 18 bp, Saccharomyces cerevisiae
ctacgcccaacccaacca

SEQ ID NO: 875 - DNA, 20 bp, Saccharomyces cerevisiae
ctatgaagccgccgaaaaat

SEQ ID NO: 876 - DNA, 22 bp, Saccharomyces cerevisiae
gacttttgtttgctggagaaag

SEQ ID NO: 877 - DNA, 22 bp, Saccharomyces cerevisiae
atgagatggtaagatgtgtgat

SEQ ID NO: 878 - DNA, 21 bp, Saccharomyces cerevisiae
aaatgaagcgtcaacttcaaa

SEQ ID NO: 879 - DNA, 23 bp, Saccharomyces cerevisiae
agaaatatgaataagcacgagcc

SEQ ID NO: 880 - DNA, 27 bp, Saccharomyces cerevisiae
gtacttagttattgttcggagttgttt

SEQ ID NO: 881 - DNA, 25 bp, Saccharomyces cerevisiae
tgcaattatgtcgttatattcacaa

SEQ ID NO: 882 - DNA, 23 bp, Saccharomyces cerevisiae
tcattctaccatctttcatgtcc

SEQ ID NO: 883 - DNA, 25 bp, Saccharomyces cerevisiae
gaattatcgttgttagcatgatttt

SEQ ID NO: 884 - DNA, 27 bp, Saccharomyces cerevisiae
taaactgtaccttgtctacaaagattg

SEQ ID NO: 885 - DNA, 23 bp, Saccharomyces cerevisiae
atgcacagctaaaacagagacaa

SEQ ID NO: 886 - DNA, 24 bp, Saccharomyces cerevisiae
ttggtttcgatgtactcttttgtt

SEQ ID NO: 887 - DNA, 27 bp, Saccharomyces cerevisiae
aaatataaaggctctccagttgttacc

SEQ ID NO: 888 - DNA, 26 bp, Saccharomyces cerevisiae
ggaagcgtactagaaaatacctctat

SEQ ID NO: 889 - DNA, 24 bp, Saccharomyces cerevisiae
gctcatctttcatctagtggtttc

SEQ ID NO: 890 - DNA, 21 bp, Saccharomyces cerevisiae
attcgctcatgtttcttcgag

SEQ ID NO: 891 - DNA, 27 bp, Saccharomyces cerevisiae
caagagctataatcttcgtcatgtact

SEQ ID NO: 892 - DNA, 27 bp, Saccharomyces cerevisiae
tttttgtaactgtaatttcactcatgc

SEQ ID NO: 893 - DNA, 23 bp, Saccharomyces cerevisiae
tgagctctttagaaaactgaacg

SEQ ID NO: 894 - DNA, 27 bp, Saccharomyces cerevisiae
gcactttaaatacaataaatcgtgtaa

SEQ ID NO: 895 - DNA, 25 bp, Saccharomyces cerevisiae
tggttctgaagaataagagagaaga

SEQ ID NO: 896 - DNA, 19 bp, Saccharomyces cerevisiae
atcatccaaaacccagcat

SEQ ID NO: 897 - DNA, 25 bp, Saccharomyces cerevisiae
cacatagacagatgacgagtagctt

SEQ ID NO: 898 - DNA, 20 bp, Saccharomyces cerevisiae
gaccaaaaataaaagcacgc

SEQ ID NO: 899 - DNA, 27 bp, Saccharomyces cerevisiae
tgcaattactaacgataattcttctga

SEQ ID NO: 900 - DNA, 25 bp, Saccharomyces cerevisiae
gcttcccacagtaataataacaagt

SEQ ID NO: 901 - DNA, 24 bp, Saccharomyces cerevisiae
ttttatatccaaaagcagcaagaa

SEQ ID NO: 902 - DNA, 22 bp, Saccharomyces cerevisiae
atgtacatacacacgcaccatt

SEQ ID NO: 903 - DNA, 24 bp, Saccharomyces cerevisiae
tgcacactgaaatctaatagttgg

SEQ ID NO: 904 - DNA, 20 bp, Saccharomyces cerevisiae
caagaataaacgcaggttgg

SEQ ID NO: 905 - DNA, 20 bp, Saccharomyces cerevisiae
tgagcgcaatttgctaaaaa

SEQ ID NO: 906 - DNA, 27 bp, Saccharomyces cerevisiae
gcatagatatgacgttttattaccttt

SEQ ID NO: 907 - DNA, 19 bp, Saccharomyces cerevisiae
cgactttccaccattttcg

SEQ ID NO: 908 - DNA, 20 bp, Saccharomyces cerevisiae
cgcaaagaaacgcagcatag

SEQ ID NO: 909 - DNA, 27 bp, Saccharomyces cerevisiae
catgcatagtgatgataatgaatttag

SEQ ID NO: 910 - DNA, 24 bp, Saccharomyces cerevisiae
cattacgctccttcgtattactca

SEQ ID NO: 911 - DNA, 18 bp, Saccharomyces cerevisiae
taggaagggcagaccagg

SEQ ID NO: 912 - DNA, 27 bp, Saccharomyces cerevisiae
tgataaagcgatttttatacttttctc

SEQ ID NO: 913 - DNA, 26 bp, Saccharomyces cerevisiae
gtggcatgatagagttaaaatatgtg

SEQ ID NO: 914 - DNA, 24 bp, Saccharomyces cerevisiae
aagaacaaatgagggatctagtgt

SEQ ID NO: 915 - DNA, 25 bp, Saccharomyces cerevisiae
aaacgttatctttgatttatattct

SEQ ID NO: 916 - DNA, 23 bp, Saccharomyces cerevisiae
tgaataagaagataaccgggaca

SEQ ID NO: 917 - DNA, 21 bp, Saccharomyces cerevisiae
ccagaagagttaagatgcccg

SEQ ID NO: 918 - DNA, 26 bp, Saccharomyces cerevisiae
agagcacctttcatgtataatctgtg

SEQ ID NO: 919 - DNA, 22 bp, Saccharomyces cerevisiae
atacaatattcacggcatgcaa

SEQ ID NO: 920 - DNA, 22 bp, Saccharomyces cerevisiae
gaagtaatgattagggcgatca

SEQ ID NO: 921 - DNA, 26 bp, Saccharomyces cerevisiae
catgaagattagatttattggagaaa

SEQ ID NO: 922 - DNA, 25 bp, Saccharomyces cerevisiae
tttgttgattgtcatcagttttagt

SEQ ID NO: 923 - DNA, 26 bp, Saccharomyces cerevisiae
aagaactttatatatcatgtagccaa

SEQ ID NO: 924 - DNA, 24 bp, Saccharomyces cerevisiae
tttgaacctcattgtattttacgg

SEQ ID NO: 925 - DNA, 22 bp, Saccharomyces cerevisiae
gtcgaataaattgttctccggt

SEQ ID NO: 926 - DNA, 23 bp, Saccharomyces cerevisiae
gaagtcttttccagttttcctga

SEQ ID NO: 927 - DNA, 24 bp, Saccharomyces cerevisiae
aactttatggatgattgcgatatt

SEQ ID NO: 928 - DNA, 20 bp, Saccharomyces cerevisiae
caggccttagaggcactacc

SEQ ID NO: 929 - DNA, 27 bp, Saccharomyces cerevisiae
ttaaataacgtacttgctcttcgtaca

SEQ ID NO: 930 - DNA, 20 bp, Saccharomyces cerevisiae
aagagcattgggcagagagt

SEQ ID NO: 931 - DNA, 25 bp, Saccharomyces cerevisiae
aggagaagctagtgtatccaatgtt

SEQ ID NO: 932 - DNA, 25 bp, Saccharomyces cerevisiae
acttttgggtaattatgatgtgaat

SEQ ID NO: 933 - DNA, 25 bp, Saccharomyces cerevisiae
gcttatccttttacttcaatcaccc

SEQ ID NO: 934 - DNA, 18 bp, Saccharomyces cerevisiae
tttgaatgagcggcatgg

SEQ ID NO: 935 - DNA, 20 bp, Saccharomyces cerevisiae
aatttcccacggatgggagt

SEQ ID NO: 936 - DNA, 26 bp, Saccharomyces cerevisiae
aaaagaaaatagttgtacttgatccc

SEQ ID NO: 937 - DNA, 23 bp, Saccharomyces cerevisiae
aacgagcagtctaagaacctgaa

SEQ ID NO: 938 - DNA, 19 bp, Saccharomyces cerevisiae
tgatcgggtgcactatcac

SEQ ID NO: 939 - DNA, 26 bp, Saccharomyces cerevisiae
aaacagaactgttcaaagaaagatga

SEQ ID NO: 940 - DNA, 20 bp, Saccharomyces cerevisiae
tttcacgaagaagaaggcca

SEQ ID NO: 941 - DNA, 20 bp, Saccharomyces cerevisiae
tgtggtaaacaagatggccc

SEQ ID NO: 942 - DNA, 23 bp, Saccharomyces cerevisiae
gtcacctactcttagcgcatttt

SEQ ID NO: 943 - DNA, 27 bp, Saccharomyces cerevisiae
aaagtagaaagaaatacgaatacgaaa

SEQ ID NO: 944 - DNA, 21 bp, Saccharomyces cerevisiae
acgagctagtttgtaacttca

SEQ ID NO: 945 - DNA, 21 bp, Saccharomyces cerevisiae
ttagaacagaaccgggctaat

SEQ ID NO: 946 - DNA, 27 bp, Saccharomyces cerevisiae
cggtaactaacatatatcttctcaaaa

SEQ ID NO: 947 - DNA, 26 bp, Saccharomyces cerevisiae
tagttatcatgtttcttatcccctcc

SEQ ID NO: 948 - DNA, 23 bp, Saccharomyces cerevisiae
ttatgtgttgcttatggttttga

SEQ ID NO: 949 - DNA, 23 bp, Saccharomyces cerevisiae
gtcttttaacggaataagcttcg

SEQ ID NO: 950 - DNA, 26 bp, Saccharomyces cerevisiae
tcatatccattcatatcatttagtgc

SEQ ID NO: 951 - DNA, 27 bp, Saccharomyces cerevisiae
ttgtatttgtatgtgtttatgtgtttg

SEQ ID NO: 952 - DNA, 25 bp, Saccharomyces cerevisiae
aaaaaaaaaaaaaaacataaggaaa

SEQ ID NO: 953 - DNA, 22 bp, Saccharomyces cerevisiae
tctgtttatccgtcatattccc

SEQ ID NO: 954 - DNA, 26 bp, Saccharomyces cerevisiae
tgtcataagaagacaataagaaaagc

SEQ ID NO: 955 - DNA, 27 bp, Saccharomyces cerevisiae
tgactatctctctcttcatagtcttcc

SEQ ID NO: 956 - DNA, 21 bp, Saccharomyces cerevisiae
ggagtgatgcctttacgaatg

SEQ ID NO: 957 - DNA, 27 bp, Saccharomyces cerevisiae
tatatttaattcaaacttaactaatgg

SEQ ID NO: 958 - DNA, 21 bp, Saccharomyces cerevisiae
aagaaaaaggggaacgagaga

SEQ ID NO: 959 - DNA, 26 bp, Saccharomyces cerevisiae
cgtaaaaatgaattcttgtcttgcat

SEQ ID NO: 960 - DNA, 26 bp, Saccharomyces cerevisiae
tttcattactagacagatgaaacgaa

SEQ ID NO: 961 - DNA, 19 bp, Saccharomyces cerevisiae
tagggatacttcctccccg

SEQ ID NO: 962 - DNA, 24 bp, Saccharomyces cerevisiae
ttgctgattcttacctcatttttg

SEQ ID NO: 963 - DNA, 24 bp, Saccharomyces cerevisiae
cttttcaacgtaggtttctgtttt

SEQ ID NO: 964 - DNA, 24 bp, Saccharomyces cerevisiae
atcatctgaggatgttttcttttt

SEQ ID NO: 965 - DNA, 25 bp, Saccharomyces cerevisiae
aaaatatttgcatatcaagggaagg

SEQ ID NO: 966 - DNA, 24 bp, Saccharomyces cerevisiae
tcttggctgtagcacttatacaaa

SEQ ID NO: 967 - DNA, 20 bp, Saccharomyces cerevisiae
tcggtcaacaacaaagccct

SEQ ID NO: 968 - DNA, 26 bp, Saccharomyces cerevisiae
ttctatcatagtatgtcgcctgtaaa

SEQ ID NO: 969 - DNA, 21 bp, Saccharomyces cerevisiae
tccccataaaaacaagcattt

SEQ ID NO: 970 - DNA, 26 bp, Saccharomyces cerevisiae
caaaactgatttgtttttatctttga

SEQ ID NO: 971 - DNA, 27 bp, Saccharomyces cerevisiae
ccaacatattaagaaatctggagtaca

SEQ ID NO: 972 - DNA, 20 bp, Saccharomyces cerevisiae
gtgctaagtggcgccttact

SEQ ID NO: 973 - DNA, 27 bp, Saccharomyces cerevisiae
agaacaacctaattttattacccaaaa

SEQ ID NO: 974 - DNA, 23 bp, Saccharomyces cerevisiae
taactagacaaggttcgtccacc

SEQ ID NO: 975 - DNA, 26 bp, Saccharomyces cerevisiae
atgctatataaatataataacaatcg

SEQ ID NO: 976 - DNA, 26 bp, Saccharomyces cerevisiae
acctgaccattattgtgaatataagc

SEQ ID NO: 977 - DNA, 21 bp, Saccharomyces cerevisiae
ttgtaagaaagaggcggtacg

SEQ ID NO: 978 - DNA, 22 bp, Saccharomyces cerevisiae
gataatggaattttcttcgcca

SEQ ID NO: 979 - DNA, 27 bp, Saccharomyces cerevisiae
acacctatcatggttaaatcatacaca

SEQ ID NO: 980 - DNA, 22 bp, Saccharomyces cerevisiae
gagagaacacagaaaaagcagg

SEQ ID NO: 981 - DNA, 26 bp, Saccharomyces cerevisiae
agcaaatattgatatacatggaagag

SEQ ID NO: 982 - DNA, 27 bp, Saccharomyces cerevisiae
ctttatagtagcgcctttttatattcc

SEQ ID NO: 983 - DNA, 24 bp, Saccharomyces cerevisiae
tggtgtagtaaggatactggaacc

SEQ ID NO: 984 - DNA, 25 bp, Saccharomyces cerevisiae
cgcgagatctaatattaacgaaaaa

SEQ ID NO: 985 - DNA, 26 bp, Saccharomyces cerevisiae
tatggcctcataaaaatatttgcttc

SEQ ID NO: 986 - DNA, 24 bp, Saccharomyces cerevisiae
aattagaagaatcagcatcatcaa

SEQ ID NO: 987 - DNA, 21 bp, Saccharomyces cerevisiae
gcttattgagccttcccttca

SEQ ID NO: 988 - DNA, 27 bp, Saccharomyces cerevisiae
tataattcatcttaacttcttatattg

SEQ ID NO: 989 - DNA, 26 bp, Saccharomyces cerevisiae
ggcttttgaattactacaactattcc

SEQ ID NO: 990 - DNA, 24 bp, Saccharomyces cerevisiae
tcaatatgcgaaccatataagcta

SEQ ID NO: 991 - DNA, 26 bp, Saccharomyces cerevisiae
atgagcctctgagcagtataaattgt

SEQ ID NO: 992 - DNA, 27 bp, Saccharomyces cerevisiae
atgcatatggaagtttttgttatcttt

SEQ ID NO: 993 - DNA, 24 bp, Saccharomyces cerevisiae
atagtgtttgctccccttactttt

SEQ ID NO: 994 - DNA, 21 bp, Saccharomyces cerevisiae
agcggaagcattttattcacc

SEQ ID NO: 995 - DNA, 23 bp, Saccharomyces cerevisiae
agacaaacgccaatttaatgaag

SEQ ID NO: 996 - DNA, 24 bp, Saccharomyces cerevisiae
actattatgcattacactttcccc

SEQ ID NO: 997 - DNA, 18 bp, Saccharomyces cerevisiae
ttcgctgctggtgtcgtt

SEQ ID NO: 998 - DNA, 26 bp, Saccharomyces cerevisiae
cacatgtatagcataatcttcgattc

SEQ ID NO: 999 - DNA, 27 bp, Saccharomyces cerevisiae
gtctccaaatgaaaagaagaataaaaa

SEQ ID NO: 1000 - DNA, 26 bp, Saccharomyces cerevisiae
gttccgacatagtatctaatcaattt

SEQ ID NO: 1001 - DNA, 21 bp, Saccharomyces cerevisiae
taaaacaattcatcggtccgt

SEQ ID NO: 1002 - DNA, 22 bp, Saccharomyces cerevisiae
aacaaccaatatatgcatgggc

SEQ ID NO: 1003 - DNA, 21 bp, Saccharomyces cerevisiae
ttcggtgaaccctgttaaaat

SEQ ID NO: 1004 - DNA, 20 bp, Saccharomyces cerevisiae
gcccgaatcagatactcaaa

SEQ ID NO: 1005 - DNA, 26 bp, Saccharomyces cerevisiae
tgatattgtccttacaataaagcctg

SEQ ID NO: 1006 - DNA, 25 bp, Saccharomyces cerevisiae
ttttaaagctattgaaaaagatgcg

SEQ ID NO: 1007 - DNA, 26 bp, Saccharomyces cerevisiae
catatctagattgcatgttttatatt

SEQ ID NO: 1008 - DNA, 27 bp, Saccharomyces cerevisiae
tacataatacgcatatttaaacacaca

SEQ ID NO: 1009 - DNA, 23 bp, Saccharomyces cerevisiae
agaacttggtgaattttgaagca

SEQ ID NO: 1010 - DNA, 24 bp, Saccharomyces cerevisiae
caagagcattgaagaaatgaaaaa

SEQ ID NO: 1011 - DNA, 23 bp, Saccharomyces cerevisiae
aactacaacccagtaaaaaaaga

SEQ ID NO: 1012 - DNA, 26 bp, Saccharomyces cerevisiae
ttgtaaggagaacgataaagtaacaa

SEQ ID NO: 1013 - DNA, 23 bp, Saccharomyces cerevisiae
cagaaagaataaaataacagact

SEQ ID NO: 1014 - DNA, 22 bp, Saccharomyces cerevisiae
tctgttatttagtgttaaatgc

SEQ ID NO: 1015 - DNA, 27 bp, Saccharomyces cerevisiae
tgaacgtcattacttacctttttattt

SEQ ID NO: 1016 - DNA, 26 bp, Saccharomyces cerevisiae
ataactacgtatagtcctttggttcg

SEQ ID NO: 1017 - DNA, 20 bp, Saccharomyces cerevisiae
taacccagttttcacctggc

SEQ ID NO: 1018 - DNA, 20 bp, Saccharomyces cerevisiae
aaagcaactcctggatcgtt

SEQ ID NO: 1019 - DNA, 23 bp, Saccharomyces cerevisiae
gttcgtggctatatatgcacttg

SEQ ID NO: 1020 - DNA, 26 bp, Saccharomyces cerevisiae
tagaacgcttcgtcattagatataca

SEQ ID NO: 1021 - DNA, 21 bp, Saccharomyces cerevisiae
atccagcaaggatcgttaccc

SEQ ID NO: 1022 - DNA, 25 bp, Saccharomyces cerevisiae
tacgaaaatgcatgagatagtaagg

SEQ ID NO: 1023 - DNA, 26 bp, Saccharomyces cerevisiae
ttaaaacttgcttttaatctgcatac

SEQ ID NO: 1024 - DNA, 26 bp, Saccharomyces cerevisiae
tttagtttagacgactgcataaatgg

SEQ ID NO: 1025 - DNA, 26 bp, Saccharomyces cerevisiae
tagggatagataccacacatacctca

SEQ ID NO: 1026 - DNA, 27 bp, Saccharomyces cerevisiae
aaccatatttataggaatttcgatttg

SEQ ID NO: 1027 - DNA, 24 bp, Saccharomyces cerevisiae
tatctatttaattctttcaccgca

SEQ ID NO: 1028 - DNA, 27 bp, Saccharomyces cerevisiae
aaaatattcactgtcctctatttatgc

SEQ ID NO: 1029 - DNA, 27 bp, Saccharomyces cerevisiae
cttaaaatatatgacaaacttgccctg

SEQ ID NO: 1030 - DNA, 25 bp, Saccharomyces cerevisiae
aaacatgttcgttcgatatgttcaa

SEQ ID NO: 1031 - DNA, 27 bp, Saccharomyces cerevisiae
caaagtgataaattactgctagtctga

SEQ ID NO: 1032 - DNA, 22 bp, Saccharomyces cerevisiae
tatacaaacacccgaagcattg

SEQ ID NO: 1033 - DNA, 27 bp, Saccharomyces cerevisiae
tgaaacgaactaaaaagttatagagga

SEQ ID NO: 1034 - DNA, 22 bp, Saccharomyces cerevisiae
tttgtctaatcggggttgtatt

SEQ ID NO: 1035 - DNA, 27 bp, Saccharomyces cerevisiae
aatctcatataaactcccttccttaca

SEQ ID NO: 1036 - DNA, 25 bp, Saccharomyces cerevisiae
acgtaataactcttactaattctgt

SEQ ID NO: 1037 - DNA, 24 bp, Saccharomyces cerevisiae
aaacatcagttcgatacaacttgg

SEQ ID NO: 1038 - DNA, 22 bp, Saccharomyces cerevisiae
ggtccttgccttctatatctgc

SEQ ID NO: 1039 - DNA, 18 bp, Saccharomyces cerevisiae
gagtcctcgtaatccggg

SEQ ID NO: 1040 - DNA, 23 bp, Saccharomyces cerevisiae
tagtgaaagacgttgttgcttcc

SEQ ID NO: 1041 - DNA, 27 bp, Saccharomyces cerevisiae
gcatatataatgcacatttttaacatc

SEQ ID NO: 1042 - DNA, 23 bp, Saccharomyces cerevisiae
gtagaggtttcctgttttccttc

SEQ ID NO: 1043 - DNA, 24 bp, Saccharomyces cerevisiae
agaaagcatacattgaacatagcc

SEQ ID NO: 1044 - DNA, 21 bp, Saccharomyces cerevisiae
taaacttaggcgcatcaacag

SEQ ID NO: 1045 - DNA, 23 bp, Saccharomyces cerevisiae
taaatttgcttttcgtctcttgc

SEQ ID NO: 1046 - DNA, 27 bp, Saccharomyces cerevisiae
attatcatttactataaaatccctgcg

SEQ ID NO: 1047 - DNA, 24 bp, Saccharomyces cerevisiae
agaaacgaataaattctgaagaga

SEQ ID NO: 1048 - DNA, 23 bp, Saccharomyces cerevisiae
agctcgcaactcttttacatacc

SEQ ID NO: 1049 - DNA, 26 bp, Saccharomyces cerevisiae
tagataatatccagataaagcaaaaa

SEQ ID NO: 1050 - DNA, 27 bp, Saccharomyces cerevisiae
atattcttgtaaatatatgaggtcttt

SEQ ID NO: 1051 - DNA, 26 bp, Saccharomyces cerevisiae
caataaatctcctacgaacgaatagg

SEQ ID NO: 1052 - DNA, 22 bp, Saccharomyces cerevisiae
agtttttgtatcgcgatgtttg

SEQ ID NO: 1053 - DNA, 26 bp, Saccharomyces cerevisiae
aatattaaaccaaaaaattatgacaa

SEQ ID NO: 1054 - DNA, 27 bp, Saccharomyces cerevisiae
gttatgtgcaaagacaagtaacataca

SEQ ID NO: 1055 - DNA, 26 bp, Saccharomyces cerevisiae
cccattacgcatttgattataatttg

SEQ ID NO: 1056 - DNA, 21 bp, Saccharomyces cerevisiae
agacaaacgccaattttacga

SEQ ID NO: 1057 - DNA, 23 bp, Saccharomyces cerevisiae
attctttcacccatcattcaaaa

SEQ ID NO: 1058 - DNA, 27 bp, Saccharomyces cerevisiae
tctttctcagtgtttattttcttgagc

SEQ ID NO: 1059 - DNA, 26 bp, Saccharomyces cerevisiae
aatattggctcactatgtattttcaa

SEQ ID NO: 1060 - DNA, 26 bp, Saccharomyces cerevisiae
atttatcaactaccaagcttgaagga

SEQ ID NO: 1061 - DNA, 26 bp, Saccharomyces cerevisiae
attccaaaaaaaaaaaaaaaaaaaaa

SEQ ID NO: 1062 - DNA, 27 bp, Saccharomyces cerevisiae
gctatgtagtgctttcctaaacttaca

SEQ ID NO: 1063 - DNA, 25 bp, Saccharomyces cerevisiae
attataatcttgcaggtcttgattg

SEQ ID NO: 1064 - DNA, 21 bp, Saccharomyces cerevisiae
attatgcggaaatggtgttgg

SEQ ID NO: 1065 - DNA, 22 bp, Saccharomyces cerevisiae
ttgatattgcctttcagtcgaa

SEQ ID NO: 1066 - DNA, 20 bp, Saccharomyces cerevisiae
tctcttgtccacagcgaaga

SEQ ID NO: 1067 - DNA, 26 bp, Saccharomyces cerevisiae
tcctgtaattttaatgtacttacgca

SEQ ID NO: 1068 - DNA, 23 bp, Saccharomyces cerevisiae
atttgtgaggacaacgttaatca

SEQ ID NO: 1069 - DNA, 23 bp, Saccharomyces cerevisiae
taatatttaagctgcagcgtccc

SEQ ID NO: 1070 - DNA, 26 bp, Saccharomyces cerevisiae
tatagtacacatatttcaaacataca

SEQ ID NO: 1071 - DNA, 26 bp, Saccharomyces cerevisiae
acgcttgtatttaataatttgttcac

SEQ ID NO: 1072 - DNA, 27 bp, Saccharomyces cerevisiae
cttgacatttgattggtaaagagtatg

SEQ ID NO: 1073 - DNA, 21 bp, Saccharomyces cerevisiae
gtttattgaggttgtccgcga

SEQ ID NO: 1074 - DNA, 20 bp, Saccharomyces cerevisiae
tcagtaaacgcaaggcacaa

SEQ ID NO: 1075 - DNA, 26 bp, Saccharomyces cerevisiae
attattcacccaacaggtatgtaaaa

SEQ ID NO: 1076 - DNA, 21 bp, Saccharomyces cerevisiae
aaacgcaaaagaaatagggaa

SEQ ID NO: 1077 - DNA, 19 bp, Saccharomyces cerevisiae
tcgcgatatggacaaacac

SEQ ID NO: 1078 - DNA, 26 bp, Saccharomyces cerevisiae
tgacctcatatatgctagacttgact

SEQ ID NO: 1079 - DNA, 24 bp, Saccharomyces cerevisiae
agacaagaatgaataaattttgaa

SEQ ID NO: 1080 - DNA, 25 bp, Saccharomyces cerevisiae
ataagaatagtactgcttttccgca

SEQ ID NO: 1081 - DNA, 20 bp, Saccharomyces cerevisiae
tgaaggaaaaaggtcttggc

SEQ ID NO: 1082 - DNA, 27 bp, Saccharomyces cerevisiae
taataagaataatgggatttgttttct

SEQ ID NO: 1083 - DNA, 25 bp, Saccharomyces cerevisiae
aaaaataaatgaggaaacacacaca

SEQ ID NO: 1084 - DNA, 20 bp, Saccharomyces cerevisiae
tcacttgttactccgcaacg

SEQ ID NO: 1085 - DNA, 27 bp, Saccharomyces cerevisiae
ggtcactaaaactttgttattcctacg

SEQ ID NO: 1086 - DNA, 26 bp, Saccharomyces cerevisiae
gcaaagatataatcctcttatatagc

SEQ ID NO: 1087 - DNA, 25 bp, Saccharomyces cerevisiae
atgtaggaaagccaacagagtataa

SEQ ID NO: 1088 - DNA, 26 bp, Saccharomyces cerevisiae
tttgaaagaagaaaacataggaaacc

SEQ ID NO: 1089 - DNA, 26 bp, Saccharomyces cerevisiae
ttcttctggtaaactcttatccagtg

SEQ ID NO: 1090 - DNA, 22 bp, Saccharomyces cerevisiae
tagggaattggttcaaaagatg

SEQ ID NO: 1091 - DNA, 21 bp, Saccharomyces cerevisiae
atgcatgggcagaaataaaaa

SEQ ID NO: 1092 - DNA, 25 bp, Saccharomyces cerevisiae
atccacctttcttcttcactttaat

SEQ ID NO: 1093 - DNA, 21 bp, Saccharomyces cerevisiae
cgccataccacacataatctc

SEQ ID NO: 1094 - DNA, 24 bp, Saccharomyces cerevisiae
aaactccaactcctttacacagaa

SEQ ID NO: 1095 - DNA, 20 bp, Saccharomyces cerevisiae
cgcttaggcataatggtggt

SEQ ID NO: 1096 - DNA, 26 bp, Saccharomyces cerevisiae
aagtaacgagcacatttaacataaac

SEQ ID NO: 1097 - DNA, 19 bp, Saccharomyces cerevisiae
tgcggccctgtgaaaatac

SEQ ID NO: 1098 - DNA, 24 bp, Saccharomyces cerevisiae
tgagttaggcacttacgtatcttg

SEQ ID NO: 1099 - DNA, 23 bp, Saccharomyces cerevisiae
atttcacgaaaacaccttgtaaa

SEQ ID NO: 1100 - DNA, 25 bp, Saccharomyces cerevisiae
tcttgtgtcttgattcatatatccg

SEQ ID NO: 1101 - DNA, 21 bp, Saccharomyces cerevisiae
aaaagttgatggagaatgcca

SEQ ID NO: 1102 - DNA, 27 bp, Saccharomyces cerevisiae
atataaacgtagtatattttcatccag

SEQ ID NO: 1103 - DNA, 27 bp, Saccharomyces cerevisiae
acgagttaaggaaatattagcatatag

SEQ ID NO: 1104 - DNA, 26 bp, Saccharomyces cerevisiae
taataaaaggtttcgatacaataggg

SEQ ID NO: 1105 - DNA, 25 bp, Saccharomyces cerevisiae
tgggtttatttttacatagaatagt

SEQ ID NO: 1106 - DNA, 25 bp, Saccharomyces cerevisiae
tcgattatgtaactacaaccgtacc

SEQ ID NO: 1107 - DNA, 25 bp, Saccharomyces cerevisiae
gattcaaattaatgaaataaacact

SEQ ID NO: 1108 - DNA, 26 bp, Saccharomyces cerevisiae
tgcatccccatagatatattactgtt

SEQ ID NO: 1109 - DNA, 25 bp, Saccharomyces cerevisiae
taagtattggcgtatataaacgggt

SEQ ID NO: 1110 - DNA, 27 bp, Saccharomyces cerevisiae
ataatgctaggacaaacacatttgtag

SEQ ID NO: 1111 - DNA, 20 bp, Saccharomyces cerevisiae
tttattgttcacgccgttca

SEQ ID NO: 1112 - DNA, 27 bp, Saccharomyces cerevisiae
cacctaatatttcagttctatagggca

SEQ ID NO: 1113 - DNA, 21 bp, Saccharomyces cerevisiae
ttcccataacaaactccgagg

SEQ ID NO: 1114 - DNA, 22 bp, Saccharomyces cerevisiae
cgaaaatacctttcggcttaca

SEQ ID NO: 1115 - DNA, 23 bp, Saccharomyces cerevisiae
aataatgatgttgcttcggtttt

SEQ ID NO: 1116 - DNA, 23 bp, Saccharomyces cerevisiae
tcttactgacagtctgccgacaa

SEQ ID NO: 1117 - DNA, 19 bp, Saccharomyces cerevisiae
acttgaaacgcttcctggc

SEQ ID NO: 1118 - DNA, 27 bp, Saccharomyces cerevisiae
aaattgagttaacgataaataatcgag

SEQ ID NO: 1119 - DNA, 26 bp, Saccharomyces cerevisiae
aaggatgattgaaatttaagcaatta

SEQ ID NO: 1120 - DNA, 27 bp, Saccharomyces cerevisiae
tactaagttcttgtgacaatgttttct

SEQ ID NO: 1121 - DNA, 24 bp, Saccharomyces cerevisiae
taaagagggataatgttgcattta

SEQ ID NO: 1122 - DNA, 21 bp, Saccharomyces cerevisiae
tttttgacgacaaccaagagg

SEQ ID NO: 1123 - DNA, 26 bp, Saccharomyces cerevisiae
tttaacctatacattaagaccaagcg

SEQ ID NO: 1124 - DNA, 20 bp, Saccharomyces cerevisiae
tcccacccccaatatttcta

SEQ ID NO: 1125 - DNA, 27 bp, Saccharomyces cerevisiae
taggtgacccctactctttacttatca

SEQ ID NO: 1126 - DNA, 26 bp, Saccharomyces cerevisiae
tagatgagtaccacttacgatcttgt

SEQ ID NO: 1127 - DNA, 25 bp, Saccharomyces cerevisiae
tgaagtgtagataatgaacggacaa

SEQ ID NO: 1128 - DNA, 27 bp, Saccharomyces cerevisiae
ggatcagaataagcttctcttttattt

SEQ ID NO: 1129 - DNA, 21 bp, Saccharomyces cerevisiae
ctataaaacttggttcacttt

SEQ ID NO: 1130 - DNA, 19 bp, Saccharomyces cerevisiae
acggaatagtcgcgcattt

SEQ ID NO: 1131 - DNA, 27 bp, Saccharomyces cerevisiae
attgttcaagatcagaaatagagtgaa

SEQ ID NO: 1132 - DNA, 24 bp, Saccharomyces cerevisiae
atatatgcccctacatatcaatgc

SEQ ID NO: 1133 - DNA, 25 bp, Saccharomyces cerevisiae
aaagtatttgtcctaccaaaaaagg

SEQ ID NO: 1134 - DNA, 27 bp, Saccharomyces cerevisiae
aaggaagaaataaagaagataattgcc

SEQ ID NO: 1135 - DNA, 21 bp, Saccharomyces cerevisiae
acggactaagagcctgatttc

SEQ ID NO: 1136 - DNA, 25 bp, Saccharomyces cerevisiae
cattgagtttgtacattacttttcg

SEQ ID NO: 1137 - DNA, 21 bp, Saccharomyces cerevisiae
tccaaccaaaccgtaaataaa

SEQ ID NO: 1138 - DNA, 27 bp, Saccharomyces cerevisiae
acgatatatcctgtaaatagaaacagc

SEQ ID NO: 1139 - DNA, 27 bp, Saccharomyces cerevisiae
taaattagaaaagttaaagcagcatgt

SEQ ID NO: 1140 - DNA, 23 bp, Saccharomyces cerevisiae
aagagaccgaactatcacaaaaa

SEQ ID NO: 1141 - DNA, 27 bp, Saccharomyces cerevisiae
tgattcgataaatagagcacatataaa

SEQ ID NO: 1142 - DNA, 27 bp, Saccharomyces cerevisiae
aataaatagcatattgttaatctgcac

SEQ ID NO: 1143 - DNA, 21 bp, Saccharomyces cerevisiae
gactaattgcaagtcggatgc

SEQ ID NO: 1144 - DNA, 24 bp, Saccharomyces cerevisiae
ggaaaaactggccattaataattt

SEQ ID NO: 1145 - DNA, 23 bp, Saccharomyces cerevisiae
cactgaaaggaaaagcttcataa

SEQ ID NO: 1146 - DNA, 22 bp, Saccharomyces cerevisiae
aaccaggattttgtgtattccc

SEQ ID NO: 1147 - DNA, 23 bp, Saccharomyces cerevisiae
aagcccttctgagaaacaataca

SEQ ID NO: 1148 - DNA, 24 bp, Saccharomyces cerevisiae
taagtacgagaacaaaacctgcat

SEQ ID NO: 1149 - DNA, 24 bp, Saccharomyces cerevisiae
ccagagatataatggataccacgg

SEQ ID NO: 1150 - DNA, 25 bp, Saccharomyces cerevisiae
atatgaaaggtcctaggaatacacg

SEQ ID NO: 1151 - DNA, 22 bp, Saccharomyces cerevisiae
gaataatgcgtttgaagtgaga

SEQ ID NO: 1152 - DNA, 23 bp, Saccharomyces cerevisiae
gaacaatcctaatttcttaagtg

SEQ ID NO: 1153 - DNA, 27 bp, Saccharomyces cerevisiae
ctataaaagacaatatgcgtaatgaaa

SEQ ID NO: 1154 - DNA, 22 bp, Saccharomyces cerevisiae
gcggttgttctaaccactattt

SEQ ID NO: 1155 - DNA, 27 bp, Saccharomyces cerevisiae
agaaagcactagtatcttcaaaatctg

SEQ ID NO: 1156 - DNA, 21 bp, Saccharomyces cerevisiae
cgcggctaattaaacaagaaa

SEQ ID NO: 1157 - DNA, 20 bp, Saccharomyces cerevisiae
accctgcacattcgtttcag

SEQ ID NO: 1158 - DNA, 21 bp, Saccharomyces cerevisiae
tgatgatcgaacgaaactttg

SEQ ID NO: 1159 - DNA, 27 bp, Saccharomyces cerevisiae
caagttgaatcgtatgatagaaaatgc

SEQ ID NO: 1160 - DNA, 24 bp, Saccharomyces cerevisiae
aaatttcaaataaagggtgaagaa

SEQ ID NO: 1161 - DNA, 19 bp, Saccharomyces cerevisiae
taaatggcgcaagttttcc

SEQ ID NO: 1162 - DNA, 24 bp, Saccharomyces cerevisiae
ttttaaatgtcgaaattatgcctg

SEQ ID NO: 1163 - DNA, 25 bp, Saccharomyces cerevisiae
agaaaataatgatagatagatgtaa

SEQ ID NO: 1164 - DNA, 27 bp, Saccharomyces cerevisiae
atggcttttattctattaaaatgatct

SEQ ID NO: 1165 - DNA, 26 bp, Saccharomyces cerevisiae
tggaaagattaatcaataagcaattt

SEQ ID NO: 1166 - DNA, 19 bp, Saccharomyces cerevisiae
gcttagcgatcgccctgta

SEQ ID NO: 1167 - DNA, 25 bp, Saccharomyces cerevisiae
aaacccattatactgcatcttacca

SEQ ID NO: 1168 - DNA, 23 bp, Saccharomyces cerevisiae
gaaacgaaagagcatagaaggaa

SEQ ID NO: 1169 - DNA, 20 bp, Saccharomyces cerevisiae
tgctaagtcgaggcaatctc

SEQ ID NO: 1170 - DNA, 23 bp, Saccharomyces cerevisiae
cacgcggtttaatttttataagg

SEQ ID NO: 1171 - DNA, 25 bp, Saccharomyces cerevisiae
atttttaggtgtcatttcgattttg

SEQ ID NO: 1172 - DNA, 24 bp, Saccharomyces cerevisiae
aggagagtgtttctttatcttcca

SEQ ID NO: 1173 - DNA, 23 bp, Saccharomyces cerevisiae
acagactgatcgttcgttgtacg

SEQ ID NO: 1174 - DNA, 27 bp, Saccharomyces cerevisiae
ctgatatttattggtggtaaaaaaatg

SEQ ID NO: 1175 - DNA, 22 bp, Saccharomyces cerevisiae
ggtaaaacgggaacctaaaatg

SEQ ID NO: 1176 - DNA, 19 bp, Saccharomyces cerevisiae
tagtcgccatgctaaacgc

SEQ ID NO: 1177 - DNA, 27 bp, Saccharomyces cerevisiae
tgatagtaatagaatccaaaaaaaaaa

SEQ ID NO: 1178 - DNA, 24 bp, Saccharomyces cerevisiae
tgcatatagatatataaacgtacc

SEQ ID NO: 1179 - DNA, 26 bp, Saccharomyces cerevisiae
gtcgaataactggataagaaatcctg

SEQ ID NO: 1180 - DNA, 22 bp, Saccharomyces cerevisiae
tatttcttataacacgacggca

SEQ ID NO: 1181 - DNA, 27 bp, Saccharomyces cerevisiae
agaaaataagagacattatgaatttgg

SEQ ID NO: 1182 - DNA, 21 bp, Saccharomyces cerevisiae
caatgaaaaatgcgtaaaacg

SEQ ID NO: 1183 - DNA, 24 bp, Saccharomyces cerevisiae
tacgacgactaaaaagtttgcatt

SEQ ID NO: 1184 - DNA, 25 bp, Saccharomyces cerevisiae
aataaaagaaaaaatcaaaaaaaaa

SEQ ID NO: 1185 - DNA, 27 bp, Saccharomyces cerevisiae
gaattctttaccagttccatgaaataa

SEQ ID NO: 1186 - DNA, 27 bp, Saccharomyces cerevisiae
gtaagcatccatagatatttaaaagtt

SEQ ID NO: 1187 - DNA, 25 bp, Saccharomyces cerevisiae
tttttatgcatcttttataattgcg

SEQ ID NO: 1188 - DNA, 27 bp, Saccharomyces cerevisiae
cttacataattgtatctttttaacaca

SEQ ID NO: 1189 - DNA, 21 bp, Saccharomyces cerevisiae
cgctaacgctgatggagtatt

SEQ ID NO: 1190 - DNA, 27 bp, Saccharomyces cerevisiae
cattgtttgttttataagagtcagtgt

SEQ ID NO: 1191 - DNA, 21 bp, Saccharomyces cerevisiae
ccaatgcatttacaatggaca

SEQ ID NO: 1192 - DNA, 21 bp, Saccharomyces cerevisiae
aaaaagaaaaatgaaggttct

SEQ ID NO: 1193 - DNA, 21 bp, Saccharomyces cerevisiae
agacaaacgccaattttacga

SEQ ID NO: 1194 - DNA, 27 bp, Saccharomyces cerevisiae
aagtgaatttatagtgttgatcagtcg

SEQ ID NO: 1195 - DNA, 22 bp, Saccharomyces cerevisiae
tcagcgaatcagttttgtcttg

SEQ ID NO: 1196 - DNA, 23 bp, Saccharomyces cerevisiae
taacagtatgccgttttaccaca

SEQ ID NO: 1197 - DNA, 23 bp, Saccharomyces cerevisiae
ggtcctttcttcataatcaatgc

SEQ ID NO: 1198 - DNA, 26 bp, Saccharomyces cerevisiae
cttgtataaattggaagcaacaatag

SEQ ID NO: 1199 - DNA, 20 bp, Saccharomyces cerevisiae
tgtgatggcaagtttgaatg

SEQ ID NO: 1200 - DNA, 27 bp, Saccharomyces cerevisiae
aacgaatgatttactaatggcttaatg

SEQ ID NO: 1201 - DNA, 24 bp, Saccharomyces cerevisiae
tgggtttaacaatatgtatcgagg

SEQ ID NO: 1202 - DNA, 26 bp, Saccharomyces cerevisiae
ggaaaataacctagttacaatcatcg

SEQ ID NO: 1203 - DNA, 24 bp, Saccharomyces cerevisiae
gggatgaagaataagaataaacgc

SEQ ID NO: 1204 - DNA, 23 bp, Saccharomyces cerevisiae
cacacgtttaatcaacctatcca

SEQ ID NO: 1205 - DNA, 27 bp, Saccharomyces cerevisiae
agacagactatataatggtaggtcgtt

SEQ ID NO: 1206 - DNA, 18 bp, Saccharomyces cerevisiae
cccgggcctttttttttt

SEQ ID NO: 1207 - DNA, 20 bp, Saccharomyces cerevisiae
actaggtgattgggccttcc

SEQ ID NO: 1208 - DNA, 20 bp, Saccharomyces cerevisiae
tagggactctcggcagaaat

SEQ ID NO: 1209 - DNA, 25 bp, Saccharomyces cerevisiae
gtatatcgtgaaaaccaagaagagg

SEQ ID NO: 1210 - DNA, 21 bp, Saccharomyces cerevisiae
tcgtatttccgtcttcaaacc

SEQ ID NO: 1211 - DNA, 22 bp, Saccharomyces cerevisiae
ttcagctttgtattacttggcg

SEQ ID NO: 1212 - DNA, 24 bp, Saccharomyces cerevisiae
acgtgatttcttttatttcgttga

SEQ ID NO: 1213 - DNA, 22 bp, Saccharomyces cerevisiae
agagcgtgagaaaatactgcat

SEQ ID NO: 1214 - DNA, 25 bp, Saccharomyces cerevisiae
tgaagggaaagatatgagctataca

SEQ ID NO: 1215 - DNA, 23 bp, Saccharomyces cerevisiae
gaaacgacataaaagaagggtga

SEQ ID NO: 1216 - DNA, 26 bp, Saccharomyces cerevisiae
attgtataattttatgcttgaacgaa

SEQ ID NO: 1217 - DNA, 24 bp, Saccharomyces cerevisiae
ctacagcttataagggagagagga

SEQ ID NO: 1218 - DNA, 19 bp, Saccharomyces cerevisiae
agtgatctgggctgtcagg

SEQ ID NO: 1219 - DNA, 21 bp, Saccharomyces cerevisiae
ttggagtgaaaaagatcggaa

SEQ ID NO: 1220 - DNA, 27 bp, Saccharomyces cerevisiae
gaatgaaaatattaggaaaaaggagtt

SEQ ID NO: 1221 - DNA, 22 bp, Saccharomyces cerevisiae
taatgatcacggctaaaacggt

SEQ ID NO: 1222 - DNA, 24 bp, Saccharomyces cerevisiae
gattagcatatgcctcttcttctt

SEQ ID NO: 1223 - DNA, 27 bp, Saccharomyces cerevisiae
tgcatatatagtacatcagaaccttcg

SEQ ID NO: 1224 - DNA, 26 bp, Saccharomyces cerevisiae
ggaatttcgtaacgtgtatagaatca

SEQ ID NO: 1225 - DNA, 22 bp, Saccharomyces cerevisiae
gcagtgaattgctcatgttttc

SEQ ID NO: 1226 - DNA, 20 bp, Saccharomyces cerevisiae
ctccatgctggacttactcg

SEQ ID NO: 1227 - DNA, 21 bp, Saccharomyces cerevisiae
taacacaccatccacatttcc

SEQ ID NO: 1228 - DNA, 22 bp, Saccharomyces cerevisiae
cctcaggtttgatggtctaaaa

SEQ ID NO: 1229 - DNA, 22 bp, Saccharomyces cerevisiae
tgagggcgttttcaagataaaa

SEQ ID NO: 1230 - DNA, 25 bp, Saccharomyces cerevisiae
aacagaagataggcttctattttta

SEQ ID NO: 1231 - DNA, 22 bp, Saccharomyces cerevisiae
tggttttgaacaactttagcag

SEQ ID NO: 1232 - DNA, 27 bp, Saccharomyces cerevisiae
acaaccaagaatagtaagagaaatcaa

SEQ ID NO: 1233 - DNA, 22 bp, Saccharomyces cerevisiae
aaaatacaatgcactaatgccg

SEQ ID NO: 1234 - DNA, 26 bp, Saccharomyces cerevisiae
ttttatacgccatgtatcttagacaa

SEQ ID NO: 1235 - DNA, 21 bp, Saccharomyces cerevisiae
atgtttgtatggcaacctgtc

SEQ ID NO: 1236 - DNA, 27 bp, Saccharomyces cerevisiae
aagtagtacattcttcatttgctcaag

SEQ ID NO: 1237 - DNA, 20 bp, Saccharomyces cerevisiae
ggaaccaataaaaccactgc

SEQ ID NO: 1238 - DNA, 23 bp, Saccharomyces cerevisiae
gactaacaagtaagagcgcgatg

SEQ ID NO: 1239 - DNA, 27 bp, Saccharomyces cerevisiae
agttagttctgctaagtttatctgcat

SEQ ID NO: 1240 - DNA, 24 bp, Saccharomyces cerevisiae
ggaaaatttgatttttgattcagg

SEQ ID NO: 1241 - DNA, 25 bp, Saccharomyces cerevisiae
tatttcattgaatacttactgtcct

SEQ ID NO: 1242 - DNA, 22 bp, Saccharomyces cerevisiae
ttgggttgtgttcgcacatatt

SEQ ID NO: 1243 - DNA, 23 bp, Saccharomyces cerevisiae
cttttttttttttatttagaact

SEQ ID NO: 1244 - DNA, 23 bp, Saccharomyces cerevisiae
aacgctcaagtaacaaatgagtg

SEQ ID NO: 1245 - DNA, 23 bp, Saccharomyces cerevisiae
ggcaagtgattatactctccaca

SEQ ID NO: 1246 - DNA, 24 bp, Saccharomyces cerevisiae
gatagttgacttgaacaggaatgg

SEQ ID NO: 1247 - DNA, 27 bp, Saccharomyces cerevisiae
tcaaagtactaatgttctaccttttat

SEQ ID NO: 1248 - DNA, 18 bp, Saccharomyces cerevisiae
ttcccgtgggcttcctac

SEQ ID NO: 1249 - DNA, 26 bp, Saccharomyces cerevisiae
cttactcatcttaacaccatttgctt

SEQ ID NO: 1250 - DNA, 24 bp, Saccharomyces cerevisiae
tgaagtcaaagtgattcaattcat

SEQ ID NO: 1251 - DNA, 20 bp, Saccharomyces cerevisiae
agcgaaacgcctctgcttac

SEQ ID NO: 1252 - DNA, 24 bp, Saccharomyces cerevisiae
atatcatgcataaaatgctttcac

SEQ ID NO: 1253 - DNA, 23 bp, Saccharomyces cerevisiae
tagtggtacgtttcctcattcaa

SEQ ID NO: 1254 - DNA, 27 bp, Saccharomyces cerevisiae
ttggttcttacatgtcatattattttc

SEQ ID NO: 1255 - DNA, 26 bp, Saccharomyces cerevisiae
gaattagttatcttgttggcttttcg

SEQ ID NO: 1256 - DNA, 23 bp, Saccharomyces cerevisiae
atggaaaattaacgaagaattac

SEQ ID NO: 1257 - DNA, 25 bp, Saccharomyces cerevisiae
cctaatcagcaaattctactagccc

SEQ ID NO: 1258 - DNA, 23 bp, Saccharomyces cerevisiae
acattgcatttattggtgttgaa

SEQ ID NO: 1259 - DNA, 27 bp, Saccharomyces cerevisiae
aaaaggtctaacatcctttgagttatg

SEQ ID NO: 1260 - DNA, 26 bp, Saccharomyces cerevisiae
ggataatatgtcagaagttgttcact

SEQ ID NO: 1261 - DNA, 25 bp, Saccharomyces cerevisiae
tttctgctgtaagaactattttatc

SEQ ID NO: 1262 - DNA, 27 bp, Saccharomyces cerevisiae
cttgattaaggaaggaaaattagaaaa

SEQ ID NO: 1263 - DNA, 27 bp, Saccharomyces cerevisiae
tgaaaatctaaatgtcgtgatgtataa

SEQ ID NO: 1264 - DNA, 26 bp, Saccharomyces cerevisiae
gaaaataaaggcatctacaaatctca

SEQ ID NO: 1265 - DNA, 23 bp, Saccharomyces cerevisiae
agtttgtcaacgacactcacaag

SEQ ID NO: 1266 - DNA, 20 bp, Saccharomyces cerevisiae
aagagaaattaagacggggg

SEQ ID NO: 1267 - DNA, 27 bp, Saccharomyces cerevisiae
tgaagaaagaaagaaagaaaatacctt

SEQ ID NO: 1268 - DNA, 21 bp, Saccharomyces cerevisiae
ttgacaaaaaaatgaaaacca

SEQ ID NO: 1269 - DNA, 21 bp, Saccharomyces cerevisiae
atcgaccagctctttagcatc

SEQ ID NO: 1270 - DNA, 26 bp, Saccharomyces cerevisiae
gaatgatgtcttcttcaacagagatt

SEQ ID NO: 1271 - DNA, 24 bp, Saccharomyces cerevisiae
caattttgagaatattcccttttt

SEQ ID NO: 1272 - DNA, 23 bp, Saccharomyces cerevisiae
aaggaaaacaccttcaaacaaga

SEQ ID NO: 1273 - DNA, 24 bp, Saccharomyces cerevisiae
catgtttacagaaagataaaccca

SEQ ID NO: 1274 - DNA, 23 bp, Saccharomyces cerevisiae
acccatttgcatttacttgtgtt

SEQ ID NO: 1275 - DNA, 19 bp, Saccharomyces cerevisiae
taggctatgtcgtcggagg

SEQ ID NO: 1276 - DNA, 27 bp, Saccharomyces cerevisiae
acctcctagataatgatattcttcaaa

SEQ ID NO: 1277 - DNA, 21 bp, Saccharomyces cerevisiae
cagcaattccattcattttcc

SEQ ID NO: 1278 - DNA, 22 bp, Saccharomyces cerevisiae
cccaaataggtacggacatcta

SEQ ID NO: 1279 - DNA, 25 bp, Saccharomyces cerevisiae
tttcgtttacttcaatcttggattt

SEQ ID NO: 1280 - DNA, 25 bp, Saccharomyces cerevisiae
agctgactataattaagttcgataa

SEQ ID NO: 1281 - DNA, 25 bp, Saccharomyces cerevisiae
ttgaaacttacacggtacaataggg

SEQ ID NO: 1282 - DNA, 21 bp, Saccharomyces cerevisiae
ataggcttggtttcattgtca

SEQ ID NO: 1283 - DNA, 24 bp, Saccharomyces cerevisiae
gaagttctcaagtatacacatatt

SEQ ID NO: 1284 - DNA, 26 bp, Saccharomyces cerevisiae
ttaatttaagtcaacataccgaagaa

SEQ ID NO: 1285 - DNA, 22 bp, Saccharomyces cerevisiae
aaaaccgataacaaagtgatgg

SEQ ID NO: 1286 - DNA, 20 bp, Saccharomyces cerevisiae
taagccgatggcctcacaat

SEQ ID NO: 1287 - DNA, 19 bp, Saccharomyces cerevisiae
tgagcttgaggtgacaggc

SEQ ID NO: 1288 - DNA, 19 bp, Saccharomyces cerevisiae
tctttggcctagtcgggag

SEQ ID NO: 1289 - DNA, 27 bp, Saccharomyces cerevisiae
gctaaccatgcttacactatataccaa

SEQ ID NO: 1290 - DNA, 19 bp, Saccharomyces cerevisiae
agcgatctgctcttgcagt

SEQ ID NO: 1291 - DNA, 21 bp, Saccharomyces cerevisiae
caaaccctttaggtttcatgc

SEQ ID NO: 1292 - DNA, 18 bp, Saccharomyces cerevisiae
ccttttgcttcttccgcc

SEQ ID NO: 1293 - DNA, 25 bp, Saccharomyces cerevisiae
tgtgaactaaaaaaataaaaatgaa

SEQ ID NO: 1294 - DNA, 27 bp, Saccharomyces cerevisiae
gaaataaataatgaatgaaataaaaaa

SEQ ID NO: 1295 - DNA, 27 bp, Saccharomyces cerevisiae
atatagataaaaatcactgcataggga

SEQ ID NO: 1296 - DNA, 19 bp, Saccharomyces cerevisiae
taaattttgcgacgcctgc

SEQ ID NO: 1297 - DNA, 26 bp, Saccharomyces cerevisiae
atatattgcacttaaaatatacatag

SEQ ID NO: 1298 - DNA, 21 bp, Saccharomyces cerevisiae
tttgggctggacatgatattt

SEQ ID NO: 1299 - DNA, 23 bp, Saccharomyces cerevisiae
ttacacctgcattttcctttatg

SEQ ID NO: 1300 - DNA, 21 bp, Saccharomyces cerevisiae
tccatggaggcacactttaac

SEQ ID NO: 1301 - DNA, 21 bp, Saccharomyces cerevisiae
gtttttcaataacgcacatgg

SEQ ID NO: 1302 - DNA, 28 bp, Saccharomyces cerevisiae
tagaacttttaccaatgaaaagaaatca

SEQ ID NO: 1303 - DNA, 27 bp, Saccharomyces cerevisiae
accacttcataaaatcacgtaaataca

SEQ ID NO: 1304 - DNA, 23 bp, Saccharomyces cerevisiae
ggcagaaactgaagtctctttta

SEQ ID NO: 1305 - DNA, 25 bp, Saccharomyces cerevisiae
tctttcatcgcatatcttatattca

SEQ ID NO: 1306 - DNA, 23 bp, Saccharomyces cerevisiae
tggtaatcctctaaaatcgaaca

SEQ ID NO: 1307 - DNA, 18 bp, Saccharomyces cerevisiae
gtgcgatcgctctgcctt

SEQ ID NO: 1308 - DNA, 27 bp, Saccharomyces cerevisiae
ctttttatgcattataattatcgagtt

SEQ ID NO: 1309 - DNA, 23 bp, Saccharomyces cerevisiae
cgctcatagactgctttattttt

SEQ ID NO: 1310 - DNA, 25 bp, Saccharomyces cerevisiae
taagtaagaaaatcttgtaaatatg

SEQ ID NO: 1311 - DNA, 18 bp, Saccharomyces cerevisiae
tagtggcgacaagcgagg

SEQ ID NO: 1312 - DNA, 27 bp, Saccharomyces cerevisiae
aacataaacttaaaaacttttaggaga

SEQ ID NO: 1313 - DNA, 25 bp, Saccharomyces cerevisiae
aactattatcctacataataccggc

SEQ ID NO: 1314 - DNA, 20 bp, Saccharomyces cerevisiae
gatgagcgagcaaacacagg

SEQ ID NO: 1315 - DNA, 27 bp, Saccharomyces cerevisiae
atgatctgttatttccttgttgtaact

SEQ ID NO: 1316 - DNA, 24 bp, Saccharomyces cerevisiae
ttgatcaatcaaattagtggagga

SEQ ID NO: 1317 - DNA, 27 bp, Saccharomyces cerevisiae
cctttttccaatatacacaaacataca

SEQ ID NO: 1318 - DNA, 27 bp, Saccharomyces cerevisiae
atacccacttacatttacaatatgttt

SEQ ID NO: 1319 - DNA, 24 bp, Saccharomyces cerevisiae
tgaatcgctttctagctacttttt

SEQ ID NO: 1320 - DNA, 27 bp, Saccharomyces cerevisiae
cagagttaagagtctaccacttgaagc

SEQ ID NO: 1321 - DNA, 25 bp, Saccharomyces cerevisiae
cagttttgatgttcccatttaaaga

SEQ ID NO: 1322 - DNA, 22 bp, Saccharomyces cerevisiae
cttcctaagcactgtgatctgc

SEQ ID NO: 1323 - DNA, 19 bp, Saccharomyces cerevisiae
aggtaaaaacggacaaccg

SEQ ID NO: 1324 - DNA, 22 bp, Saccharomyces cerevisiae
tgaatggagagactgaaaacca

SEQ ID NO: 1325 - DNA, 24 bp, Saccharomyces cerevisiae
gaggatgcatgattatagcctagc

SEQ ID NO: 1326 - DNA, 22 bp, Saccharomyces cerevisiae
aaagtaagacaagcagccctca

SEQ ID NO: 1327 - DNA, 26 bp, Saccharomyces cerevisiae
aatattgtttaatttaacgaaccctg

SEQ ID NO: 1328 - DNA, 20 bp, Saccharomyces cerevisiae
aaaaatcaccctgcattgcc

SEQ ID NO: 1329 - DNA, 27 bp, Saccharomyces cerevisiae
ggttaattcaggtattatttttatggc

SEQ ID NO: 1330 - DNA, 24 bp, Saccharomyces cerevisiae
tatatagcatacaacataataaaa

SEQ ID NO: 1331 - DNA, 19 bp, Saccharomyces cerevisiae
gacacaatgcgaaaaatcg

SEQ ID NO: 1332 - DNA, 27 bp, Saccharomyces cerevisiae
atatttttctctttacttccttaccct

SEQ ID NO: 1333 - DNA, 19 bp, Saccharomyces cerevisiae
caagcctggtgaacaattt

SEQ ID NO: 1334 - DNA, 19 bp, Saccharomyces cerevisiae
tatggtgcagtgcctttca

SEQ ID NO: 1335 - DNA, 25 bp, Saccharomyces cerevisiae
acgaagtaaaattttctcaaattca

SEQ ID NO: 1336 - DNA, 20 bp, Saccharomyces cerevisiae
ggctttgttgaatggtccag

SEQ ID NO: 1337 - DNA, 25 bp, Saccharomyces cerevisiae
gcttaaaacctgataaaatccatgt

SEQ ID NO: 1338 - DNA, 26 bp, Saccharomyces cerevisiae
gttggtaattaacatggtgtagagaa

SEQ ID NO: 1339 - DNA, 22 bp, Saccharomyces cerevisiae
aaggaaaaacactcgatgatga

SEQ ID NO: 1340 - DNA, 27 bp, Saccharomyces cerevisiae
tgatctgtaagtagtgaaaagacaaaa

SEQ ID NO: 1341 - DNA, 27 bp, Saccharomyces cerevisiae
gcagaaagaataaaagactaatccaaa

SEQ ID NO: 1342 - DNA, 24 bp, Saccharomyces cerevisiae
aaaaagaccttttgaaagtttcgc

SEQ ID NO: 1343 - DNA, 27 bp, Saccharomyces cerevisiae
aatcactaaagtactccaaagtggtaa

SEQ ID NO: 1344 - DNA, 24 bp, Saccharomyces cerevisiae
ccgcctgtataaacatgataaaga

SEQ ID NO: 1345 - DNA, 21 bp, Saccharomyces cerevisiae
ataaatcacacccgaacacca

SEQ ID NO: 1346 - DNA, 20 bp, Saccharomyces cerevisiae
tcggttcatggcaatctcat

SEQ ID NO: 1347 - DNA, 26 bp, Saccharomyces cerevisiae
atagatactgtacataccgaaacgcc

SEQ ID NO: 1348 - DNA, 22 bp, Saccharomyces cerevisiae
aatttggaatgatgcgattttt

SEQ ID NO: 1349 - DNA, 27 bp, Saccharomyces cerevisiae
tctggatatgaaaaatattaaagcaga

SEQ ID NO: 1350 - DNA, 22 bp, Saccharomyces cerevisiae
aagaaacacacatcctcacacg

SEQ ID NO: 1351 - DNA, 22 bp, Saccharomyces cerevisiae
atctcacatgatgcttgactga

SEQ ID NO: 1352 - DNA, 24 bp, Saccharomyces cerevisiae
gaagcacttggtacaaactcgtat

SEQ ID NO: 1353 - DNA, 25 bp, Saccharomyces cerevisiae
ttacttacgaaaagagaggctattg

SEQ ID NO: 1354 - DNA, 26 bp, Saccharomyces cerevisiae
actgtatacttttctttccacctttg

SEQ ID NO: 1355 - DNA, 26 bp, Saccharomyces cerevisiae
tttgaccagtatgaatattccaagca

SEQ ID NO: 1356 - DNA, 27 bp, Saccharomyces cerevisiae
acaaaaatacctttttgagactgaatg

SEQ ID NO: 1357 - DNA, 22 bp, Saccharomyces cerevisiae
atgtctgatcgattctttttgc

SEQ ID NO: 1358 - DNA, 20 bp, Saccharomyces cerevisiae
ggctgaagtcacgtgttgag

SEQ ID NO: 1359 - DNA, 20 bp, Saccharomyces cerevisiae
taaacggcaaactcctctgc

SEQ ID NO: 1360 - DNA, 19 bp, Saccharomyces cerevisiae
gcgcacctattccctctgt

SEQ ID NO: 1361 - DNA, 27 bp, Saccharomyces cerevisiae
aggcacagataatgaaataatacaaaa

SEQ ID NO: 1362 - DNA, 27 bp, Saccharomyces cerevisiae
acgtagtgtatagcggtaatgtttatt

SEQ ID NO: 1363 - DNA, 22 bp, Saccharomyces cerevisiae
agatgagaggctagatcgagaa

SEQ ID NO: 1364 - DNA, 25 bp, Saccharomyces cerevisiae
ttcgattaatctttcactattgcat

SEQ ID NO: 1365 - DNA, 26 bp, Saccharomyces cerevisiae
gaaaacagacaagaaaaagaaacaaa

SEQ ID NO: 1366 - DNA, 20 bp, Saccharomyces cerevisiae
ctgcattgtgttacatgcga

SEQ ID NO: 1367 - DNA, 23 bp, Saccharomyces cerevisiae
tctactagcgataacattaacaa

SEQ ID NO: 1368 - DNA, 25 bp, Saccharomyces cerevisiae
acgctaacttaatcacaggattcat

SEQ ID NO: 1369 - DNA, 26 bp, Saccharomyces cerevisiae
tcataaaactagaacgaatgaatgtt

SEQ ID NO: 1370 - DNA, 27 bp, Saccharomyces cerevisiae
cttaaggtagataatagtggtccatgt

SEQ ID NO: 1371 - DNA, 26 bp, Saccharomyces cerevisiae
aaaatgaacttaaagacacctttctg

SEQ ID NO: 1372 - DNA, 23 bp, Saccharomyces cerevisiae
agctaatgacaagagaaacatgc

SEQ ID NO: 1373 - DNA, 27 bp, Saccharomyces cerevisiae
tttaacatgatagaatataaatgcaaa

SEQ ID NO: 1374 - DNA, 26 bp, Saccharomyces cerevisiae
ttacaacgacatcttaagtgagaatc

SEQ ID NO: 1375 - DNA, 20 bp, Saccharomyces cerevisiae
acaggccccttttcctttgt

SEQ ID NO: 1376 - DNA, 26 bp, Saccharomyces cerevisiae
atttcatcatttcttaccatcttctc

SEQ ID NO: 1377 - DNA, 26 bp, Saccharomyces cerevisiae
agatccgcttagcttatgttaatact

SEQ ID NO: 1378 - DNA, 23 bp, Saccharomyces cerevisiae
aaaccttctgcaccatttttaga

SEQ ID NO: 1379 - DNA, 22 bp, Saccharomyces cerevisiae
cgcatgaaaatttaggatttgg

SEQ ID NO: 1380 - DNA, 22 bp, Saccharomyces cerevisiae
ttatcttcatcaccgccatacc

SEQ ID NO: 1381 - DNA, 18 bp, Saccharomyces cerevisiae
taagtgggcggaattggc

SEQ ID NO: 1382 - DNA, 25 bp, Saccharomyces cerevisiae
atacacccttctagacggcattaaa

SEQ ID NO: 1383 - DNA, 21 bp, Saccharomyces cerevisiae
tagcgatagctcgaagaatca

SEQ ID NO: 1384 - DNA, 20 bp, Saccharomyces cerevisiae
aacaaaaaaaagaaaaacat

SEQ ID NO: 1385 - DNA, 22 bp, Saccharomyces cerevisiae
gataatcaaggtcaaggcaacg

SEQ ID NO: 1386 - DNA, 23 bp, Saccharomyces cerevisiae
gagaagaaataatgaaaacattg

SEQ ID NO: 1387 - DNA, 19 bp, Saccharomyces cerevisiae
taaaccttggcctttgcac

SEQ ID NO: 1388 - DNA, 18 bp, Saccharomyces cerevisiae
catgaatgaagagccgcc

SEQ ID NO: 1389 - DNA, 27 bp, Saccharomyces cerevisiae
aaaattaagaatgttgatgaaatagga

SEQ ID NO: 1390 - DNA, 26 bp, Saccharomyces cerevisiae
tcttatcgatttccgtatataattca

SEQ ID NO: 1391 - DNA, 25 bp, Saccharomyces cerevisiae
acgaaagcatgatttattcatacac

SEQ ID NO: 1392 - DNA, 25 bp, Saccharomyces cerevisiae
tgttaataccgaagaaacaagttca

SEQ ID NO: 1393 - DNA, 23 bp, Saccharomyces cerevisiae
taagcagtttgcagctacgtatt

SEQ ID NO: 1394 - DNA, 26 bp, Saccharomyces cerevisiae
aaaatagacggcttctactatcatca

SEQ ID NO: 1395 - DNA, 22 bp, Saccharomyces cerevisiae
ggcatacgctaaggaatattga

SEQ ID NO: 1396 - DNA, 25 bp, Saccharomyces cerevisiae
tttttaaagcatccatttatctctt

SEQ ID NO: 1397 - DNA, 23 bp, Saccharomyces cerevisiae
tattgtttccatgcctctacatt

SEQ ID NO: 1398 - DNA, 25 bp, Saccharomyces cerevisiae
agcaggaaataaactaaacaagctc

SEQ ID NO: 1399 - DNA, 27 bp, Saccharomyces cerevisiae
ttcatttgaataaataactgaaaaccg

SEQ ID NO: 1400 - DNA, 26 bp, Saccharomyces cerevisiae
atgtaattatatgaataagctagcaa

SEQ ID NO: 1401 - DNA, 23 bp, Saccharomyces cerevisiae
agaatagcgtggtagacgcgtaa

SEQ ID NO: 1402 - DNA, 21 bp, Saccharomyces cerevisiae
ttacgttctgcgattttctca

SEQ ID NO: 1403 - DNA, 23 bp, Saccharomyces cerevisiae
acgaaaggaatgaacattatccg

SEQ ID NO: 1404 - DNA, 24 bp, Saccharomyces cerevisiae
tgcatatgtgcagttttcataatc

SEQ ID NO: 1405 - DNA, 24 bp, Saccharomyces cerevisiae
gtttttcttgtcaattactcgttg

SEQ ID NO: 1406 - DNA, 24 bp, Saccharomyces cerevisiae
ccacctctttaattcaccaatttt

SEQ ID NO: 1407 - DNA, 24 bp, Saccharomyces cerevisiae
aaattttctttccaaactcctacc

SEQ ID NO: 1408 - DNA, 26 bp, Saccharomyces cerevisiae
aaacaataggaacggaaagctttatt

SEQ ID NO: 1409 - DNA, 27 bp, Saccharomyces cerevisiae
aaagcttcgacacatacataataactc

SEQ ID NO: 1410 - DNA, 23 bp, Saccharomyces cerevisiae
gcgttccataactttgtgtatct

SEQ ID NO: 1411 - DNA, 21 bp, Saccharomyces cerevisiae
ttgtgcaaaagaaaaacctgc

SEQ ID NO: 1412 - DNA, 23 bp, Saccharomyces cerevisiae
agtagtcgtttttaaactttttt

SEQ ID NO: 1413 - DNA, 27 bp, Saccharomyces cerevisiae
gattttgcatagtattatgagcatttt

SEQ ID NO: 1414 - DNA, 24 bp, Saccharomyces cerevisiae
taggtttatgcatttcgtcaaatc

SEQ ID NO: 1415 - DNA, 27 bp, Saccharomyces cerevisiae
tggagttgagatgtttacgtatatttt

SEQ ID NO: 1416 - DNA, 24 bp, Saccharomyces cerevisiae
gaccagctatatgaggagttatgc

SEQ ID NO: 1417 - DNA, 19 bp, Saccharomyces cerevisiae
aacctagttacgccgaggg

SEQ ID NO: 1418 - DNA, 22 bp, Saccharomyces cerevisiae
accttataaccagcaaattcgg

SEQ ID NO: 1419 - DNA, 27 bp, Saccharomyces cerevisiae
caagagtgaaagaaaagaaagtaaaaa

SEQ ID NO: 1420 - DNA, 20 bp, Saccharomyces cerevisiae
taagcgctttccagggacac

SEQ ID NO: 1421 - DNA, 23 bp, Saccharomyces cerevisiae
gggggatcttaatcgtagaaaaa

SEQ ID NO: 1422 - DNA, 24 bp, Saccharomyces cerevisiae
gaaacagacacagacacagacaaa

SEQ ID NO: 1423 - DNA, 25 bp, Saccharomyces cerevisiae
tttttactctattaacgcatggaaa

SEQ ID NO: 1424 - DNA, 27 bp, Saccharomyces cerevisiae
tcttttagatagacctctacagctttt

SEQ ID NO: 1425 - DNA, 27 bp, Saccharomyces cerevisiae
acttcatgcaatttcttgtagataagg

SEQ ID NO: 1426 - DNA, 23 bp, Saccharomyces cerevisiae
taggtgcagaaatatcctttgga

SEQ ID NO: 1427 - DNA, 23 bp, Saccharomyces cerevisiae
ttccggaaaatataattggtgaa

SEQ ID NO: 1428 - DNA, 27 bp, Saccharomyces cerevisiae
ccgaaataaagataaagaaacgttgta

SEQ ID NO: 1429 - DNA, 26 bp, Saccharomyces cerevisiae
tcgtctgaataagtatcagcagaaat

SEQ ID NO: 1430 - DNA, 26 bp, Saccharomyces cerevisiae
aggtgatcctaaatagtatgacatta

SEQ ID NO: 1431 - DNA, 26 bp, Saccharomyces cerevisiae
acactatatggttattcactgttggg

SEQ ID NO: 1432 - DNA, 27 bp, Saccharomyces cerevisiae
caatagaaaagcattatagagacaacg

SEQ ID NO: 1433 - DNA, 21 bp, Saccharomyces cerevisiae
cgcagttccaatttacaagaa

SEQ ID NO: 1434 - DNA, 27 bp, Saccharomyces cerevisiae
gaaaacacttaaaggaagacatagttt

SEQ ID NO: 1435 - DNA, 23 bp, Saccharomyces cerevisiae
ttgcatctcttaatcgttacaca

SEQ ID NO: 1436 - DNA, 18 bp, Saccharomyces cerevisiae
gcgacagggcctcctctt

SEQ ID NO: 1437 - DNA, 27 bp, Saccharomyces cerevisiae
tactaacgaaatctttacaggaagaaa

SEQ ID NO: 1438 - DNA, 27 bp, Saccharomyces cerevisiae
tttcggtataggaacaagtaagttaaa

SEQ ID NO: 1439 - DNA, 25 bp, Saccharomyces cerevisiae
gagagttaatggttatacagctgcc

SEQ ID NO: 1440 - DNA, 27 bp, Saccharomyces cerevisiae
tatttatttacggtttatagaatggtc

SEQ ID NO: 1441 - DNA, 23 bp, Saccharomyces cerevisiae
agagattatgccaaaagaattgc

SEQ ID NO: 1442 - DNA, 27 bp, Saccharomyces cerevisiae
tttaaatagtttttgttgtcacttgtc

SEQ ID NO: 1443 - DNA, 23 bp, Saccharomyces cerevisiae
tttatggtcttattagcgggaaa

SEQ ID NO: 1444 - DNA, 25 bp, Saccharomyces cerevisiae
ttgcataagtagtttttgtttttcc

SEQ ID NO: 1445 - DNA, 27 bp, Saccharomyces cerevisiae
cagcaataaacatcctttcatatactt

SEQ ID NO: 1446 - DNA, 27 bp, Saccharomyces cerevisiae
acgaataaggtaatttcttttcaagat

SEQ ID NO: 1447 - DNA, 26 bp, Saccharomyces cerevisiae
ataaaggctctatatctctctgtaaa

SEQ ID NO: 1448 - DNA, 26 bp, Saccharomyces cerevisiae
aaggaaaaaactaaaaaagaagaaaa

SEQ ID NO: 1449 - DNA, 25 bp, Saccharomyces cerevisiae
tcatgatcacctttattgtaaaagc

SEQ ID NO: 1450 - DNA, 20 bp, Saccharomyces cerevisiae
aaatgatagcgtgagcgaac

SEQ ID NO: 1451 - DNA, 21 bp, Saccharomyces cerevisiae
gccaattaaggcagcactatt

SEQ ID NO: 1452 - DNA, 26 bp, Saccharomyces cerevisiae
aatgaatgaatagactttgacaaaaa

SEQ ID NO: 1453 - DNA, 26 bp, Saccharomyces cerevisiae
caagtatcttgattatggttcgttat

SEQ ID NO: 1454 - DNA, 22 bp, Saccharomyces cerevisiae
ttcagcaaatagcattcaacaa

SEQ ID NO: 1455 - DNA, 27 bp, Saccharomyces cerevisiae
atatttttagttgaataaagaggcagg

SEQ ID NO: 1456 - DNA, 25 bp, Saccharomyces cerevisiae
aaaaattcgtcataaataggtttca

SEQ ID NO: 1457 - DNA, 27 bp, Saccharomyces cerevisiae
cgttgatttctctacttcttattcttt

SEQ ID NO: 1458 - DNA, 22 bp, Saccharomyces cerevisiae
gcataaaacaagcaccttcaaa

SEQ ID NO: 1459 - DNA, 22 bp, Saccharomyces cerevisiae
gtatagcgcacaggttttgact

SEQ ID NO: 1460 - DNA, 22 bp, Saccharomyces cerevisiae
gcttaaaccaaagcgaaattct

SEQ ID NO: 1461 - DNA, 20 bp, Saccharomyces cerevisiae
aagggcatttgaatcaagga

SEQ ID NO: 1462 - DNA, 22 bp, Saccharomyces cerevisiae
atgttcggtacctcagaacaac

SEQ ID NO: 1463 - DNA, 20 bp, Saccharomyces cerevisiae
ccctatcattgaaggtggaa

SEQ ID NO: 1464 - DNA, 19 bp, Saccharomyces cerevisiae
tgaaacagaagggccttgg

SEQ ID NO: 1465 - DNA, 27 bp, Saccharomyces cerevisiae
agttcaaacagtaataagagtctatcg

SEQ ID NO: 1466 - DNA, 27 bp, Saccharomyces cerevisiae
aagtacttaactaaataataccagcat

SEQ ID NO: 1467 - DNA, 25 bp, Saccharomyces cerevisiae
aattgatgagagaattttgagatga

SEQ ID NO: 1468 - DNA, 24 bp, Saccharomyces cerevisiae
tgacagtattatttttgggtaacg

SEQ ID NO: 1469 - DNA, 20 bp, Saccharomyces cerevisiae
gcaaaagtgggaaggtctcg

SEQ ID NO: 1470 - DNA, 27 bp, Saccharomyces cerevisiae
cagtaaagtaaagatcagaaccaaaaa

SEQ ID NO: 1471 - DNA, 27 bp, Saccharomyces cerevisiae
tcataggattatctcttcctctttcaa

SEQ ID NO: 1472 - DNA, 22 bp, Saccharomyces cerevisiae
ccgccctgtacataggtatatt

SEQ ID NO: 1473 - DNA, 24 bp, Saccharomyces cerevisiae
acaaaataagagcagaactgcata

SEQ ID NO: 1474 - DNA, 27 bp, Saccharomyces cerevisiae
cagtaagccttattttgtaatgaaaac

SEQ ID NO: 1475 - DNA, 27 bp, Saccharomyces cerevisiae
gattagaataaacaacaaaatcataac

SEQ ID NO: 1476 - DNA, 27 bp, Saccharomyces cerevisiae
tacgaactactcaattattttcacttc

SEQ ID NO: 1477 - DNA, 21 bp, Saccharomyces cerevisiae
tgagtgctcaacgaactttca

SEQ ID NO: 1478 - DNA, 20 bp, Saccharomyces cerevisiae
taggcaggtgacgcattaaa

SEQ ID NO: 1479 - DNA, 24 bp, Saccharomyces cerevisiae
aagcttccaaaaaaaaaaaagaaa

SEQ ID NO: 1480 - DNA, 23 bp, Saccharomyces cerevisiae
atggaagatgcttcagtatcagg

SEQ ID NO: 1481 - DNA, 22 bp, Saccharomyces cerevisiae
gtgcacttatccatcgactctc

SEQ ID NO: 1482 - DNA, 18 bp, Saccharomyces cerevisiae
gcgcgcaaagtttcaagt

SEQ ID NO: 1483 - DNA, 24 bp, Saccharomyces cerevisiae
ttcctgatggatttttaactgtaa

SEQ ID NO: 1484 - DNA, 23 bp, Saccharomyces cerevisiae
gtaatcagagccatagcgtatca

SEQ ID NO: 1485 - DNA, 22 bp, Saccharomyces cerevisiae
atgtcaggtactcctgagggga

SEQ ID NO: 1486 - DNA, 27 bp, Saccharomyces cerevisiae
gaacataacaaacacacgtaataattt

SEQ ID NO: 1487 - DNA, 27 bp, Saccharomyces cerevisiae
cctaagaaatgaataacaatactgaca

SEQ ID NO: 1488 - DNA, 27 bp, Saccharomyces cerevisiae
aaagttattttgagtagctgataaagc

SEQ ID NO: 1489 - DNA, 24 bp, Saccharomyces cerevisiae
ttgttacatgtactggctgtttcg

SEQ ID NO: 1490 - DNA, 25 bp, Saccharomyces cerevisiae
caccaagtatgtgtattctaagggt

SEQ ID NO: 1491 - DNA, 25 bp, Saccharomyces cerevisiae
tttttaatgaagatgacattgctcc

SEQ ID NO: 1492 - DNA, 22 bp, Saccharomyces cerevisiae
tcttcaatatttgtgtatggcg

SEQ ID NO: 1493 - DNA, 27 bp, Saccharomyces cerevisiae
aaagattctctttttttatgatatttg

SEQ ID NO: 1494 - DNA, 26 bp, Saccharomyces cerevisiae
tattcgatgtattaattaagcggacg

SEQ ID NO: 1495 - DNA, 23 bp, Saccharomyces cerevisiae
acagataatcctacgtacgcaca

SEQ ID NO: 1496 - DNA, 27 bp, Saccharomyces cerevisiae
tatagttattgtccgataccctatgaa

SEQ ID NO: 1497 - DNA, 24 bp, Saccharomyces cerevisiae
tgcgtataaacgtttttcacaaat

SEQ ID NO: 1498 - DNA, 27 bp, Saccharomyces cerevisiae
tcaaaaaatagaaaaataaaaaaaaaa

SEQ ID NO: 1499 - DNA, 18 bp, Saccharomyces cerevisiae
tgtctgtcgcattcacgc

SEQ ID NO: 1500 - DNA, 27 bp, Saccharomyces cerevisiae
tttcaatgattaattttgtaaggtgaa

SEQ ID NO: 1501 - DNA, 27 bp, Saccharomyces cerevisiae
tgaaaaaaatgtaatgaaatataaatg

SEQ ID NO: 1502 - DNA, 22 bp, Saccharomyces cerevisiae
aaaatggggtcactcttcattc

SEQ ID NO: 1503 - DNA, 25 bp, Saccharomyces cerevisiae
attttctctgaatgttacagtgcat

SEQ ID NO: 1504 - DNA, 25 bp, Saccharomyces cerevisiae
tttgattaatgagaaaatgaaatga

SEQ ID NO: 1505 - DNA, 25 bp, Saccharomyces cerevisiae
ttctcaaggtatgacactttggatt

SEQ ID NO: 1506 - DNA, 24 bp, Saccharomyces cerevisiae
agaaggtagactatcgcatataaa

SEQ ID NO: 1507 - DNA, 19 bp, Saccharomyces cerevisiae
gacggtagatgaatggccc

SEQ ID NO: 1508 - DNA, 25 bp, Saccharomyces cerevisiae
gcatgtagacattatatgagccatt

SEQ ID NO: 1509 - DNA, 20 bp, Saccharomyces cerevisiae
ggacaattccctcccacgta

SEQ ID NO: 1510 - DNA, 26 bp, Saccharomyces cerevisiae
agtatatcatccttacgtatttgacg

SEQ ID NO: 1511 - DNA, 24 bp, Saccharomyces cerevisiae
gttgcatggacaacttaaactagg

SEQ ID NO: 1512 - DNA, 19 bp, Saccharomyces cerevisiae
tttcagaaacgccatcggt

SEQ ID NO: 1513 - DNA, 24 bp, Saccharomyces cerevisiae
tagcattttatatattctgtttgt

SEQ ID NO: 1514 - DNA, 27 bp, Saccharomyces cerevisiae
aatatatctctaataagattcacgaaa

SEQ ID NO: 1515 - DNA, 19 bp, Saccharomyces cerevisiae
tagcagcattggaccgagt

SEQ ID NO: 1516 - DNA, 25 bp, Saccharomyces cerevisiae
atcgggattgtttcgatacatcata

SEQ ID NO: 1517 - DNA, 21 bp, Saccharomyces cerevisiae
ccgggaaaacatgtcttttta

SEQ ID NO: 1518 - DNA, 26 bp, Saccharomyces cerevisiae
attatctaaggattggtctcatgttg

SEQ ID NO: 1519 - DNA, 25 bp, Saccharomyces cerevisiae
tacatgttcaaaaacaaaaagaacg

SEQ ID NO: 1520 - DNA, 25 bp, Saccharomyces cerevisiae
gaaacagagtcgttagatttttcaa

SEQ ID NO: 1521 - DNA, 24 bp, Saccharomyces cerevisiae
aaggaacaatgaatcgaaataaag

SEQ ID NO: 1522 - DNA, 27 bp, Saccharomyces cerevisiae
ttacaaagatgacacgataataatgtt

SEQ ID NO: 1523 - DNA, 22 bp, Saccharomyces cerevisiae
tatactggagttgcatcgttga

SEQ ID NO: 1524 - DNA, 27 bp, Saccharomyces cerevisiae
cttcattgaacattttagcattagtgg

SEQ ID NO: 1525 - DNA, 27 bp, Saccharomyces cerevisiae
atgtaccaagtgtatgcactctatttt

SEQ ID NO: 1526 - DNA, 22 bp, Saccharomyces cerevisiae
gcacattttatttaaccagcct

SEQ ID NO: 1527 - DNA, 27 bp, Saccharomyces cerevisiae
acaataacttgaaagttgagatcttgg

SEQ ID NO: 1528 - DNA, 27 bp, Saccharomyces cerevisiae
aaaagcacataaaaacttgattgtgta

SEQ ID NO: 1529 - DNA, 22 bp, Saccharomyces cerevisiae
tccagatgatcgagagatgact

SEQ ID NO: 1530 - DNA, 27 bp, Saccharomyces cerevisiae
tgaaactttatagagtcatattttcac

SEQ ID NO: 1531 - DNA, 27 bp, Saccharomyces cerevisiae
atccttcagtaacttgaatcatacagc

SEQ ID NO: 1532 - DNA, 24 bp, Saccharomyces cerevisiae
ggttaataagaaatgttgcagctc

SEQ ID NO: 1533 - DNA, 25 bp, Saccharomyces cerevisiae
taatgatgaagattattctgttgcc

SEQ ID NO: 1534 - DNA, 27 bp, Saccharomyces cerevisiae
acatagtacacacatataaataagtaa

SEQ ID NO: 1535 - DNA, 23 bp, Saccharomyces cerevisiae
acctttaaactcgcgacttcttt

SEQ ID NO: 1536 - DNA, 26 bp, Saccharomyces cerevisiae
tgaaatgttttgcttagtgtaaatct

SEQ ID NO: 1537 - DNA, 21 bp, Saccharomyces cerevisiae
tagtatatacgtgtgcgtgcg

SEQ ID NO: 1538 - DNA, 24 bp, Saccharomyces cerevisiae
tatggttgattcaattgttgttct

SEQ ID NO: 1539 - DNA, 24 bp, Saccharomyces cerevisiae
tcaaaacaataaaaatgtcatctg

SEQ ID NO: 1540 - DNA, 23 bp, Saccharomyces cerevisiae
tggtatagtcccgtacacactct

SEQ ID NO: 1541 - DNA, 28 bp, Saccharomyces cerevisiae
aaccgtatatagatcaataataatgcac

SEQ ID NO: 1542 - DNA, 27 bp, Saccharomyces cerevisiae
taaggtcaaagaaaaacatacaaaatg

SEQ ID NO: 1543 - DNA, 19 bp, Saccharomyces cerevisiae
taggcgatctttttccggc

SEQ ID NO: 1544 - DNA, 27 bp, Saccharomyces cerevisiae
aataaaactaatcccatgaatgagtaa

SEQ ID NO: 1545 - DNA, 22 bp, Saccharomyces cerevisiae
aaaccgttgcacaaagtttaga

SEQ ID NO: 1546 - DNA, 27 bp, Saccharomyces cerevisiae
acaatttgatttttatcttctaatgct

SEQ ID NO: 1547 - DNA, 18 bp, Saccharomyces cerevisiae
tgcatgatggatcaaccc

SEQ ID NO: 1548 - DNA, 27 bp, Saccharomyces cerevisiae
tttgtaaattaagtttgaacaacaaga

SEQ ID NO: 1549 - DNA, 20 bp, Saccharomyces cerevisiae
gctaatttgcgataggcatt

SEQ ID NO: 1550 - DNA, 24 bp, Saccharomyces cerevisiae
cctctgactctaaaggtgatttgg

SEQ ID NO: 1551 - DNA, 24 bp, Saccharomyces cerevisiae
atgcctttttaaagaaactggaaa

SEQ ID NO: 1552 - DNA, 27 bp, Saccharomyces cerevisiae
gagaccaaataaagatcctgaatcata

SEQ ID NO: 1553 - DNA, 21 bp, Saccharomyces cerevisiae
tgtgttggttgcaatgttttc

SEQ ID NO: 1554 - DNA, 20 bp, Saccharomyces cerevisiae
tagtcgccgatattgtttcg

SEQ ID NO: 1555 - DNA, 23 bp, Saccharomyces cerevisiae
taagggagaagtagaacctccca

SEQ ID NO: 1556 - DNA, 20 bp, Saccharomyces cerevisiae
ccgcaggtgaaattagatgg

SEQ ID NO: 1557 - DNA, 24 bp, Saccharomyces cerevisiae
agtggtcaacgtctaaaaatatga

SEQ ID NO: 1558 - DNA, 25 bp, Saccharomyces cerevisiae
taaagagaaccttaatcctggaaca

SEQ ID NO: 1559 - DNA, 24 bp, Saccharomyces cerevisiae
gtttaagcctactggactgaaaaa

SEQ ID NO: 1560 - DNA, 20 bp, Saccharomyces cerevisiae
tgatatttgtgcttcagggc

SEQ ID NO: 1561 - DNA, 19 bp, Saccharomyces cerevisiae
acgtaggacggaaaccacg

SEQ ID NO: 1562 - DNA, 24 bp, Saccharomyces cerevisiae
tcagctcccactatgtatgaatta

SEQ ID NO: 1563 - DNA, 26 bp, Saccharomyces cerevisiae
cagctcctgtagcatataaacatatc

SEQ ID NO: 1564 - DNA, 24 bp, Saccharomyces cerevisiae
tagactaaaatatgaactgcagcg

SEQ ID NO: 1565 - DNA, 24 bp, Saccharomyces cerevisiae
atgatgaacaatgggactacaaaa

SEQ ID NO: 1566 - DNA, 27 bp, Saccharomyces cerevisiae
aactgaaatcatgaataaagacattga

SEQ ID NO: 1567 - DNA, 22 bp, Saccharomyces cerevisiae
ggagatagtaggcgacacttcg

SEQ ID NO: 1568 - DNA, 21 bp, Saccharomyces cerevisiae
tcggggttatgaatgagaaaa

SEQ ID NO: 1569 - DNA, 27 bp, Saccharomyces cerevisiae
ttaaactgtgtatatcagctactgctc

SEQ ID NO: 1570 - DNA, 26 bp, Saccharomyces cerevisiae
atttattaaagtgtatatagttgcca

SEQ ID NO: 1571 - DNA, 27 bp, Saccharomyces cerevisiae
aattaagctgtattatattcatccctg

SEQ ID NO: 1572 - DNA, 20 bp, Saccharomyces cerevisiae
ttcctaagcaccaaccgaac

SEQ ID NO: 1573 - DNA, 18 bp, Saccharomyces cerevisiae
aaataggctaggcgcggg

SEQ ID NO: 1574 - DNA, 20 bp, Saccharomyces cerevisiae
ttaggaacaggcgaggtcaa

SEQ ID NO: 1575 - DNA, 27 bp, Saccharomyces cerevisiae
agaatatctaagaaaaaataactactg

SEQ ID NO: 1576 - DNA, 21 bp, Saccharomyces cerevisiae
aaactcgagcgtccctaggat

SEQ ID NO: 1577 - DNA, 19 bp, Saccharomyces cerevisiae
gaaggccagatcttgtgcg

SEQ ID NO: 1578 - DNA, 23 bp, Saccharomyces cerevisiae
tcataatgtgtttcggttatgaa

SEQ ID NO: 1579 - DNA, 23 bp, Saccharomyces cerevisiae
ttaccctcgtacttttcatttca

SEQ ID NO: 1580 - DNA, 27 bp, Saccharomyces cerevisiae
gaaataatgttgtaactctaagaaagt

SEQ ID NO: 1581 - DNA, 22 bp, Saccharomyces cerevisiae
tgaaatcacaaaaacagatgcg

SEQ ID NO: 1582 - DNA, 27 bp, Saccharomyces cerevisiae
ctttgtctataatcaagcaattatccg

SEQ ID NO: 1583 - DNA, 22 bp, Saccharomyces cerevisiae
gcatagtcacagaacctcttgc

SEQ ID NO: 1584 - DNA, 23 bp, Saccharomyces cerevisiae
tcagaataatgatctcatgcaca

SEQ ID NO: 1585 - DNA, 27 bp, Saccharomyces cerevisiae
gataaatttttttttatactccttttt

SEQ ID NO: 1586 - DNA, 25 bp, Saccharomyces cerevisiae
ttggacaacaatactcttagcaagg

SEQ ID NO: 1587 - DNA, 22 bp, Saccharomyces cerevisiae
ccgagacagattgaggtctttc

SEQ ID NO: 1588 - DNA, 18 bp, Saccharomyces cerevisiae
taatcgcgcggtacgaca

SEQ ID NO: 1589 - DNA, 22 bp, Saccharomyces cerevisiae
taatgaaaagaaaggaagcgat

SEQ ID NO: 1590 - DNA, 27 bp, Saccharomyces cerevisiae
ctcctctaatggattaatatgtaggaa

SEQ ID NO: 1591 - DNA, 20 bp, Saccharomyces cerevisiae
tctgatctctccgccctact

SEQ ID NO: 1592 - DNA, 27 bp, Saccharomyces cerevisiae
ctagtacaataatcaattcaagagcac

SEQ ID NO: 1593 - DNA, 26 bp, Saccharomyces cerevisiae
taaattgtcatgcatatgactcatcc

SEQ ID NO: 1594 - DNA, 21 bp, Saccharomyces cerevisiae
tgtctgcatttttacccctca

SEQ ID NO: 1595 - DNA, 27 bp, Saccharomyces cerevisiae
cagaagaaataagacccataaactttg

SEQ ID NO: 1596 - DNA, 24 bp, Saccharomyces cerevisiae
tgtataaaaagtgtgtgtatgcgg

SEQ ID NO: 1597 - DNA, 26 bp, Saccharomyces cerevisiae
gctctttcttcgtttctatttctttt

SEQ ID NO: 1598 - DNA, 27 bp, Saccharomyces cerevisiae
gaaacaagatacctttgctttatttcg

SEQ ID NO: 1599 - DNA, 26 bp, Saccharomyces cerevisiae
aataataaaaagaagatcatgcaaca

SEQ ID NO: 1600 - DNA, 25 bp, Saccharomyces cerevisiae
atatattccccaataaactggaatc

SEQ ID NO: 1601 - DNA, 25 bp, Saccharomyces cerevisiae
agcttttgattaagccttctagtcc

SEQ ID NO: 1602 - DNA, 22 bp, Saccharomyces cerevisiae
atgttacggatcgactcaaaga

SEQ ID NO: 1603 - DNA, 27 bp, Saccharomyces cerevisiae
tttttctctttctttcctataacacca

SEQ ID NO: 1604 - DNA, 25 bp, Saccharomyces cerevisiae
ctaacgagaacacgttcactacaga

SEQ ID NO: 1605 - DNA, 27 bp, Saccharomyces cerevisiae
aaaattttagaattaaaagtctactgc

SEQ ID NO: 1606 - DNA, 23 bp, Saccharomyces cerevisiae
gagaacgacggcagtaatattgt

SEQ ID NO: 1607 - DNA, 27 bp, Saccharomyces cerevisiae
acttaagttttacaaagaaatttgcga

SEQ ID NO: 1608 - DNA, 20 bp, Saccharomyces cerevisiae
agttgcggttccctctgtct

SEQ ID NO: 1609 - DNA, 26 bp, Saccharomyces cerevisiae
tgtgcataaatatctagaaaaatcgc

SEQ ID NO: 1610 - DNA, 20 bp, Saccharomyces cerevisiae
tgatcacggaagtgtctcgc

SEQ ID NO: 1611 - DNA, 25 bp, Saccharomyces cerevisiae
taggaaggaaataatcaccataaaa

SEQ ID NO: 1612 - DNA, 19 bp, Saccharomyces cerevisiae
taatctccttaaacgcgca

SEQ ID NO: 1613 - DNA, 24 bp, Saccharomyces cerevisiae
actaagcagtaaaaagcaaattcc

SEQ ID NO: 1614 - DNA, 22 bp, Saccharomyces cerevisiae
gtcgcatataacagtggaggtg

SEQ ID NO: 1615 - DNA, 27 bp, Saccharomyces cerevisiae
tgagcattatctatcgctttattattt

SEQ ID NO: 1616 - DNA, 25 bp, Saccharomyces cerevisiae
gaactgagttgaaaagaaacaaagc

SEQ ID NO: 1617 - DNA, 26 bp, Saccharomyces cerevisiae
agttatagttgttttcacagtcagca

SEQ ID NO: 1618 - DNA, 26 bp, Saccharomyces cerevisiae
tgaactgtgcatatttgaattttaag

SEQ ID NO: 1619 - DNA, 20 bp, Saccharomyces cerevisiae
ggtcatcaataagcctggtg

SEQ ID NO: 1620 - DNA, 18 bp, Saccharomyces cerevisiae
agccaaaacatccaaccg

SEQ ID NO: 1621 - DNA, 24 bp, Saccharomyces cerevisiae
atcagcgaatgagtattctcaaag

SEQ ID NO: 1622 - DNA, 19 bp, Saccharomyces cerevisiae
atgggtcgggtcactcaat

SEQ ID NO: 1623 - DNA, 21 bp, Saccharomyces cerevisiae
tcatctagatttacggagcga

SEQ ID NO: 1624 - DNA, 23 bp, Saccharomyces cerevisiae
tgctgtctactacaatcattccc

SEQ ID NO: 1625 - DNA, 27 bp, Saccharomyces cerevisiae
tgtaggtattgtaacattatttattct

SEQ ID NO: 1626 - DNA, 24 bp, Saccharomyces cerevisiae
agggtatgaaatgaaaaacaaaac

SEQ ID NO: 1627 - DNA, 22 bp, Saccharomyces cerevisiae
aacaccctttttaacgaaatgg

SEQ ID NO: 1628 - DNA, 26 bp, Saccharomyces cerevisiae
ccaaagtagattcagtataacgatgt

SEQ ID NO: 1629 - DNA, 22 bp, Saccharomyces cerevisiae
gcgggtattttgatggtaaatc

SEQ ID NO: 1630 - DNA, 20 bp, Saccharomyces cerevisiae
tttgaaatttgcagcccata

SEQ ID NO: 1631 - DNA, 20 bp, Saccharomyces cerevisiae
ttgtgaagttgatctgcgcc

SEQ ID NO: 1632 - DNA, 26 bp, Saccharomyces cerevisiae
aattaaatggcgattgtatattgaaa

SEQ ID NO: 1633 - DNA, 24 bp, Saccharomyces cerevisiae
gaaattaagtttttgacggacagc

SEQ ID NO: 1634 - DNA, 26 bp, Saccharomyces cerevisiae
tccttgtagacattatttcatatgtt

SEQ ID NO: 1635 - DNA, 27 bp, Saccharomyces cerevisiae
acacaatatttttactgtcattttttt

SEQ ID NO: 1636 - DNA, 26 bp, Saccharomyces cerevisiae
gctctctgacgaacatttatctatgc

SEQ ID NO: 1637 - DNA, 25 bp, Saccharomyces cerevisiae
gtaaagcattatttcttcttgcatt

SEQ ID NO: 1638 - DNA, 27 bp, Saccharomyces cerevisiae
tattttgcatataatagcattggtaca

SEQ ID NO: 1639 - DNA, 25 bp, Saccharomyces cerevisiae
gcaaaacaatagtgtatatgttgga

SEQ ID NO: 1640 - DNA, 26 bp, Saccharomyces cerevisiae
gaaatcaaacttagacgtatctctcg

SEQ ID NO: 1641 - DNA, 27 bp, Saccharomyces cerevisiae
aaaaatgtaaaatatatatacgcaaga

SEQ ID NO: 1642 - DNA, 27 bp, Saccharomyces cerevisiae
agatgacctcttttgtttttactagag

SEQ ID NO: 1643 - DNA, 27 bp, Saccharomyces cerevisiae
aaatatataataacataagtttgcatt

SEQ ID NO: 1644 - DNA, 20 bp, Saccharomyces cerevisiae
tgttgaacttcagccataca

SEQ ID NO: 1645 - DNA, 24 bp, Saccharomyces cerevisiae
tcttagtgcatcttgttacctcaa

SEQ ID NO: 1646 - DNA, 26 bp, Saccharomyces cerevisiae
atatttgcatattgtacattaaacct

SEQ ID NO: 1647 - DNA, 24 bp, Saccharomyces cerevisiae
tttgtcataaaaaatacttgtaaa

SEQ ID NO: 1648 - DNA, 27 bp, Saccharomyces cerevisiae
gaactgcaatcattagttacttcttga

SEQ ID NO: 1649 - DNA, 24 bp, Saccharomyces cerevisiae
aaggtgattaatggaatgaaaaca

SEQ ID NO: 1650 - DNA, 23 bp, Saccharomyces cerevisiae
ggcgagtgattatttgatattcc

SEQ ID NO: 1651 - DNA, 26 bp, Saccharomyces cerevisiae
gagtgatgtaatattaaacaatgtaa

SEQ ID NO: 1652 - DNA, 25 bp, Saccharomyces cerevisiae
taggaaacttcatcatttctaaagc

SEQ ID NO: 1653 - DNA, 27 bp, Saccharomyces cerevisiae
aaattatagaagattgaaactgagcaa

SEQ ID NO: 1654 - DNA, 24 bp, Saccharomyces cerevisiae
aagaatattagcgtaggcttagca

SEQ ID NO: 1655 - DNA, 24 bp, Saccharomyces cerevisiae
tagaatgctgtcctgcatattatt

SEQ ID NO: 1656 - DNA, 20 bp, Saccharomyces cerevisiae
tggtaaggcgcaaatatcca

SEQ ID NO: 1657 - DNA, 27 bp, Saccharomyces cerevisiae
agaatgtagtaactttgcttttcttgt

SEQ ID NO: 1658 - DNA, 23 bp, Saccharomyces cerevisiae
ttggtcattgttaaggctaaagg

SEQ ID NO: 1659 - DNA, 27 bp, Saccharomyces cerevisiae
actttagatagatatttagcatatccg

SEQ ID NO: 1660 - DNA, 24 bp, Saccharomyces cerevisiae
gctttctctcgataagtttgttca

SEQ ID NO: 1661 - DNA, 24 bp, Saccharomyces cerevisiae
ataaaataagtaacaacgaacatt

SEQ ID NO: 1662 - DNA, 26 bp, Saccharomyces cerevisiae
taacaccatttttctttccttttaat

SEQ ID NO: 1663 - DNA, 26 bp, Saccharomyces cerevisiae
gcagtatcctgtacaattttatgctc

SEQ ID NO: 1664 - DNA, 22 bp, Saccharomyces cerevisiae
gcgtaaacaattaacccgtctt

SEQ ID NO: 1665 - DNA, 27 bp, Saccharomyces cerevisiae
gtttaaaagagataaaagacgagaaaa

SEQ ID NO: 1666 - DNA, 25 bp, Saccharomyces cerevisiae
gagcaacacagtttatcttatatgt

SEQ ID NO: 1667 - DNA, 25 bp, Saccharomyces cerevisiae
aaaaagttcgcttcttaaccatatt

SEQ ID NO: 1668 - DNA, 22 bp, Saccharomyces cerevisiae
tcatcatgaacagtttggaacc

SEQ ID NO: 1669 - DNA, 21 bp, Saccharomyces cerevisiae
aagtgatggttatacgcgcac

SEQ ID NO: 1670 - DNA, 27 bp, Saccharomyces cerevisiae
acatagactgaaaatcaaaaatctctt

SEQ ID NO: 1671 - DNA, 27 bp, Saccharomyces cerevisiae
tttcaactttttctataattttcatgc

SEQ ID NO: 1672 - DNA, 27 bp, Saccharomyces cerevisiae
gtttttagtgagttattggctcatatt

SEQ ID NO: 1673 - DNA, 21 bp, Saccharomyces cerevisiae
gcatgaaccggttagttctca

SEQ ID NO: 1674 - DNA, 26 bp, Saccharomyces cerevisiae
ctgggttaagtgtaaagtaacaacac

SEQ ID NO: 1675 - DNA, 27 bp, Saccharomyces cerevisiae
tttttcgttcaaataaatataaagcag

SEQ ID NO: 1676 - DNA, 24 bp, Saccharomyces cerevisiae
taattacctaacgtcacccactga

SEQ ID NO: 1677 - DNA, 23 bp, Saccharomyces cerevisiae
gtgttcctcaatatggctgtttt

SEQ ID NO: 1678 - DNA, 26 bp, Saccharomyces cerevisiae
ttatcataaataccaacttttgcgtc

SEQ ID NO: 1679 - DNA, 26 bp, Saccharomyces cerevisiae
tttgtttgagtagctgtgattgtaaa

SEQ ID NO: 1680 - DNA, 24 bp, Saccharomyces cerevisiae
acgacatgtgttcaaatactgctt

SEQ ID NO: 1681 - DNA, 25 bp, Saccharomyces cerevisiae
ttctaacctgtaactgacaatagca

SEQ ID NO: 1682 - DNA, 26 bp, Saccharomyces cerevisiae
atgatcaaaaacttttcttcaccaca

SEQ ID NO: 1683 - DNA, 22 bp, Saccharomyces cerevisiae
cccttttaagtaggtaaccccc

SEQ ID NO: 1684 - DNA, 27 bp, Saccharomyces cerevisiae
aagcttaactatcacgtacattttctg

SEQ ID NO: 1685 - DNA, 20 bp, Saccharomyces cerevisiae
tttaacgcttcctgggaact

SEQ ID NO: 1686 - DNA, 25 bp, Saccharomyces cerevisiae
tgtgtttaagattgactgagcattg

SEQ ID NO: 1687 - DNA, 21 bp, Saccharomyces cerevisiae
taaggcagactgtgtcgtgta

SEQ ID NO: 1688 - DNA, 26 bp, Saccharomyces cerevisiae
gtacacattgcaaactaaatagcacg

SEQ ID NO: 1689 - DNA, 19 bp, Saccharomyces cerevisiae
cccttttgcatacctcccg

SEQ ID NO: 1690 - DNA, 26 bp, Saccharomyces cerevisiae
gcagaagttgatgttacctagatgtg

SEQ ID NO: 1691 - DNA, 27 bp, Saccharomyces cerevisiae
gtctaagagatatttgaaacgatttgt

SEQ ID NO: 1692 - DNA, 19 bp, Saccharomyces cerevisiae
tcgctattgcctccgtctc

SEQ ID NO: 1693 - DNA, 24 bp, Saccharomyces cerevisiae
ccactttttgtcttatgagtgctt

SEQ ID NO: 1694 - DNA, 24 bp, Saccharomyces cerevisiae
aggataatggaaaatttgaaatcg

SEQ ID NO: 1695 - DNA, 27 bp, Saccharomyces cerevisiae
tttatattcgtatattggtaaatcatc

SEQ ID NO: 1696 - DNA, 20 bp, Saccharomyces cerevisiae
ttctgatgccccagattatt

SEQ ID NO: 1697 - DNA, 22 bp, Saccharomyces cerevisiae
aaatgattggtcgtaaaagctg

SEQ ID NO: 1698 - DNA, 24 bp, Saccharomyces cerevisiae
gaaatgaaataatgacctgcaaca

SEQ ID NO: 1699 - DNA, 21 bp, Saccharomyces cerevisiae
gcaaataaaaaaatatccagt

SEQ ID NO: 1700 - DNA, 27 bp, Saccharomyces cerevisiae
ttttcatatgtacacatacaagtgacc

SEQ ID NO: 1701 - DNA, 24 bp, Saccharomyces cerevisiae
taaatgatatacagccagcgtaag

SEQ ID NO: 1702 - DNA, 22 bp, Saccharomyces cerevisiae
ccgaacctgaccactattgttt

SEQ ID NO: 1703 - DNA, 27 bp, Saccharomyces cerevisiae
caccattggtaaatctctctattgtaa

SEQ ID NO: 1704 - DNA, 25 bp, Saccharomyces cerevisiae
gaaaccaagtaaagataaatgagca

SEQ ID NO: 1705 - DNA, 27 bp, Saccharomyces cerevisiae
cctgtttaaagaagaggtataaacgaa

SEQ ID NO: 1706 - DNA, 27 bp, Saccharomyces cerevisiae
taagcttacacaataatctaattgcac

SEQ ID NO: 1707 - DNA, 25 bp, Saccharomyces cerevisiae
attttcttttagaaacgataagcta

SEQ ID NO: 1708 - DNA, 24 bp, Saccharomyces cerevisiae
taacatgaattggaaaaagaaaaa

SEQ ID NO: 1709 - DNA, 22 bp, Saccharomyces cerevisiae
aaccaaagtcattcaccgactc

SEQ ID NO: 1710 - DNA, 23 bp, Saccharomyces cerevisiae
ctatagtaggctctatgcatccg

SEQ ID NO: 1711 - DNA, 23 bp, Saccharomyces cerevisiae
tggcggtgattaagtaataaaaa

SEQ ID NO: 1712 - DNA, 24 bp, Saccharomyces cerevisiae
tgtttaagtctacttggcatcctc

SEQ ID NO: 1713 - DNA, 25 bp, Saccharomyces cerevisiae
gattaagtcattcattatcactttt

SEQ ID NO: 1714 - DNA, 21 bp, Saccharomyces cerevisiae
tgggaaataaaattgcaaaaa

SEQ ID NO: 1715 - DNA, 23 bp, Saccharomyces cerevisiae
tgaggcattactatcttgccttt

SEQ ID NO: 1716 - DNA, 23 bp, Saccharomyces cerevisiae
attttataatattcgttaaaggt

SEQ ID NO: 1717 - DNA, 25 bp, Saccharomyces cerevisiae
gcttgttcatagtcaattcttttcc

SEQ ID NO: 1718 - DNA, 22 bp, Saccharomyces cerevisiae
gcgcactacagggatacttatt

SEQ ID NO: 1719 - DNA, 23 bp, Saccharomyces cerevisiae
gaaggaaaatagctgtgacagaa

SEQ ID NO: 1720 - DNA, 24 bp, Saccharomyces cerevisiae
ttttgaatgatacgtaaaagatcg

SEQ ID NO: 1721 - DNA, 25 bp, Saccharomyces cerevisiae
aaaaaacttacactgaaatgataca

SEQ ID NO: 1722 - DNA, 27 bp, Saccharomyces cerevisiae
agtatgaactgaattttagggatatgt

SEQ ID NO: 1723 - DNA, 26 bp, Saccharomyces cerevisiae
ccacatacttaacgtaaaaaggaatg

SEQ ID NO: 1724 - DNA, 23 bp, Saccharomyces cerevisiae
gtaacagctatctacgtccctgc

SEQ ID NO: 1725 - DNA, 24 bp, Saccharomyces cerevisiae
ttcgttgcatagacagtatgaaaa

SEQ ID NO: 1726 - DNA, 23 bp, Saccharomyces cerevisiae
tgacatttttagtttgtgtaaaa

SEQ ID NO: 1727 - DNA, 27 bp, Saccharomyces cerevisiae
cttgtagtgtaggatcaactattttcg

SEQ ID NO: 1728 - DNA, 26 bp, Saccharomyces cerevisiae
atttagtgtaaattgaaacagaaaag

SEQ ID NO: 1729 - DNA, 23 bp, Saccharomyces cerevisiae
ctactgaagtttgcctttggttt

SEQ ID NO: 1730 - DNA, 22 bp, Saccharomyces cerevisiae
tgatcagttggatgaagaaaaa

SEQ ID NO: 1731 - DNA, 27 bp, Saccharomyces cerevisiae
ttatacgtaataaatattccacgaacg

SEQ ID NO: 1732 - DNA, 26 bp, Saccharomyces cerevisiae
tatatattcccccttcttttgaataa

SEQ ID NO: 1733 - DNA, 27 bp, Saccharomyces cerevisiae
atattatgaagaaaagtggaatgaaac

SEQ ID NO: 1734 - DNA, 20 bp, Saccharomyces cerevisiae
ttctgatgtaagggcaagca

SEQ ID NO: 1735 - DNA, 19 bp, Saccharomyces cerevisiae
taatgagcactttcgcccg

SEQ ID NO: 1736 - DNA, 27 bp, Saccharomyces cerevisiae
ctttagctatggaaaattattcaaaca

SEQ ID NO: 1737 - DNA, 25 bp, Saccharomyces cerevisiae
gcatttaagtacctcacctcagtat

SEQ ID NO: 1738 - DNA, 25 bp, Saccharomyces cerevisiae
agatcattatcgtaaaagaggagcg

SEQ ID NO: 1739 - DNA, 24 bp, Saccharomyces cerevisiae
ttgcataattcatctcatttttga

SEQ ID NO: 1740 - DNA, 18 bp, Saccharomyces cerevisiae
aagcaggcaaaaggtccc

SEQ ID NO: 1741 - DNA, 18 bp, Saccharomyces cerevisiae
accgcacactttcatccc

SEQ ID NO: 1742 - DNA, 26 bp, Saccharomyces cerevisiae
acaaaacggtcaattactgtagaaaa

SEQ ID NO: 1743 - DNA, 22 bp, Saccharomyces cerevisiae
gaatacaatctcatggtcctgg

SEQ ID NO: 1744 - DNA, 21 bp, Saccharomyces cerevisiae
cgcgcttaaatgaacagactt

SEQ ID NO: 1745 - DNA, 25 bp, Saccharomyces cerevisiae
cactatgaaaacctgtccaataaga

SEQ ID NO: 1746 - DNA, 27 bp, Saccharomyces cerevisiae
aaataaatgactttttgtagtggactt

SEQ ID NO: 1747 - DNA, 26 bp, Saccharomyces cerevisiae
atacgataaacggaagaatggtattt

SEQ ID NO: 1748 - DNA, 27 bp, Saccharomyces cerevisiae
attgtaaaaaaaaaaaaataatgtcca

SEQ ID NO: 1749 - DNA, 21 bp, Saccharomyces cerevisiae
gctcacgcactatactacgca

SEQ ID NO: 1750 - DNA, 26 bp, Saccharomyces cerevisiae
tggaccacctagataaataatttgaa

SEQ ID NO: 1751 - DNA, 21 bp, Saccharomyces cerevisiae
atagaaatatgattgtttttt

SEQ ID NO: 1752 - DNA, 21 bp, Saccharomyces cerevisiae
aacgttccttttacacaacca

SEQ ID NO: 1753 - DNA, 20 bp, Saccharomyces cerevisiae
accaccatcctcgtcatcat

SEQ ID NO: 1754 - DNA, 27 bp, Saccharomyces cerevisiae
tgatgatgtgtcttttgtacattactc

SEQ ID NO: 1755 - DNA, 27 bp, Saccharomyces cerevisiae
aattaaggtgtgtatatgtaatcaggc

SEQ ID NO: 1756 - DNA, 25 bp, Saccharomyces cerevisiae
tcataccaatgaattttatacaggc

SEQ ID NO: 1757 - DNA, 26 bp, Saccharomyces cerevisiae
gcctaaaacagcaaatttatgtagaa

SEQ ID NO: 1758 - DNA, 23 bp, Saccharomyces cerevisiae
aagttttcttgcagccgtataaa

SEQ ID NO: 1759 - DNA, 19 bp, Saccharomyces cerevisiae
ttattggtcagcctcgtcc

SEQ ID NO: 1760 - DNA, 24 bp, Saccharomyces cerevisiae
accagattctgataaaatgaaggt

SEQ ID NO: 1761 - DNA, 19 bp, Saccharomyces cerevisiae
taagccgatcccattaccg

SEQ ID NO: 1762 - DNA, 25 bp, Saccharomyces cerevisiae
gcaacacaagaacctactctctctc

SEQ ID NO: 1763 - DNA, 23 bp, Saccharomyces cerevisiae
ttctgatggtgaaatctttttgt

SEQ ID NO: 1764 - DNA, 26 bp, Saccharomyces cerevisiae
ataatttaatcaaatacttttgggca

SEQ ID NO: 1765 - DNA, 26 bp, Saccharomyces cerevisiae
aaagtaagacagtgccctttatagat

SEQ ID NO: 1766 - DNA, 25 bp, Saccharomyces cerevisiae
tctataatgtaatggaatgaagaaa

SEQ ID NO: 1767 - DNA, 23 bp, Saccharomyces cerevisiae
tctaactaaaaagcctcagctcg

SEQ ID NO: 1768 - DNA, 24 bp, Saccharomyces cerevisiae
gagtaaacgctgattatgtcacac

SEQ ID NO: 1769 - DNA, 23 bp, Saccharomyces cerevisiae
aaatggtcttgattgatacatgc

SEQ ID NO: 1770 - DNA, 24 bp, Saccharomyces cerevisiae
tggacttggtcaagatgaatagtt

SEQ ID NO: 1771 - DNA, 24 bp, Saccharomyces cerevisiae
caaaaatgtccttaataaacgcct

SEQ ID NO: 1772 - DNA, 27 bp, Saccharomyces cerevisiae
aataattctaaaatccataggtaagta

SEQ ID NO: 1773 - DNA, 24 bp, Saccharomyces cerevisiae
aacttcgaaagaaacagaggagtc

SEQ ID NO: 1774 - DNA, 20 bp, Saccharomyces cerevisiae
gcatcttgggattcggagaa

SEQ ID NO: 1775 - DNA, 23 bp, Saccharomyces cerevisiae
accaagtgaacatcagaaaatgc

SEQ ID NO: 1776 - DNA, 24 bp, Saccharomyces cerevisiae
catcagtgaataaaggcttgtaaa

SEQ ID NO: 1777 - DNA, 25 bp, Saccharomyces cerevisiae
ttacctttatacctttattttgccc

SEQ ID NO: 1778 - DNA, 21 bp, Saccharomyces cerevisiae
gcctgatcatttttcgtgtaa

SEQ ID NO: 1779 - DNA, 24 bp, Saccharomyces cerevisiae
catgactgctgatatactgaatcg

SEQ ID NO: 1780 - DNA, 21 bp, Saccharomyces cerevisiae
tggggttaagatagcaacgta

SEQ ID NO: 1781 - DNA, 23 bp, Saccharomyces cerevisiae
gattaaatcattttcgtttgcat

SEQ ID NO: 1782 - DNA, 23 bp, Saccharomyces cerevisiae
tgaaatagctacgcaacattgaa

SEQ ID NO: 1783 - DNA, 25 bp, Saccharomyces cerevisiae
gtgaacaaaacacaaataagacttg

SEQ ID NO: 1784 - DNA, 26 bp, Saccharomyces cerevisiae
acaaacaattgattttaaagtgctta

SEQ ID NO: 1785 - DNA, 23 bp, Saccharomyces cerevisiae
agatagggatacggactcaaact

SEQ ID NO: 1786 - DNA, 23 bp, Saccharomyces cerevisiae
tggtaatcatttgaaaaccttgc

SEQ ID NO: 1787 - DNA, 24 bp, Saccharomyces cerevisiae
aaaagaaaaagacacagctaggat

SEQ ID NO: 1788 - DNA, 25 bp, Saccharomyces cerevisiae
tcacattacaataacaaaactgcaa

SEQ ID NO: 1789 - DNA, 18 bp, Saccharomyces cerevisiae
tagcgtgtatgtggcacg

SEQ ID NO: 1790 - DNA, 26 bp, Saccharomyces cerevisiae
acatctataccctttatatgacattc

SEQ ID NO: 1791 - DNA, 25 bp, Saccharomyces cerevisiae
tttttctatcttcaacaacgaaacg

SEQ ID NO: 1792 - DNA, 26 bp, Saccharomyces cerevisiae
ggagattgataagacttttctagttg

SEQ ID NO: 1793 - DNA, 27 bp, Saccharomyces cerevisiae
agaaaaagtatacataaactcgaccaa

SEQ ID NO: 1794 - DNA, 23 bp, Saccharomyces cerevisiae
atgtgtcaaactaggctcaaaaa

SEQ ID NO: 1795 - DNA, 20 bp, Saccharomyces cerevisiae
tgagaataatttcgagcgcc

SEQ ID NO: 1796 - DNA, 25 bp, Saccharomyces cerevisiae
tgtcacaggaatgtttactaaaaga

SEQ ID NO: 1797 - DNA, 27 bp, Saccharomyces cerevisiae
ctatcattctcatcatttgtcatactt

SEQ ID NO: 1798 - DNA, 20 bp, Saccharomyces cerevisiae
aacctctccgcccgtatatt

SEQ ID NO: 1799 - DNA, 22 bp, Saccharomyces cerevisiae
tctccctgttcagtactttggt

SEQ ID NO: 1800 - DNA, 26 bp, Saccharomyces cerevisiae
ggctaattttagtagaaaagaagcaa

SEQ ID NO: 1801 - DNA, 23 bp, Saccharomyces cerevisiae
tgattggagcacccttactaaaa

SEQ ID NO: 1802 - DNA, 22 bp, Saccharomyces cerevisiae
accctacagcggtacatttctt

SEQ ID NO: 1803 - DNA, 23 bp, Saccharomyces cerevisiae
taaaattgatatgcgagctcttc

SEQ ID NO: 1804 - DNA, 25 bp, Saccharomyces cerevisiae
aagttctatcattagtatatgggga

SEQ ID NO: 1805 - DNA, 25 bp, Saccharomyces cerevisiae
cattattccgtgtggcaataatctc

SEQ ID NO: 1806 - DNA, 24 bp, Saccharomyces cerevisiae
tgccagtatttttcagctaatttc

SEQ ID NO: 1807 - DNA, 22 bp, Saccharomyces cerevisiae
tatggttctccgcaattttatg

SEQ ID NO: 1808 - DNA, 27 bp, Saccharomyces cerevisiae
catgaatagatcatgttaagtatcgaa

SEQ ID NO: 1809 - DNA, 27 bp, Saccharomyces cerevisiae
ttcaaggtgtaatctagtatggtttga

SEQ ID NO: 1810 - DNA, 27 bp, Saccharomyces cerevisiae
aaataaggttgatgtagtgtagtctaa

SEQ ID NO: 1811 - DNA, 27 bp, Saccharomyces cerevisiae
ttccgctaagagtcttcagaatataca

SEQ ID NO: 1812 - DNA, 26 bp, Saccharomyces cerevisiae
tatactcaatgtaacaatataacaaa

SEQ ID NO: 1813 - DNA, 26 bp, Saccharomyces cerevisiae
atggatctatataacttgaaatatgc

SEQ ID NO: 1814 - DNA, 25 bp, Saccharomyces cerevisiae
taagaattttgattagtgttagagc

SEQ ID NO: 1815 - DNA, 27 bp, Saccharomyces cerevisiae
agttaaacccaaagaaaatataaaaca

SEQ ID NO: 1816 - DNA, 26 bp, Saccharomyces cerevisiae
acgaatagatagaataaataagtaca

SEQ ID NO: 1817 - DNA, 27 bp, Saccharomyces cerevisiae
atataaactcataattgatagaaaggg

SEQ ID NO: 1818 - DNA, 24 bp, Saccharomyces cerevisiae
agtatctccatatcttgtgggagc

SEQ ID NO: 1819 - DNA, 26 bp, Saccharomyces cerevisiae
ttcgcgaaatagtataaatgaataga

SEQ ID NO: 1820 - DNA, 27 bp, Saccharomyces cerevisiae
gaaaagcaataacgatatacaagaaaa

SEQ ID NO: 1821 - DNA, 22 bp, Saccharomyces cerevisiae
cgttcctaactccaaatgtagg

SEQ ID NO: 1822 - DNA, 22 bp, Saccharomyces cerevisiae
tgacaaacagtatgttgcgatg

SEQ ID NO: 1823 - DNA, 23 bp, Saccharomyces cerevisiae
gtcactttcaaggacagttcaca

SEQ ID NO: 1824 - DNA, 27 bp, Saccharomyces cerevisiae
atattagcactgccacaatgtatagag

SEQ ID NO: 1825 - DNA, 22 bp, Saccharomyces cerevisiae
gtgactgaagaataaatgggga

SEQ ID NO: 1826 - DNA, 22 bp, Saccharomyces cerevisiae
ggctgatcggataattacaacc

SEQ ID NO: 1827 - DNA, 27 bp, Saccharomyces cerevisiae
ccctaaatgaactttatcttcttacag

SEQ ID NO: 1828 - DNA, 27 bp, Saccharomyces cerevisiae
cgtcaatactaagtttaaaagctcaaa

SEQ ID NO: 1829 - DNA, 21 bp, Saccharomyces cerevisiae
ttgccttagccacgtaatatg

SEQ ID NO: 1830 - DNA, 26 bp, Saccharomyces cerevisiae
taataaacattgataaataggcgtgc

SEQ ID NO: 1831 - DNA, 23 bp, Saccharomyces cerevisiae
tgtgggcttcagataacttaaca

SEQ ID NO: 1832 - DNA, 20 bp, Saccharomyces cerevisiae
ggcctgttctaagacaactt

SEQ ID NO: 1833 - DNA, 24 bp, Saccharomyces cerevisiae
tttaaatttgttctctgcctcctc

SEQ ID NO: 1834 - DNA, 24 bp, Saccharomyces cerevisiae
aaccatgatttctttttcgtcttt

SEQ ID NO: 1835 - DNA, 19 bp, Saccharomyces cerevisiae
gcgttaagcctcggaaact

SEQ ID NO: 1836 - DNA, 20 bp, Saccharomyces cerevisiae
acggattgaacacaccatgt

SEQ ID NO: 1837 - DNA, 22 bp, Saccharomyces cerevisiae
ttgaattgccactgttctaccc

SEQ ID NO: 1838 - DNA, 26 bp, Saccharomyces cerevisiae
tgaatgccaaatttacgaatatcaat

SEQ ID NO: 1839 - DNA, 27 bp, Saccharomyces cerevisiae
tgatttaagtcattgtatggtcatatt

SEQ ID NO: 1840 - DNA, 19 bp, Saccharomyces cerevisiae
accaatccgccattcattt

SEQ ID NO: 1841 - DNA, 22 bp, Saccharomyces cerevisiae
tcctcgtagtccaatttacgtg

SEQ ID NO: 1842 - DNA, 26 bp, Saccharomyces cerevisiae
aaattttgatttctatgtagtgcagc

SEQ ID NO: 1843 - DNA, 25 bp, Saccharomyces cerevisiae
taggacatattttcgtttccttttt

SEQ ID NO: 1844 - DNA, 22 bp, Saccharomyces cerevisiae
aaggaggagtagactaccatgt

SEQ ID NO: 1845 - DNA, 23 bp, Saccharomyces cerevisiae
aggaagtgaatggtaacgaaaaa

SEQ ID NO: 1846 - DNA, 20 bp, Saccharomyces cerevisiae
aggggaaataaaacggtggc

SEQ ID NO: 1847 - DNA, 27 bp, Saccharomyces cerevisiae
taaattagttgctcttctcttttgttc

SEQ ID NO: 1848 - DNA, 24 bp, Saccharomyces cerevisiae
aagatgtaaatctcttcgctgttc

SEQ ID NO: 1849 - DNA, 20 bp, Saccharomyces cerevisiae
tttggctcttcgatttgctg

SEQ ID NO: 1850 - DNA, 27 bp, Saccharomyces cerevisiae
aaacggatgaaatcctgtatattcaaa

SEQ ID NO: 1851 - DNA, 26 bp, Saccharomyces cerevisiae
aaataaggtcaaaagcaaataaaagc

SEQ ID NO: 1852 - DNA, 26 bp, Saccharomyces cerevisiae
ttagtctaaaaattttgctagcccat

SEQ ID NO: 1853 - DNA, 18 bp, Saccharomyces cerevisiae
agcaaaaaagggccgcat

SEQ ID NO: 1854 - DNA, 25 bp, Saccharomyces cerevisiae
caaagtcaattattttcaactttta

SEQ ID NO: 1855 - DNA, 27 bp, Saccharomyces cerevisiae
caaaaaaaaaattgaaaagtaactaca

SEQ ID NO: 1856 - DNA, 26 bp, Saccharomyces cerevisiae
ttcccattgataagactaaaattacg

SEQ ID NO: 1857 - DNA, 18 bp, Saccharomyces cerevisiae
cttctgcgtcgccaagat

SEQ ID NO: 1858 - DNA, 26 bp, Saccharomyces cerevisiae
gaaagtctgatgaaatttttctttcc

SEQ ID NO: 1859 - DNA, 21 bp, Saccharomyces cerevisiae
tgcagcagcaaatgtagagtg

SEQ ID NO: 1860 - DNA, 27 bp, Saccharomyces cerevisiae
gacgaataaatagacactcacatgtat

SEQ ID NO: 1861 - DNA, 25 bp, Saccharomyces cerevisiae
tcataatcggtgataaaaacaaaaa

SEQ ID NO: 1862 - DNA, 24 bp, Saccharomyces cerevisiae
aagcctactggctagtgttttatc

SEQ ID NO: 1863 - DNA, 27 bp, Saccharomyces cerevisiae
tttgggcttattactgattacagtttt

SEQ ID NO: 1864 - DNA, 26 bp, Saccharomyces cerevisiae
cttctatgtctcaacgttagcatttc

SEQ ID NO: 1865 - DNA, 27 bp, Saccharomyces cerevisiae
taaaacttgctctcacacataatagac

SEQ ID NO: 1866 - DNA, 21 bp, Saccharomyces cerevisiae
gacgaatagacactctccccc

SEQ ID NO: 1867 - DNA, 24 bp, Saccharomyces cerevisiae
tattgcaattacttcttctcatgc

SEQ ID NO: 1868 - DNA, 20 bp, Saccharomyces cerevisiae
tcaaggaagcctccatcatt

SEQ ID NO: 1869 - DNA, 23 bp, Saccharomyces cerevisiae
gctgtgttgattgatgtttttga

SEQ ID NO: 1870 - DNA, 23 bp, Saccharomyces cerevisiae
ggggttggttcttgtatagttga

SEQ ID NO: 1871 - DNA, 25 bp, Saccharomyces cerevisiae
ggcaatatgtatataaatgcgaaaa

SEQ ID NO: 1872 - DNA, 27 bp, Saccharomyces cerevisiae
tgtattaaataacatgcttttctgctc

SEQ ID NO: 1873 - DNA, 20 bp, Saccharomyces cerevisiae
gctctcacaaggtccacttc

SEQ ID NO: 1874 - DNA, 23 bp, Saccharomyces cerevisiae
gcttttttccttttggacttttt

SEQ ID NO: 1875 - DNA, 22 bp, Saccharomyces cerevisiae
tgatatcatctcaaaacatcgg

SEQ ID NO: 1876 - DNA, 27 bp, Saccharomyces cerevisiae
tatctatgataaacagagaaaattagc

SEQ ID NO: 1877 - DNA, 23 bp, Saccharomyces cerevisiae
caggtaactatgctcccttctcc

SEQ ID NO: 1878 - DNA, 25 bp, Saccharomyces cerevisiae
caagcttaagttcttttcaaacatt

SEQ ID NO: 1879 - DNA, 22 bp, Saccharomyces cerevisiae
gcgttctactctttgtcaaacc

SEQ ID NO: 1880 - DNA, 25 bp, Saccharomyces cerevisiae
acagaattactgctattctcttcca

SEQ ID NO: 1881 - DNA, 24 bp, Saccharomyces cerevisiae
gcctccgttaataagatcaagttt

SEQ ID NO: 1882 - DNA, 25 bp, Saccharomyces cerevisiae
ttcgatatgtacagaaagcttcaaa

SEQ ID NO: 1883 - DNA, 25 bp, Saccharomyces cerevisiae
tcacatatgaaagtatatacccgct

SEQ ID NO: 1884 - DNA, 21 bp, Saccharomyces cerevisiae
tgttcgtctttttattgcgct

SEQ ID NO: 1885 - DNA, 25 bp, Saccharomyces cerevisiae
agcgactcaaacaaattaaagaaga

SEQ ID NO: 1886 - DNA, 26 bp, Saccharomyces cerevisiae
cgttaatatccaaataaaagcaaaca

SEQ ID NO: 1887 - DNA, 26 bp, Saccharomyces cerevisiae
acgcttaagtagttataaaaataaaa

SEQ ID NO: 1888 - DNA, 27 bp, Saccharomyces cerevisiae
tccttaatgcttgtatatttcttcttt

SEQ ID NO: 1889 - DNA, 24 bp, Saccharomyces cerevisiae
aaaaatcgaacgaactcataaacg

SEQ ID NO: 1890 - DNA, 25 bp, Saccharomyces cerevisiae
tgaatagtgggcaactaatgtaata

SEQ ID NO: 1891 - DNA, 21 bp, Saccharomyces cerevisiae
gccaaacattagcgtgtattg

SEQ ID NO: 1892 - DNA, 20 bp, Saccharomyces cerevisiae
atgaagagctcatgcacagg

SEQ ID NO: 1893 - DNA, 20 bp, Saccharomyces cerevisiae
tttttcgcttgctcacattt

SEQ ID NO: 1894 - DNA, 25 bp, Saccharomyces cerevisiae
cgttgatgaatatttcaattcactt

SEQ ID NO: 1895 - DNA, 18 bp, Saccharomyces cerevisiae
gctctaccgcacccactc

SEQ ID NO: 1896 - DNA, 22 bp, Saccharomyces cerevisiae
cacaagataataaaaaagataa

SEQ ID NO: 1897 - DNA, 25 bp, Saccharomyces cerevisiae
cgccaaatatggacacttatatact

SEQ ID NO: 1898 - DNA, 23 bp, Saccharomyces cerevisiae
tttcagacaaactagggtgagga

SEQ ID NO: 1899 - DNA, 25 bp, Saccharomyces cerevisiae
aatctatgctatctatctttagtct

SEQ ID NO: 1900 - DNA, 26 bp, Saccharomyces cerevisiae
taaagtaagagttctttagacattca

SEQ ID NO: 1901 - DNA, 27 bp, Saccharomyces cerevisiae
tttgattgacgtttcataagaatacaa

SEQ ID NO: 1902 - DNA, 26 bp, Saccharomyces cerevisiae
ttacactcgtctttatacgaaactgg

SEQ ID NO: 1903 - DNA, 22 bp, Saccharomyces cerevisiae
aggagagtttgctctcttctgc

SEQ ID NO: 1904 - DNA, 27 bp, Saccharomyces cerevisiae
aaagatgatggcaatcctataattacg

SEQ ID NO: 1905 - DNA, 20 bp, Saccharomyces cerevisiae
acgaagcataaccaacgcct

SEQ ID NO: 1906 - DNA, 19 bp, Saccharomyces cerevisiae
ctttaatgcgatactgccg

SEQ ID NO: 1907 - DNA, 21 bp, Saccharomyces cerevisiae
tatggaaagaatcgccatgtt

SEQ ID NO: 1908 - DNA, 26 bp, Saccharomyces cerevisiae
ccatgataaattcaccacatgtatct

SEQ ID NO: 1909 - DNA, 25 bp, Saccharomyces cerevisiae
gtttgattatgaggagaagtgaaaa

SEQ ID NO: 1910 - DNA, 21 bp, Saccharomyces cerevisiae
tttggcttttccgcttagctt

SEQ ID NO: 1911 - DNA, 26 bp, Saccharomyces cerevisiae
ggcataagaggtaagacagttagtgg

SEQ ID NO: 1912 - DNA, 24 bp, Saccharomyces cerevisiae
tgggaaataagatagatgcagaga

SEQ ID NO: 1913 - DNA, 26 bp, Saccharomyces cerevisiae
ttatcaaaaagaataaaaggaagtgc

SEQ ID NO: 1914 - DNA, 20 bp, Saccharomyces cerevisiae
cttttggccaagtaggcaga

SEQ ID NO: 1915 - DNA, 26 bp, Saccharomyces cerevisiae
aaagttgaaatgaataggaggttagt

SEQ ID NO: 1916 - DNA, 20 bp, Saccharomyces cerevisiae
acgctttcgcaagatctcaa

SEQ ID NO: 1917 - DNA, 24 bp, Saccharomyces cerevisiae
agcctttggtaagaaaagtgtaag

SEQ ID NO: 1918 - DNA, 25 bp, Saccharomyces cerevisiae
gaatagaaaacgttgttgaatgaca

SEQ ID NO: 1919 - DNA, 25 bp, Saccharomyces cerevisiae
gccaagattaacataagacaagttt

SEQ ID NO: 1920 - DNA, 19 bp, Saccharomyces cerevisiae
accggttaacatcatggca

SEQ ID NO: 1921 - DNA, 24 bp, Saccharomyces cerevisiae
agggaccgttaatgattacaattt

SEQ ID NO: 1922 - DNA, 23 bp, Saccharomyces cerevisiae
gtgccattggtaagaagtaaagg

SEQ ID NO: 1923 - DNA, 25 bp, Saccharomyces cerevisiae
agaaatacccttctttccaaattga

SEQ ID NO: 1924 - DNA, 26 bp, Saccharomyces cerevisiae
taattctaagttactcgccttttaca

SEQ ID NO: 1925 - DNA, 20 bp, Saccharomyces cerevisiae
tcaccaaaaggagaaccaat

SEQ ID NO: 1926 - DNA, 25 bp, Saccharomyces cerevisiae
gatagtgcttagtctgtaatggacc

SEQ ID NO: 1927 - DNA, 27 bp, Saccharomyces cerevisiae
ataaagaatgcacggataaataagtaa

SEQ ID NO: 1928 - DNA, 24 bp, Saccharomyces cerevisiae
gagcaggtgagtagtaacatggaa

SEQ ID NO: 1929 - DNA, 26 bp, Saccharomyces cerevisiae
aagagaaagatagaaattcaaatgcc

SEQ ID NO: 1930 - DNA, 27 bp, Saccharomyces cerevisiae
tacatacaaatacatgccttactttcg

SEQ ID NO: 1931 - DNA, 25 bp, Saccharomyces cerevisiae
gaaaagctcattaatatttgagcac

SEQ ID NO: 1932 - DNA, 27 bp, Saccharomyces cerevisiae
attataatatacctatgtacagggcgg

SEQ ID NO: 1933 - DNA, 21 bp, Saccharomyces cerevisiae
aaataagatacattgccgctg

SEQ ID NO: 1934 - DNA, 24 bp, Saccharomyces cerevisiae
tcccaactctaatatacaggcatc

SEQ ID NO: 1935 - DNA, 27 bp, Saccharomyces cerevisiae
tccttgttttatatattcattgttcca

SEQ ID NO: 1936 - DNA, 21 bp, Saccharomyces cerevisiae
aagacagtagtcagcgttggg

SEQ ID NO: 1937 - DNA, 26 bp, Saccharomyces cerevisiae
cctcaaagacattctatatttcaacc

SEQ ID NO: 1938 - DNA, 26 bp, Saccharomyces cerevisiae
tttcaataaagtgaaacagaaaaatg

SEQ ID NO: 1939 - DNA, 25 bp, Saccharomyces cerevisiae
ggaatttacattatttagcaacgca

SEQ ID NO: 1940 - DNA, 20 bp, Saccharomyces cerevisiae
gaagttgccgcagtatggaa

SEQ ID NO: 1941 - DNA, 25 bp, Saccharomyces cerevisiae
taaatgtttaaatgcgtaaaaatgc

SEQ ID NO: 1942 - DNA, 26 bp, Saccharomyces cerevisiae
tagttttagcctcaccgatatactta

SEQ ID NO: 1943 - DNA, 20 bp, Saccharomyces cerevisiae
ttcagtgcactcttgcggat

SEQ ID NO: 1944 - DNA, 25 bp, Saccharomyces cerevisiae
ccacgccgatttattagtaagttca

SEQ ID NO: 1945 - DNA, 25 bp, Saccharomyces cerevisiae
atgtaaagtgataaaaatatacacg

SEQ ID NO: 1946 - DNA, 18 bp, Saccharomyces cerevisiae
gaaggcaaggccgaaaaa

SEQ ID NO: 1947 - DNA, 21 bp, Saccharomyces cerevisiae
tgagaaagttgtatatggccg

SEQ ID NO: 1948 - DNA, 20 bp, Saccharomyces cerevisiae
caaatttgacggagttgctc

SEQ ID NO: 1949 - DNA, 22 bp, Saccharomyces cerevisiae
tgtgttcatgtaacgaaaaggg

SEQ ID NO: 1950 - DNA, 26 bp, Saccharomyces cerevisiae
acttgacaataactatataaagcaaa

SEQ ID NO: 1951 - DNA, 18 bp, Saccharomyces cerevisiae
taaaaagggcggagcgag

SEQ ID NO: 1952 - DNA, 22 bp, Saccharomyces cerevisiae
attttctacgataaagtcacaa

SEQ ID NO: 1953 - DNA, 25 bp, Saccharomyces cerevisiae
aaaattgattatttactcctttcaa

SEQ ID NO: 1954 - DNA, 18 bp, Saccharomyces cerevisiae
taacgctcatcggttccc

SEQ ID NO: 1955 - DNA, 26 bp, Saccharomyces cerevisiae
tcgtaccatcaactcttgaatattgt

SEQ ID NO: 1956 - DNA, 27 bp, Saccharomyces cerevisiae
ggattttacctaatatgtattattttg

SEQ ID NO: 1957 - DNA, 26 bp, Saccharomyces cerevisiae
tgatgaaacaaaacttactattctgc

SEQ ID NO: 1958 - DNA, 25 bp, Saccharomyces cerevisiae
gcttgagagaaagttatgaggtagc

SEQ ID NO: 1959 - DNA, 21 bp, Saccharomyces cerevisiae
aaagaccgttaatgtggaggt

SEQ ID NO: 1960 - DNA, 24 bp, Saccharomyces cerevisiae
ttgctagtgagcctagataacgaa

SEQ ID NO: 1961 - DNA, 19 bp, Saccharomyces cerevisiae
acgcacggcatcatcttat

SEQ ID NO: 1962 - DNA, 23 bp, Saccharomyces cerevisiae
agggggctttgacgtataagtgt

SEQ ID NO: 1963 - DNA, 27 bp, Saccharomyces cerevisiae
tcctctaactaaaaattaaaaattcca

SEQ ID NO: 1964 - DNA, 26 bp, Saccharomyces cerevisiae
ttttatattcttccagtttctttggc

SEQ ID NO: 1965 - DNA, 23 bp, Saccharomyces cerevisiae
ctacacaagcacattgcatagaa

SEQ ID NO: 1966 - DNA, 27 bp, Saccharomyces cerevisiae
tgactaatgaaggaatgatattatgtg

SEQ ID NO: 1967 - DNA, 20 bp, Saccharomyces cerevisiae
gatttgacgcccttacgaat

SEQ ID NO: 1968 - DNA, 20 bp, Saccharomyces cerevisiae
tgaaatgtcaaaggcttcgc

SEQ ID NO: 1969 - DNA, 27 bp, Saccharomyces cerevisiae
gttctctttatcatctatatattactc

SEQ ID NO: 1970 - DNA, 26 bp, Saccharomyces cerevisiae
tagactccactttgcttctatagtcc

SEQ ID NO: 1971 - DNA, 26 bp, Saccharomyces cerevisiae
tcagaagactaaattacggacttgaa

SEQ ID NO: 1972 - DNA, 23 bp, Saccharomyces cerevisiae
atctaaggttatacgaggtgcaa

SEQ ID NO: 1973 - DNA, 20 bp, Saccharomyces cerevisiae
ggccgataaggtgtactggc

SEQ ID NO: 1974 - DNA, 20 bp, Saccharomyces cerevisiae
ctctgaattttcccacagcg

SEQ ID NO: 1975 - DNA, 27 bp, Saccharomyces cerevisiae
ttttaaaactgtagcaatctaccaatc

SEQ ID NO: 1976 - DNA, 25 bp, Saccharomyces cerevisiae
gtttttctttcatggtacccttatg

SEQ ID NO: 1977 - DNA, 26 bp, Saccharomyces cerevisiae
gtatgtagaatagatcaaaatggcaa

SEQ ID NO: 1978 - DNA, 20 bp, Saccharomyces cerevisiae
ggtcaaggccttttctggtc

SEQ ID NO: 1979 - DNA, 21 bp, Saccharomyces cerevisiae
gtcatccgcatcgcatatacc

SEQ ID NO: 1980 - DNA, 25 bp, Saccharomyces cerevisiae
tgtttctcgttcacgtatttatctc

SEQ ID NO: 1981 - DNA, 27 bp, Saccharomyces cerevisiae
taatatagcatttagagataggatttt

SEQ ID NO: 1982 - DNA, 23 bp, Saccharomyces cerevisiae
tatggtgggtgaaaattttgtaa

SEQ ID NO: 1983 - DNA, 27 bp, Saccharomyces cerevisiae
taccagaaagtctcagtagaatacacg

SEQ ID NO: 1984 - DNA, 20 bp, Saccharomyces cerevisiae
ccgccatctctactcactcc

SEQ ID NO: 1985 - DNA, 27 bp, Saccharomyces cerevisiae
gactttatagacacacaaaatatccct

SEQ ID NO: 1986 - DNA, 26 bp, Saccharomyces cerevisiae
tattaagtatataaagagccacgatt

SEQ ID NO: 1987 - DNA, 21 bp, Saccharomyces cerevisiae
taccaaaacaccccataggaa

SEQ ID NO: 1988 - DNA, 24 bp, Saccharomyces cerevisiae
atcgatcatgatagttaagggtga

SEQ ID NO: 1989 - DNA, 27 bp, Saccharomyces cerevisiae
aataacgattaaggaatgataatcaaa

SEQ ID NO: 1990 - DNA, 24 bp, Saccharomyces cerevisiae
aacagcggataaaataaaggtttt

SEQ ID NO: 1991 - DNA, 21 bp, Saccharomyces cerevisiae
ggaagatggtgataccaatgc

SEQ ID NO: 1992 - DNA, 26 bp, Saccharomyces cerevisiae
atatattatgttttatcatcatgcac

SEQ ID NO: 1993 - DNA, 23 bp, Saccharomyces cerevisiae
tcttatcattcaagttgcccttc

SEQ ID NO: 1994 - DNA, 27 bp, Saccharomyces cerevisiae
caatgataaaatagcatatcgttaaaa

SEQ ID NO: 1995 - DNA, 24 bp, Saccharomyces cerevisiae
taagcattttgtactttaaggcag

SEQ ID NO: 1996 - DNA, 23 bp, Saccharomyces cerevisiae
tttttctgtcgctacttcattca

SEQ ID NO: 1997 - DNA, 25 bp, Saccharomyces cerevisiae
cgtgaggagtgaactatacatagcg

SEQ ID NO: 1998 - DNA, 25 bp, Saccharomyces cerevisiae
cagcattaaaataatgtatggcttt

SEQ ID NO: 1999 - DNA, 23 bp, Saccharomyces cerevisiae
caattgttattgtgtccttccaa

SEQ ID NO: 2000 - DNA, 22 bp, Saccharomyces cerevisiae
gcaactgagcaaaaagcataca

SEQ ID NO: 2001 - DNA, 20 bp, Saccharomyces cerevisiae
tgcgcagtacgctctaagtt

SEQ ID NO: 2002 - DNA, 21 bp, Saccharomyces cerevisiae
cttgtcacttctcatccaccc

SEQ ID NO: 2003 - DNA, 27 bp, Saccharomyces cerevisiae
atataaaatgaaaataatatccaaaga

SEQ ID NO: 2004 - DNA, 24 bp, Saccharomyces cerevisiae
tacgattgacttagattcgatatt

SEQ ID NO: 2005 - DNA, 27 bp, Saccharomyces cerevisiae
atgccaatgtaattaacactctaaaaa

SEQ ID NO: 2006 - DNA, 27 bp, Saccharomyces cerevisiae
aaattgtactgagaatttatagggaaa

SEQ ID NO: 2007 - DNA, 22 bp, Saccharomyces cerevisiae
ggacagccatcatgaaattaaa

SEQ ID NO: 2008 - DNA, 23 bp, Saccharomyces cerevisiae
ggtagccattttcatttttatgc

SEQ ID NO: 2009 - DNA, 27 bp, Saccharomyces cerevisiae
catgtgattaatatcagaaggtaaatg

SEQ ID NO: 2010 - DNA, 24 bp, Saccharomyces cerevisiae
ttttccaaacactttccattacta

SEQ ID NO: 2011 - DNA, 23 bp, Saccharomyces cerevisiae
agatagaggttcctgacttgtcg

SEQ ID NO: 2012 - DNA, 27 bp, Saccharomyces cerevisiae
ttttagacaatattttttttttttttt

SEQ ID NO: 2013 - DNA, 25 bp, Saccharomyces cerevisiae
taaacaaatgttgaaaacttcttcg

SEQ ID NO: 2014 - DNA, 26 bp, Saccharomyces cerevisiae
aagcatatataccaaaaacaggagtg

SEQ ID NO: 2015 - DNA, 23 bp, Saccharomyces cerevisiae
agcatcaacacataaatccttgc

SEQ ID NO: 2016 - DNA, 21 bp, Saccharomyces cerevisiae
tttgttagaaaactcgcatcg

SEQ ID NO: 2017 - DNA, 23 bp, Saccharomyces cerevisiae
tgataatgaaggtaaacatcccc

SEQ ID NO: 2018 - DNA, 24 bp, Saccharomyces cerevisiae
tgacaaagaatccgataaaatgaa

SEQ ID NO: 2019 - DNA, 20 bp, Saccharomyces cerevisiae
gaagcttttttccgaaacct

SEQ ID NO: 2020 - DNA, 21 bp, Saccharomyces cerevisiae
acaggccagaaattttgaaag

SEQ ID NO: 2021 - DNA, 24 bp, Saccharomyces cerevisiae
cgcccataaatcgtctatattaaa

SEQ ID NO: 2022 - DNA, 27 bp, Saccharomyces cerevisiae
taacacttacagagtcctatcaggaaa

SEQ ID NO: 2023 - DNA, 27 bp, Saccharomyces cerevisiae
ttaattagttgatagactttttccgtc

SEQ ID NO: 2024 - DNA, 26 bp, Saccharomyces cerevisiae
ttttccagataggtacaacaattgaa

SEQ ID NO: 2025 - DNA, 24 bp, Saccharomyces cerevisiae
caatcaaatatacaaaacaatacg

SEQ ID NO: 2026 - DNA, 25 bp, Saccharomyces cerevisiae
acttctttcattcattttctcttgg

SEQ ID NO: 2027 - DNA, 25 bp, Saccharomyces cerevisiae
atctaaatctacatcgttctcagga

SEQ ID NO: 2028 - DNA, 26 bp, Saccharomyces cerevisiae
tgattaaatataacacgggataaaaa

SEQ ID NO: 2029 - DNA, 26 bp, Saccharomyces cerevisiae
taatgccttgattttgttttatcttc

SEQ ID NO: 2030 - DNA, 21 bp, Saccharomyces cerevisiae
tccagctaatcttccggtttt

SEQ ID NO: 2031 - DNA, 24 bp, Saccharomyces cerevisiae
ttttctttccttacgcacagtatg

SEQ ID NO: 2032 - DNA, 23 bp, Saccharomyces cerevisiae
aaacaactctgcagttcaaatca

SEQ ID NO: 2033 - DNA, 26 bp, Saccharomyces cerevisiae
aaaggcggtatttatctattatttgg

SEQ ID NO: 2034 - DNA, 26 bp, Saccharomyces cerevisiae
catgcatagaaagtcctactataaac

SEQ ID NO: 2035 - DNA, 25 bp, Saccharomyces cerevisiae
tgagttaggcaatactgagatgttt

SEQ ID NO: 2036 - DNA, 19 bp, Saccharomyces cerevisiae
taaatttgctccggtacgc

SEQ ID NO: 2037 - DNA, 25 bp, Saccharomyces cerevisiae
tagtgttagaactccaccttctgtg

SEQ ID NO: 2038 - DNA, 23 bp, Saccharomyces cerevisiae
gaataaaagtacccccattttcc

SEQ ID NO: 2039 - DNA, 25 bp, Saccharomyces cerevisiae
gtaaaagtgcaaaactagaaagccc

SEQ ID NO: 2040 - DNA, 19 bp, Saccharomyces cerevisiae
ggacgcgttaaggacattc

SEQ ID NO: 2041 - DNA, 25 bp, Saccharomyces cerevisiae
taaagaagcaccaaaagaaataaaa

SEQ ID NO: 2042 - DNA, 20 bp, Saccharomyces cerevisiae
ggcacagaaacaaagagcag

SEQ ID NO: 2043 - DNA, 26 bp, Saccharomyces cerevisiae
tttgaattaatctactcttaacactg

SEQ ID NO: 2044 - DNA, 24 bp, Saccharomyces cerevisiae
aacacttttatccattttttttcg

SEQ ID NO: 2045 - DNA, 22 bp, Saccharomyces cerevisiae
agaaatcaccacaacgacactt

SEQ ID NO: 2046 - DNA, 27 bp, Saccharomyces cerevisiae
aattaaagtatgacagaatcgtttgaa

SEQ ID NO: 2047 - DNA, 24 bp, Saccharomyces cerevisiae
agcttttttttccttttttttttc

SEQ ID NO: 2048 - DNA, 22 bp, Saccharomyces cerevisiae
tattcttcctgtaagcacagcg

SEQ ID NO: 2049 - DNA, 24 bp, Saccharomyces cerevisiae
tgattatttaggaagcacctcaga

SEQ ID NO: 2050 - DNA, 25 bp, Saccharomyces cerevisiae
taaagtatggtttgtcgttttgttc

SEQ ID NO: 2051 - DNA, 24 bp, Saccharomyces cerevisiae
tagaatgcattaaccagtgttttt

SEQ ID NO: 2052 - DNA, 27 bp, Saccharomyces cerevisiae
tgaacattaaatagcatagcataacaa

SEQ ID NO: 2053 - DNA, 25 bp, Saccharomyces cerevisiae
tacgagaataatttctcatcatcca

SEQ ID NO: 2054 - DNA, 27 bp, Saccharomyces cerevisiae
ttcggataaatatacaagtaaatagac

SEQ ID NO: 2055 - DNA, 25 bp, Saccharomyces cerevisiae
gttaggaaaacgaactgtaatgaat

SEQ ID NO: 2056 - DNA, 21 bp, Saccharomyces cerevisiae
tgaacaaaacggtgctcttag

SEQ ID NO: 2057 - DNA, 20 bp, Saccharomyces cerevisiae
ttatagtgatcatgtgcggc

SEQ ID NO: 2058 - DNA, 20 bp, Saccharomyces cerevisiae
agtggcatttggatttaccc

SEQ ID NO: 2059 - DNA, 22 bp, Saccharomyces cerevisiae
ccaccaacattcattttcactt

SEQ ID NO: 2060 - DNA, 25 bp, Saccharomyces cerevisiae
ttttacgaaaagtaaatagttgcga

SEQ ID NO: 2061 - DNA, 27 bp, Saccharomyces cerevisiae
agcagatcatgagtagaatatcaaaaa

SEQ ID NO: 2062 - DNA, 21 bp, Saccharomyces cerevisiae
gcttgactttcttcaccctcc

SEQ ID NO: 2063 - DNA, 27 bp, Saccharomyces cerevisiae
agagcttttaatttttattttttttca

SEQ ID NO: 2064 - DNA, 27 bp, Saccharomyces cerevisiae
ttgaagaaataagttgaataaaggaaa

SEQ ID NO: 2065 - DNA, 21 bp, Saccharomyces cerevisiae
atcctagagggcccataatca

SEQ ID NO: 2066 - DNA, 19 bp, Saccharomyces cerevisiae
catgccccatatggacaac

SEQ ID NO: 2067 - DNA, 24 bp, Saccharomyces cerevisiae
tcttgattgaagagatcaaagaga

SEQ ID NO: 2068 - DNA, 24 bp, Saccharomyces cerevisiae
gtccatttggttttcgtaaaatac

SEQ ID NO: 2069 - DNA, 18 bp, Saccharomyces cerevisiae
tagcgtgttacgcaccca

SEQ ID NO: 2070 - DNA, 27 bp, Saccharomyces cerevisiae
agtatgtttcagtatgagtacggtgaa

SEQ ID NO: 2071 - DNA, 26 bp, Saccharomyces cerevisiae
gtcaagaaaatgatatacaaaatggg

SEQ ID NO: 2072 - DNA, 22 bp, Saccharomyces cerevisiae
gcgtgatggcgtaaataataca

SEQ ID NO: 2073 - DNA, 23 bp, Saccharomyces cerevisiae
tatatacttccattattctatga

SEQ ID NO: 2074 - DNA, 25 bp, Saccharomyces cerevisiae
tgtactatatttccgtcatctcggt

SEQ ID NO: 2075 - DNA, 27 bp, Saccharomyces cerevisiae
acttgatagctcatgtatttacaaacc

SEQ ID NO: 2076 - DNA, 24 bp, Saccharomyces cerevisiae
taaaataaagacatataaaacgtg

SEQ ID NO: 2077 - DNA, 25 bp, Saccharomyces cerevisiae
agacgattgaaatccttcatatcta

SEQ ID NO: 2078 - DNA, 25 bp, Saccharomyces cerevisiae
cagcggtatacttatttttactccc

SEQ ID NO: 2079 - DNA, 27 bp, Saccharomyces cerevisiae
ttccgcattcaataaccttatgtattt

SEQ ID NO: 2080 - DNA, 25 bp, Saccharomyces cerevisiae
ttgttacgccttaacttttgttctc

SEQ ID NO: 2081 - DNA, 18 bp, Saccharomyces cerevisiae
tactaatcgccgtctcgg

SEQ ID NO: 2082 - DNA, 24 bp, Saccharomyces cerevisiae
acttttcatagcatcctccttgtc

SEQ ID NO: 2083 - DNA, 20 bp, Saccharomyces cerevisiae
atttagaacccgcatttgaa

SEQ ID NO: 2084 - DNA, 27 bp, Saccharomyces cerevisiae
ataagaaaattctagaaatagagagag

SEQ ID NO: 2085 - DNA, 26 bp, Saccharomyces cerevisiae
aaatcacaatcttccattttatttca

SEQ ID NO: 2086 - DNA, 20 bp, Saccharomyces cerevisiae
agttaagcgtcgccaaaaat

SEQ ID NO: 2087 - DNA, 22 bp, Saccharomyces cerevisiae
tcatgattgaggtgcagttttt

SEQ ID NO: 2088 - DNA, 25 bp, Saccharomyces cerevisiae
tgttgtaacgctatgtaattccacc

SEQ ID NO: 2089 - DNA, 23 bp, Saccharomyces cerevisiae
acaaacaaattaatcggatgatg

SEQ ID NO: 2090 - DNA, 22 bp, Saccharomyces cerevisiae
aagattgcatagcatgttctaa

SEQ ID NO: 2091 - DNA, 23 bp, Saccharomyces cerevisiae
ttcataagttccttttcagttcg

SEQ ID NO: 2092 - DNA, 26 bp, Saccharomyces cerevisiae
acaagcagtaaataaaacgtatagaa

SEQ ID NO: 2093 - DNA, 27 bp, Saccharomyces cerevisiae
ctacagagtagacctccgtattttaca

SEQ ID NO: 2094 - DNA, 27 bp, Saccharomyces cerevisiae
tacttctataaacggttagaaacaggc

SEQ ID NO: 2095 - DNA, 27 bp, Saccharomyces cerevisiae
gagtgggtataactaaatctttagacg

SEQ ID NO: 2096 - DNA, 26 bp, Saccharomyces cerevisiae
tggtgcaacaacaataataatagtaa

SEQ ID NO: 2097 - DNA, 21 bp, Saccharomyces cerevisiae
gccaccaccacatttttagag

SEQ ID NO: 2098 - DNA, 26 bp, Saccharomyces cerevisiae
cccattagataaatagacaacctgta

SEQ ID NO: 2099 - DNA, 19 bp, Saccharomyces cerevisiae
ttctttaaggcgacgcacc

SEQ ID NO: 2100 - DNA, 27 bp, Saccharomyces cerevisiae
cttaaatgagaaaaatttcgtaatgag

SEQ ID NO: 2101 - DNA, 26 bp, Saccharomyces cerevisiae
cacatccaagtacagtaaatttgtca

SEQ ID NO: 2102 - DNA, 21 bp, Saccharomyces cerevisiae
gcatttcgttcacttaccaaa

SEQ ID NO: 2103 - DNA, 26 bp, Saccharomyces cerevisiae
caggtaaagttttcttgccttataca

SEQ ID NO: 2104 - DNA, 21 bp, Saccharomyces cerevisiae
aatctcctgaaaatctcccga

SEQ ID NO: 2105 - DNA, 27 bp, Saccharomyces cerevisiae
agtagatgatagttggtttttattcca

SEQ ID NO: 2106 - DNA, 27 bp, Saccharomyces cerevisiae
aaaaaggtataacacatacatatagaa

SEQ ID NO: 2107 - DNA, 26 bp, Saccharomyces cerevisiae
cagttgtttactcgaattttgcaatc

SEQ ID NO: 2108 - DNA, 23 bp, Saccharomyces cerevisiae
ttttcatgtaaaccctcttctca

SEQ ID NO: 2109 - DNA, 27 bp, Saccharomyces cerevisiae
catagcaaatgatagaaaaatagtcaa

SEQ ID NO: 2110 - DNA, 27 bp, Saccharomyces cerevisiae
tgctaatgtaatgcaatcatgttttgt

SEQ ID NO: 2111 - DNA, 27 bp, Saccharomyces cerevisiae
aatatcacaattaacattctacaacca

SEQ ID NO: 2112 - DNA, 21 bp, Saccharomyces cerevisiae
atggcatgagttcagagtcaa

SEQ ID NO: 2113 - DNA, 24 bp, Saccharomyces cerevisiae
tagttctatatcgcgacgtattgt

SEQ ID NO: 2114 - DNA, 27 bp, Saccharomyces cerevisiae
agacacattctcattcgaaatattgta

SEQ ID NO: 2115 - DNA, 21 bp, Saccharomyces cerevisiae
aaggaggagcaaatcaacctg

SEQ ID NO: 2116 - DNA, 25 bp, Saccharomyces cerevisiae
aatttataactagatgaacgataga

SEQ ID NO: 2117 - DNA, 20 bp, Saccharomyces cerevisiae
taagctggtccgtacgttgg

SEQ ID NO: 2118 - DNA, 25 bp, Saccharomyces cerevisiae
gacaaggattaaccattagaactgc

SEQ ID NO: 2119 - DNA, 27 bp, Saccharomyces cerevisiae
agtcagagataaaagagacgtatagga

SEQ ID NO: 2120 - DNA, 26 bp, Saccharomyces cerevisiae
tgggcatagtatctcacgtatatttt

SEQ ID NO: 2121 - DNA, 26 bp, Saccharomyces cerevisiae
atttgggtagtttaagggaatattgt

SEQ ID NO: 2122 - DNA, 23 bp, Saccharomyces cerevisiae
atggcagagtaccaacactaccg

SEQ ID NO: 2123 - DNA, 27 bp, Saccharomyces cerevisiae
aatcagcaaatataactaccactaagc

SEQ ID NO: 2124 - DNA, 21 bp, Saccharomyces cerevisiae
ccaaaactggaacaccaaaaa

SEQ ID NO: 2125 - DNA, 19 bp, Saccharomyces cerevisiae
tactgatggtgcgttttgc

SEQ ID NO: 2126 - DNA, 25 bp, Saccharomyces cerevisiae
atactattctctcttcctttctggc

SEQ ID NO: 2127 - DNA, 26 bp, Saccharomyces cerevisiae
tcataaggtaatgtcaacagcttaaa

SEQ ID NO: 2128 - DNA, 23 bp, Saccharomyces cerevisiae
tgtaagccataaacgaaatttta

SEQ ID NO: 2129 - DNA, 26 bp, Saccharomyces cerevisiae
gctgtgtcttaaaatataccatccaa

SEQ ID NO: 2130 - DNA, 22 bp, Saccharomyces cerevisiae
ccaaactgatagatagtcgcgt

SEQ ID NO: 2131 - DNA, 26 bp, Saccharomyces cerevisiae
ctgcagtaattctttttgcactactt

SEQ ID NO: 2132 - DNA, 24 bp, Saccharomyces cerevisiae
aaaacttgagcataaggcgtataa

SEQ ID NO: 2133 - DNA, 18 bp, Saccharomyces cerevisiae
ggcagtgattggcatggt

SEQ ID NO: 2134 - DNA, 25 bp, Saccharomyces cerevisiae
ttatttatgaaaattggcctgtaaa

SEQ ID NO: 2135 - DNA, 20 bp, Saccharomyces cerevisiae
aaacaactatacccgcctgc

SEQ ID NO: 2136 - DNA, 27 bp, Saccharomyces cerevisiae
atacaaagctaaacagtctcctctttt

SEQ ID NO: 2137 - DNA, 27 bp, Saccharomyces cerevisiae
actttttattaagattacgtccctaca

SEQ ID NO: 2138 - DNA, 23 bp, Saccharomyces cerevisiae
cttttgcttcctgtttttgtttt

SEQ ID NO: 2139 - DNA, 25 bp, Saccharomyces cerevisiae
accggaataatttttgtagagaatc

SEQ ID NO: 2140 - DNA, 27 bp, Saccharomyces cerevisiae
tatatgacaccatgtattctttaccat

SEQ ID NO: 2141 - DNA, 23 bp, Saccharomyces cerevisiae
gcattcttatgtaccgcattaaa

SEQ ID NO: 2142 - DNA, 25 bp, Saccharomyces cerevisiae
ttttgagcataccattttcttagtt

SEQ ID NO: 2143 - DNA, 22 bp, Saccharomyces cerevisiae
ttataatacttccaggtcgtgt

SEQ ID NO: 2144 - DNA, 23 bp, Saccharomyces cerevisiae
aaagaaaatgcccgtaattcgac

SEQ ID NO: 2145 - DNA, 20 bp, Saccharomyces cerevisiae
aagagccgcataaggaagaa

SEQ ID NO: 2146 - DNA, 19 bp, Saccharomyces cerevisiae
gatgcgtaacgagcgagta

SEQ ID NO: 2147 - DNA, 22 bp, Saccharomyces cerevisiae
ggtattttttctttctgctggg

SEQ ID NO: 2148 - DNA, 20 bp, Saccharomyces cerevisiae
aggaaatctccaacctggac

SEQ ID NO: 2149 - DNA, 21 bp, Saccharomyces cerevisiae
gaaaaggggacataccaagaa

SEQ ID NO: 2150 - DNA, 24 bp, Saccharomyces cerevisiae
tatgtcatacttttagcgctcatt

SEQ ID NO: 2151 - DNA, 23 bp, Saccharomyces cerevisiae
cggtaaaataatcacctgaaaaa

SEQ ID NO: 2152 - DNA, 22 bp, Saccharomyces cerevisiae
tcgccctgagagattttatttt

SEQ ID NO: 2153 - DNA, 20 bp, Saccharomyces cerevisiae
aaaggcaaaaattaacgcga

SEQ ID NO: 2154 - DNA, 27 bp, Saccharomyces cerevisiae
atattgggataacttttgaatacaact

SEQ ID NO: 2155 - DNA, 25 bp, Saccharomyces cerevisiae
taatgatgtaaaagaaaagagaggg

SEQ ID NO: 2156 - DNA, 27 bp, Saccharomyces cerevisiae
agttaatatccttcacttttcaccttc

SEQ ID NO: 2157 - DNA, 23 bp, Saccharomyces cerevisiae
acggtttattgattttgtttcca

SEQ ID NO: 2158 - DNA, 19 bp, Saccharomyces cerevisiae
tgcattataggccccaatc

SEQ ID NO: 2159 - DNA, 27 bp, Saccharomyces cerevisiae
gagcgatatagtaagagagagaaagaa

SEQ ID NO: 2160 - DNA, 21 bp, Saccharomyces cerevisiae
aaaacgttcccttatccttcg

SEQ ID NO: 2161 - DNA, 20 bp, Saccharomyces cerevisiae
tggtgaatgccttgatgaca

SEQ ID NO: 2162 - DNA, 27 bp, Saccharomyces cerevisiae
tctcaataactcttcttccatattttc

SEQ ID NO: 2163 - DNA, 27 bp, Saccharomyces cerevisiae
gattgtaaatatatgctactttcttcc

SEQ ID NO: 2164 - DNA, 26 bp, Saccharomyces cerevisiae
ataaagcaatcttgatgaggataatg

SEQ ID NO: 2165 - DNA, 25 bp, Saccharomyces cerevisiae
aggacacagcagaaacagtattaca

SEQ ID NO: 2166 - DNA, 27 bp, Saccharomyces cerevisiae
gtttgatagtaagagacgtaagaacct

SEQ ID NO: 2167 - DNA, 26 bp, Saccharomyces cerevisiae
tgatacttaagagctaaacgaaaaga

SEQ ID NO: 2168 - DNA, 25 bp, Saccharomyces cerevisiae
agacattagctttgagaatttgtgc

SEQ ID NO: 2169 - DNA, 24 bp, Saccharomyces cerevisiae
taatcacgataataataacaacaa

SEQ ID NO: 2170 - DNA, 20 bp, Saccharomyces cerevisiae
tgatgccttccttgttcagg

SEQ ID NO: 2171 - DNA, 26 bp, Saccharomyces cerevisiae
ctggcagagtaatagaaaggagtagc

SEQ ID NO: 2172 - DNA, 27 bp, Saccharomyces cerevisiae
agactttaacagacttgcacaattttt

SEQ ID NO: 2173 - DNA, 26 bp, Saccharomyces cerevisiae
ctatcttaaacactaaactacctcct

SEQ ID NO: 2174 - DNA, 26 bp, Saccharomyces cerevisiae
tctgaagaataacctaccaaacttca

SEQ ID NO: 2175 - DNA, 26 bp, Saccharomyces cerevisiae
aattattattactttcttcccctccg

SEQ ID NO: 2176 - DNA, 22 bp, Saccharomyces cerevisiae
agtggttacatttggatagcga

SEQ ID NO: 2177 - DNA, 23 bp, Saccharomyces cerevisiae
agctgatacatgggttagtttcc

SEQ ID NO: 2178 - DNA, 24 bp, Saccharomyces cerevisiae
tggtaatcaaaatgtatttagcga

SEQ ID NO: 2179 - DNA, 27 bp, Saccharomyces cerevisiae
ataaaaatcccaatttattctcttacc

SEQ ID NO: 2180 - DNA, 22 bp, Saccharomyces cerevisiae
gtatcgctaatgtataaaaaaa

SEQ ID NO: 2181 - DNA, 25 bp, Saccharomyces cerevisiae
aggagtagaatgagatgagaaagca

SEQ ID NO: 2182 - DNA, 19 bp, Saccharomyces cerevisiae
tgaattgaatcaaacgccg

SEQ ID NO: 2183 - DNA, 26 bp, Saccharomyces cerevisiae
ccttcttgtatacagcacaaataaaa

SEQ ID NO: 2184 - DNA, 27 bp, Saccharomyces cerevisiae
aaaagaaaagacaaaaaagctaaactg

SEQ ID NO: 2185 - DNA, 18 bp, Saccharomyces cerevisiae
taaagtacgaaggcgggc

SEQ ID NO: 2186 - DNA, 24 bp, Saccharomyces cerevisiae
ggtctgtaaacttgtgaactctcg

SEQ ID NO: 2187 - DNA, 26 bp, Saccharomyces cerevisiae
tagcttgataaaattactcttctgcc

SEQ ID NO: 2188 - DNA, 22 bp, Saccharomyces cerevisiae
tgcaactatgtcgctcattaac

SEQ ID NO: 2189 - DNA, 20 bp, Saccharomyces cerevisiae
ttctttgcgtaatccgaacg

SEQ ID NO: 2190 - DNA, 25 bp, Saccharomyces cerevisiae
cctcgaggttaaacttcattactgc

SEQ ID NO: 2191 - DNA, 21 bp, Saccharomyces cerevisiae
acttccaacattttcctctcg

SEQ ID NO: 2192 - DNA, 19 bp, Saccharomyces cerevisiae
aatgtcgatcaggcacgtt

SEQ ID NO: 2193 - DNA, 22 bp, Saccharomyces cerevisiae
taatcacacttgaatgtgctgc

SEQ ID NO: 2194 - DNA, 23 bp, Saccharomyces cerevisiae
tcgggcaaactaagtctagttca

SEQ ID NO: 2195 - DNA, 27 bp, Saccharomyces cerevisiae
gaagtataattaaatcgtcttcatcag

SEQ ID NO: 2196 - DNA, 27 bp, Saccharomyces cerevisiae
tagggtaaagtgaaatatcaacaactt

SEQ ID NO: 2197 - DNA, 21 bp, Saccharomyces cerevisiae
gttattatataacgaaactat

SEQ ID NO: 2198 - DNA, 22 bp, Saccharomyces cerevisiae
agtgattctgtcattccagtcc

SEQ ID NO: 2199 - DNA, 25 bp, Saccharomyces cerevisiae
tttgaatttccaatatcctagtcac

SEQ ID NO: 2200 - DNA, 23 bp, Saccharomyces cerevisiae
caattctttgtcctgcatacctt

SEQ ID NO: 2201 - DNA, 27 bp, Saccharomyces cerevisiae
attactgtaaattttctcatctaccca

SEQ ID NO: 2202 - DNA, 23 bp, Saccharomyces cerevisiae
taatgaaaattttagccgtgaca

SEQ ID NO: 2203 - DNA, 27 bp, Saccharomyces cerevisiae
ttgtgaaagaataatacaaagagaaaa

SEQ ID NO: 2204 - DNA, 27 bp, Saccharomyces cerevisiae
tgtatttagaaagaaaagaaaagtgga

SEQ ID NO: 2205 - DNA, 20 bp, Saccharomyces cerevisiae
tgaaattcatgcgcttgcta

SEQ ID NO: 2206 - DNA, 25 bp, Saccharomyces cerevisiae
tacgtagaatttgaatgtcaatctg

SEQ ID NO: 2207 - DNA, 27 bp, Saccharomyces cerevisiae
tgattaacaatcttatagcatggattc

SEQ ID NO: 2208 - DNA, 26 bp, Saccharomyces cerevisiae
tgaaaataaaatgccaagttttatag

SEQ ID NO: 2209 - DNA, 20 bp, Saccharomyces cerevisiae
tgtaatccatcaccccccta

SEQ ID NO: 2210 - DNA, 27 bp, Saccharomyces cerevisiae
atacaaaaagtttattttcttatatcc

SEQ ID NO: 2211 - DNA, 24 bp, Saccharomyces cerevisiae
aaaggatacggtacaaagattcaa

SEQ ID NO: 2212 - DNA, 26 bp, Saccharomyces cerevisiae
ccaaggtaacaatcaaaaataatagc

SEQ ID NO: 2213 - DNA, 26 bp, Saccharomyces cerevisiae
aatgaatcgtagatactgaaaaaccc

SEQ ID NO: 2214 - DNA, 27 bp, Saccharomyces cerevisiae
aagagtaaatagcgtgtatcttctcaa

SEQ ID NO: 2215 - DNA, 21 bp, Saccharomyces cerevisiae
tagtgaggcgattagatgtcg

SEQ ID NO: 2216 - DNA, 27 bp, Saccharomyces cerevisiae
taatgattgtgttagttatggactgga

SEQ ID NO: 2217 - DNA, 18 bp, Saccharomyces cerevisiae
gcatgagcacacgctcta

SEQ ID NO: 2218 - DNA, 26 bp, Saccharomyces cerevisiae
atcgaataatgattacgctaataaca

SEQ ID NO: 2219 - DNA, 25 bp, Saccharomyces cerevisiae
tgaaagtatgtacatttggaagagc

SEQ ID NO: 2220 - DNA, 25 bp, Saccharomyces cerevisiae
caataagaacgctctttgtttatct

SEQ ID NO: 2221 - DNA, 22 bp, Saccharomyces cerevisiae
aaaaacaccaaagaatggagag

SEQ ID NO: 2222 - DNA, 22 bp, Saccharomyces cerevisiae
ttggtgtgaaatctctctgtga

SEQ ID NO: 2223 - DNA, 25 bp, Saccharomyces cerevisiae
ggagacatttaatagaccccatttt

SEQ ID NO: 2224 - DNA, 26 bp, Saccharomyces cerevisiae
aatatatatactacttcaacatgtca

SEQ ID NO: 2225 - DNA, 24 bp, Saccharomyces cerevisiae
ctgctgctactgcattgatatact

SEQ ID NO: 2226 - DNA, 25 bp, Saccharomyces cerevisiae
tataaaaacttgcattgtgagaaaa

SEQ ID NO: 2227 - DNA, 19 bp, Saccharomyces cerevisiae
tgcagtcgcattatcgtcg

SEQ ID NO: 2228 - DNA, 24 bp, Saccharomyces cerevisiae
aaaggcagttttcaatgctttcac

SEQ ID NO: 2229 - DNA, 24 bp, Saccharomyces cerevisiae
tgactttgcttttgatttcacttt

SEQ ID NO: 2230 - DNA, 23 bp, Saccharomyces cerevisiae
gtcagacgtttggcatatactga

SEQ ID NO: 2231 - DNA, 27 bp, Saccharomyces cerevisiae
aacggatgcattttatataattttagc

SEQ ID NO: 2232 - DNA, 25 bp, Saccharomyces cerevisiae
ctgatactttaccatacgggagttg

SEQ ID NO: 2233 - DNA, 25 bp, Saccharomyces cerevisiae
gattaaacgtaataaaaataaatgc

SEQ ID NO: 2234 - DNA, 27 bp, Saccharomyces cerevisiae
ttggaagatacttagtcatatggattt

SEQ ID NO: 2235 - DNA, 27 bp, Saccharomyces cerevisiae
aaatttcagccaataagcattatattc

SEQ ID NO: 2236 - DNA, 22 bp, Saccharomyces cerevisiae
aatttctgaatacatacagcgt

SEQ ID NO: 2237 - DNA, 20 bp, Saccharomyces cerevisiae
cgggttcatcaagctttttt

SEQ ID NO: 2238 - DNA, 26 bp, Saccharomyces cerevisiae
atagttgtgtattgttcctgcatttt

SEQ ID NO: 2239 - DNA, 24 bp, Saccharomyces cerevisiae
aatggaatattgaaactggagtga

SEQ ID NO: 2240 - DNA, 25 bp, Saccharomyces cerevisiae
cacgctttaataatatttgtggttc

SEQ ID NO: 2241 - DNA, 26 bp, Saccharomyces cerevisiae
ggacactataaataacaaacaatcgc

SEQ ID NO: 2242 - DNA, 26 bp, Saccharomyces cerevisiae
aacaaaaaaggaaaacaaaaaaaaga

SEQ ID NO: 2243 - DNA, 25 bp, Saccharomyces cerevisiae
taattggataatatgttactactgt

SEQ ID NO: 2244 - DNA, 20 bp, Saccharomyces cerevisiae
cttgctcaacgcgaccttat

SEQ ID NO: 2245 - DNA, 21 bp, Saccharomyces cerevisiae
ctccgcaccttataaaaacaa

SEQ ID NO: 2246 - DNA, 25 bp, Saccharomyces cerevisiae
ctggcaatataaacacaagtgtagc

SEQ ID NO: 2247 - DNA, 20 bp, Saccharomyces cerevisiae
ataagaacccacgcttcaaa

SEQ ID NO: 2248 - DNA, 27 bp, Saccharomyces cerevisiae
cttttcacttgataaattaaaactacg

SEQ ID NO: 2249 - DNA, 23 bp, Saccharomyces cerevisiae
atatttggtccggccaattttta

SEQ ID NO: 2250 - DNA, 24 bp, Saccharomyces cerevisiae
aattgctcgtacacactagaagcc

SEQ ID NO: 2251 - DNA, 27 bp, Saccharomyces cerevisiae
accttctttttttatatttcgattttt

SEQ ID NO: 2252 - DNA, 26 bp, Saccharomyces cerevisiae
ctaatgtccactattgatgctttctc

SEQ ID NO: 2253 - DNA, 27 bp, Saccharomyces cerevisiae
tacaaaaaattaacatatacataaaag

SEQ ID NO: 2254 - DNA, 27 bp, Saccharomyces cerevisiae
tttattatttagtacacgtatgtagca

SEQ ID NO: 2255 - DNA, 25 bp, Saccharomyces cerevisiae
gaaaaatagatttgccgtctactta

SEQ ID NO: 2256 - DNA, 26 bp, Saccharomyces cerevisiae
tacaataaatagggagcagatattga

SEQ ID NO: 2257 - DNA, 24 bp, Saccharomyces cerevisiae
aggtactagcccgtaatttttgtg

SEQ ID NO: 2258 - DNA, 22 bp, Saccharomyces cerevisiae
atgtgatcatcatggtccaacg

SEQ ID NO: 2259 - DNA, 26 bp, Saccharomyces cerevisiae
tgaacagtgaagattaaacctatgtg

SEQ ID NO: 2260 - DNA, 18 bp, Saccharomyces cerevisiae
acgacgaagcacgtgaca

SEQ ID NO: 2261 - DNA, 21 bp, Saccharomyces cerevisiae
acgatcaccaaagcattagca

SEQ ID NO: 2262 - DNA, 26 bp, Saccharomyces cerevisiae
tgtatataacttaatctaatctgcac

SEQ ID NO: 2263 - DNA, 20 bp, Saccharomyces cerevisiae
ttcagcagctaccgccatta

SEQ ID NO: 2264 - DNA, 24 bp, Saccharomyces cerevisiae
agtatttaagcaaaagaatgcaca

SEQ ID NO: 2265 - DNA, 27 bp, Saccharomyces cerevisiae
tgaagcacacaactatttctataagca

SEQ ID NO: 2266 - DNA, 21 bp, Saccharomyces cerevisiae
ttctttctggtggcatttttc

SEQ ID NO: 2267 - DNA, 22 bp, Saccharomyces cerevisiae
tacaatatcgcttccctaggac

SEQ ID NO: 2268 - DNA, 25 bp, Saccharomyces cerevisiae
aaagaccccataatatctacgaagg

SEQ ID NO: 2269 - DNA, 26 bp, Saccharomyces cerevisiae
ctttttttttctttttttctcatttt

SEQ ID NO: 2270 - DNA, 27 bp, Saccharomyces cerevisiae
accatgtaattgatagaggtagaatgt

SEQ ID NO: 2271 - DNA, 22 bp, Saccharomyces cerevisiae
tgaacgtggagttttacttttg

SEQ ID NO: 2272 - DNA, 25 bp, Saccharomyces cerevisiae
atttaaagcaatagtaatcgtggac

SEQ ID NO: 2273 - DNA, 21 bp, Saccharomyces cerevisiae
taggcagggcctattaagtgc

SEQ ID NO: 2274 - DNA, 21 bp, Saccharomyces cerevisiae
aactcgaaataaaacgataaa

SEQ ID NO: 2275 - DNA, 27 bp, Saccharomyces cerevisiae
acgagtacttcactttcaaatatcacg

SEQ ID NO: 2276 - DNA, 27 bp, Saccharomyces cerevisiae
gtgatcattattttctttttgatgttc

SEQ ID NO: 2277 - DNA, 27 bp, Saccharomyces cerevisiae
aagtagataaatcaccacgaatcattt

SEQ ID NO: 2278 - DNA, 20 bp, Saccharomyces cerevisiae
aaagggacgtgtcgtaacat

SEQ ID NO: 2279 - DNA, 27 bp, Saccharomyces cerevisiae
tgatcctactttgcatactaataaaaa

SEQ ID NO: 2280 - DNA, 27 bp, Saccharomyces cerevisiae
tatagctacttatgtatatagcgcttg

SEQ ID NO: 2281 - DNA, 20 bp, Saccharomyces cerevisiae
ggagacagcaaactgaaacg

SEQ ID NO: 2282 - DNA, 27 bp, Saccharomyces cerevisiae
tagaattcaagtcaaaaaaaaaaaaaa

SEQ ID NO: 2283 - DNA, 27 bp, Saccharomyces cerevisiae
aattgttacaaaaaggaaagaagaaaa

SEQ ID NO: 2284 - DNA, 27 bp, Saccharomyces cerevisiae
actgtactacactaatgcttctccaca

SEQ ID NO: 2285 - DNA, 26 bp, Saccharomyces cerevisiae
tgattacgtccgtagaaataaaatga

SEQ ID NO: 2286 - DNA, 22 bp, Saccharomyces cerevisiae
ttgaatcatgcacgttatccag

SEQ ID NO: 2287 - DNA, 23 bp, Saccharomyces cerevisiae
gaaggcatataaaatagatcgtt

SEQ ID NO: 2288 - DNA, 25 bp, Saccharomyces cerevisiae
aaatactcctaattcaatttctttt

SEQ ID NO: 2289 - DNA, 26 bp, Saccharomyces cerevisiae
tctgtgtgaagtgtcaaatagttaaa

SEQ ID NO: 2290 - DNA, 25 bp, Saccharomyces cerevisiae
agtactcacgttctcgtgttaatcc

SEQ ID NO: 2291 - DNA, 22 bp, Saccharomyces cerevisiae
ccaattcaaaacttccaacagt

SEQ ID NO: 2292 - DNA, 23 bp, Saccharomyces cerevisiae
actccttttacttcggttgtgaa

SEQ ID NO: 2293 - DNA, 24 bp, Saccharomyces cerevisiae
tggttaagatagaagtaaccgtga

SEQ ID NO: 2294 - DNA, 22 bp, Saccharomyces cerevisiae
caaattgcctaatgagcaaaaa

SEQ ID NO: 2295 - DNA, 27 bp, Saccharomyces cerevisiae
gtagtaagttcaagttcagaagaccca

SEQ ID NO: 2296 - DNA, 24 bp, Saccharomyces cerevisiae
tgaattttacttcacgctactgat

SEQ ID NO: 2297 - DNA, 27 bp, Saccharomyces cerevisiae
tcataccacatactcatatataaagac

SEQ ID NO: 2298 - DNA, 23 bp, Saccharomyces cerevisiae
ttttggattattccttccactca

SEQ ID NO: 2299 - DNA, 27 bp, Saccharomyces cerevisiae
gtctatgaattacaaatacactaaaca

SEQ ID NO: 2300 - DNA, 26 bp, Saccharomyces cerevisiae
cgatctttatatttgtcaccttttcc

SEQ ID NO: 2301 - DNA, 26 bp, Saccharomyces cerevisiae
tggtagaagaaagttagataccctca

SEQ ID NO: 2302 - DNA, 23 bp, Saccharomyces cerevisiae
taggcaggacaatttcagtgttt

SEQ ID NO: 2303 - DNA, 23 bp, Saccharomyces cerevisiae
tcgtctaagatgtgagcaccata

SEQ ID NO: 2304 - DNA, 27 bp, Saccharomyces cerevisiae
acatataaacataaagatacatagcaa

SEQ ID NO: 2305 - DNA, 25 bp, Saccharomyces cerevisiae
atgaaatactgacagcttatgatgc

SEQ ID NO: 2306 - DNA, 21 bp, Saccharomyces cerevisiae
ataacttatggcatgggaggg

SEQ ID NO: 2307 - DNA, 18 bp, Saccharomyces cerevisiae
atctagccgcccaatgtc

SEQ ID NO: 2308 - DNA, 24 bp, Saccharomyces cerevisiae
acacactagtgcatcaatatttgc

SEQ ID NO: 2309 - DNA, 26 bp, Saccharomyces cerevisiae
tactacttaaaagcgcaacagatttt

SEQ ID NO: 2310 - DNA, 27 bp, Saccharomyces cerevisiae
atttagactttgtttggaatacattga

SEQ ID NO: 2311 - DNA, 24 bp, Saccharomyces cerevisiae
tcaagggtcttccatacttctctc

SEQ ID NO: 2312 - DNA, 21 bp, Saccharomyces cerevisiae
tcaagccgaggagtaaaaagg

SEQ ID NO: 2313 - DNA, 21 bp, Saccharomyces cerevisiae
ttcgggtgttttctcctatcc

SEQ ID NO: 2314 - DNA, 27 bp, Saccharomyces cerevisiae
aaggcggagaaataattttataaacca

SEQ ID NO: 2315 - DNA, 23 bp, Saccharomyces cerevisiae
ctggagtagtatgtcgatgttcg

SEQ ID NO: 2316 - DNA, 22 bp, Saccharomyces cerevisiae
tagacggtgtcatcctgacatt

SEQ ID NO: 2317 - DNA, 23 bp, Saccharomyces cerevisiae
catatgttcaccgagttttgtca

SEQ ID NO: 2318 - DNA, 24 bp, Saccharomyces cerevisiae
acacttttattttcttttggcttg

SEQ ID NO: 2319 - DNA, 25 bp, Saccharomyces cerevisiae
cacaagagtgtcgcattatatttac

SEQ ID NO: 2320 - DNA, 27 bp, Saccharomyces cerevisiae
tcctagctttgatatactctaattact

SEQ ID NO: 2321 - DNA, 20 bp, Saccharomyces cerevisiae
tatagctacttggcaggccc

SEQ ID NO: 2322 - DNA, 26 bp, Saccharomyces cerevisiae
tgacgatgacttcagtctattagtat

SEQ ID NO: 2323 - DNA, 22 bp, Saccharomyces cerevisiae
aaactgtggtataatgcgttgc

SEQ ID NO: 2324 - DNA, 25 bp, Saccharomyces cerevisiae
agtgacctggctctatagtgttgtc

SEQ ID NO: 2325 - DNA, 22 bp, Saccharomyces cerevisiae
atgtaatcaactccccttcaaa

SEQ ID NO: 2326 - DNA, 27 bp, Saccharomyces cerevisiae
tattcatgataacaaggtgaaaaatag

SEQ ID NO: 2327 - DNA, 26 bp, Saccharomyces cerevisiae
aaagacaaaaatgaatagaggaaagc

SEQ ID NO: 2328 - DNA, 23 bp, Saccharomyces cerevisiae
catcactacccatttgtctttcc

SEQ ID NO: 2329 - DNA, 26 bp, Saccharomyces cerevisiae
ggtaagttttagaaatgtgcattaaa

SEQ ID NO: 2330 - DNA, 21 bp, Saccharomyces cerevisiae
tcgtcataaaatgctcccatc

SEQ ID NO: 2331 - DNA, 26 bp, Saccharomyces cerevisiae
tgcatacataatggataaatagcaca

SEQ ID NO: 2332 - DNA, 22 bp, Saccharomyces cerevisiae
ctatctaactgagggagcttcg

SEQ ID NO: 2333 - DNA, 20 bp, Saccharomyces cerevisiae
tttctcactttccaccttcg

SEQ ID NO: 2334 - DNA, 23 bp, Saccharomyces cerevisiae
atctctacttacggataccgagg

SEQ ID NO: 2335 - DNA, 26 bp, Saccharomyces cerevisiae
tcgtttataatcttatttacaagtca

SEQ ID NO: 2336 - DNA, 24 bp, Saccharomyces cerevisiae
tccacatgatgagtaatgtgaaat

SEQ ID NO: 2337 - DNA, 25 bp, Saccharomyces cerevisiae
gcatgacctttacaatttgatattt

SEQ ID NO: 2338 - DNA, 27 bp, Saccharomyces cerevisiae
attgattaagtgagaataaacttttcg

SEQ ID NO: 2339 - DNA, 23 bp, Saccharomyces cerevisiae
tatctatgctatatgcccggatg

SEQ ID NO: 2340 - DNA, 19 bp, Saccharomyces cerevisiae
aactgatggcgcgagaaac

SEQ ID NO: 2341 - DNA, 25 bp, Saccharomyces cerevisiae
tttttagaatttaactcactcgtgg

SEQ ID NO: 2342 - DNA, 27 bp, Saccharomyces cerevisiae
actaaaactatttcatttagaatttca

SEQ ID NO: 2343 - DNA, 19 bp, Saccharomyces cerevisiae
caaccctgaaaaggcttca

SEQ ID NO: 2344 - DNA, 25 bp, Saccharomyces cerevisiae
gtagaggacgcaatttaagtatttg

SEQ ID NO: 2345 - DNA, 25 bp, Saccharomyces cerevisiae
aaattatgatttgatgttcctgaat

SEQ ID NO: 2346 - DNA, 23 bp, Saccharomyces cerevisiae
gatagaacagaaaaagggaagcc

SEQ ID NO: 2347 - DNA, 27 bp, Saccharomyces cerevisiae
caagatgcctagatagatagagtacga

SEQ ID NO: 2348 - DNA, 21 bp, Saccharomyces cerevisiae
tggaatgcaaacaaagatgaa

SEQ ID NO: 2349 - DNA, 22 bp, Saccharomyces cerevisiae
tattgcgcatacttcttatggg

SEQ ID NO: 2350 - DNA, 22 bp, Saccharomyces cerevisiae
tctaacttggaaaccgaacact

SEQ ID NO: 2351 - DNA, 25 bp, Saccharomyces cerevisiae
aaacagtaaatagacctaatatgat

SEQ ID NO: 2352 - DNA, 18 bp, Saccharomyces cerevisiae
gccgttatgtcggcaaga

SEQ ID NO: 2353 - DNA, 23 bp, Saccharomyces cerevisiae
cttcaggatttcagttattttcg

SEQ ID NO: 2354 - DNA, 25 bp, Saccharomyces cerevisiae
cacaaatgaattttatcgagatagg

SEQ ID NO: 2355 - DNA, 23 bp, Saccharomyces cerevisiae
acgagtggctaaatatttgttcg

SEQ ID NO: 2356 - DNA, 23 bp, Saccharomyces cerevisiae
tcacagcaataatgtcttacgaa

SEQ ID NO: 2357 - DNA, 24 bp, Saccharomyces cerevisiae
caatgacacatggagatcattttt

SEQ ID NO: 2358 - DNA, 27 bp, Saccharomyces cerevisiae
gcataaattttaattcacaatgtacca

SEQ ID NO: 2359 - DNA, 27 bp, Saccharomyces cerevisiae
caagaattctagtaaaaattaaagtcc

SEQ ID NO: 2360 - DNA, 27 bp, Saccharomyces cerevisiae
gatgcataaatacgataaaaagacatt

SEQ ID NO: 2361 - DNA, 21 bp, Saccharomyces cerevisiae
tgacggaggaagtgaagaaaa

SEQ ID NO: 2362 - DNA, 19 bp, Saccharomyces cerevisiae
tgggccgtatgataggcat

SEQ ID NO: 2363 - DNA, 23 bp, Saccharomyces cerevisiae
aagtcctattcttttccctctca

SEQ ID NO: 2364 - DNA, 25 bp, Saccharomyces cerevisiae
tttatcttttccgaagaagttgatt

SEQ ID NO: 2365 - DNA, 24 bp, Saccharomyces cerevisiae
atagaagcttcaacataaatagga

SEQ ID NO: 2366 - DNA, 20 bp, Saccharomyces cerevisiae
tggggaaggagtagacgaaa

SEQ ID NO: 2367 - DNA, 25 bp, Saccharomyces cerevisiae
atttttgtgtatcttaagtccaagc

SEQ ID NO: 2368 - DNA, 27 bp, Saccharomyces cerevisiae
tagataagctatgaaagtcaatccttt

SEQ ID NO: 2369 - DNA, 27 bp, Saccharomyces cerevisiae
gagagactgtaagatttgaggttttag

SEQ ID NO: 2370 - DNA, 23 bp, Saccharomyces cerevisiae
cttgataattttatttagcactt

SEQ ID NO: 2371 - DNA, 27 bp, Saccharomyces cerevisiae
cccaactgaaataaaaatgaatagaaa

SEQ ID NO: 2372 - DNA, 26 bp, Saccharomyces cerevisiae
catatacataagtagaagataattcg

SEQ ID NO: 2373 - DNA, 23 bp, Saccharomyces cerevisiae
ccggacgagtagaaagctataca

SEQ ID NO: 2374 - DNA, 27 bp, Saccharomyces cerevisiae
ctttgataaaataacatttttcgttct

SEQ ID NO: 2375 - DNA, 20 bp, Saccharomyces cerevisiae
tagagcacatgcgcctccct

SEQ ID NO: 2376 - DNA, 27 bp, Saccharomyces cerevisiae
cttattgaaattatttgtcattttttt

SEQ ID NO: 2377 - DNA, 23 bp, Saccharomyces cerevisiae
ataaattgctcaagtgtgtcgaa

SEQ ID NO: 2378 - DNA, 24 bp, Saccharomyces cerevisiae
ataaatgcatggtttgattacctg

SEQ ID NO: 2379 - DNA, 26 bp, Saccharomyces cerevisiae
gaaagtaacttgcactttaaaaatcg

SEQ ID NO: 2380 - DNA, 25 bp, Saccharomyces cerevisiae
atttccatttatagacaaacttaga

SEQ ID NO: 2381 - DNA, 25 bp, Saccharomyces cerevisiae
tataaagtgggaaaaagtatgtgct

SEQ ID NO: 2382 - DNA, 21 bp, Saccharomyces cerevisiae
atgtagccttttcaggtacgc

SEQ ID NO: 2383 - DNA, 22 bp, Saccharomyces cerevisiae
tttttgcttggcttcttactgg

SEQ ID NO: 2384 - DNA, 27 bp, Saccharomyces cerevisiae
tgttttctccttctttacatgtttaat

SEQ ID NO: 2385 - DNA, 20 bp, Saccharomyces cerevisiae
ctgcccataattgtccaacg

SEQ ID NO: 2386 - DNA, 27 bp, Saccharomyces cerevisiae
gctgcttaaatagaagatgaaaaataa

SEQ ID NO: 2387 - DNA, 26 bp, Saccharomyces cerevisiae
gtgactctttctacgttatcctcctc

SEQ ID NO: 2388 - DNA, 25 bp, Saccharomyces cerevisiae
gaggtgaaagtaaaaaaacattacc

SEQ ID NO: 2389 - DNA, 27 bp, Saccharomyces cerevisiae
cattaccgatgtaacaatatatgaaag

SEQ ID NO: 2390 - DNA, 22 bp, Saccharomyces cerevisiae
aatgcaaggtgaggtaaaagtt

SEQ ID NO: 2391 - DNA, 26 bp, Saccharomyces cerevisiae
gctcagtaaatgaaatgtaaggaatg

SEQ ID NO: 2392 - DNA, 27 bp, Saccharomyces cerevisiae
ttttctataaaggttataaacgctagg

SEQ ID NO: 2393 - DNA, 24 bp, Saccharomyces cerevisiae
tcaaggacataaatctaagcgagg

SEQ ID NO: 2394 - DNA, 25 bp, Saccharomyces cerevisiae
tatttcccttgttaattttgcatga

SEQ ID NO: 2395 - DNA, 26 bp, Saccharomyces cerevisiae
ccctaggcgaataggtatatacaaga

SEQ ID NO: 2396 - DNA, 27 bp, Saccharomyces cerevisiae
accgaagtttaaatgcattagaaaaga

SEQ ID NO: 2397 - DNA, 22 bp, Saccharomyces cerevisiae
ttcaaggttctttagcagaccg

SEQ ID NO: 2398 - DNA, 20 bp, Saccharomyces cerevisiae
ccaccagaaagtggcataca

SEQ ID NO: 2399 - DNA, 27 bp, Saccharomyces cerevisiae
attcagaaataaacacaaacatataca

SEQ ID NO: 2400 - DNA, 27 bp, Saccharomyces cerevisiae
ttactgtaggaataaagtagtataggg

SEQ ID NO: 2401 - DNA, 23 bp, Saccharomyces cerevisiae
gtacatgacctccatttcagctt

SEQ ID NO: 2402 - DNA, 24 bp, Saccharomyces cerevisiae
acttttagaatttagtcttgttca

SEQ ID NO: 2403 - DNA, 27 bp, Saccharomyces cerevisiae
acttagtcatacgtcattggtattctc

SEQ ID NO: 2404 - DNA, 27 bp, Saccharomyces cerevisiae
tcagtttgattgcaatattactacctc

SEQ ID NO: 2405 - DNA, 24 bp, Saccharomyces cerevisiae
gagcacgacctactaataacgaga

SEQ ID NO: 2406 - DNA, 19 bp, Saccharomyces cerevisiae
ggcaacaatcaaaagggga

SEQ ID NO: 2407 - DNA, 25 bp, Saccharomyces cerevisiae
ttatcaagcccttattagctacaat

SEQ ID NO: 2408 - DNA, 26 bp, Saccharomyces cerevisiae
aaaaattctaaatgcgttatgtaaga

SEQ ID NO: 2409 - DNA, 27 bp, Saccharomyces cerevisiae
tatcagagagttttacataacattgta

SEQ ID NO: 2410 - DNA, 27 bp, Saccharomyces cerevisiae
acagtcagtcttttcttttgatagatg

SEQ ID NO: 2411 - DNA, 26 bp, Saccharomyces cerevisiae
cctagataaagcccttacatactttt

SEQ ID NO: 2412 - DNA, 19 bp, Saccharomyces cerevisiae
cgcttcttccaacgcagat

SEQ ID NO: 2413 - DNA, 25 bp, Saccharomyces cerevisiae
taatcatatcccttctcacattttt

SEQ ID NO: 2414 - DNA, 22 bp, Saccharomyces cerevisiae
ttctcatcactccatctcatcc

SEQ ID NO: 2415 - DNA, 26 bp, Saccharomyces cerevisiae
tagtttaagaacttttgcatggtatc

SEQ ID NO: 2416 - DNA, 27 bp, Saccharomyces cerevisiae
cttagtgtatatactttggcacacttg

SEQ ID NO: 2417 - DNA, 25 bp, Saccharomyces cerevisiae
ttgtctcctttacccatttatgtat

SEQ ID NO: 2418 - DNA, 26 bp, Saccharomyces cerevisiae
taaagttttttttttttttttcagca

SEQ ID NO: 2419 - DNA, 26 bp, Saccharomyces cerevisiae
cggataaaattatctgatgactgtcg

SEQ ID NO: 2420 - DNA, 27 bp, Saccharomyces cerevisiae
gtataaagttcatttgttcttttatgt

SEQ ID NO: 2421 - DNA, 21 bp, Saccharomyces cerevisiae
atacggttgccttgtttgtct

SEQ ID NO: 2422 - DNA, 25 bp, Saccharomyces cerevisiae
actgctttctatatttacatgtggg

SEQ ID NO: 2423 - DNA, 23 bp, Saccharomyces cerevisiae
atattccgtccttcaaatgaaaa

SEQ ID NO: 2424 - DNA, 24 bp, Saccharomyces cerevisiae
ttggtcttacgttcttatgtgttt

SEQ ID NO: 2425 - DNA, 23 bp, Saccharomyces cerevisiae
tccgaacaatagtaatcagttcc

SEQ ID NO: 2426 - DNA, 23 bp, Saccharomyces cerevisiae
atgacggtttaatgcaagtaatg

SEQ ID NO: 2427 - DNA, 27 bp, Saccharomyces cerevisiae
tttatttatttatttattttggagggc

SEQ ID NO: 2428 - DNA, 21 bp, Saccharomyces cerevisiae
aggtatacggtgcaaggaaaa

SEQ ID NO: 2429 - DNA, 27 bp, Saccharomyces cerevisiae
acttaatacaacttttcattcctttgt

SEQ ID NO: 2430 - DNA, 26 bp, Saccharomyces cerevisiae
tagaaatatttacatgtatcgctggt

SEQ ID NO: 2431 - DNA, 23 bp, Saccharomyces cerevisiae
ttcaattggtttggatttttctt

SEQ ID NO: 2432 - DNA, 24 bp, Saccharomyces cerevisiae
aaataattccccactgaagaaaaa

SEQ ID NO: 2433 - DNA, 24 bp, Saccharomyces cerevisiae
tggatcataacgatctattgtcgc

SEQ ID NO: 2434 - DNA, 26 bp, Saccharomyces cerevisiae
taaataattagaacaccgtattagtg

SEQ ID NO: 2435 - DNA, 21 bp, Saccharomyces cerevisiae
acattccattgcgtttcattg

SEQ ID NO: 2436 - DNA, 25 bp, Saccharomyces cerevisiae
tttttgaaaatagaagccttgttta

SEQ ID NO: 2437 - DNA, 26 bp, Saccharomyces cerevisiae
cacgcttaataaaggagaataaatcg

SEQ ID NO: 2438 - DNA, 19 bp, Saccharomyces cerevisiae
gtccgctagttcatcgcct

SEQ ID NO: 2439 - DNA, 22 bp, Saccharomyces cerevisiae
gcctgatttaaatatccgaaaa

SEQ ID NO: 2440 - DNA, 27 bp, Saccharomyces cerevisiae
aaataagccaaaaagaaacaagtataa

SEQ ID NO: 2441 - DNA, 27 bp, Saccharomyces cerevisiae
aataataccttcgaagaaaatgtttag

SEQ ID NO: 2442 - DNA, 20 bp, Saccharomyces cerevisiae
cgattgagctccgcacatta

SEQ ID NO: 2443 - DNA, 23 bp, Saccharomyces cerevisiae
tgaaacagcaattcattacaagc

SEQ ID NO: 2444 - DNA, 25 bp, Saccharomyces cerevisiae
ttgtaaaccaagaattactttagcc

SEQ ID NO: 2445 - DNA, 25 bp, Saccharomyces cerevisiae
taaaagaaaatatggaaaacccttt

SEQ ID NO: 2446 - DNA, 21 bp, Saccharomyces cerevisiae
cgacccctcaaacaagaattg

SEQ ID NO: 2447 - DNA, 20 bp, Saccharomyces cerevisiae
ctgacgtgaacttgcaccat

SEQ ID NO: 2448 - DNA, 20 bp, Saccharomyces cerevisiae
gattgagtagccccatgaca

SEQ ID NO: 2449 - DNA, 20 bp, Saccharomyces cerevisiae
tgggaaggactgatgatgaa

SEQ ID NO: 2450 - DNA, 23 bp, Saccharomyces cerevisiae
aaattttgtgccctactaaggtc

SEQ ID NO: 2451 - DNA, 26 bp, Saccharomyces cerevisiae
tgaattaatcatcctcttcatgtact

SEQ ID NO: 2452 - DNA, 23 bp, Saccharomyces cerevisiae
tagtagtttttgttcatgcctgg

SEQ ID NO: 2453 - DNA, 25 bp, Saccharomyces cerevisiae
ttttgaatttaaataatcctttcca

SEQ ID NO: 2454 - DNA, 21 bp, Saccharomyces cerevisiae
tgatgtcttcctttgtctgct

SEQ ID NO: 2455 - DNA, 26 bp, Saccharomyces cerevisiae
aataaccattacctccctactaaaaa

SEQ ID NO: 2456 - DNA, 23 bp, Saccharomyces cerevisiae
taaatccctccctccatataagc

SEQ ID NO: 2457 - DNA, 24 bp, Saccharomyces cerevisiae
aggaaagaaaatgtaacttttggc

SEQ ID NO: 2458 - DNA, 21 bp, Saccharomyces cerevisiae
gcgcttgataccctttagaga

SEQ ID NO: 2459 - DNA, 22 bp, Saccharomyces cerevisiae
taatagcgctttttcactgagg

SEQ ID NO: 2460 - DNA, 22 bp, Saccharomyces cerevisiae
gtacagaaggaagaatgtcgcc

SEQ ID NO: 2461 - DNA, 27 bp, Saccharomyces cerevisiae
tccgactctaaatatttttcttgtttg

SEQ ID NO: 2462 - DNA, 25 bp, Saccharomyces cerevisiae
aagttgaattaattaagagagtatt

SEQ ID NO: 2463 - DNA, 23 bp, Saccharomyces cerevisiae
attatcgtcctccatatgtctcg

SEQ ID NO: 2464 - DNA, 26 bp, Saccharomyces cerevisiae
tccgtttaatgacacatataaaattg

SEQ ID NO: 2465 - DNA, 22 bp, Saccharomyces cerevisiae
tgaatgattgcaatgaaaagtt

SEQ ID NO: 2466 - DNA, 27 bp, Saccharomyces cerevisiae
tttaccctatcagcttatcgtattttt

SEQ ID NO: 2467 - DNA, 22 bp, Saccharomyces cerevisiae
gccaacaaacaactttcgtaac

SEQ ID NO: 2468 - DNA, 26 bp, Saccharomyces cerevisiae
tgtagaaaaaaaaaaagaaaaaagaa

SEQ ID NO: 2469 - DNA, 23 bp, Saccharomyces cerevisiae
atgcgtatgtgcgtataactgtg

SEQ ID NO: 2470 - DNA, 20 bp, Saccharomyces cerevisiae
agcggctatggacattttta

SEQ ID NO: 2471 - DNA, 24 bp, Saccharomyces cerevisiae
gatgaataatgcaaaactcaagaa

SEQ ID NO: 2472 - DNA, 21 bp, Saccharomyces cerevisiae
acaaaagcgtgaacacttcca

SEQ ID NO: 2473 - DNA, 27 bp, Saccharomyces cerevisiae
acaaaattgtctacatacataactgcc

SEQ ID NO: 2474 - DNA, 23 bp, Saccharomyces cerevisiae
aggatacgaaaatgcaccttaat

SEQ ID NO: 2475 - DNA, 20 bp, Saccharomyces cerevisiae
gtcttctactaggccttttt

SEQ ID NO: 2476 - DNA, 24 bp, Saccharomyces cerevisiae
aaataaaccaaccgacttattcat

SEQ ID NO: 2477 - DNA, 22 bp, Saccharomyces cerevisiae
gtttctaattaaaataccgccg

SEQ ID NO: 2478 - DNA, 20 bp, Saccharomyces cerevisiae
tatgtttcacgtcctgaccc

SEQ ID NO: 2479 - DNA, 21 bp, Saccharomyces cerevisiae
catttacattcaaccagtggc

SEQ ID NO: 2480 - DNA, 27 bp, Saccharomyces cerevisiae
acttgatagttgtgataaacatttctt

SEQ ID NO: 2481 - DNA, 23 bp, Saccharomyces cerevisiae
gccaatcgtcatgtcaattatgt

SEQ ID NO: 2482 - DNA, 24 bp, Saccharomyces cerevisiae
aaaaaaagaaaagtgtagaaaact

SEQ ID NO: 2483 - DNA, 27 bp, Saccharomyces cerevisiae
catgtatactaggagattgaatatgaa

SEQ ID NO: 2484 - DNA, 21 bp, Saccharomyces cerevisiae
aaacgatagcgaactcattca

SEQ ID NO: 2485 - DNA, 27 bp, Saccharomyces cerevisiae
atcagatagaatatgcctgtaaaaact

SEQ ID NO: 2486 - DNA, 20 bp, Saccharomyces cerevisiae
aaaatttttgctgctggaag

SEQ ID NO: 2487 - DNA, 27 bp, Saccharomyces cerevisiae
aaggatgaataaactagaagaaactga

SEQ ID NO: 2488 - DNA, 26 bp, Saccharomyces cerevisiae
ctttgatctcgatgtatatcaatttt

SEQ ID NO: 2489 - DNA, 20 bp, Saccharomyces cerevisiae
ggagtgattttgtgccatcc

SEQ ID NO: 2490 - DNA, 25 bp, Saccharomyces cerevisiae
atgcaacaaaggtcaaatgacataa

SEQ ID NO: 2491 - DNA, 27 bp, Saccharomyces cerevisiae
tgactaggtttagataccaacactaca

SEQ ID NO: 2492 - DNA, 22 bp, Saccharomyces cerevisiae
cccacaaaatgaaactcaaacg

SEQ ID NO: 2493 - DNA, 24 bp, Saccharomyces cerevisiae
cctgcaatatgagtagagtttacg

SEQ ID NO: 2494 - DNA, 24 bp, Saccharomyces cerevisiae
gtgatgtgctgagaagataagagg

SEQ ID NO: 2495 - DNA, 27 bp, Saccharomyces cerevisiae
atatcttaattcacctgtttactatca

SEQ ID NO: 2496 - DNA, 25 bp, Saccharomyces cerevisiae
tgttaaccactagaaacgagctaga

SEQ ID NO: 2497 - DNA, 26 bp, Saccharomyces cerevisiae
gtctttacgatatacaaaagttctgc

SEQ ID NO: 2498 - DNA, 23 bp, Saccharomyces cerevisiae
taggcagccatcactgtagtatt

SEQ ID NO: 2499 - DNA, 22 bp, Saccharomyces cerevisiae
agacatgcctttacgaatgaga

SEQ ID NO: 2500 - DNA, 25 bp, Saccharomyces cerevisiae
gcttaatgtatcaaataatcaagta

SEQ ID NO: 2501 - DNA, 26 bp, Saccharomyces cerevisiae
tattaaatatgcgttaaatggagagc

SEQ ID NO: 2502 - DNA, 22 bp, Saccharomyces cerevisiae
acacgccgaagaagacttagtt

SEQ ID NO: 2503 - DNA, 27 bp, Saccharomyces cerevisiae
gtacaggaaaaacaaaaaagagttagg

SEQ ID NO: 2504 - DNA, 23 bp, Saccharomyces cerevisiae
gtctggaaaagctatgaacacaa

SEQ ID NO: 2505 - DNA, 22 bp, Saccharomyces cerevisiae
aactgagttcacgtttgaatga

SEQ ID NO: 2506 - DNA, 24 bp, Saccharomyces cerevisiae
acgaaatatttgtttcagtgattt

SEQ ID NO: 2507 - DNA, 24 bp, Saccharomyces cerevisiae
cgataatccattgtttcagagttt

SEQ ID NO: 2508 - DNA, 23 bp, Saccharomyces cerevisiae
tagttacaatatttttaacagaa

SEQ ID NO: 2509 - DNA, 23 bp, Saccharomyces cerevisiae
aagggaaattgagaagagaaaaa

SEQ ID NO: 2510 - DNA, 20 bp, Saccharomyces cerevisiae
aaagaacgagggggaaacag

SEQ ID NO: 2511 - DNA, 27 bp, Saccharomyces cerevisiae
tcactctttaagtatgtagtgcaatgt

SEQ ID NO: 2512 - DNA, 22 bp, Saccharomyces cerevisiae
tgatttttcgtggggtattatg

SEQ ID NO: 2513 - DNA, 21 bp, Saccharomyces cerevisiae
tttctgctaacgacagatgcg

SEQ ID NO: 2514 - DNA, 21 bp, Saccharomyces cerevisiae
tcgcctttctaaacttccttg

SEQ ID NO: 2515 - DNA, 26 bp, Saccharomyces cerevisiae
agggtttgagttttcagtacatagtt

SEQ ID NO: 2516 - DNA, 27 bp, Saccharomyces cerevisiae
tataaacttatgtatattccttcagtc

SEQ ID NO: 2517 - DNA, 26 bp, Saccharomyces cerevisiae
aaagtcaaaacaaggtcactttacaa

SEQ ID NO: 2518 - DNA, 27 bp, Saccharomyces cerevisiae
tgatgatttctttcctttttatattga

SEQ ID NO: 2519 - DNA, 27 bp, Saccharomyces cerevisiae
ctataaatagataaactacgtaaacgc

SEQ ID NO: 2520 - DNA, 27 bp, Saccharomyces cerevisiae
atgtcatagtaagtgtaaacaaaaccc

SEQ ID NO: 2521 - DNA, 25 bp, Saccharomyces cerevisiae
atacacatatcaaagaaagcagtca

SEQ ID NO: 2522 - DNA, 22 bp, Saccharomyces cerevisiae
tgtctgcctcttacattcttgc

SEQ ID NO: 2523 - DNA, 24 bp, Saccharomyces cerevisiae
tgaatcatgtattgtgcattaaaa

SEQ ID NO: 2524 - DNA, 22 bp, Saccharomyces cerevisiae
ggttagcccttcctttcatttt

SEQ ID NO: 2525 - DNA, 27 bp, Saccharomyces cerevisiae
cattaagatggtgacaaatattacaaa

SEQ ID NO: 2526 - DNA, 23 bp, Saccharomyces cerevisiae
tgagtacatacccattatgttgt

SEQ ID NO: 2527 - DNA, 27 bp, Saccharomyces cerevisiae
ccattgcaatagatatgattatagagc

SEQ ID NO: 2528 - DNA, 27 bp, Saccharomyces cerevisiae
ttttcataaattgactacaaacttacg

SEQ ID NO: 2529 - DNA, 23 bp, Saccharomyces cerevisiae
gaaactgactaaataaatgactt

SEQ ID NO: 2530 - DNA, 25 bp, Saccharomyces cerevisiae
ctgtaaatatgaggactgtctgtgc

SEQ ID NO: 2531 - DNA, 19 bp, Saccharomyces cerevisiae
taataatccggcgtgaggg

SEQ ID NO: 2532 - DNA, 22 bp, Saccharomyces cerevisiae
ttcttacgaaacggtatgctcc

SEQ ID NO: 2533 - DNA, 25 bp, Saccharomyces cerevisiae
gggcgaatatgattactaagttaaa

SEQ ID NO: 2534 - DNA, 25 bp, Saccharomyces cerevisiae
tgatataagctatgtaaaatcatgc

SEQ ID NO: 2535 - DNA, 22 bp, Saccharomyces cerevisiae
ccagttgactagtgtttgtgcg

SEQ ID NO: 2536 - DNA, 21 bp, Saccharomyces cerevisiae
gttgatgtttacgttgcatga

SEQ ID NO: 2537 - DNA, 27 bp, Saccharomyces cerevisiae
ttccattagagcactagagcataacta

SEQ ID NO: 2538 - DNA, 25 bp, Saccharomyces cerevisiae
gtcaagttcagagtaattttcggtt

SEQ ID NO: 2539 - DNA, 22 bp, Saccharomyces cerevisiae
atcacgtgaaccacagtaacct

SEQ ID NO: 2540 - DNA, 27 bp, Saccharomyces cerevisiae
ttggaaggtatttctaggttctacttt

SEQ ID NO: 2541 - DNA, 24 bp, Saccharomyces cerevisiae
ataagatggcttatgcacaataga

SEQ ID NO: 2542 - DNA, 25 bp, Saccharomyces cerevisiae
ccatatataagaaacacactttcag

SEQ ID NO: 2543 - DNA, 26 bp, Saccharomyces cerevisiae
gtactgttagtttttattttgggaca

SEQ ID NO: 2544 - DNA, 22 bp, Saccharomyces cerevisiae
atgaggaggtaaactttcatgt

SEQ ID NO: 2545 - DNA, 19 bp, Saccharomyces cerevisiae
gattaagccaattggtgcg

SEQ ID NO: 2546 - DNA, 23 bp, Saccharomyces cerevisiae
ataggtaagtttcaatgaggcga

SEQ ID NO: 2547 - DNA, 26 bp, Saccharomyces cerevisiae
gaagtccttgaatataagatgaattt

SEQ ID NO: 2548 - DNA, 24 bp, Saccharomyces cerevisiae
aatttcacatactattcagataaa

SEQ ID NO: 2549 - DNA, 27 bp, Saccharomyces cerevisiae
aaccataatgcaaaatcagtataaagg

SEQ ID NO: 2550 - DNA, 22 bp, Saccharomyces cerevisiae
tgcgaataaaggttaccagaga

SEQ ID NO: 2551 - DNA, 26 bp, Saccharomyces cerevisiae
aatattctatccactcatcaacctca

SEQ ID NO: 2552 - DNA, 25 bp, Saccharomyces cerevisiae
tgagaaaagaaaacggttaaagatg

SEQ ID NO: 2553 - DNA, 26 bp, Saccharomyces cerevisiae
ggcggtaaataatctctagtaatatc

SEQ ID NO: 2554 - DNA, 23 bp, Saccharomyces cerevisiae
tagggctgtaaaaacctctcaca

SEQ ID NO: 2555 - DNA, 27 bp, Saccharomyces cerevisiae
aaagtcgtaaaactaaaaagtctctgc

SEQ ID NO: 2556 - DNA, 26 bp, Saccharomyces cerevisiae
tgagttaacctaagttagacgaaaaa

SEQ ID NO: 2557 - DNA, 22 bp, Saccharomyces cerevisiae
gctgaactattatttggaagcc

SEQ ID NO: 2558 - DNA, 20 bp, Saccharomyces cerevisiae
aaaacgatagggtggcacat

SEQ ID NO: 2559 - DNA, 19 bp, Saccharomyces cerevisiae
cagaaaacgcctcaaaccg

SEQ ID NO: 2560 - DNA, 20 bp, Saccharomyces cerevisiae
aaacaaccaacacgaagcac

SEQ ID NO: 2561 - DNA, 21 bp, Saccharomyces cerevisiae
tttggaatgtagagacgtgta

SEQ ID NO: 2562 - DNA, 23 bp, Saccharomyces cerevisiae
tgttaaccgtactttgtagcacc

SEQ ID NO: 2563 - DNA, 24 bp, Saccharomyces cerevisiae
ggaatacctactcctgtcactttc

SEQ ID NO: 2564 - DNA, 21 bp, Saccharomyces cerevisiae
gctgattgaagaaacccaaaa

SEQ ID NO: 2565 - DNA, 25 bp, Saccharomyces cerevisiae
ttttctggtcatataataatctaca

SEQ ID NO: 2566 - DNA, 24 bp, Saccharomyces cerevisiae
taatgatatccgaaccatagctga

SEQ ID NO: 2567 - DNA, 25 bp, Saccharomyces cerevisiae
tgaactttttgtataacatcattgg

SEQ ID NO: 2568 - DNA, 25 bp, Saccharomyces cerevisiae
ctttaaataggaagccctttaacaa

SEQ ID NO: 2569 - DNA, 22 bp, Saccharomyces cerevisiae
aaaaggaggaccaagagatgtg

SEQ ID NO: 2570 - DNA, 24 bp, Saccharomyces cerevisiae
aaaaggggtatactagctccatgt

SEQ ID NO: 2571 - DNA, 18 bp, Saccharomyces cerevisiae
ggcgttggacatccatga

SEQ ID NO: 2572 - DNA, 22 bp, Saccharomyces cerevisiae
ccagtccttctgttttgttttt

SEQ ID NO: 2573 - DNA, 27 bp, Saccharomyces cerevisiae
ataagataaagtttggtttgttgatcc

SEQ ID NO: 2574 - DNA, 27 bp, Saccharomyces cerevisiae
atttataatctttcttcaatatgcgtg

SEQ ID NO: 2575 - DNA, 26 bp, Saccharomyces cerevisiae
ttaatattttcaattttttacgattt

SEQ ID NO: 2576 - DNA, 20 bp, Saccharomyces cerevisiae
gggagcacttctcctcaaga

SEQ ID NO: 2577 - DNA, 23 bp, Saccharomyces cerevisiae
cctcttcatcatctgtggagaca

SEQ ID NO: 2578 - DNA, 24 bp, Saccharomyces cerevisiae
cgtaggtaataattttcatcgtca

SEQ ID NO: 2579 - DNA, 24 bp, Saccharomyces cerevisiae
ctgaggtgagtagacgaaacattc

SEQ ID NO: 2580 - DNA, 21 bp, Saccharomyces cerevisiae
aacacccccataagtttgaag

SEQ ID NO: 2581 - DNA, 21 bp, Saccharomyces cerevisiae
tcattggaagacgttgttacg

SEQ ID NO: 2582 - DNA, 21 bp, Saccharomyces cerevisiae
caatgagtaagcgacttgcat

SEQ ID NO: 2583 - DNA, 25 bp, Saccharomyces cerevisiae
gcaaatcaataaatacttgtgtact

SEQ ID NO: 2584 - DNA, 25 bp, Saccharomyces cerevisiae
gacaagaaacaaggtgaatcactaa

SEQ ID NO: 2585 - DNA, 27 bp, Saccharomyces cerevisiae
tgaaaacttttttttccttattttttc

SEQ ID NO: 2586 - DNA, 25 bp, Saccharomyces cerevisiae
gcttaagtaatatcaactcagagcg

SEQ ID NO: 2587 - DNA, 26 bp, Saccharomyces cerevisiae
aatgtgtatattagtttaaaaagttg

SEQ ID NO: 2588 - DNA, 24 bp, Saccharomyces cerevisiae
caatgggagatcaaaaatacaaca

SEQ ID NO: 2589 - DNA, 26 bp, Saccharomyces cerevisiae
tgatcaattaatgtattgcagaataa

SEQ ID NO: 2590 - DNA, 26 bp, Saccharomyces cerevisiae
gtctaaactgtataatacttggatca

SEQ ID NO: 2591 - DNA, 23 bp, Saccharomyces cerevisiae
gtttttccttgttggaaagaaga

SEQ ID NO: 2592 - DNA, 22 bp, Saccharomyces cerevisiae
caagcataagccatcttcttca

SEQ ID NO: 2593 - DNA, 21 bp, Saccharomyces cerevisiae
ttcttttcgacgacctgattc

SEQ ID NO: 2594 - DNA, 26 bp, Saccharomyces cerevisiae
tcccaatgaccacactattataaatc

SEQ ID NO: 2595 - DNA, 22 bp, Saccharomyces cerevisiae
tcggcagtctaaaggttaaaca

SEQ ID NO: 2596 - DNA, 20 bp, Saccharomyces cerevisiae
aacaaactcacaggtcctcg

SEQ ID NO: 2597 - DNA, 25 bp, Saccharomyces cerevisiae
acaagagaaacttttgggtaaaatg

SEQ ID NO: 2598 - DNA, 22 bp, Saccharomyces cerevisiae
tgaggccttcagtttttagctc

SEQ ID NO: 2599 - DNA, 27 bp, Saccharomyces cerevisiae
attatgtaaaatagtcattctttaagc

SEQ ID NO: 2600 - DNA, 19 bp, Saccharomyces cerevisiae
aagatgctttcgggaatgt

SEQ ID NO: 2601 - DNA, 26 bp, Saccharomyces cerevisiae
aatagaaaaagatgagagtagccacg

SEQ ID NO: 2602 - DNA, 26 bp, Saccharomyces cerevisiae
gtctaatctggcttgattcttaatct

SEQ ID NO: 2603 - DNA, 25 bp, Saccharomyces cerevisiae
atggagaactgaaaaatattgcttt

SEQ ID NO: 2604 - DNA, 23 bp, Saccharomyces cerevisiae
tccaagtgaatgatttaatgtgc

SEQ ID NO: 2605 - DNA, 22 bp, Saccharomyces cerevisiae
tttgccaaaaatgctatagtcg

SEQ ID NO: 2606 - DNA, 26 bp, Saccharomyces cerevisiae
taattttaagaaccattctctttcaa

SEQ ID NO: 2607 - DNA, 26 bp, Saccharomyces cerevisiae
tgatacctgtcctcattcatctataa

SEQ ID NO: 2608 - DNA, 26 bp, Saccharomyces cerevisiae
aaaaggaatgaaaaaaaaaaaaaaaa

SEQ ID NO: 2609 - DNA, 27 bp, Saccharomyces cerevisiae
tgatttaaaaagcagttaaggagtatg

SEQ ID NO: 2610 - DNA, 26 bp, Saccharomyces cerevisiae
caggctctttaacacaatatagactc

SEQ ID NO: 2611 - DNA, 24 bp, Saccharomyces cerevisiae
gtacttatgacgatttggaacaca

SEQ ID NO: 2612 - DNA, 27 bp, Saccharomyces cerevisiae
taaaataacgtatttcagaaagctgta

SEQ ID NO: 2613 - DNA, 24 bp, Saccharomyces cerevisiae
ttcatttctattttaacattttct

SEQ ID NO: 2614 - DNA, 21 bp, Saccharomyces cerevisiae
cctctgtgaattctgcattgt

SEQ ID NO: 2615 - DNA, 27 bp, Saccharomyces cerevisiae
caagaatatcaaaatttcttgtaccat

SEQ ID NO: 2616 - DNA, 20 bp, Saccharomyces cerevisiae
cgacttcatccgtcattttc

SEQ ID NO: 2617 - DNA, 26 bp, Saccharomyces cerevisiae
tgataaattttccgagtatttccaat

SEQ ID NO: 2618 - DNA, 25 bp, Saccharomyces cerevisiae
aggatatatttaaccacgactttcg

SEQ ID NO: 2619 - DNA, 27 bp, Saccharomyces cerevisiae
acaaaaattcttatataacttaggcga

SEQ ID NO: 2620 - DNA, 26 bp, Saccharomyces cerevisiae
tgaatgtctgtatgtagcttcaaaat

SEQ ID NO: 2621 - DNA, 27 bp, Saccharomyces cerevisiae
taacatctatataacataataagcgca

SEQ ID NO: 2622 - DNA, 25 bp, Saccharomyces cerevisiae
cactttttctgagcattttattacg

SEQ ID NO: 2623 - DNA, 25 bp, Saccharomyces cerevisiae
tgaacttcttgtctattttccttgg

SEQ ID NO: 2624 - DNA, 25 bp, Saccharomyces cerevisiae
attcggtttttattattcatgacct

SEQ ID NO: 2625 - DNA, 27 bp, Saccharomyces cerevisiae
ctcttgtagtttacatggtgatacttt

SEQ ID NO: 2626 - DNA, 23 bp, Saccharomyces cerevisiae
tcaaaatttacggctttgaaaaa

SEQ ID NO: 2627 - DNA, 22 bp, Saccharomyces cerevisiae
gcaaagaggaggagaaaacaaa

SEQ ID NO: 2628 - DNA, 21 bp, Saccharomyces cerevisiae
ctggatcatttgtctcgcatt

SEQ ID NO: 2629 - DNA, 25 bp, Saccharomyces cerevisiae
ttgcacatataaaatatctatcact

SEQ ID NO: 2630 - DNA, 27 bp, Saccharomyces cerevisiae
cgttagcgaaataaagacatataaaaa

SEQ ID NO: 2631 - DNA, 21 bp, Saccharomyces cerevisiae
aaaacgtgcttaccttgtgaa

SEQ ID NO: 2632 - DNA, 26 bp, Saccharomyces cerevisiae
ttattagtactatagcatagttttgt

SEQ ID NO: 2633 - DNA, 21 bp, Saccharomyces cerevisiae
gctcggtcacattatcgtctt

SEQ ID NO: 2634 - DNA, 23 bp, Saccharomyces cerevisiae
gatgaagagtaatgtggttggat

SEQ ID NO: 2635 - DNA, 25 bp, Saccharomyces cerevisiae
atttcacattgatctcttacataca

SEQ ID NO: 2636 - DNA, 26 bp, Saccharomyces cerevisiae
tagataactcggttttgagcatattg

SEQ ID NO: 2637 - DNA, 20 bp, Saccharomyces cerevisiae
tgtgcacactagggcattca

SEQ ID NO: 2638 - DNA, 21 bp, Saccharomyces cerevisiae
aagggaaccttttacaacaaa

SEQ ID NO: 2639 - DNA, 25 bp, Saccharomyces cerevisiae
aaataaaatcattgtttagtcctgg

SEQ ID NO: 2640 - DNA, 26 bp, Saccharomyces cerevisiae
tttaaattacgctaatatccccttca

SEQ ID NO: 2641 - DNA, 26 bp, Saccharomyces cerevisiae
gaagaatagtttttctttcccatttc

SEQ ID NO: 2642 - DNA, 21 bp, Saccharomyces cerevisiae
ctggcagactaactgatcaaa

SEQ ID NO: 2643 - DNA, 22 bp, Saccharomyces cerevisiae
gctagcagttgatgtgagtgag

SEQ ID NO: 2644 - DNA, 23 bp, Saccharomyces cerevisiae
atagtgtcagcggtagtggaatc

SEQ ID NO: 2645 - DNA, 22 bp, Saccharomyces cerevisiae
gaagtgtcgcagaggaatcttt

SEQ ID NO: 2646 - DNA, 21 bp, Saccharomyces cerevisiae
aaagaaagaaaaagggcacaa

SEQ ID NO: 2647 - DNA, 22 bp, Saccharomyces cerevisiae
ggtggttaaaaatagcagcaaa

SEQ ID NO: 2648 - DNA, 27 bp, Saccharomyces cerevisiae
ccctccaattaaacataacttgtactc

SEQ ID NO: 2649 - DNA, 20 bp, Saccharomyces cerevisiae
tttttcacgagcacctacaa

SEQ ID NO: 2650 - DNA, 19 bp, Saccharomyces cerevisiae
aatcacacgtcagcgtcat

SEQ ID NO: 2651 - DNA, 27 bp, Saccharomyces cerevisiae
agacccttatagaattaccaatgtatg

SEQ ID NO: 2652 - DNA, 22 bp, Saccharomyces cerevisiae
gactagtcaaccacaagccttt

SEQ ID NO: 2653 - DNA, 27 bp, Saccharomyces cerevisiae
tttaaatacgcacaactcatttaattt

SEQ ID NO: 2654 - DNA, 26 bp, Saccharomyces cerevisiae
gaaagaaaaacacaatactaccaaca

SEQ ID NO: 2655 - DNA, 25 bp, Saccharomyces cerevisiae
aacaatttttcttcaccacattttc

SEQ ID NO: 2656 - DNA, 23 bp, Saccharomyces cerevisiae
ggtgggaaaacaaattcaataaa

SEQ ID NO: 2657 - DNA, 22 bp, Saccharomyces cerevisiae
cactacgcattggcttaatctc

SEQ ID NO: 2658 - DNA, 27 bp, Saccharomyces cerevisiae
aaatatatagattatttttttagcatt

SEQ ID NO: 2659 - DNA, 23 bp, Saccharomyces cerevisiae
ataggaagcgagaatttttgaca

SEQ ID NO: 2660 - DNA, 23 bp, Saccharomyces cerevisiae
gaatccttgtgggagtagtgtga

SEQ ID NO: 2661 - DNA, 27 bp, Saccharomyces cerevisiae
ttgttaatttttaactttcaaagagca

SEQ ID NO: 2662 - DNA, 27 bp, Saccharomyces cerevisiae
aacagtttatgtaaaatgaaattagga

SEQ ID NO: 2663 - DNA, 24 bp, Saccharomyces cerevisiae
tttaacgttcgagattaagaaggc

SEQ ID NO: 2664 - DNA, 27 bp, Saccharomyces cerevisiae
acacatatataaaatataccggagatg

SEQ ID NO: 2665 - DNA, 27 bp, Saccharomyces cerevisiae
cgtttacagtagatgaatgatgtattt

SEQ ID NO: 2666 - DNA, 20 bp, Saccharomyces cerevisiae
aggcaaccagaaggaaggag

SEQ ID NO: 2667 - DNA, 24 bp, Saccharomyces cerevisiae
tatccttcgacagcttaatgaaca

SEQ ID NO: 2668 - DNA, 27 bp, Saccharomyces cerevisiae
tgaagagtatcaagaatttaaaatgaa

SEQ ID NO: 2669 - DNA, 25 bp, Saccharomyces cerevisiae
cgcaagtaacgaattttataaatga

SEQ ID NO: 2670 - DNA, 27 bp, Saccharomyces cerevisiae
atctagtgttagaagacgaagcatttt

SEQ ID NO: 2671 - DNA, 25 bp, Saccharomyces cerevisiae
ttgggttactaagaaattaaaaata

SEQ ID NO: 2672 - DNA, 27 bp, Saccharomyces cerevisiae
tattaattaaaaaaaaaaaaaagccaa

SEQ ID NO: 2673 - DNA, 22 bp, Saccharomyces cerevisiae
tcacaacagtaactgcgacaag

SEQ ID NO: 2674 - DNA, 19 bp, Saccharomyces cerevisiae
gcccccacaacaaaaatta

SEQ ID NO: 2675 - DNA, 22 bp, Saccharomyces cerevisiae
tttcacgaggtaaaaggaagga

SEQ ID NO: 2676 - DNA, 21 bp, Saccharomyces cerevisiae
cctacgatggatcgaacaaaa

SEQ ID NO: 2677 - DNA, 27 bp, Saccharomyces cerevisiae
tagatgagaacagtcctttaagtaaca

SEQ ID NO: 2678 - DNA, 26 bp, Saccharomyces cerevisiae
tagatagattaagagagaaggctcgg

SEQ ID NO: 2679 - DNA, 26 bp, Saccharomyces cerevisiae
gagaagaaataaggatgcattttaca

SEQ ID NO: 2680 - DNA, 20 bp, Saccharomyces cerevisiae
atcaaggttgtggcattttt

SEQ ID NO: 2681 - DNA, 26 bp, Saccharomyces cerevisiae
aaagacaatacatctaaagagatgcc

SEQ ID NO: 2682 - DNA, 27 bp, Saccharomyces cerevisiae
tgacgaactgagtgactaataaataaa

SEQ ID NO: 2683 - DNA, 19 bp, Saccharomyces cerevisiae
tgaagggatcatcgaagca

SEQ ID NO: 2684 - DNA, 21 bp, Saccharomyces cerevisiae
aagcgaagatgaacaacgaag

SEQ ID NO: 2685 - DNA, 26 bp, Saccharomyces cerevisiae
acagtacgttgaagattatgtattgg

SEQ ID NO: 2686 - DNA, 20 bp, Saccharomyces cerevisiae
agaaacgcctaaataacata

SEQ ID NO: 2687 - DNA, 23 bp, Saccharomyces cerevisiae
ctctgatttcactgtcattgcat

SEQ ID NO: 2688 - DNA, 21 bp, Saccharomyces cerevisiae
gcatagcttaatccgttttca

SEQ ID NO: 2689 - DNA, 27 bp, Saccharomyces cerevisiae
cttgtagcatgatctttttacattttt

SEQ ID NO: 2690 - DNA, 20 bp, Saccharomyces cerevisiae
taaacttttccaccaagcca

SEQ ID NO: 2691 - DNA, 23 bp, Saccharomyces cerevisiae
attggctacctaagatgaacgtc

SEQ ID NO: 2692 - DNA, 27 bp, Saccharomyces cerevisiae
gattgtagtaatgttatggcttgaagt

SEQ ID NO: 2693 - DNA, 23 bp, Saccharomyces cerevisiae
taggcagtcgaactgactctaat

SEQ ID NO: 2694 - DNA, 24 bp, Saccharomyces cerevisiae
taagagaattgcattatggtcaac

SEQ ID NO: 2695 - DNA, 27 bp, Saccharomyces cerevisiae
gattagaatagtttttccattttacca

SEQ ID NO: 2696 - DNA, 23 bp, Saccharomyces cerevisiae
tgggtgttctcgttctacttttc

SEQ ID NO: 2697 - DNA, 22 bp, Saccharomyces cerevisiae
acataactccatgcatgctaca

SEQ ID NO: 2698 - DNA, 27 bp, Saccharomyces cerevisiae
atatgttcttagataaaattccttaca

SEQ ID NO: 2699 - DNA, 27 bp, Saccharomyces cerevisiae
cgtaagtagcttttccttatagaatgt

SEQ ID NO: 2700 - DNA, 25 bp, Saccharomyces cerevisiae
aattaatgggtagggttaatagctt

SEQ ID NO: 2701 - DNA, 22 bp, Saccharomyces cerevisiae
ggcgtatcataatctaaataca

SEQ ID NO: 2702 - DNA, 26 bp, Saccharomyces cerevisiae
aggaagtagaaatacttatgaaggca

SEQ ID NO: 2703 - DNA, 22 bp, Saccharomyces cerevisiae
cgagaaagagagggacaagatg

SEQ ID NO: 2704 - DNA, 26 bp, Saccharomyces cerevisiae
tagattgttccgaacttgttcagttg

SEQ ID NO: 2705 - DNA, 22 bp, Saccharomyces cerevisiae
tgaaccgtcagaagttccgata

SEQ ID NO: 2706 - DNA, 21 bp, Saccharomyces cerevisiae
ctgcacaagcggtttatgaat

SEQ ID NO: 2707 - DNA, 19 bp, Saccharomyces cerevisiae
taagggccattcatcccac

SEQ ID NO: 2708 - DNA, 19 bp, Saccharomyces cerevisiae
tgaagaaaaggtcatgcca

SEQ ID NO: 2709 - DNA, 24 bp, Saccharomyces cerevisiae
aataagtcatgagaaagtttgaat

SEQ ID NO: 2710 - DNA, 21 bp, Saccharomyces cerevisiae
gcccgactgataacaacagtg

SEQ ID NO: 2711 - DNA, 24 bp, Saccharomyces cerevisiae
ttacatagcaacaatgaaaatccg

SEQ ID NO: 2712 - DNA, 27 bp, Saccharomyces cerevisiae
tgacatatatatagctcgcagtagaag

SEQ ID NO: 2713 - DNA, 25 bp, Saccharomyces cerevisiae
gctgtaagcgagatacataagaaaa

SEQ ID NO: 2714 - DNA, 26 bp, Saccharomyces cerevisiae
tttattagcattgatattattatttt

SEQ ID NO: 2715 - DNA, 23 bp, Saccharomyces cerevisiae
ttggcgtgaggataaatagagaa

SEQ ID NO: 2716 - DNA, 27 bp, Saccharomyces cerevisiae
tagcacataagtaaaaatggaatacgg

SEQ ID NO: 2717 - DNA, 26 bp, Saccharomyces cerevisiae
tgagttctatatgtgataaaatgatg

SEQ ID NO: 2718 - DNA, 27 bp, Saccharomyces cerevisiae
gaaattagaaccgaatcaaaatagttc

SEQ ID NO: 2719 - DNA, 20 bp, Saccharomyces cerevisiae
gcgtgaagaaaagcaacaaa

SEQ ID NO: 2720 - DNA, 18 bp, Saccharomyces cerevisiae
ctgtgaaacgggcgtcct

SEQ ID NO: 2721 - DNA, 27 bp, Saccharomyces cerevisiae
caaaaagtataaaacacttcggttaat

SEQ ID NO: 2722 - DNA, 22 bp, Saccharomyces cerevisiae
caatgaacaattttccaacgta

SEQ ID NO: 2723 - DNA, 24 bp, Saccharomyces cerevisiae
gaagcttctaaacaaagtaatgct

SEQ ID NO: 2724 - DNA, 25 bp, Saccharomyces cerevisiae
ggttttatctaaaagtaataatcaa

SEQ ID NO: 2725 - DNA, 25 bp, Saccharomyces cerevisiae
aaaaataaaagttcatgtcaaggca

SEQ ID NO: 2726 - DNA, 27 bp, Saccharomyces cerevisiae
tacggacaacatactttatatgactga

SEQ ID NO: 2727 - DNA, 27 bp, Saccharomyces cerevisiae
attccaaattgaaacgtaatactatct

SEQ ID NO: 2728 - DNA, 23 bp, Saccharomyces cerevisiae
caactcagcaagatttgattttt

SEQ ID NO: 2729 - DNA, 24 bp, Saccharomyces cerevisiae
aatagaacaatacgcacacacaca

SEQ ID NO: 2730 - DNA, 26 bp, Saccharomyces cerevisiae
taaccactacacaaataggtatatca

SEQ ID NO: 2731 - DNA, 27 bp, Saccharomyces cerevisiae
cacaaggactaggatactgttattttt

SEQ ID NO: 2732 - DNA, 26 bp, Saccharomyces cerevisiae
caattttagagtattctgccattttt

SEQ ID NO: 2733 - DNA, 26 bp, Saccharomyces cerevisiae
ttatagaatgtaaacggcaaatttta

SEQ ID NO: 2734 - DNA, 22 bp, Saccharomyces cerevisiae
ttttgaattttgaagaaagcca

SEQ ID NO: 2735 - DNA, 23 bp, Saccharomyces cerevisiae
ttcaagtgaatgttaacaaaaat

SEQ ID NO: 2736 - DNA, 24 bp, Saccharomyces cerevisiae
aaaacgaagtgatatctttacatc

SEQ ID NO: 2737 - DNA, 26 bp, Saccharomyces cerevisiae
atagattcacgtcctaaatcaaagtt

SEQ ID NO: 2738 - DNA, 22 bp, Saccharomyces cerevisiae
aaaaatgaattgcccgtaaaca

SEQ ID NO: 2739 - DNA, 26 bp, Saccharomyces cerevisiae
aaccttaaaccaaacataattaaacc

SEQ ID NO: 2740 - DNA, 22 bp, Saccharomyces cerevisiae
aggctgacgtaatgtctgaaaa

SEQ ID NO: 2741 - DNA, 24 bp, Saccharomyces cerevisiae
ctcttataatttgtttccctcgac

SEQ ID NO: 2742 - DNA, 25 bp, Saccharomyces cerevisiae
caaatacgttagtaaagggttttca

SEQ ID NO: 2743 - DNA, 19 bp, Saccharomyces cerevisiae
ggcaagctttctcgcattt

SEQ ID NO: 2744 - DNA, 27 bp, Saccharomyces cerevisiae
tgtaaggaattcactagttcataagca

SEQ ID NO: 2745 - DNA, 25 bp, Saccharomyces cerevisiae
tcaattaccttatttatttcctcac

SEQ ID NO: 2746 - DNA, 25 bp, Saccharomyces cerevisiae
aagaaataaagcttaaaccaaggga

SEQ ID NO: 2747 - DNA, 23 bp, Saccharomyces cerevisiae
ctctcttaacctcggcaataaaa

SEQ ID NO: 2748 - DNA, 23 bp, Saccharomyces cerevisiae
tgagtttatgctgagtttttgcg

SEQ ID NO: 2749 - DNA, 27 bp, Saccharomyces cerevisiae
aagatctaaggtttgtaactgagaaaa

SEQ ID NO: 2750 - DNA, 27 bp, Saccharomyces cerevisiae
tgaacaaatcgctcttaaatatatacc

SEQ ID NO: 2751 - DNA, 19 bp, Saccharomyces cerevisiae
aattcagcgtcgtcgaacc

SEQ ID NO: 2752 - DNA, 22 bp, Saccharomyces cerevisiae
gacctgtgtgtggtcttttctt

SEQ ID NO: 2753 - DNA, 27 bp, Saccharomyces cerevisiae
aagaaggactaagatattgaaaagtcc

SEQ ID NO: 2754 - DNA, 27 bp, Saccharomyces cerevisiae
ataagtacgtaagaatccgtaaaaagg

SEQ ID NO: 2755 - DNA, 19 bp, Saccharomyces cerevisiae
aaagcattaccgtcacgca

SEQ ID NO: 2756 - DNA, 27 bp, Saccharomyces cerevisiae
gaatctattcaggatgtaacttaatgg

SEQ ID NO: 2757 - DNA, 21 bp, Saccharomyces cerevisiae
acgactgcttactcagggaga

SEQ ID NO: 2758 - DNA, 27 bp, Saccharomyces cerevisiae
catatataaatatctgtatccttcttt

SEQ ID NO: 2759 - DNA, 22 bp, Saccharomyces cerevisiae
atacccagttgagaagacgagc

SEQ ID NO: 2760 - DNA, 25 bp, Saccharomyces cerevisiae
aaaaaccattgaaatctgtataaaa

SEQ ID NO: 2761 - DNA, 24 bp, Saccharomyces cerevisiae
tagtcgatcgtttcttattaacca

SEQ ID NO: 2762 - DNA, 27 bp, Saccharomyces cerevisiae
aaaatgaccctaaactacttctaaacc

SEQ ID NO: 2763 - DNA, 20 bp, Saccharomyces cerevisiae
cactgaacaggaaattcgca

SEQ ID NO: 2764 - DNA, 21 bp, Saccharomyces cerevisiae
gcaatgccaatgatgaatatg

SEQ ID NO: 2765 - DNA, 23 bp, Saccharomyces cerevisiae
aggattgaaacttctttactgcc

SEQ ID NO: 2766 - DNA, 23 bp, Saccharomyces cerevisiae
tagccacacaggcacttataaac

SEQ ID NO: 2767 - DNA, 26 bp, Saccharomyces cerevisiae
ccaaattagctttctttctatttctt

SEQ ID NO: 2768 - DNA, 25 bp, Saccharomyces cerevisiae
agcgattaaaagtatttgtgaatga

SEQ ID NO: 2769 - DNA, 27 bp, Saccharomyces cerevisiae
aggtatacgtatttaagacatcatagg

SEQ ID NO: 2770 - DNA, 24 bp, Saccharomyces cerevisiae
aaacaaccctacaaattgttctgg

SEQ ID NO: 2771 - DNA, 20 bp, Saccharomyces cerevisiae
tggcaatcgttaggagcttt

SEQ ID NO: 2772 - DNA, 25 bp, Saccharomyces cerevisiae
agtttgtagatcaacctatttacgc

SEQ ID NO: 2773 - DNA, 23 bp, Saccharomyces cerevisiae
gttttcgagaggatttttatcca

SEQ ID NO: 2774 - DNA, 24 bp, Saccharomyces cerevisiae
taaataaaactagtatacagcaaa

SEQ ID NO: 2775 - DNA, 27 bp, Saccharomyces cerevisiae
accattcattatgttacaaagatagca

SEQ ID NO: 2776 - DNA, 26 bp, Saccharomyces cerevisiae
aaaccatgttgatgatttgttatatt

SEQ ID NO: 2777 - DNA, 27 bp, Saccharomyces cerevisiae
actaatttgataaacaggctaaaggtt

SEQ ID NO: 2778 - DNA, 25 bp, Saccharomyces cerevisiae
cattagtaccatttgcaagacattg

SEQ ID NO: 2779 - DNA, 26 bp, Saccharomyces cerevisiae
taaatcgcactttgtatctacttttt

SEQ ID NO: 2780 - DNA, 18 bp, Saccharomyces cerevisiae
ctgtccccggctttaggc

SEQ ID NO: 2781 - DNA, 22 bp, Saccharomyces cerevisiae
ggaaagaaataaccaataataa

SEQ ID NO: 2782 - DNA, 27 bp, Saccharomyces cerevisiae
ttgtaaacgataaatatgccataaaga

SEQ ID NO: 2783 - DNA, 22 bp, Saccharomyces cerevisiae
gtgaagctgacgcatagatagg

SEQ ID NO: 2784 - DNA, 26 bp, Saccharomyces cerevisiae
cattcaaaacgtgaacatctttgtta

SEQ ID NO: 2785 - DNA, 25 bp, Saccharomyces cerevisiae
aacatataaatgtgtatgacaagca

SEQ ID NO: 2786 - DNA, 22 bp, Saccharomyces cerevisiae
acacgtaatcgccttacctacg

SEQ ID NO: 2787 - DNA, 27 bp, Saccharomyces cerevisiae
aaggattaaagatgctaagagatagtg

SEQ ID NO: 2788 - DNA, 27 bp, Saccharomyces cerevisiae
taatatgtaggatagaatgaaaggagg

SEQ ID NO: 2789 - DNA, 27 bp, Saccharomyces cerevisiae
ttatttataagtgttgttagaggctgc

SEQ ID NO: 2790 - DNA, 27 bp, Saccharomyces cerevisiae
acaaatatattaggttcaaggtcttcg

SEQ ID NO: 2791 - DNA, 21 bp, Saccharomyces cerevisiae
acggcatatacttacgcgcac

SEQ ID NO: 2792 - DNA, 24 bp, Saccharomyces cerevisiae
gcttatcctatcctctatttccgc

SEQ ID NO: 2793 - DNA, 23 bp, Saccharomyces cerevisiae
cgcttttatgaacatattccgat

SEQ ID NO: 2794 - DNA, 20 bp, Saccharomyces cerevisiae
cctaaacgttccttgaagcc

SEQ ID NO: 2795 - DNA, 22 bp, Saccharomyces cerevisiae
taggacgggaaaaatgagaaaa

SEQ ID NO: 2796 - DNA, 19 bp, Saccharomyces cerevisiae
aaagccgccatttgtgtct

SEQ ID NO: 2797 - DNA, 20 bp, Saccharomyces cerevisiae
agacgttaaactaaagttgc

SEQ ID NO: 2798 - DNA, 22 bp, Saccharomyces cerevisiae
tagataaggacgccactgactt

SEQ ID NO: 2799 - DNA, 27 bp, Saccharomyces cerevisiae
taggtgcatttcttatttcttaatttt

SEQ ID NO: 2800 - DNA, 20 bp, Saccharomyces cerevisiae
accgtattttgctcgttcca

SEQ ID NO: 2801 - DNA, 27 bp, Saccharomyces cerevisiae
atatatagatcgcgataataaacgctc

SEQ ID NO: 2802 - DNA, 23 bp, Saccharomyces cerevisiae
gcaaggtcatgaactgaatcttt

SEQ ID NO: 2803 - DNA, 27 bp, Saccharomyces cerevisiae
ttacagaggtatatccgtattttcatt

SEQ ID NO: 2804 - DNA, 18 bp, Saccharomyces cerevisiae
cgctatcctcggttctgc

SEQ ID NO: 2805 - DNA, 24 bp, Saccharomyces cerevisiae
acaacatctattatgggaacatcc

SEQ ID NO: 2806 - DNA, 25 bp, Saccharomyces cerevisiae
tcattatgattatgtcaagcacctg

SEQ ID NO: 2807 - DNA, 27 bp, Saccharomyces cerevisiae
ctatgaataaaagtaaaaataaacaca

SEQ ID NO: 2808 - DNA, 22 bp, Saccharomyces cerevisiae
tggcattgaaatttagcttttt

SEQ ID NO: 2809 - DNA, 22 bp, Saccharomyces cerevisiae
aatttttgtggaatagaaccgc

SEQ ID NO: 2810 - DNA, 24 bp, Saccharomyces cerevisiae
tattgatacgtcatatttctctct

SEQ ID NO: 2811 - DNA, 23 bp, Saccharomyces cerevisiae
tatcaagcggatatctttttttg

SEQ ID NO: 2812 - DNA, 21 bp, Saccharomyces cerevisiae
aggagcaatgcaaaatctagg

SEQ ID NO: 2813 - DNA, 27 bp, Saccharomyces cerevisiae
aatcttgatgtacgtaacgcactttct

SEQ ID NO: 2814 - DNA, 20 bp, Saccharomyces cerevisiae
ccaaactaagttcgcgtttt

SEQ ID NO: 2815 - DNA, 20 bp, Saccharomyces cerevisiae
cgtttgatgataaccggtgc

SEQ ID NO: 2816 - DNA, 27 bp, Saccharomyces cerevisiae
ttctatcgatggtaaagagtatgtgtc

SEQ ID NO: 2817 - DNA, 22 bp, Saccharomyces cerevisiae
agacaatcgcaagagggtataa

SEQ ID NO: 2818 - DNA, 27 bp, Saccharomyces cerevisiae
cgtgatttacatatactacaagtcgcc

SEQ ID NO: 2819 - DNA, 26 bp, Saccharomyces cerevisiae
tttcatttcaaacaagaatagctaac

SEQ ID NO: 2820 - DNA, 19 bp, Saccharomyces cerevisiae
gactccgcttaaattcata

SEQ ID NO: 2821 - DNA, 26 bp, Saccharomyces cerevisiae
ggatatcattgctatgtaaacaaact

SEQ ID NO: 2822 - DNA, 20 bp, Saccharomyces cerevisiae
aatttcttcttgtccgccac

SEQ ID NO: 2823 - DNA, 24 bp, Saccharomyces cerevisiae
aacagctctgttaccgtaggtttc

SEQ ID NO: 2824 - DNA, 24 bp, Saccharomyces cerevisiae
gagatttttttgtaaataagagtt

SEQ ID NO: 2825 - DNA, 27 bp, Saccharomyces cerevisiae
taggtgacattctgataatacgttaag

SEQ ID NO: 2826 - DNA, 23 bp, Saccharomyces cerevisiae
ccatagcgcaattctatgtaagt

SEQ ID NO: 2827 - DNA, 21 bp, Saccharomyces cerevisiae
gcactccacgagttatgctct

SEQ ID NO: 2828 - DNA, 27 bp, Saccharomyces cerevisiae
ctcagaacagaattagtgttaatagcg

SEQ ID NO: 2829 - DNA, 25 bp, Saccharomyces cerevisiae
atacaaattccaattggttatgaca

SEQ ID NO: 2830 - DNA, 24 bp, Saccharomyces cerevisiae
acttaaatagagttatcattcctt

SEQ ID NO: 2831 - DNA, 18 bp, Saccharomyces cerevisiae
gggaggcggtgaaggttt

SEQ ID NO: 2832 - DNA, 27 bp, Saccharomyces cerevisiae
aagattaataaagaaaacatgaaaatc

SEQ ID NO: 2833 - DNA, 20 bp, Saccharomyces cerevisiae
tggtaatttgcgggtctatg

SEQ ID NO: 2834 - DNA, 22 bp, Saccharomyces cerevisiae
caagacggaaagattgaaagag

SEQ ID NO: 2835 - DNA, 27 bp, Saccharomyces cerevisiae
tctcagtaagaaaaagaagatgaatgc

SEQ ID NO: 2836 - DNA, 25 bp, Saccharomyces cerevisiae
gagtactaacatatcattcactaca

SEQ ID NO: 2837 - DNA, 26 bp, Saccharomyces cerevisiae
attaccttttgttggcatctaaaatc

SEQ ID NO: 2838 - DNA, 24 bp, Saccharomyces cerevisiae
caacttaattattttcttcttttg

SEQ ID NO: 2839 - DNA, 20 bp, Saccharomyces cerevisiae
agagccctcggtagcataac

SEQ ID NO: 2840 - DNA, 26 bp, Saccharomyces cerevisiae
tgcctatatagagtagagaagaaaaa

SEQ ID NO: 2841 - DNA, 23 bp, Saccharomyces cerevisiae
ttttatggttccttactctcgca

SEQ ID NO: 2842 - DNA, 27 bp, Saccharomyces cerevisiae
tagtgtacaaaaatatctatatgggtc

SEQ ID NO: 2843 - DNA, 22 bp, Saccharomyces cerevisiae
ttgaggcattaaaaatgtaccc

SEQ ID NO: 2844 - DNA, 20 bp, Saccharomyces cerevisiae
taagcgcaaccgtgataaaa

SEQ ID NO: 2845 - DNA, 27 bp, Saccharomyces cerevisiae
tcactttcaagctgtagtatgtaaacg

SEQ ID NO: 2846 - DNA, 24 bp, Saccharomyces cerevisiae
gttacagcatgttctgcttaaaaa

SEQ ID NO: 2847 - DNA, 24 bp, Saccharomyces cerevisiae
ctgaattaacatgttctatctaat

SEQ ID NO: 2848 - DNA, 25 bp, Saccharomyces cerevisiae
atttactgactaaaaaatccagaag

SEQ ID NO: 2849 - DNA, 25 bp, Saccharomyces cerevisiae
tgaacaacttacacattcctattca

SEQ ID NO: 2850 - DNA, 21 bp, Saccharomyces cerevisiae
tcaatgcttctttcttgcgtt

SEQ ID NO: 2851 - DNA, 20 bp, Saccharomyces cerevisiae
agcgctctaagaaaaacggt

SEQ ID NO: 2852 - DNA, 27 bp, Saccharomyces cerevisiae
gaaaatttttaatagtaatcctaagca

SEQ ID NO: 2853 - DNA, 26 bp, Saccharomyces cerevisiae
atgctagcctgaaatgtattattgtg

SEQ ID NO: 2854 - DNA, 23 bp, Saccharomyces cerevisiae
aggccataattcacactgaaaaa

SEQ ID NO: 2855 - DNA, 20 bp, Saccharomyces cerevisiae
gctaagcaataagcgattta

SEQ ID NO: 2856 - DNA, 24 bp, Saccharomyces cerevisiae
gtaccggataacagagtaactggt

SEQ ID NO: 2857 - DNA, 21 bp, Saccharomyces cerevisiae
atgtccacagagtgttccgtt

SEQ ID NO: 2858 - DNA, 26 bp, Saccharomyces cerevisiae
tgctgtaatatcaatttttcatcaat

SEQ ID NO: 2859 - DNA, 21 bp, Saccharomyces cerevisiae
tgaaaatcttcccttggcttt

SEQ ID NO: 2860 - DNA, 26 bp, Saccharomyces cerevisiae
tagatcaataagattcaaataaagcg

SEQ ID NO: 2861 - DNA, 27 bp, Saccharomyces cerevisiae
caagctgtaattaaataatcaaatgtc

SEQ ID NO: 2862 - DNA, 24 bp, Saccharomyces cerevisiae
tctttgtaacttgaacggatcttt

SEQ ID NO: 2863 - DNA, 20 bp, Saccharomyces cerevisiae
gcagatcaaaggcaaagaca

SEQ ID NO: 2864 - DNA, 26 bp, Saccharomyces cerevisiae
atggtactcttgcatatgtaaccttt

SEQ ID NO: 2865 - DNA, 27 bp, Saccharomyces cerevisiae
aactgaacttccattatcctgtatagc

SEQ ID NO: 2866 - DNA, 25 bp, Saccharomyces cerevisiae
ttaaatttttgttaggtggacctgc

SEQ ID NO: 2867 - DNA, 26 bp, Saccharomyces cerevisiae
tattatttaggctgtttgagtttggg

SEQ ID NO: 2868 - DNA, 25 bp, Saccharomyces cerevisiae
tagacacttttaatggtaaatatcg

SEQ ID NO: 2869 - DNA, 21 bp, Saccharomyces cerevisiae
cacaatgcgtcttcagtttcc

SEQ ID NO: 2870 - DNA, 24 bp, Saccharomyces cerevisiae
tgtaattccaatatcgtaagcgtg

SEQ ID NO: 2871 - DNA, 25 bp, Saccharomyces cerevisiae
tagcatagttatttgtaccaatctt

SEQ ID NO: 2872 - DNA, 18 bp, Saccharomyces cerevisiae
gttaacgggcacagcgtc

SEQ ID NO: 2873 - DNA, 19 bp, Saccharomyces cerevisiae
tgctcgctcccgtttttac

SEQ ID NO: 2874 - DNA, 24 bp, Saccharomyces cerevisiae
ctttatggaaaattcatgttttga

SEQ ID NO: 2875 - DNA, 22 bp, Saccharomyces cerevisiae
tagatttctatcttccaacgcc

SEQ ID NO: 2876 - DNA, 23 bp, Saccharomyces cerevisiae
aaaaagtgattctcgaacaaaaa

SEQ ID NO: 2877 - DNA, 23 bp, Saccharomyces cerevisiae
tatgaaaccgatttatctctccg

SEQ ID NO: 2878 - DNA, 23 bp, Saccharomyces cerevisiae
gcaatataatggacgggtttaca

SEQ ID NO: 2879 - DNA, 20 bp, Saccharomyces cerevisiae
tccatccacccgtattcaga

SEQ ID NO: 2880 - DNA, 21 bp, Saccharomyces cerevisiae
tttatgggaagagcgtgctaa

SEQ ID NO: 2881 - DNA, 23 bp, Saccharomyces cerevisiae
atgcgtatgtagtgtccattgtt

SEQ ID NO: 2882 - DNA, 23 bp, Saccharomyces cerevisiae
tgactgagtgattctagcaggtc

SEQ ID NO: 2883 - DNA, 23 bp, Saccharomyces cerevisiae
gcttaatgagattttatgtagtt

SEQ ID NO: 2884 - DNA, 25 bp, Saccharomyces cerevisiae
caatgattaaaatagcatagtcggg

SEQ ID NO: 2885 - DNA, 22 bp, Saccharomyces cerevisiae
taaacgtagcaagcagggtaca

SEQ ID NO: 2886 - DNA, 19 bp, Saccharomyces cerevisiae
ccacaaagcaagccatttc

SEQ ID NO: 2887 - DNA, 25 bp, Saccharomyces cerevisiae
atgtgatgataataccacagagagg

SEQ ID NO: 2888 - DNA, 26 bp, Saccharomyces cerevisiae
aagacgtaaggcatgaaaatattagg

SEQ ID NO: 2889 - DNA, 21 bp, Saccharomyces cerevisiae
ttgatgattgtgacgacaaga

SEQ ID NO: 2890 - DNA, 26 bp, Saccharomyces cerevisiae
accataaaatttaactgtagtcgcaa

SEQ ID NO: 2891 - DNA, 26 bp, Saccharomyces cerevisiae
cttggcaaataaaaatatataaaaaa

SEQ ID NO: 2892 - DNA, 24 bp, Saccharomyces cerevisiae
catttgtaatttgaccgattactg

SEQ ID NO: 2893 - DNA, 27 bp, Saccharomyces cerevisiae
ggtatctatatatttatttaatcgtgg

SEQ ID NO: 2894 - DNA, 20 bp, Saccharomyces cerevisiae
ttctgagccatctctcctga

SEQ ID NO: 2895 - DNA, 24 bp, Saccharomyces cerevisiae
acctcaacagctacacattctttt

SEQ ID NO: 2896 - DNA, 25 bp, Saccharomyces cerevisiae
tttaaatccaaagaaaaataaaggg

SEQ ID NO: 2897 - DNA, 20 bp, Saccharomyces cerevisiae
atgtggtggtgtatgtgcca

SEQ ID NO: 2898 - DNA, 26 bp, Saccharomyces cerevisiae
ttctaggtttcaagtaaaatcatacg

SEQ ID NO: 2899 - DNA, 27 bp, Saccharomyces cerevisiae
taaaagacctgatacttattgacacaa

SEQ ID NO: 2900 - DNA, 27 bp, Saccharomyces cerevisiae
catatatagagaaatacttcatcgtgg

SEQ ID NO: 2901 - DNA, 22 bp, Saccharomyces cerevisiae
atcctatgaggatataaacagt

SEQ ID NO: 2902 - DNA, 27 bp, Saccharomyces cerevisiae
aagtttatttgatacataatccggaaa

SEQ ID NO: 2903 - DNA, 23 bp, Saccharomyces cerevisiae
tattgcgaggagcattaattgta

SEQ ID NO: 2904 - DNA, 23 bp, Saccharomyces cerevisiae
tgttgctaaatatagaaatgaca

SEQ ID NO: 2905 - DNA, 21 bp, Saccharomyces cerevisiae
ctatgatacaggccttcgtcg

SEQ ID NO: 2906 - DNA, 26 bp, Saccharomyces cerevisiae
tttcgaaattacttacacttttgacg

SEQ ID NO: 2907 - DNA, 24 bp, Saccharomyces cerevisiae
ttttccttaagttaattgactggc

SEQ ID NO: 2908 - DNA, 21 bp, Saccharomyces cerevisiae
aaagagtgtctgtttatagca

SEQ ID NO: 2909 - DNA, 27 bp, Saccharomyces cerevisiae
catagtgcatattgaattgattagttg

SEQ ID NO: 2910 - DNA, 20 bp, Saccharomyces cerevisiae
ttacattacgccaagggttg

SEQ ID NO: 2911 - DNA, 21 bp, Saccharomyces cerevisiae
tttgtcggctgaaaagaactc

SEQ ID NO: 2912 - DNA, 27 bp, Saccharomyces cerevisiae
ggcaagtatatatagcacgtaatcttc

SEQ ID NO: 2913 - DNA, 26 bp, Saccharomyces cerevisiae
aattaggactaggcgatatagatttg

SEQ ID NO: 2914 - DNA, 27 bp, Saccharomyces cerevisiae
tttcattgagagtcttactcatcttca

SEQ ID NO: 2915 - DNA, 21 bp, Saccharomyces cerevisiae
catatgcaggtctcgatttcc

SEQ ID NO: 2916 - DNA, 25 bp, Saccharomyces cerevisiae
tcatcaattaatcaatatggtttgg

SEQ ID NO: 2917 - DNA, 26 bp, Saccharomyces cerevisiae
aaagctttgtaaatatgatgagagaa

SEQ ID NO: 2918 - DNA, 25 bp, Saccharomyces cerevisiae
ttatcggttgaaagaaaattacaca

SEQ ID NO: 2919 - DNA, 27 bp, Saccharomyces cerevisiae
cttcgctaatatatcaaagaataaaaa

SEQ ID NO: 2920 - DNA, 26 bp, Saccharomyces cerevisiae
tgaatatatagatgtttagtctctta

SEQ ID NO: 2921 - DNA, 27 bp, Saccharomyces cerevisiae
taagctttcgagaaaaactttctttta

SEQ ID NO: 2922 - DNA, 25 bp, Saccharomyces cerevisiae
atttcttgcaaacataagtaaatgc

SEQ ID NO: 2923 - DNA, 21 bp, Saccharomyces cerevisiae
aaaaggatattcattgcacgc

SEQ ID NO: 2924 - DNA, 22 bp, Saccharomyces cerevisiae
taaatatagcttgattgctgcg

SEQ ID NO: 2925 - DNA, 24 bp, Saccharomyces cerevisiae
ttatctctgcggaagactaagaca

SEQ ID NO: 2926 - DNA, 25 bp, Saccharomyces cerevisiae
acgttaggacttctttaattccctc

SEQ ID NO: 2927 - DNA, 25 bp, Saccharomyces cerevisiae
cccctctaaatatactgctagtcaa

SEQ ID NO: 2928 - DNA, 23 bp, Saccharomyces cerevisiae
atcaagcgagatctctgtgtgtg

SEQ ID NO: 2929 - DNA, 23 bp, Saccharomyces cerevisiae
tctatgaaaccaacctctgctat

SEQ ID NO: 2930 - DNA, 23 bp, Saccharomyces cerevisiae
ataagcgtccccacttttatttc

SEQ ID NO: 2931 - DNA, 26 bp, Saccharomyces cerevisiae
agagttgattaaaagaaaatgacctt

SEQ ID NO: 2932 - DNA, 27 bp, Saccharomyces cerevisiae
ttgtttctataatgtacacaacgtcaa

SEQ ID NO: 2933 - DNA, 21 bp, Saccharomyces cerevisiae
attcctaacgttgctccaatg

SEQ ID NO: 2934 - DNA, 27 bp, Saccharomyces cerevisiae
tcattttttacttaaaactagtcattt

SEQ ID NO: 2935 - DNA, 19 bp, Saccharomyces cerevisiae
atgtgatgcctgccttttt

SEQ ID NO: 2936 - DNA, 23 bp, Saccharomyces cerevisiae
ggccccttgttaataattcttgc

SEQ ID NO: 2937 - DNA, 23 bp, Saccharomyces cerevisiae
gatgtggggtaagaatggtactg

SEQ ID NO: 2938 - DNA, 26 bp, Saccharomyces cerevisiae
ttggataaataattcgttacatagtt

SEQ ID NO: 2939 - DNA, 21 bp, Saccharomyces cerevisiae
attggccacacattaaaggaa

SEQ ID NO: 2940 - DNA, 25 bp, Saccharomyces cerevisiae
tcgaatgtttctttcttttattcaa

SEQ ID NO: 2941 - DNA, 27 bp, Saccharomyces cerevisiae
acagctgataaactctgtctaataacc

SEQ ID NO: 2942 - DNA, 24 bp, Saccharomyces cerevisiae
tgtgattgagaataattagaggca

SEQ ID NO: 2943 - DNA, 24 bp, Saccharomyces cerevisiae
ttgtgaatgaaagtgaagagaaat

SEQ ID NO: 2944 - DNA, 25 bp, Saccharomyces cerevisiae
agcagttagaagaaagaattttgaa

SEQ ID NO: 2945 - DNA, 27 bp, Saccharomyces cerevisiae
taaatattcatgacattatctatgctg

SEQ ID NO: 2946 - DNA, 26 bp, Saccharomyces cerevisiae
taaatgtatattgatataagtgtagg

SEQ ID NO: 2947 - DNA, 27 bp, Saccharomyces cerevisiae
aaaaatatataagaaaaaaaaaaaaaa

SEQ ID NO: 2948 - DNA, 18 bp, Saccharomyces cerevisiae
ttgtaagcccctttgccg

SEQ ID NO: 2949 - DNA, 23 bp, Saccharomyces cerevisiae
atcgttagcgttctttctacttg

SEQ ID NO: 2950 - DNA, 22 bp, Saccharomyces cerevisiae
atcgtaggttgttgcttacctg

SEQ ID NO: 2951 - DNA, 27 bp, Saccharomyces cerevisiae
tatgtatctatatattgctgattgcat

SEQ ID NO: 2952 - DNA, 18 bp, Saccharomyces cerevisiae
tttgttgggcaagccata

SEQ ID NO: 2953 - DNA, 27 bp, Saccharomyces cerevisiae
tatcgaatcatcatttaatacacaagg

SEQ ID NO: 2954 - DNA, 24 bp, Saccharomyces cerevisiae
atatattaccaataggccaccttg

SEQ ID NO: 2955 - DNA, 21 bp, Saccharomyces cerevisiae
cgtaaatgagaacttacgggg

SEQ ID NO: 2956 - DNA, 26 bp, Saccharomyces cerevisiae
cgctaaatcatatgagatgaaaagaa

SEQ ID NO: 2957 - DNA, 27 bp, Saccharomyces cerevisiae
gacatacaaaggaacaaagtctgtttg

SEQ ID NO: 2958 - DNA, 27 bp, Saccharomyces cerevisiae
tagctagaagttttgtaggtatatgtg

SEQ ID NO: 2959 - DNA, 27 bp, Saccharomyces cerevisiae
aaaagaaacttagaaatcacaattagc

SEQ ID NO: 2960 - DNA, 27 bp, Saccharomyces cerevisiae
aaataacaacaaaaatcctctctttga

SEQ ID NO: 2961 - DNA, 27 bp, Saccharomyces cerevisiae
taagcggaacaagtatacattttatta

SEQ ID NO: 2962 - DNA, 23 bp, Saccharomyces cerevisiae
aggtgattatgtaaaacaagcgt

SEQ ID NO: 2963 - DNA, 21 bp, Saccharomyces cerevisiae
tacaaaaaaagatttgaataa

SEQ ID NO: 2964 - DNA, 24 bp, Saccharomyces cerevisiae
cagaaatcgtccagctaattattc

SEQ ID NO: 2965 - DNA, 27 bp, Saccharomyces cerevisiae
accttaattaggactagaacacttttg

SEQ ID NO: 2966 - DNA, 25 bp, Saccharomyces cerevisiae
agaacatagagatagaaatggcatc

SEQ ID NO: 2967 - DNA, 22 bp, Saccharomyces cerevisiae
cgttgattttgttaccactgga

SEQ ID NO: 2968 - DNA, 25 bp, Saccharomyces cerevisiae
taaaaatttggaagactttatatcc

SEQ ID NO: 2969 - DNA, 24 bp, Saccharomyces cerevisiae
tatatattattgaaaagcctatgt

SEQ ID NO: 2970 - DNA, 25 bp, Saccharomyces cerevisiae
acttgaatcttgtacgtaaatgcac

SEQ ID NO: 2971 - DNA, 21 bp, Saccharomyces cerevisiae
cctgtgtagcatgctcatttt

SEQ ID NO: 2972 - DNA, 27 bp, Saccharomyces cerevisiae
acatataactttgcaaatgattcaaaa

SEQ ID NO: 2973 - DNA, 26 bp, Saccharomyces cerevisiae
cactgttatttatatacatcgggagg

SEQ ID NO: 2974 - DNA, 24 bp, Saccharomyces cerevisiae
aattcagtacataatacctcaaaa

SEQ ID NO: 2975 - DNA, 19 bp, Saccharomyces cerevisiae
gcatcacatcgtaacgcct

SEQ ID NO: 2976 - DNA, 21 bp, Saccharomyces cerevisiae
ggttaacacatgcagtgatgc

SEQ ID NO: 2977 - DNA, 23 bp, Saccharomyces cerevisiae
agaacctagagtcacgattgaaa

SEQ ID NO: 2978 - DNA, 24 bp, Saccharomyces cerevisiae
tcttgttcctttccaacatataaa

SEQ ID NO: 2979 - DNA, 22 bp, Saccharomyces cerevisiae
cctgtaaatgagggaaaaatgc

SEQ ID NO: 2980 - DNA, 26 bp, Saccharomyces cerevisiae
atgtgcttttgtttatttcctatttg

SEQ ID NO: 2981 - DNA, 25 bp, Saccharomyces cerevisiae
tgactcacccatactttttcttttt

SEQ ID NO: 2982 - DNA, 21 bp, Saccharomyces cerevisiae
agcagaaaactgggagaaatg

SEQ ID NO: 2983 - DNA, 18 bp, Saccharomyces cerevisiae
gaaatgatcccgtcccgt

SEQ ID NO: 2984 - DNA, 26 bp, Saccharomyces cerevisiae
gcattttttttttttattttatatgc

SEQ ID NO: 2985 - DNA, 22 bp, Saccharomyces cerevisiae
gattcaatcggcaaggtttatc

SEQ ID NO: 2986 - DNA, 25 bp, Saccharomyces cerevisiae
gacatttgagtatgcaatgaatttg

SEQ ID NO: 2987 - DNA, 25 bp, Saccharomyces cerevisiae
aacacatatatcgttatgcatttcc

SEQ ID NO: 2988 - DNA, 24 bp, Saccharomyces cerevisiae
tgtttcttcatgtaattattcaaa

SEQ ID NO: 2989 - DNA, 27 bp, Saccharomyces cerevisiae
ttactagtacttaacatacccgagctg

SEQ ID NO: 2990 - DNA, 20 bp, Saccharomyces cerevisiae
ggacacgacgtaaagtgcag

SEQ ID NO: 2991 - DNA, 25 bp, Saccharomyces cerevisiae
gacgcattttgatatataggagttt

SEQ ID NO: 2992 - DNA, 20 bp, Saccharomyces cerevisiae
aatatgccgacacaagggag

SEQ ID NO: 2993 - DNA, 18 bp, Saccharomyces cerevisiae
gcctcgctcaaaggagac

SEQ ID NO: 2994 - DNA, 23 bp, Saccharomyces cerevisiae
aacgaataaggggaagaaaatag

SEQ ID NO: 2995 - DNA, 20 bp, Saccharomyces cerevisiae
agggtagcctccccataaca

SEQ ID NO: 2996 - DNA, 27 bp, Saccharomyces cerevisiae
caactatagattactgtcgtgcataaa

SEQ ID NO: 2997 - DNA, 24 bp, Saccharomyces cerevisiae
tttttatctccctttacaagagca

SEQ ID NO: 2998 - DNA, 22 bp, Saccharomyces cerevisiae
gaaaaataagttcccacaaacg

SEQ ID NO: 2999 - DNA, 19 bp, Saccharomyces cerevisiae
tgcgtgacgttgaatcgag

SEQ ID NO: 3000 - DNA, 24 bp, Saccharomyces cerevisiae
tcactgaatttagcgaatacatgg

SEQ ID NO: 3001 - DNA, 22 bp, Saccharomyces cerevisiae
ataagaacatggacaccgcttt

SEQ ID NO: 3002 - DNA, 21 bp, Saccharomyces cerevisiae
gtaaaaaggggaagcgatctt

SEQ ID NO: 3003 - DNA, 21 bp, Saccharomyces cerevisiae
gttgccctttccttctttctt

SEQ ID NO: 3004 - DNA, 24 bp, Saccharomyces cerevisiae
ttaggtaaaaataacatccgttca

SEQ ID NO: 3005 - DNA, 24 bp, Saccharomyces cerevisiae
aaatatagttgatggttcactggc

SEQ ID NO: 3006 - DNA, 26 bp, Saccharomyces cerevisiae
tataccctgactccacatacctattc

SEQ ID NO: 3007 - DNA, 27 bp, Saccharomyces cerevisiae
tcttagtgagacacaattaaaacaaca

SEQ ID NO: 3008 - DNA, 21 bp, Saccharomyces cerevisiae
ttctcaagtgggcgtaataga

SEQ ID NO: 3009 - DNA, 21 bp, Saccharomyces cerevisiae
tttaggccgaacaagtgtcct

SEQ ID NO: 3010 - DNA, 23 bp, Saccharomyces cerevisiae
tgaaataacattcatcagcaaaa

SEQ ID NO: 3011 - DNA, 25 bp, Saccharomyces cerevisiae
aaataactgcaggaaatgaaaatga

SEQ ID NO: 3012 - DNA, 22 bp, Saccharomyces cerevisiae
taccacgtaggatggatgtgtt

SEQ ID NO: 3013 - DNA, 20 bp, Saccharomyces cerevisiae
tacgctgacaagtttttggc

SEQ ID NO: 3014 - DNA, 27 bp, Saccharomyces cerevisiae
tagagagctaacttaacaatctcgttt

SEQ ID NO: 3015 - DNA, 20 bp, Saccharomyces cerevisiae
cggcaagaaaatccactgtt

SEQ ID NO: 3016 - DNA, 19 bp, Saccharomyces cerevisiae
gagtagagcacgcagcacg

SEQ ID NO: 3017 - DNA, 23 bp, Saccharomyces cerevisiae
aacaaaagacaagggaattgttg

SEQ ID NO: 3018 - DNA, 21 bp, Saccharomyces cerevisiae
taaaattagtgccggcttttt

SEQ ID NO: 3019 - DNA, 24 bp, Saccharomyces cerevisiae
ctacataacgtagacgcttcaaaa

SEQ ID NO: 3020 - DNA, 20 bp, Saccharomyces cerevisiae
cattcatttccagcatacca

SEQ ID NO: 3021 - DNA, 24 bp, Saccharomyces cerevisiae
taaagtagccatgtttaatcagca

SEQ ID NO: 3022 - DNA, 25 bp, Saccharomyces cerevisiae
aggttaccataaatcaaaacactga

SEQ ID NO: 3023 - DNA, 19 bp, Saccharomyces cerevisiae
aattgaggaagggtttgcc

SEQ ID NO: 3024 - DNA, 27 bp, Saccharomyces cerevisiae
tttcattagttttcacacaatatcaat

SEQ ID NO: 3025 - DNA, 27 bp, Saccharomyces cerevisiae
ataaagtgaaatccgtagctacataaa

SEQ ID NO: 3026 - DNA, 26 bp, Saccharomyces cerevisiae
ctagaacttttcttagaacgctatca

SEQ ID NO: 3027 - DNA, 27 bp, Saccharomyces cerevisiae
gctaagagacgaatttagtttgttttg

SEQ ID NO: 3028 - DNA, 22 bp, Saccharomyces cerevisiae
aaaaacacgctttttcagttcg

SEQ ID NO: 3029 - DNA, 22 bp, Saccharomyces cerevisiae
gtttgtctccctcactgttttt

SEQ ID NO: 3030 - DNA, 24 bp, Saccharomyces cerevisiae
aaggttttctagatttcacattgc

SEQ ID NO: 3031 - DNA, 22 bp, Saccharomyces cerevisiae
aatcagctgtgacaagtaagtt

SEQ ID NO: 3032 - DNA, 26 bp, Saccharomyces cerevisiae
ctcgaaagaagaaaaatactacaagc

SEQ ID NO: 3033 - DNA, 27 bp, Saccharomyces cerevisiae
tgaggtacaaatgatatatactacggg

SEQ ID NO: 3034 - DNA, 24 bp, Saccharomyces cerevisiae
atgaaactggtaatgggaattttt

SEQ ID NO: 3035 - DNA, 20 bp, Saccharomyces cerevisiae
cttaggagggggcaaaagac

SEQ ID NO: 3036 - DNA, 26 bp, Saccharomyces cerevisiae
tgattaaataatacttatacttacct

SEQ ID NO: 3037 - DNA, 26 bp, Saccharomyces cerevisiae
aggcttatatgaagctaaggtctctc

SEQ ID NO: 3038 - DNA, 26 bp, Saccharomyces cerevisiae
aagctaaactaaataagcaagagtat

SEQ ID NO: 3039 - DNA, 26 bp, Saccharomyces cerevisiae
ataaaggtaagggtatcgtgaaataa

SEQ ID NO: 3040 - DNA, 27 bp, Saccharomyces cerevisiae
tgatattagatcaaagcctaagaaaaa

SEQ ID NO: 3041 - DNA, 26 bp, Saccharomyces cerevisiae
tcttagtttcgtttttagtaatgtgc

SEQ ID NO: 3042 - DNA, 20 bp, Saccharomyces cerevisiae
gttggcatttgcttctccac

SEQ ID NO: 3043 - DNA, 22 bp, Saccharomyces cerevisiae
cagacaacgcaaaatgatctac

SEQ ID NO: 3044 - DNA, 25 bp, Saccharomyces cerevisiae
aataactttgtttctcttccctttt

SEQ ID NO: 3045 - DNA, 23 bp, Saccharomyces cerevisiae
agctaatagcgacaacaggaaaa

SEQ ID NO: 3046 - DNA, 22 bp, Saccharomyces cerevisiae
ccgtgtaaaaggttaatgagca

SEQ ID NO: 3047 - DNA, 22 bp, Saccharomyces cerevisiae
tataataagacacggacgcaca

SEQ ID NO: 3048 - DNA, 24 bp, Saccharomyces cerevisiae
tggcatatacatatggaaaatgat

SEQ ID NO: 3049 - DNA, 23 bp, Saccharomyces cerevisiae
ttttcatgataaatgaatgccaa

SEQ ID NO: 3050 - DNA, 22 bp, Saccharomyces cerevisiae
tacacggtccaatggataaaca

SEQ ID NO: 3051 - DNA, 21 bp, Saccharomyces cerevisiae
gtgcctcaaccaaatttgaca

SEQ ID NO: 3052 - DNA, 23 bp, Saccharomyces cerevisiae
tctgaagattaagtagtcaaaaa

SEQ ID NO: 3053 - DNA, 25 bp, Saccharomyces cerevisiae
tgtgtatatgtctatgtatgcagcg

SEQ ID NO: 3054 - DNA, 21 bp, Saccharomyces cerevisiae
aaaaatgctctcctcagcacc

SEQ ID NO: 3055 - DNA, 19 bp, Saccharomyces cerevisiae
aacctgaaatagcagcccc

SEQ ID NO: 3056 - DNA, 27 bp, Saccharomyces cerevisiae
atttgtaaaggttaaaatagaaggccg

SEQ ID NO: 3057 - DNA, 25 bp, Saccharomyces cerevisiae
gattaaagattcttgtagccgaata

SEQ ID NO: 3058 - DNA, 21 bp, Saccharomyces cerevisiae
tggacggacaaactcgttact

SEQ ID NO: 3059 - DNA, 25 bp, Saccharomyces cerevisiae
attatgtaattccctgaaaacttcc

SEQ ID NO: 3060 - DNA, 20 bp, Saccharomyces cerevisiae
atgcatcgatcaatcggagt

SEQ ID NO: 3061 - DNA, 27 bp, Saccharomyces cerevisiae
gagaaaaactaatgaagtgattaacaa

SEQ ID NO: 3062 - DNA, 21 bp, Saccharomyces cerevisiae
ttcggtcgatgactaaatgtt

SEQ ID NO: 3063 - DNA, 21 bp, Saccharomyces cerevisiae
taataggaaacgtgacggcag

SEQ ID NO: 3064 - DNA, 26 bp, Saccharomyces cerevisiae
aaatttctatttaacactgcagaaaa

SEQ ID NO: 3065 - DNA, 25 bp, Saccharomyces cerevisiae
gtaaagcttcttgaatcaaaggaaa

SEQ ID NO: 3066 - DNA, 23 bp, Saccharomyces cerevisiae
taagggatttctcttaatttttt

SEQ ID NO: 3067 - DNA, 27 bp, Saccharomyces cerevisiae
ttgctataagtggaaaatttcttttag

SEQ ID NO: 3068 - DNA, 27 bp, Saccharomyces cerevisiae
aaaatttgaaggagagtaaagaatacg

SEQ ID NO: 3069 - DNA, 21 bp, Saccharomyces cerevisiae
cattgagccttttgatcatgc

SEQ ID NO: 3070 - DNA, 25 bp, Saccharomyces cerevisiae
tattagacgacatcgtagccatatt

SEQ ID NO: 3071 - DNA, 25 bp, Saccharomyces cerevisiae
ctgtgattatacgcaacgatatttt

SEQ ID NO: 3072 - DNA, 21 bp, Saccharomyces cerevisiae
taaaccaatggcaactaccaa

SEQ ID NO: 3073 - DNA, 24 bp, Saccharomyces cerevisiae
tagggaatagtggtgaaagttacg

SEQ ID NO: 3074 - DNA, 25 bp, Saccharomyces cerevisiae
catatccagtattaactaaaagtat

SEQ ID NO: 3075 - DNA, 26 bp, Saccharomyces cerevisiae
ctggaagaatagcaatgtcatactgg

SEQ ID NO: 3076 - DNA, 21 bp, Saccharomyces cerevisiae
cgttttcatcaccacatgttt

SEQ ID NO: 3077 - DNA, 27 bp, Saccharomyces cerevisiae
atacataagacatgtagaacaagaatg

SEQ ID NO: 3078 - DNA, 23 bp, Saccharomyces cerevisiae
tgaaaataatattgacgttcgca

SEQ ID NO: 3079 - DNA, 24 bp, Saccharomyces cerevisiae
tgacgagcaagacatattctattt

SEQ ID NO: 3080 - DNA, 27 bp, Saccharomyces cerevisiae
agttcttatctatttcatttccaccaa

SEQ ID NO: 3081 - DNA, 26 bp, Saccharomyces cerevisiae
aaaaaaattaaagaaagtttcaaagc

SEQ ID NO: 3082 - DNA, 26 bp, Saccharomyces cerevisiae
caaaactgtatatatgcgctaaaagc

SEQ ID NO: 3083 - DNA, 27 bp, Saccharomyces cerevisiae
aggtagaaaattattcaaaccttgtaa

SEQ ID NO: 3084 - DNA, 24 bp, Saccharomyces cerevisiae
cgcatatggttctaatagtttcca

SEQ ID NO: 3085 - DNA, 23 bp, Saccharomyces cerevisiae
ggtctaattttcaaccaaacgtg

SEQ ID NO: 3086 - DNA, 18 bp, Saccharomyces cerevisiae
cattgcataggcacgcac

SEQ ID NO: 3087 - DNA, 23 bp, Saccharomyces cerevisiae
cgaaaatctgtcagcgtataaca

SEQ ID NO: 3088 - DNA, 25 bp, Saccharomyces cerevisiae
tgattcaaggagtagggtaaagtaa

SEQ ID NO: 3089 - DNA, 26 bp, Saccharomyces cerevisiae
ttaccatatatgcttcaacgtaggtc

SEQ ID NO: 3090 - DNA, 26 bp, Saccharomyces cerevisiae
tcaaaaataacggtcatatatcgaag

SEQ ID NO: 3091 - DNA, 23 bp, Saccharomyces cerevisiae
ttcctttttcaaaatgacgttta

SEQ ID NO: 3092 - DNA, 25 bp, Saccharomyces cerevisiae
agttagactgctacaccaacaaaaa

SEQ ID NO: 3093 - DNA, 26 bp, Saccharomyces cerevisiae
ttagtgttatcatcgttctcctttca

SEQ ID NO: 3094 - DNA, 27 bp, Saccharomyces cerevisiae
tacaattgaaaccgagaagtatatctg

SEQ ID NO: 3095 - DNA, 26 bp, Saccharomyces cerevisiae
tatagtttttctcaacattcaaggaa

SEQ ID NO: 3096 - DNA, 26 bp, Saccharomyces cerevisiae
ggttgagcattacgtatgatatgtcc

SEQ ID NO: 3097 - DNA, 20 bp, Saccharomyces cerevisiae
tgggaagattccgctctacc

SEQ ID NO: 3098 - DNA, 27 bp, Saccharomyces cerevisiae
tagtatttatttaagtattgtttgtgc

SEQ ID NO: 3099 - DNA, 24 bp, Saccharomyces cerevisiae
tcttctagttttcggtaaattggt

SEQ ID NO: 3100 - DNA, 24 bp, Saccharomyces cerevisiae
gtcaatggtaactcagcctttctt

SEQ ID NO: 3101 - DNA, 26 bp, Saccharomyces cerevisiae
gaattcaattagacatcataagaaca

SEQ ID NO: 3102 - DNA, 22 bp, Saccharomyces cerevisiae
ccttcgtttaggttttctttgg

SEQ ID NO: 3103 - DNA, 22 bp, Saccharomyces cerevisiae
ggccgctaaaaataatacgaaa

SEQ ID NO: 3104 - DNA, 25 bp, Saccharomyces cerevisiae
cttctaccaatatcgtcattgctgt

SEQ ID NO: 3105 - DNA, 27 bp, Saccharomyces cerevisiae
cttttaatgataaaattaagtgagtcc

SEQ ID NO: 3106 - DNA, 25 bp, Saccharomyces cerevisiae
gagtaaatcaaatatgaaaaaggca

SEQ ID NO: 3107 - DNA, 27 bp, Saccharomyces cerevisiae
aaataggaaattgtaagtaactggaaa

SEQ ID NO: 3108 - DNA, 26 bp, Saccharomyces cerevisiae
aaagtaattgtagaatggagtgttca

SEQ ID NO: 3109 - DNA, 26 bp, Saccharomyces cerevisiae
gatgattgagaatgaatatgtagtaa

SEQ ID NO: 3110 - DNA, 25 bp, Saccharomyces cerevisiae
ggaaaaattgcaaagttatgtcttc

SEQ ID NO: 3111 - DNA, 27 bp, Saccharomyces cerevisiae
tattgtatatttatataagtctgcttg

SEQ ID NO: 3112 - DNA, 23 bp, Saccharomyces cerevisiae
ctttaaatttgacgagaaaaccc

SEQ ID NO: 3113 - DNA, 25 bp, Saccharomyces cerevisiae
ttctatataaattagttatgcgttg

SEQ ID NO: 3114 - DNA, 19 bp, Saccharomyces cerevisiae
tcccataggtgataagcat

SEQ ID NO: 3115 - DNA, 20 bp, Saccharomyces cerevisiae
gcaaggggtaagagagaagg

SEQ ID NO: 3116 - DNA, 21 bp, Saccharomyces cerevisiae
catctattggtgcaaagagca

SEQ ID NO: 3117 - DNA, 26 bp, Saccharomyces cerevisiae
ggtgttactagacataatttagttca

SEQ ID NO: 3118 - DNA, 22 bp, Saccharomyces cerevisiae
taatcccaaattaccttcatgc

SEQ ID NO: 3119 - DNA, 27 bp, Saccharomyces cerevisiae
tatggaaattaacgctatcagattaga

SEQ ID NO: 3120 - DNA, 22 bp, Saccharomyces cerevisiae
gaaatgtgccatttgtatacgc

SEQ ID NO: 3121 - DNA, 20 bp, Saccharomyces cerevisiae
tgaggtccttgttttctgcg

SEQ ID NO: 3122 - DNA, 24 bp, Saccharomyces cerevisiae
aatcgaagtcgtgaattctcaatg

SEQ ID NO: 3123 - DNA, 25 bp, Saccharomyces cerevisiae
aagcactgaatttcaaaaacattta

SEQ ID NO: 3124 - DNA, 26 bp, Saccharomyces cerevisiae
tgaggatagcaggtacatataaattg

SEQ ID NO: 3125 - DNA, 27 bp, Saccharomyces cerevisiae
atttttattttctccttccatatgagc

SEQ ID NO: 3126 - DNA, 18 bp, Saccharomyces cerevisiae
tgattatcgggaggccat

SEQ ID NO: 3127 - DNA, 21 bp, Saccharomyces cerevisiae
tgaatcgaacaacgacaaaaa

SEQ ID NO: 3128 - DNA, 19 bp, Saccharomyces cerevisiae
gccaacgaaaaagaggtcc

SEQ ID NO: 3129 - DNA, 23 bp, Saccharomyces cerevisiae
aaaattcgttggtactagcttcg

SEQ ID NO: 3130 - DNA, 20 bp, Saccharomyces cerevisiae
ttgacagcacgaggagaaac

SEQ ID NO: 3131 - DNA, 19 bp, Saccharomyces cerevisiae
tagtctaggtccggagcgg

SEQ ID NO: 3132 - DNA, 23 bp, Saccharomyces cerevisiae
agattgatgtgagaatgatgcag

SEQ ID NO: 3133 - DNA, 24 bp, Saccharomyces cerevisiae
caagacgcttgaaagttctaaaaa

SEQ ID NO: 3134 - DNA, 23 bp, Saccharomyces cerevisiae
taagcaaaatgtcgtacataccg

SEQ ID NO: 3135 - DNA, 27 bp, Saccharomyces cerevisiae
tagagaatcagaaagtaagaggaaaaa

SEQ ID NO: 3136 - DNA, 26 bp, Saccharomyces cerevisiae
actttttcctaaacagtatttgcagc

SEQ ID NO: 3137 - DNA, 27 bp, Saccharomyces cerevisiae
accatacaacactaacagtaatctcgc

SEQ ID NO: 3138 - DNA, 26 bp, Saccharomyces cerevisiae
tcccttaaagaagacagtgataaaaa

SEQ ID NO: 3139 - DNA, 25 bp, Saccharomyces cerevisiae
caataaacaattttcgtggtaaatg

SEQ ID NO: 3140 - DNA, 21 bp, Saccharomyces cerevisiae
tcaagttttgatcagccctca

SEQ ID NO: 3141 - DNA, 27 bp, Saccharomyces cerevisiae
ttaacaattttaaatagaatagaaccc

SEQ ID NO: 3142 - DNA, 25 bp, Saccharomyces cerevisiae
aatgaaataagggctaaccattgag

SEQ ID NO: 3143 - DNA, 27 bp, Saccharomyces cerevisiae
tggaacaaatagacaactttttcaaac

SEQ ID NO: 3144 - DNA, 26 bp, Saccharomyces cerevisiae
acatgcatatatatttgtgattgatt

SEQ ID NO: 3145 - DNA, 27 bp, Saccharomyces cerevisiae
tgaaagaatttaagtattcaactttcg

SEQ ID NO: 3146 - DNA, 25 bp, Saccharomyces cerevisiae
actctcgtatgtatgcatttagtga

SEQ ID NO: 3147 - DNA, 20 bp, Saccharomyces cerevisiae
ataggtgtaaggattccccg

SEQ ID NO: 3148 - DNA, 26 bp, Saccharomyces cerevisiae
aatcccaaggtgctatttctatattt

SEQ ID NO: 3149 - DNA, 26 bp, Saccharomyces cerevisiae
tctggaatttaccctaactgtacaaa

SEQ ID NO: 3150 - DNA, 23 bp, Saccharomyces cerevisiae
tcacaataatgcatctggacatc

SEQ ID NO: 3151 - DNA, 24 bp, Saccharomyces cerevisiae
ggtttataggtcactgaggaaaga

SEQ ID NO: 3152 - DNA, 22 bp, Saccharomyces cerevisiae
tccaacaagacattgaaatcca

SEQ ID NO: 3153 - DNA, 26 bp, Saccharomyces cerevisiae
gctaaaccataacctatacaggactt

SEQ ID NO: 3154 - DNA, 25 bp, Saccharomyces cerevisiae
attgaattaagtaacatcattgttt

SEQ ID NO: 3155 - DNA, 25 bp, Saccharomyces cerevisiae
ttcgtttcgaaatctatatttttgt

SEQ ID NO: 3156 - DNA, 25 bp, Saccharomyces cerevisiae
tagcaagtatggtgctatttgtctg

SEQ ID NO: 3157 - DNA, 22 bp, Saccharomyces cerevisiae
gacgtttgatatggtccgtttt

SEQ ID NO: 3158 - DNA, 24 bp, Saccharomyces cerevisiae
tagatcaattgtgattccatgaac

SEQ ID NO: 3159 - DNA, 27 bp, Saccharomyces cerevisiae
cgttaataatatagttggatatgctca

SEQ ID NO: 3160 - DNA, 27 bp, Saccharomyces cerevisiae
aaataatccttctttcgtgttcttaat

SEQ ID NO: 3161 - DNA, 21 bp, Saccharomyces cerevisiae
cagtgaagaaagcctaaagca

SEQ ID NO: 3162 - DNA, 27 bp, Saccharomyces cerevisiae
ctagaggtatatactgagcatttggtt

SEQ ID NO: 3163 - DNA, 25 bp, Saccharomyces cerevisiae
ttcttagactaacagcgatagagcg

SEQ ID NO: 3164 - DNA, 23 bp, Saccharomyces cerevisiae
atgcatccacacactattttcag

SEQ ID NO: 3165 - DNA, 24 bp, Saccharomyces cerevisiae
gggaacatatgaatgagaaaatct

SEQ ID NO: 3166 - DNA, 20 bp, Saccharomyces cerevisiae
cgcttacgcagacatctcat

SEQ ID NO: 3167 - DNA, 24 bp, Saccharomyces cerevisiae
gagaatttatttctgctcggaatg

SEQ ID NO: 3168 - DNA, 26 bp, Saccharomyces cerevisiae
taacaaaacaggtaattccgtaatgc

SEQ ID NO: 3169 - DNA, 23 bp, Saccharomyces cerevisiae
cccttgatttattttcctctttg

SEQ ID NO: 3170 - DNA, 21 bp, Saccharomyces cerevisiae
agtgaccaataagattgacct

SEQ ID NO: 3171 - DNA, 20 bp, Saccharomyces cerevisiae
taagctggtgcaagtttccg

SEQ ID NO: 3172 - DNA, 19 bp, Saccharomyces cerevisiae
gcccaggatgagcactagg

SEQ ID NO: 3173 - DNA, 27 bp, Saccharomyces cerevisiae
taaacctgtataatataaccttgaaga

SEQ ID NO: 3174 - DNA, 25 bp, Saccharomyces cerevisiae
cgatataaacttatgctgaggtagg

SEQ ID NO: 3175 - DNA, 21 bp, Saccharomyces cerevisiae
gagcacatccactctcattcc

SEQ ID NO: 3176 - DNA, 27 bp, Saccharomyces cerevisiae
gattcttgaaatgtagtccgtaatttt

SEQ ID NO: 3177 - DNA, 20 bp, Saccharomyces cerevisiae
tcatgaaaccattgcgctct

SEQ ID NO: 3178 - DNA, 27 bp, Saccharomyces cerevisiae
acgcactgataaattttaagataaaga

SEQ ID NO: 3179 - DNA, 23 bp, Saccharomyces cerevisiae
acataatttgtgggctttcatca

SEQ ID NO: 3180 - DNA, 23 bp, Saccharomyces cerevisiae
taatggataaaggtattcttatg

SEQ ID NO: 3181 - DNA, 26 bp, Saccharomyces cerevisiae
tcaattgattaacgtgctaatgtaga

SEQ ID NO: 3182 - DNA, 27 bp, Saccharomyces cerevisiae
tctaatgttttcatcaagctacttaaa

SEQ ID NO: 3183 - DNA, 27 bp, Saccharomyces cerevisiae
ttgtatttatagttaatcacacacaat

SEQ ID NO: 3184 - DNA, 25 bp, Saccharomyces cerevisiae
ttaagcccgataacacattctattt

SEQ ID NO: 3185 - DNA, 27 bp, Saccharomyces cerevisiae
taagaacttttctgtatttcaggactt

SEQ ID NO: 3186 - DNA, 27 bp, Saccharomyces cerevisiae
agcattagatagacttagtgaatacat

SEQ ID NO: 3187 - DNA, 25 bp, Saccharomyces cerevisiae
gggactgttaatgaaaaattcaatg

SEQ ID NO: 3188 - DNA, 26 bp, Saccharomyces cerevisiae
tctctaaggagaagaaatccataact

SEQ ID NO: 3189 - DNA, 24 bp, Saccharomyces cerevisiae
catataagtaacgaccgtgcacat

SEQ ID NO: 3190 - DNA, 22 bp, Saccharomyces cerevisiae
gcgttttgctttacggtagaaa

SEQ ID NO: 3191 - DNA, 27 bp, Saccharomyces cerevisiae
aaatgagataatatataactatgcgga

SEQ ID NO: 3192 - DNA, 26 bp, Saccharomyces cerevisiae
tagtgctctaaaaatgtttcactctt

SEQ ID NO: 3193 - DNA, 24 bp, Saccharomyces cerevisiae
gatttctaagttccatgaaccaaa

SEQ ID NO: 3194 - DNA, 26 bp, Saccharomyces cerevisiae
ggtgctatgtaaacaaagaaaagaaa

SEQ ID NO: 3195 - DNA, 26 bp, Saccharomyces cerevisiae
gacttagaaaagtaacacatacgctc

SEQ ID NO: 3196 - DNA, 27 bp, Saccharomyces cerevisiae
agtgagcttaaaagagagaaaagaagc

SEQ ID NO: 3197 - DNA, 22 bp, Saccharomyces cerevisiae
gcgcatcaacaaaaactctatg

SEQ ID NO: 3198 - DNA, 26 bp, Saccharomyces cerevisiae
gacgaattgtaagaggaaagtatttg

SEQ ID NO: 3199 - DNA, 24 bp, Saccharomyces cerevisiae
agtaaagagcttgttttcttcgtg

SEQ ID NO: 3200 - DNA, 27 bp, Saccharomyces cerevisiae
agaattattattaacactttctctggc

SEQ ID NO: 3201 - DNA, 26 bp, Saccharomyces cerevisiae
ctcgtaaaaaaaagagaaggaaaaaa

SEQ ID NO: 3202 - DNA, 22 bp, Saccharomyces cerevisiae
aagcaggtagcaggttaatgat

SEQ ID NO: 3203 - DNA, 20 bp, Saccharomyces cerevisiae
ggcgagtagttcgccaagtt

SEQ ID NO: 3204 - DNA, 27 bp, Saccharomyces cerevisiae
aagtcattatgcattaaataactagaa

SEQ ID NO: 3205 - DNA, 26 bp, Saccharomyces cerevisiae
caaaattgaaatgaaagacaataagt

SEQ ID NO: 3206 - DNA, 20 bp, Saccharomyces cerevisiae
cgaccgccttaattcaaaat

SEQ ID NO: 3207 - DNA, 23 bp, Saccharomyces cerevisiae
gagttgttattgtttattgtttt

SEQ ID NO: 3208 - DNA, 22 bp, Saccharomyces cerevisiae
acagaagagagtgtgcgcaata

SEQ ID NO: 3209 - DNA, 24 bp, Saccharomyces cerevisiae
gaactagattaaacttgcgtgcat

SEQ ID NO: 3210 - DNA, 27 bp, Saccharomyces cerevisiae
tcatgagatggactttacgtaataaat

SEQ ID NO: 3211 - DNA, 20 bp, Saccharomyces cerevisiae
tcacctccagtttgcacata

SEQ ID NO: 3212 - DNA, 26 bp, Saccharomyces cerevisiae
ttatcggaatttgaagaactatgatg

SEQ ID NO: 3213 - DNA, 26 bp, Saccharomyces cerevisiae
tatacaggttctctaaaacaagcagc

SEQ ID NO: 3214 - DNA, 20 bp, Saccharomyces cerevisiae
gggacagcatctcccaaaag

SEQ ID NO: 3215 - DNA, 25 bp, Saccharomyces cerevisiae
aaattttgttgttttcattaggaga

SEQ ID NO: 3216 - DNA, 27 bp, Saccharomyces cerevisiae
atgtgtgtaatcttgcaatttagtttc

SEQ ID NO: 3217 - DNA, 22 bp, Saccharomyces cerevisiae
gctttggagtagaggcaagaaa

SEQ ID NO: 3218 - DNA, 27 bp, Saccharomyces cerevisiae
agatattaaatctagcgaagcatagag

SEQ ID NO: 3219 - DNA, 27 bp, Saccharomyces cerevisiae
agggagatgttatatatgctttatttg

SEQ ID NO: 3220 - DNA, 26 bp, Saccharomyces cerevisiae
atgattatttatatccttattcggtt

SEQ ID NO: 3221 - DNA, 23 bp, Saccharomyces cerevisiae
aaataacacatctttttctttag

SEQ ID NO: 3222 - DNA, 18 bp, Saccharomyces cerevisiae
gatcactgcacccggaac

SEQ ID NO: 3223 - DNA, 20 bp, Saccharomyces cerevisiae
cactcaaatcttcggcatgt

SEQ ID NO: 3224 - DNA, 23 bp, Saccharomyces cerevisiae
ttcttgtgtttcttctggttctc

SEQ ID NO: 3225 - DNA, 20 bp, Saccharomyces cerevisiae
ttgcttccgtttcccaattt

SEQ ID NO: 3226 - DNA, 25 bp, Saccharomyces cerevisiae
tttcttttgcattttatcttttccc

SEQ ID NO: 3227 - DNA, 23 bp, Saccharomyces cerevisiae
cattcacccacttttacgttttt

SEQ ID NO: 3228 - DNA, 20 bp, Saccharomyces cerevisiae
tagacgcgctctatatgttt

SEQ ID NO: 3229 - DNA, 24 bp, Saccharomyces cerevisiae
tctgcttattgtttctttgctatg

SEQ ID NO: 3230 - DNA, 26 bp, Saccharomyces cerevisiae
aggcctaaatagtactgttgatatac

SEQ ID NO: 3231 - DNA, 20 bp, Saccharomyces cerevisiae
gcccctcctccaatctctgt

SEQ ID NO: 3232 - DNA, 27 bp, Saccharomyces cerevisiae
ttatcacgaagagtcaatcaatctttt

SEQ ID NO: 3233 - DNA, 25 bp, Saccharomyces cerevisiae
gaattgaattgaaatcgatagatca

SEQ ID NO: 3234 - DNA, 24 bp, Saccharomyces cerevisiae
tttcagaggatcaatttttaatgc

SEQ ID NO: 3235 - DNA, 20 bp, Saccharomyces cerevisiae
gagcaacggctttcttttgt

SEQ ID NO: 3236 - DNA, 25 bp, Saccharomyces cerevisiae
cgaacttcatttccactctttactt

SEQ ID NO: 3237 - DNA, 22 bp, Saccharomyces cerevisiae
gttaattagtccgaggcctttt

SEQ ID NO: 3238 - DNA, 24 bp, Saccharomyces cerevisiae
catcctttttttttttttttttcc

SEQ ID NO: 3239 - DNA, 22 bp, Saccharomyces cerevisiae
tgttggtgctttacctgttagc

SEQ ID NO: 3240 - DNA, 23 bp, Saccharomyces cerevisiae
aaacggcgtacatacataaagaa

SEQ ID NO: 3241 - DNA, 20 bp, Saccharomyces cerevisiae
cgttcccaaaccattacatt

SEQ ID NO: 3242 - DNA, 27 bp, Saccharomyces cerevisiae
aaattcatgttcgacatatagatagca

SEQ ID NO: 3243 - DNA, 21 bp, Saccharomyces cerevisiae
tgacaccaaaccatagaacgc

SEQ ID NO: 3244 - DNA, 20 bp, Saccharomyces cerevisiae
gggggttctttttccacttt

SEQ ID NO: 3245 - DNA, 22 bp, Saccharomyces cerevisiae
ggcagaaaatgagaaggaaaaa

SEQ ID NO: 3246 - DNA, 25 bp, Saccharomyces cerevisiae
tcctgaaaatagctaaagcataaat

SEQ ID NO: 3247 - DNA, 22 bp, Saccharomyces cerevisiae
gctgtttaggcaacgatatgta

SEQ ID NO: 3248 - DNA, 25 bp, Saccharomyces cerevisiae
tttttattcttagattcctgattgc

SEQ ID NO: 3249 - DNA, 26 bp, Saccharomyces cerevisiae
taaaaagaaagtggaatattcattca

SEQ ID NO: 3250 - DNA, 25 bp, Saccharomyces cerevisiae
caatattcctttatgtctttcctgc

SEQ ID NO: 3251 - DNA, 18 bp, Saccharomyces cerevisiae
gagtgcggaactgcaaat

SEQ ID NO: 3252 - DNA, 21 bp, Saccharomyces cerevisiae
tgggtttaaagaatctgcgtt

SEQ ID NO: 3253 - DNA, 25 bp, Saccharomyces cerevisiae
aaaacatttcagcatacagtaaaca

SEQ ID NO: 3254 - DNA, 25 bp, Saccharomyces cerevisiae
taaaggaagatcatgtattttgcgg

SEQ ID NO: 3255 - DNA, 26 bp, Saccharomyces cerevisiae
aatgtatacgtacataacctgacgaa

SEQ ID NO: 3256 - DNA, 25 bp, Saccharomyces cerevisiae
gaaaggatgtagcgttcatgacagt

SEQ ID NO: 3257 - DNA, 26 bp, Saccharomyces cerevisiae
gtttaaagtaaatagaacaaatttcc

SEQ ID NO: 3258 - DNA, 24 bp, Saccharomyces cerevisiae
aatcaagtttacccctctttacct

SEQ ID NO: 3259 - DNA, 25 bp, Saccharomyces cerevisiae
ggttagggctcttctacatacttga

SEQ ID NO: 3260 - DNA, 26 bp, Saccharomyces cerevisiae
tatttctgctatgcttctatttttca

SEQ ID NO: 3261 - DNA, 20 bp, Saccharomyces cerevisiae
cgtcgtcactaagtttctaa

SEQ ID NO: 3262 - DNA, 24 bp, Saccharomyces cerevisiae
aattaggcttctcattctatttta

SEQ ID NO: 3263 - DNA, 25 bp, Saccharomyces cerevisiae
ggttgtttataacatcaaaaatcca

SEQ ID NO: 3264 - DNA, 25 bp, Saccharomyces cerevisiae
aagctcactgaaaaaaaaaaagaga

SEQ ID NO: 3265 - DNA, 26 bp, Saccharomyces cerevisiae
aacgttatattttccttcaaaaatga

SEQ ID NO: 3266 - DNA, 25 bp, Saccharomyces cerevisiae
aacgtaggatttatatagaaagtag

SEQ ID NO: 3267 - DNA, 25 bp, Saccharomyces cerevisiae
tccaagctatgagctacttcaattt

SEQ ID NO: 3268 - DNA, 26 bp, Saccharomyces cerevisiae
tcatagtaaataccacgataaaagca

SEQ ID NO: 3269 - DNA, 27 bp, Saccharomyces cerevisiae
ttgtactaagcataattacgtgttttc

SEQ ID NO: 3270 - DNA, 26 bp, Saccharomyces cerevisiae
taagtatcacgctaattgaagttttt

SEQ ID NO: 3271 - DNA, 21 bp, Saccharomyces cerevisiae
tacctgtagaaaatgcgctgt

SEQ ID NO: 3272 - DNA, 20 bp, Saccharomyces cerevisiae
gaaaacacgggcttgcttat

SEQ ID NO: 3273 - DNA, 27 bp, Saccharomyces cerevisiae
ctgagtatatataactgcaaagacccc

SEQ ID NO: 3274 - DNA, 25 bp, Saccharomyces cerevisiae
agagtagtaaatacacacttcgcgg

SEQ ID NO: 3275 - DNA, 24 bp, Saccharomyces cerevisiae
aggctgctttaaaaacaagaaaga

SEQ ID NO: 3276 - DNA, 22 bp, Saccharomyces cerevisiae
gcaattgaacacggaaatagaa

SEQ ID NO: 3277 - DNA, 19 bp, Saccharomyces cerevisiae
taatccgccatttttgacc

SEQ ID NO: 3278 - DNA, 23 bp, Saccharomyces cerevisiae
tggatcaacatttccatgatagg

SEQ ID NO: 3279 - DNA, 20 bp, Saccharomyces cerevisiae
gcacgaaccatgagcagaag

SEQ ID NO: 3280 - DNA, 26 bp, Saccharomyces cerevisiae
ctgtgagtccacggtactatattaaa

SEQ ID NO: 3281 - DNA, 22 bp, Saccharomyces cerevisiae
tgaaaacatagagcaaaagcaa

SEQ ID NO: 3282 - DNA, 20 bp, Saccharomyces cerevisiae
tcgttgacggccatatcagt

SEQ ID NO: 3283 - DNA, 18 bp, Saccharomyces cerevisiae
cccatcgattgcatcttg

SEQ ID NO: 3284 - DNA, 26 bp, Saccharomyces cerevisiae
aaaaaaaaggtgaagtattatgtaaa

SEQ ID NO: 3285 - DNA, 24 bp, Saccharomyces cerevisiae
tttttctgttaacttagtgaagta

SEQ ID NO: 3286 - DNA, 18 bp, Saccharomyces cerevisiae
tctatgcatggctggggg

SEQ ID NO: 3287 - DNA, 20 bp, Saccharomyces cerevisiae
ctggtggcataaaacatatc

SEQ ID NO: 3288 - DNA, 20 bp, Saccharomyces cerevisiae
ggttcatcggaagcattttt

SEQ ID NO: 3289 - DNA, 22 bp, Saccharomyces cerevisiae
atccactgctcattcacataca

SEQ ID NO: 3290 - DNA, 27 bp, Saccharomyces cerevisiae
aggtaagccatttatatagttgagaaa

SEQ ID NO: 3291 - DNA, 21 bp, Saccharomyces cerevisiae
taaattcgttcaagcataaaa

SEQ ID NO: 3292 - DNA, 20 bp, Saccharomyces cerevisiae
actctgtttagcacctggcg

SEQ ID NO: 3293 - DNA, 26 bp, Saccharomyces cerevisiae
tgatcctatctaactctccctctttt

SEQ ID NO: 3294 - DNA, 25 bp, Saccharomyces cerevisiae
tgtagaaaagagtttcttgtaacag

SEQ ID NO: 3295 - DNA, 25 bp, Saccharomyces cerevisiae
ttttgccacactctttttatttctt

SEQ ID NO: 3296 - DNA, 27 bp, Saccharomyces cerevisiae
tttgttaattgaattttacctaattgc

SEQ ID NO: 3297 - DNA, 18 bp, Saccharomyces cerevisiae
acaaaccggccacggtaa

SEQ ID NO: 3298 - DNA, 24 bp, Saccharomyces cerevisiae
gctcttgtgtctttgttatatggg

SEQ ID NO: 3299 - DNA, 22 bp, Saccharomyces cerevisiae
ataaaagaaagaggaaagccga

SEQ ID NO: 3300 - DNA, 27 bp, Saccharomyces cerevisiae
tttttcagcatagttatgtgattcttt

SEQ ID NO: 3301 - DNA, 27 bp, Saccharomyces cerevisiae
taatcaggttacttaaatcaatgactg

SEQ ID NO: 3302 - DNA, 20 bp, Saccharomyces cerevisiae
aggactgcgcacttagttca

SEQ ID NO: 3303 - DNA, 27 bp, Saccharomyces cerevisiae
atgggtgtttattttagtactttgttt

SEQ ID NO: 3304 - DNA, 26 bp, Saccharomyces cerevisiae
tgtacaataaaccaaatcttgcaact

SEQ ID NO: 3305 - DNA, 22 bp, Saccharomyces cerevisiae
aggcgttttcttccttacattt

SEQ ID NO: 3306 - DNA, 27 bp, Saccharomyces cerevisiae
ggtgagtaaataagtcattcgtaagtg

SEQ ID NO: 3307 - DNA, 23 bp, Saccharomyces cerevisiae
tctttttgatcactgctttcaca

SEQ ID NO: 3308 - DNA, 25 bp, Saccharomyces cerevisiae
ccatcgcccatattacaataataac

SEQ ID NO: 3309 - DNA, 24 bp, Saccharomyces cerevisiae
tgcgctggtattatagaaatagag

SEQ ID NO: 3310 - DNA, 26 bp, Saccharomyces cerevisiae
tgatctgttatacacacaaaatatcg

SEQ ID NO: 3311 - DNA, 26 bp, Saccharomyces cerevisiae
aaacaactcatataaatacgtacaaa

SEQ ID NO: 3312 - DNA, 24 bp, Saccharomyces cerevisiae
ccacgtataatgcatagctcttac

SEQ ID NO: 3313 - DNA, 24 bp, Saccharomyces cerevisiae
ctagttgtatagccattatagatt

SEQ ID NO: 3314 - DNA, 25 bp, Saccharomyces cerevisiae
tcataagcacgaaagttatcctctc

SEQ ID NO: 3315 - DNA, 27 bp, Saccharomyces cerevisiae
attcatgtatattttgttcaatctttc

SEQ ID NO: 3316 - DNA, 24 bp, Saccharomyces cerevisiae
ccgtactgatatacttcgcacttt

SEQ ID NO: 3317 - DNA, 25 bp, Saccharomyces cerevisiae
tagaacaactatgaattccttggat

SEQ ID NO: 3318 - DNA, 26 bp, Saccharomyces cerevisiae
gctttttatttgattttgtgacattt

SEQ ID NO: 3319 - DNA, 27 bp, Saccharomyces cerevisiae
ggtaagattatcagttatggataccaa

SEQ ID NO: 3320 - DNA, 25 bp, Saccharomyces cerevisiae
aagaagaattaaatatagcatatca

SEQ ID NO: 3321 - DNA, 22 bp, Saccharomyces cerevisiae
gaggaataatagcatatccgca

SEQ ID NO: 3322 - DNA, 27 bp, Saccharomyces cerevisiae
ttagcataaaattgttggttttatacg

SEQ ID NO: 3323 - DNA, 20 bp, Saccharomyces cerevisiae
gcggcgatgggtatatattg

SEQ ID NO: 3324 - DNA, 26 bp, Saccharomyces cerevisiae
ttttctttttcgtaaatgctctatca

SEQ ID NO: 3325 - DNA, 23 bp, Saccharomyces cerevisiae
atatactttgtaaattgtcatgt

SEQ ID NO: 3326 - DNA, 24 bp, Saccharomyces cerevisiae
tcatgaaatgaatttgtgatcaat

SEQ ID NO: 3327 - DNA, 23 bp, Saccharomyces cerevisiae
gcataaaacaaaaggaacaaaaa

SEQ ID NO: 3328 - DNA, 25 bp, Saccharomyces cerevisiae
tcagttccgtaccatacataaacta

SEQ ID NO: 3329 - DNA, 26 bp, Saccharomyces cerevisiae
aggttatatagtcatgcagtaatgtt

SEQ ID NO: 3330 - DNA, 27 bp, Saccharomyces cerevisiae
gtctaaaagaaagaaaagaggaaagtt

SEQ ID NO: 3331 - DNA, 25 bp, Saccharomyces cerevisiae
ccgcttgcatagactatagaatgtc

SEQ ID NO: 3332 - DNA, 27 bp, Saccharomyces cerevisiae
taccctttacctctatatattacgcac

SEQ ID NO: 3333 - DNA, 24 bp, Saccharomyces cerevisiae
aacaatctcaagtgaagtattggc

SEQ ID NO: 3334 - DNA, 27 bp, Saccharomyces cerevisiae
taggatgagtttcttactttttttctc

SEQ ID NO: 3335 - DNA, 20 bp, Saccharomyces cerevisiae
aacctacaatagacgcacgc

SEQ ID NO: 3336 - DNA, 22 bp, Saccharomyces cerevisiae
gaataaggtgcataaccgaaga

SEQ ID NO: 3337 - DNA, 27 bp, Saccharomyces cerevisiae
tcttgagtgaagaggatatgtttactt

SEQ ID NO: 3338 - DNA, 25 bp, Saccharomyces cerevisiae
ggtcaaagaaaatacacagtttgaa

SEQ ID NO: 3339 - DNA, 19 bp, Saccharomyces cerevisiae
ctatgacttcgaggcgagc

SEQ ID NO: 3340 - DNA, 27 bp, Saccharomyces cerevisiae
aggaagtgaaagaataagtgttatacg

SEQ ID NO: 3341 - DNA, 26 bp, Saccharomyces cerevisiae
atatacataagccgtggagatatcag

SEQ ID NO: 3342 - DNA, 27 bp, Saccharomyces cerevisiae
ttgatatttcacaatacaaagaaatgg

SEQ ID NO: 3343 - DNA, 22 bp, Saccharomyces cerevisiae
agcacttaaactgccctcatgt

SEQ ID NO: 3344 - DNA, 20 bp, Saccharomyces cerevisiae
gcgatcattttccctcctgt

SEQ ID NO: 3345 - DNA, 25 bp, Saccharomyces cerevisiae
tactaagtgcgttgttacgtttaag

SEQ ID NO: 3346 - DNA, 18 bp, Saccharomyces cerevisiae
tgagacggatgactcccc

SEQ ID NO: 3347 - DNA, 25 bp, Saccharomyces cerevisiae
aatattgagaagtgaagggagattg

SEQ ID NO: 3348 - DNA, 24 bp, Saccharomyces cerevisiae
tggttgccgctaatcatatgtaaa

SEQ ID NO: 3349 - DNA, 24 bp, Saccharomyces cerevisiae
aaataaaacaaataggaatgttga

SEQ ID NO: 3350 - DNA, 18 bp, Saccharomyces cerevisiae
tgatagcaccggagggag

SEQ ID NO: 3351 - DNA, 27 bp, Saccharomyces cerevisiae
gatgattgatcatgaattgtacttttt

SEQ ID NO: 3352 - DNA, 27 bp, Saccharomyces cerevisiae
catcactgtatgatctcattctttctg

SEQ ID NO: 3353 - DNA, 26 bp, Saccharomyces cerevisiae
aatcaatcaatttatatctgagaaag

SEQ ID NO: 3354 - DNA, 21 bp, Saccharomyces cerevisiae
gagaacccgcaaaagtattca

SEQ ID NO: 3355 - DNA, 26 bp, Saccharomyces cerevisiae
aagagaaggtaacaagcacataaaaa

SEQ ID NO: 3356 - DNA, 24 bp, Saccharomyces cerevisiae
aaatgatcctgctctcttgatatg

SEQ ID NO: 3357 - DNA, 26 bp, Saccharomyces cerevisiae
attaaactaagtaagcatgactcaaa

SEQ ID NO: 3358 - DNA, 22 bp, Saccharomyces cerevisiae
tgtccttaagagcacacgtttt

SEQ ID NO: 3359 - DNA, 25 bp, Saccharomyces cerevisiae
ttttaattatagaacatggtacttg

SEQ ID NO: 3360 - DNA, 21 bp, Saccharomyces cerevisiae
tagattcacatacccaccgct

SEQ ID NO: 3361 - DNA, 26 bp, Saccharomyces cerevisiae
accgagtaagctgctacataatgtct

SEQ ID NO: 3362 - DNA, 23 bp, Saccharomyces cerevisiae
tcatatcagcttgttcattgctc

SEQ ID NO: 3363 - DNA, 27 bp, Saccharomyces cerevisiae
gttgactatttacagctcatctcatag

SEQ ID NO: 3364 - DNA, 21 bp, Saccharomyces cerevisiae
agtaaacggcaacagtgtggt

SEQ ID NO: 3365 - DNA, 23 bp, Saccharomyces cerevisiae
aaaaacatgctaacaggtcatgc

SEQ ID NO: 3366 - DNA, 22 bp, Saccharomyces cerevisiae
tcaatatgcgcgcttgataaac

SEQ ID NO: 3367 - DNA, 26 bp, Saccharomyces cerevisiae
acagaattgattatagttgcaaaaag

SEQ ID NO: 3368 - DNA, 20 bp, Saccharomyces cerevisiae
ttttcttcaaaagcgggact

SEQ ID NO: 3369 - DNA, 25 bp, Saccharomyces cerevisiae
ccttgaaaatacattgctaagagat

SEQ ID NO: 3370 - DNA, 23 bp, Saccharomyces cerevisiae
taatattgacgaacatatgtaaa

SEQ ID NO: 3371 - DNA, 27 bp, Saccharomyces cerevisiae
ttttatcaatatttcgatacagttttg

SEQ ID NO: 3372 - DNA, 27 bp, Saccharomyces cerevisiae
tatattacgtcatctgacatacgacac

SEQ ID NO: 3373 - DNA, 27 bp, Saccharomyces cerevisiae
taaactttaatttgtgaattttccttg

SEQ ID NO: 3374 - DNA, 22 bp, Saccharomyces cerevisiae
agtctgcgccaaataacataaa

SEQ ID NO: 3375 - DNA, 27 bp, Saccharomyces cerevisiae
atagaaatgcatatcattcttcaatta

SEQ ID NO: 3376 - DNA, 24 bp, Saccharomyces cerevisiae
tatcctgagtcactccttaaacct

SEQ ID NO: 3377 - DNA, 25 bp, Saccharomyces cerevisiae
ttataataattccttattttccctt

SEQ ID NO: 3378 - DNA, 23 bp, Saccharomyces cerevisiae
ataacgcttggataaaacgaagt

SEQ ID NO: 3379 - DNA, 26 bp, Saccharomyces cerevisiae
tttaggtttgagagctggtagtatcg

SEQ ID NO: 3380 - DNA, 25 bp, Saccharomyces cerevisiae
aacatgacacctccataacgtttac

SEQ ID NO: 3381 - DNA, 20 bp, Saccharomyces cerevisiae
tcagtgaatagcgttccgtt

SEQ ID NO: 3382 - DNA, 26 bp, Saccharomyces cerevisiae
aaaagttaccttgttcgtagaatcac

SEQ ID NO: 3383 - DNA, 26 bp, Saccharomyces cerevisiae
tcatccaaataatatccttgattaga

SEQ ID NO: 3384 - DNA, 23 bp, Saccharomyces cerevisiae
gacgtgttgtaacagagtaatca

SEQ ID NO: 3385 - DNA, 23 bp, Saccharomyces cerevisiae
aagaaactgctacatttattttt

SEQ ID NO: 3386 - DNA, 20 bp, Saccharomyces cerevisiae
ctcacgattgccagttgttt

SEQ ID NO: 3387 - DNA, 20 bp, Saccharomyces cerevisiae
tggtttggtgcaagaaattg

SEQ ID NO: 3388 - DNA, 26 bp, Saccharomyces cerevisiae
atttttgtataatttcatcatggagg

SEQ ID NO: 3389 - DNA, 23 bp, Saccharomyces cerevisiae
tgcctcctatatttagccttttt

SEQ ID NO: 3390 - DNA, 22 bp, Saccharomyces cerevisiae
caacgcgtcaataatataggct

SEQ ID NO: 3391 - DNA, 25 bp, Saccharomyces cerevisiae
gtgaatttactttaaatcttgcatt

SEQ ID NO: 3392 - DNA, 22 bp, Saccharomyces cerevisiae
ttatgagaaccagccgttacaa

SEQ ID NO: 3393 - DNA, 20 bp, Saccharomyces cerevisiae
cgggccttgaaatttcttta

SEQ ID NO: 3394 - DNA, 25 bp, Saccharomyces cerevisiae
ataaataaaaatatagtaaaaaagt

SEQ ID NO: 3395 - DNA, 24 bp, Saccharomyces cerevisiae
gctttgtaagcatggtttaccttt

SEQ ID NO: 3396 - DNA, 23 bp, Saccharomyces cerevisiae
taaaatacttccccgctatttgt

SEQ ID NO: 3397 - DNA, 21 bp, Saccharomyces cerevisiae
atttgccgtcagaaactgttc

SEQ ID NO: 3398 - DNA, 22 bp, Saccharomyces cerevisiae
acggagccaaaattagaagaaa

SEQ ID NO: 3399 - DNA, 27 bp, Saccharomyces cerevisiae
tgcgtttaattaacttactgtcttttt

SEQ ID NO: 3400 - DNA, 18 bp, Saccharomyces cerevisiae
accaccctgagctgatgc

SEQ ID NO: 3401 - DNA, 24 bp, Saccharomyces cerevisiae
tttttccctccttttctttatttc

SEQ ID NO: 3402 - DNA, 27 bp, Saccharomyces cerevisiae
attttttcgttttttatttttttttga

SEQ ID NO: 3403 - DNA, 23 bp, Saccharomyces cerevisiae
cccatatggagacagaaagtaaa

SEQ ID NO: 3404 - DNA, 27 bp, Saccharomyces cerevisiae
aataatatgaaaaaaaaaaaaaaaaaa

SEQ ID NO: 3405 - DNA, 25 bp, Saccharomyces cerevisiae
ttttccctacggagtactaccattt

SEQ ID NO: 3406 - DNA, 22 bp, Saccharomyces cerevisiae
ggcagcttctgaatcactaaag

SEQ ID NO: 3407 - DNA, 25 bp, Saccharomyces cerevisiae
gaaggttggtaaaaatttgtgtttt

SEQ ID NO: 3408 - DNA, 27 bp, Saccharomyces cerevisiae
aaaagaaagcaaatatagaaagcaaca

SEQ ID NO: 3409 - DNA, 27 bp, Saccharomyces cerevisiae
tattttggtaaagtccctagaagttag

SEQ ID NO: 3410 - DNA, 24 bp, Saccharomyces cerevisiae
cccttcaacttatatagcaccttt

SEQ ID NO: 3411 - DNA, 23 bp, Saccharomyces cerevisiae
ttcagttaatatcagaacaattt

SEQ ID NO: 3412 - DNA, 27 bp, Saccharomyces cerevisiae
actgagagttattcttcttcttctccc

SEQ ID NO: 3413 - DNA, 27 bp, Saccharomyces cerevisiae
catatatgataatttaactgtattttt

SEQ ID NO: 3414 - DNA, 24 bp, Saccharomyces cerevisiae
ttaagttgctttcctttctttttc

SEQ ID NO: 3415 - DNA, 20 bp, Saccharomyces cerevisiae
acggggattcttctttttgc

SEQ ID NO: 3416 - DNA, 22 bp, Saccharomyces cerevisiae
tgaataagcgcagagaaatcta

SEQ ID NO: 3417 - DNA, 24 bp, Saccharomyces cerevisiae
gcatttctccatggttacaataaa

SEQ ID NO: 3418 - DNA, 20 bp, Saccharomyces cerevisiae
cctgtttccaatgctcgtta

SEQ ID NO: 3419 - DNA, 23 bp, Saccharomyces cerevisiae
tttacatagtttacatttttacg

SEQ ID NO: 3420 - DNA, 26 bp, Saccharomyces cerevisiae
acatatttttgtatattttattgttg

SEQ ID NO: 3421 - DNA, 25 bp, Saccharomyces cerevisiae
cttcgtgaagattcgtgtagtatga

SEQ ID NO: 3422 - DNA, 25 bp, Saccharomyces cerevisiae
tgttgaaaacaggaaataataaaca

SEQ ID NO: 3423 - DNA, 26 bp, Saccharomyces cerevisiae
tgaatacaagccattgaattactatc

SEQ ID NO: 3424 - DNA, 26 bp, Saccharomyces cerevisiae
atgacgtaagatatatacgcagtctc

SEQ ID NO: 3425 - DNA, 27 bp, Saccharomyces cerevisiae
agatgatttatatcagcatatacctac

SEQ ID NO: 3426 - DNA, 26 bp, Saccharomyces cerevisiae
tatctcacccaaataatttcatacat

SEQ ID NO: 3427 - DNA, 27 bp, Saccharomyces cerevisiae
agcatataataggaaaatagaaacgaa

SEQ ID NO: 3428 - DNA, 21 bp, Saccharomyces cerevisiae
atgaagtctagcacagggtgg

SEQ ID NO: 3429 - DNA, 26 bp, Saccharomyces cerevisiae
tagatagcatctcttgatcctaagaa

SEQ ID NO: 3430 - DNA, 27 bp, Saccharomyces cerevisiae
acaatcaagtatttttctattcactgc

SEQ ID NO: 3431 - DNA, 27 bp, Saccharomyces cerevisiae
gattagaggagacgttactttgtttat

SEQ ID NO: 3432 - DNA, 27 bp, Saccharomyces cerevisiae
gtatacttcttttttttactttgttca

SEQ ID NO: 3433 - DNA, 23 bp, Saccharomyces cerevisiae
ttaatgcctcctttacctaacct

SEQ ID NO: 3434 - DNA, 23 bp, Saccharomyces cerevisiae
gtgcaaaaatgaaatttgaagaa

SEQ ID NO: 3435 - DNA, 19 bp, Saccharomyces cerevisiae
gcgatcactagcaagccaa

SEQ ID NO: 3436 - DNA, 23 bp, Saccharomyces cerevisiae
acacaccatcaggatcaatttac

SEQ ID NO: 3437 - DNA, 27 bp, Saccharomyces cerevisiae
aatgacacatataaaacagagtgaaga

SEQ ID NO: 3438 - DNA, 20 bp, Saccharomyces cerevisiae
tgatgacaaaactttcacgg

SEQ ID NO: 3439 - DNA, 24 bp, Saccharomyces cerevisiae
atactcatatatttgaaagaaaca

SEQ ID NO: 3440 - DNA, 26 bp, Saccharomyces cerevisiae
gcttgaacttttgtacttagttatta

SEQ ID NO: 3441 - DNA, 27 bp, Saccharomyces cerevisiae
taattttgtggatcttttactcttttc

SEQ ID NO: 3442 - DNA, 27 bp, Saccharomyces cerevisiae
gaaatatacaaacacatatatactaac

SEQ ID NO: 3443 - DNA, 25 bp, Saccharomyces cerevisiae
aagtatcgttaaacaaagcttttca

SEQ ID NO: 3444 - DNA, 22 bp, Saccharomyces cerevisiae
gatcccgctctcacctagtaca

SEQ ID NO: 3445 - DNA, 24 bp, Saccharomyces cerevisiae
aagtgcttttaaaatttacttcat

SEQ ID NO: 3446 - DNA, 26 bp, Saccharomyces cerevisiae
tgtgaataaacgtatcttaaggagaa

SEQ ID NO: 3447 - DNA, 26 bp, Saccharomyces cerevisiae
gccttcaacacactattctaataaca

SEQ ID NO: 3448 - DNA, 22 bp, Saccharomyces cerevisiae
tctacccaatagcttctttgaa

SEQ ID NO: 3449 - DNA, 27 bp, Saccharomyces cerevisiae
taaacattaaatacattacacgtagcc

SEQ ID NO: 3450 - DNA, 26 bp, Saccharomyces cerevisiae
cgctcttgaaaaattctaaataagat

SEQ ID NO: 3451 - DNA, 19 bp, Saccharomyces cerevisiae
tgaacccgatgcaaatgag

SEQ ID NO: 3452 - DNA, 27 bp, Saccharomyces cerevisiae
attgaatagtgatgttatgaccttttt

SEQ ID NO: 3453 - DNA, 24 bp, Saccharomyces cerevisiae
gaaaaggactaacttttcatctaa

SEQ ID NO: 3454 - DNA, 27 bp, Saccharomyces cerevisiae
attctcttattatatattattctcgga

SEQ ID NO: 3455 - DNA, 26 bp, Saccharomyces cerevisiae
ttatgatcgaatagtctttaactaga

SEQ ID NO: 3456 - DNA, 18 bp, Saccharomyces cerevisiae
cggcgttggagcctaatc

SEQ ID NO: 3457 - DNA, 23 bp, Saccharomyces cerevisiae
ttaatggatgccttcaatgagtt

SEQ ID NO: 3458 - DNA, 25 bp, Saccharomyces cerevisiae
ttcgggttttaatttaagtgttttt

SEQ ID NO: 3459 - DNA, 26 bp, Saccharomyces cerevisiae
acagcttaatcaaaataaatcaacaa

SEQ ID NO: 3460 - DNA, 25 bp, Saccharomyces cerevisiae
taggactcttaacaatgcctaaaaa

SEQ ID NO: 3461 - DNA, 22 bp, Saccharomyces cerevisiae
tgaaaaccattcgttctttctg

SEQ ID NO: 3462 - DNA, 18 bp, Saccharomyces cerevisiae
cgagatagcgacggggtt

SEQ ID NO: 3463 - DNA, 26 bp, Saccharomyces cerevisiae
tcaaatttatattatttagtcgtaca

SEQ ID NO: 3464 - DNA, 26 bp, Saccharomyces cerevisiae
aggttataaaacttattgtctttttt

SEQ ID NO: 3465 - DNA, 27 bp, Saccharomyces cerevisiae
tggacctaaggaaagacataatattgg

SEQ ID NO: 3466 - DNA, 20 bp, Saccharomyces cerevisiae
gtttaggccattggcagtta

SEQ ID NO: 3467 - DNA, 24 bp, Saccharomyces cerevisiae
aaaaatctgcctttctagtcatcc

SEQ ID NO: 3468 - DNA, 24 bp, Saccharomyces cerevisiae
ttgtacatatgcggcatttcttat

SEQ ID NO: 3469 - DNA, 26 bp, Saccharomyces cerevisiae
tatctcagtataatcatttgtacgtt

SEQ ID NO: 3470 - DNA, 27 bp, Saccharomyces cerevisiae
cttacctttcataatgtattatcaccc

SEQ ID NO: 3471 - DNA, 20 bp, Saccharomyces cerevisiae
taggaatacaaaagccgctg

SEQ ID NO: 3472 - DNA, 27 bp, Saccharomyces cerevisiae
gagaagaaacatacttcaaaaaaaaaa

SEQ ID NO: 3473 - DNA, 26 bp, Saccharomyces cerevisiae
tacaattccaacatgttcgtttcttc

SEQ ID NO: 3474 - DNA, 26 bp, Saccharomyces cerevisiae
taactttcatcaagctcaacttttat

SEQ ID NO: 3475 - DNA, 21 bp, Saccharomyces cerevisiae
cgataaataaaaggcgtgtca

SEQ ID NO: 3476 - DNA, 19 bp, Saccharomyces cerevisiae
cacgccttttttatgcgag

SEQ ID NO: 3477 - DNA, 18 bp, Saccharomyces cerevisiae
aaagcaactgtccccgct

SEQ ID NO: 3478 - DNA, 23 bp, Saccharomyces cerevisiae
taacatacatagccaaaggagga

SEQ ID NO: 3479 - DNA, 23 bp, Saccharomyces cerevisiae
caatttcgtttactgaaaatgct

SEQ ID NO: 3480 - DNA, 20 bp, Saccharomyces cerevisiae
tgatgcacgtgacacttgag

SEQ ID NO: 3481 - DNA, 19 bp, Saccharomyces cerevisiae
tggctcttcgttggcctat

SEQ ID NO: 3482 - DNA, 20 bp, Saccharomyces cerevisiae
cctttcccagagaataagca

SEQ ID NO: 3483 - DNA, 24 bp, Saccharomyces cerevisiae
gaaaaataaggaatgatcggagtg

SEQ ID NO: 3484 - DNA, 25 bp, Saccharomyces cerevisiae
actatttttattaagagggaaaaaa

SEQ ID NO: 3485 - DNA, 24 bp, Saccharomyces cerevisiae
agatagaaacaaaacccctcaaga

SEQ ID NO: 3486 - DNA, 26 bp, Saccharomyces cerevisiae
atttactatgtaagaaaaaagtaatg

SEQ ID NO: 3487 - DNA, 25 bp, Saccharomyces cerevisiae
aaaaccttgttttatttacatactt

SEQ ID NO: 3488 - DNA, 26 bp, Saccharomyces cerevisiae
aaacttctaatattttcttacacaca

SEQ ID NO: 3489 - DNA, 27 bp, Saccharomyces cerevisiae
ctataagttttgttctttcctaaaacg

SEQ ID NO: 3490 - DNA, 20 bp, Saccharomyces cerevisiae
tgcaatgatacgcttttgct

SEQ ID NO: 3491 - DNA, 27 bp, Saccharomyces cerevisiae
tgatatactcaagcagactatgatttt

SEQ ID NO: 3492 - DNA, 24 bp, Saccharomyces cerevisiae
gaaaaatgaaactgtgcttgataa

SEQ ID NO: 3493 - DNA, 26 bp, Saccharomyces cerevisiae
gaacagttatagcgataaagatttgc

SEQ ID NO: 3494 - DNA, 20 bp, Saccharomyces cerevisiae
ctttacgccatcgcatatca

SEQ ID NO: 3495 - DNA, 19 bp, Saccharomyces cerevisiae
tgagccaatcaagccaaaa

SEQ ID NO: 3496 - DNA, 27 bp, Saccharomyces cerevisiae
gctacgtgactactacttttccttttt

SEQ ID NO: 3497 - DNA, 26 bp, Saccharomyces cerevisiae
atgtagaagcaagagtacaattcagg

SEQ ID NO: 3498 - DNA, 27 bp, Saccharomyces cerevisiae
gtagacgaggaaaataaaattgtttcg

SEQ ID NO: 3499 - DNA, 22 bp, Saccharomyces cerevisiae
ccattttctcatcaagcctaca

SEQ ID NO: 3500 - DNA, 27 bp, Saccharomyces cerevisiae
taatgattatatgtaaaatttgccgtt

SEQ ID NO: 3501 - DNA, 27 bp, Saccharomyces cerevisiae
catttgtttttgaatatatgtatagga

SEQ ID NO: 3502 - DNA, 20 bp, Saccharomyces cerevisiae
acaaattgtatggtggcagg

SEQ ID NO: 3503 - DNA, 26 bp, Saccharomyces cerevisiae
ataattaatcgtaggataggttacat

SEQ ID NO: 3504 - DNA, 23 bp, Saccharomyces cerevisiae
cgaattcgcatttctttattatg

SEQ ID NO: 3505 - DNA, 27 bp, Saccharomyces cerevisiae
tatactactatttaagctctttgtatg

SEQ ID NO: 3506 - DNA, 27 bp, Saccharomyces cerevisiae
ttctagatatattgagaggtgaagttt

SEQ ID NO: 3507 - DNA, 26 bp, Saccharomyces cerevisiae
ttatcactaaaagtgaggaagaatgc

SEQ ID NO: 3508 - DNA, 27 bp, Saccharomyces cerevisiae
tctatatacgtaatatttttcagaatc

SEQ ID NO: 3509 - DNA, 25 bp, Saccharomyces cerevisiae
tctcttttttcgccttcatgtttta

SEQ ID NO: 3510 - DNA, 27 bp, Saccharomyces cerevisiae
gtagatatcaaagaattacgtcatcaa

SEQ ID NO: 3511 - DNA, 23 bp, Saccharomyces cerevisiae
gttcaaagaggagaacgtttgaa

SEQ ID NO: 3512 - DNA, 27 bp, Saccharomyces cerevisiae
ttctaatagataatagtaatcggtttt

SEQ ID NO: 3513 - DNA, 26 bp, Saccharomyces cerevisiae
tgagtaatatctgataaggaacgctt

SEQ ID NO: 3514 - DNA, 20 bp, Saccharomyces cerevisiae
ggattcttataagggcgcat

SEQ ID NO: 3515 - DNA, 22 bp, Saccharomyces cerevisiae
agggacttttgctaaatcgcag

SEQ ID NO: 3516 - DNA, 19 bp, Saccharomyces cerevisiae
cgctacctccagcagattt

SEQ ID NO: 3517 - DNA, 26 bp, Saccharomyces cerevisiae
aatgcaaatagctagagtagccatga

SEQ ID NO: 3518 - DNA, 27 bp, Saccharomyces cerevisiae
aaaatctattgcagtacttagtttggc

SEQ ID NO: 3519 - DNA, 27 bp, Saccharomyces cerevisiae
acgataaaagtttttcatgtgtacagt

SEQ ID NO: 3520 - DNA, 20 bp, Saccharomyces cerevisiae
aagctgaagcatggacgaat

SEQ ID NO: 3521 - DNA, 27 bp, Saccharomyces cerevisiae
tagtattgctttaagcctctaaactgc

SEQ ID NO: 3522 - DNA, 24 bp, Saccharomyces cerevisiae
acttttttttgagcgaactttttt

SEQ ID NO: 3523 - DNA, 26 bp, Saccharomyces cerevisiae
cttgaacagttgtactaaggcagttt

SEQ ID NO: 3524 - DNA, 24 bp, Saccharomyces cerevisiae
aaataaacacaaggctttcatgtg

SEQ ID NO: 3525 - DNA, 25 bp, Saccharomyces cerevisiae
ggtaaatgaaattaatcataaatca

SEQ ID NO: 3526 - DNA, 24 bp, Saccharomyces cerevisiae
gcttatatccttttcaacattgcc

SEQ ID NO: 3527 - DNA, 22 bp, Saccharomyces cerevisiae
gtagttacgaaacgtttggcgg

SEQ ID NO: 3528 - DNA, 20 bp, Saccharomyces cerevisiae
tgggcttttagggacagttc

SEQ ID NO: 3529 - DNA, 19 bp, Saccharomyces cerevisiae
tgagggggaaattttgcat

SEQ ID NO: 3530 - DNA, 27 bp, Saccharomyces cerevisiae
gaatatgttatctttgaagtgtggttg

SEQ ID NO: 3531 - DNA, 24 bp, Saccharomyces cerevisiae
gaacagaacacaaaaggaacactt

SEQ ID NO: 3532 - DNA, 26 bp, Saccharomyces cerevisiae
gcataaatatacaaaaacagaaacgg

SEQ ID NO: 3533 - DNA, 25 bp, Saccharomyces cerevisiae
gcatgaaaaaggtattcatattgtg

SEQ ID NO: 3534 - DNA, 25 bp, Saccharomyces cerevisiae
aggcatatgtagtgaagtgaacata

SEQ ID NO: 3535 - DNA, 24 bp, Saccharomyces cerevisiae
acacaaatttaactacttcccgtc

SEQ ID NO: 3536 - DNA, 21 bp, Saccharomyces cerevisiae
gaaggatccgttataaaccgc

SEQ ID NO: 3537 - DNA, 27 bp, Saccharomyces cerevisiae
agagctcatttattctcaatgtgagtc

SEQ ID NO: 3538 - DNA, 23 bp, Saccharomyces cerevisiae
ctggagtaattctcgtgatcttg

SEQ ID NO: 3539 - DNA, 21 bp, Saccharomyces cerevisiae
cattagcgcctcctgtgagaa

SEQ ID NO: 3540 - DNA, 25 bp, Saccharomyces cerevisiae
ggggaaaagaaaagaataataatgt

SEQ ID NO: 3541 - DNA, 22 bp, Saccharomyces cerevisiae
cgtttttatggtacgcattcta

SEQ ID NO: 3542 - DNA, 18 bp, Saccharomyces cerevisiae
tttccagcggcatatcgt

SEQ ID NO: 3543 - DNA, 22 bp, Saccharomyces cerevisiae
cattgcataggtgtccatgtag

SEQ ID NO: 3544 - DNA, 26 bp, Saccharomyces cerevisiae
gcgtgagcattatatagaacaagtat

SEQ ID NO: 3545 - DNA, 24 bp, Saccharomyces cerevisiae
cgggttaatgcttaaatttattgt

SEQ ID NO: 3546 - DNA, 26 bp, Saccharomyces cerevisiae
gtacattattttcattctccgacaga

SEQ ID NO: 3547 - DNA, 19 bp, Saccharomyces cerevisiae
tgaagagggaaacgggatg

SEQ ID NO: 3548 - DNA, 24 bp, Saccharomyces cerevisiae
gacatttaatttaacggatgatga

SEQ ID NO: 3549 - DNA, 26 bp, Saccharomyces cerevisiae
ttgaaatattaaaaccgacaatttac

SEQ ID NO: 3550 - DNA, 26 bp, Saccharomyces cerevisiae
atgatcgtgattatacaccgttattt

SEQ ID NO: 3551 - DNA, 24 bp, Saccharomyces cerevisiae
gaatatgaatgaatagacacatcg

SEQ ID NO: 3552 - DNA, 19 bp, Saccharomyces cerevisiae
tactaaagggccccgttcc

SEQ ID NO: 3553 - DNA, 18 bp, Saccharomyces cerevisiae
ggcttccaattggccctt

SEQ ID NO: 3554 - DNA, 25 bp, Saccharomyces cerevisiae
atattatgtacgtatgtatgtgtgc

SEQ ID NO: 3555 - DNA, 23 bp, Saccharomyces cerevisiae
aaggtttaaagcagtcaatgaaa

SEQ ID NO: 3556 - DNA, 20 bp, Saccharomyces cerevisiae
gaggcatcgcatttcattat

SEQ ID NO: 3557 - DNA, 23 bp, Saccharomyces cerevisiae
attcaggcataacgttttctttt

SEQ ID NO: 3558 - DNA, 27 bp, Saccharomyces cerevisiae
taggtaatgctcaattttatatacgca

SEQ ID NO: 3559 - DNA, 26 bp, Saccharomyces cerevisiae
cttcatcaaagaatttttcatccaca

SEQ ID NO: 3560 - DNA, 22 bp, Saccharomyces cerevisiae
tttttgagctttttctttcccc

SEQ ID NO: 3561 - DNA, 23 bp, Saccharomyces cerevisiae
tattagaagcccatgtctctcaa

SEQ ID NO: 3562 - DNA, 27 bp, Saccharomyces cerevisiae
aaaatggagtgaaaactaaagtgagtc

SEQ ID NO: 3563 - DNA, 25 bp, Saccharomyces cerevisiae
acatagtgtttaaagattacggata

SEQ ID NO: 3564 - DNA, 25 bp, Saccharomyces cerevisiae
ttaatgtcttaaaaactgtaatatc

SEQ ID NO: 3565 - DNA, 25 bp, Saccharomyces cerevisiae
tttgaactaatataatgcgatggtg

SEQ ID NO: 3566 - DNA, 18 bp, Saccharomyces cerevisiae
cagatggcgacgttatgc

SEQ ID NO: 3567 - DNA, 20 bp, Saccharomyces cerevisiae
gcggatatcagccagaacat

SEQ ID NO: 3568 - DNA, 18 bp, Saccharomyces cerevisiae
ttctagcgcggcgtcttc

SEQ ID NO: 3569 - DNA, 23 bp, Saccharomyces cerevisiae
actatttacaacgtaatgatttt

SEQ ID NO: 3570 - DNA, 20 bp, Saccharomyces cerevisiae
ggcaaaatatgagcggatag

SEQ ID NO: 3571 - DNA, 26 bp, Saccharomyces cerevisiae
cttattgattaatgcgtagaagaagc

SEQ ID NO: 3572 - DNA, 24 bp, Saccharomyces cerevisiae
tgagcgctctgagtatatttaatg

SEQ ID NO: 3573 - DNA, 21 bp, Saccharomyces cerevisiae
aatgatgcataagccctttgt

SEQ ID NO: 3574 - DNA, 21 bp, Saccharomyces cerevisiae
tgagcagacgacagattttca

SEQ ID NO: 3575 - DNA, 25 bp, Saccharomyces cerevisiae
gcaccaaatttagttgtttactttg

SEQ ID NO: 3576 - DNA, 26 bp, Saccharomyces cerevisiae
ataagcattccttttataattactct

SEQ ID NO: 3577 - DNA, 27 bp, Saccharomyces cerevisiae
ataaaacaaggaataatttccacatag

SEQ ID NO: 3578 - DNA, 27 bp, Saccharomyces cerevisiae
acattttaaatattgttatctgccctc

SEQ ID NO: 3579 - DNA, 26 bp, Saccharomyces cerevisiae
atataacataagctttacgagctgaa

SEQ ID NO: 3580 - DNA, 22 bp, Saccharomyces cerevisiae
taccgttaagaaaatttcaaga

SEQ ID NO: 3581 - DNA, 25 bp, Saccharomyces cerevisiae
aaatagaaagccagtatatgcacac

SEQ ID NO: 3582 - DNA, 24 bp, Saccharomyces cerevisiae
atataatcaccccaaaaagaaaaa

SEQ ID NO: 3583 - DNA, 27 bp, Saccharomyces cerevisiae
atcattttataaataagaactccgaga

SEQ ID NO: 3584 - DNA, 23 bp, Saccharomyces cerevisiae
gactagctgtttcgatgctaaag

SEQ ID NO: 3585 - DNA, 21 bp, Saccharomyces cerevisiae
ttatgttgcataagcgcaact

SEQ ID NO: 3586 - DNA, 27 bp, Saccharomyces cerevisiae
atttagtaggttgaatgaactgagatt

SEQ ID NO: 3587 - DNA, 27 bp, Saccharomyces cerevisiae
tactgtatattttaaaccaatgcactc

SEQ ID NO: 3588 - DNA, 22 bp, Saccharomyces cerevisiae
gttgctaaatgaatacacagcg

SEQ ID NO: 3589 - DNA, 27 bp, Saccharomyces cerevisiae
aaatattgaataaaaagaagaggggaa

SEQ ID NO: 3590 - DNA, 26 bp, Saccharomyces cerevisiae
aaaaaaaaaaactttacttagatatg

SEQ ID NO: 3591 - DNA, 27 bp, Saccharomyces cerevisiae
catgtacaaataatatgtttattaccc

SEQ ID NO: 3592 - DNA, 25 bp, Saccharomyces cerevisiae
agcatttctttttggttcttagtca

SEQ ID NO: 3593 - DNA, 24 bp, Saccharomyces cerevisiae
gaattatgcagtctatcctcatgg

SEQ ID NO: 3594 - DNA, 24 bp, Saccharomyces cerevisiae
catcgtaaatacaagacacacacg

SEQ ID NO: 3595 - DNA, 24 bp, Saccharomyces cerevisiae
tttcacactgtagataagaagggg

SEQ ID NO: 3596 - DNA, 26 bp, Saccharomyces cerevisiae
cataactaattggtaactagggttca

SEQ ID NO: 3597 - DNA, 22 bp, Saccharomyces cerevisiae
tcgaggcaatctgatctaagtt

SEQ ID NO: 3598 - DNA, 26 bp, Saccharomyces cerevisiae
tatatttaatagtatgtagtagtagt

SEQ ID NO: 3599 - DNA, 24 bp, Saccharomyces cerevisiae
tctccaagttaaccacatactatt

SEQ ID NO: 3600 - DNA, 27 bp, Saccharomyces cerevisiae
cagtgaacatatagtataacaaatcaa

SEQ ID NO: 3601 - DNA, 26 bp, Saccharomyces cerevisiae
ggtaaatagagaaataaaagaacaga

SEQ ID NO: 3602 - DNA, 25 bp, Saccharomyces cerevisiae
aacgtataatcgacgcaaatatgta

SEQ ID NO: 3603 - DNA, 25 bp, Saccharomyces cerevisiae
agatagatttgaactttattgatcc

SEQ ID NO: 3604 - DNA, 23 bp, Saccharomyces cerevisiae
ttttaatgtattgaaaatcactt

SEQ ID NO: 3605 - DNA, 24 bp, Saccharomyces cerevisiae
tgatattatcgattttctttagca

SEQ ID NO: 3606 - DNA, 27 bp, Saccharomyces cerevisiae
tattagagattgattcatagagtccga

SEQ ID NO: 3607 - DNA, 23 bp, Saccharomyces cerevisiae
ccgctatgttaaaaacagttacg

SEQ ID NO: 3608 - DNA, 25 bp, Saccharomyces cerevisiae
aagttcaaaggtaataaatgagcaa

SEQ ID NO: 3609 - DNA, 26 bp, Saccharomyces cerevisiae
ttatttagtaatatacaatagtggca

SEQ ID NO: 3610 - DNA, 20 bp, Saccharomyces cerevisiae
tagccgccctgttcttgtct

SEQ ID NO: 3611 - DNA, 19 bp, Saccharomyces cerevisiae
acggtggtgtttgacacat

SEQ ID NO: 3612 - DNA, 27 bp, Saccharomyces cerevisiae
atggaggagatattcatagtgtctttt

SEQ ID NO: 3613 - DNA, 27 bp, Saccharomyces cerevisiae
agatgaattcaaatatgaaaaacatga

SEQ ID NO: 3614 - DNA, 18 bp, Saccharomyces cerevisiae
tggctgaaaggacgaggc

SEQ ID NO: 3615 - DNA, 25 bp, Saccharomyces cerevisiae
tggctgatttagggttatatgtact

SEQ ID NO: 3616 - DNA, 27 bp, Saccharomyces cerevisiae
ttatattaggaagagaatgaactgctt

SEQ ID NO: 3617 - DNA, 18 bp, Saccharomyces cerevisiae
gaaagcgccacaaaatcg

SEQ ID NO: 3618 - DNA, 27 bp, Saccharomyces cerevisiae
ttcggctaacccaaacttatataatca

SEQ ID NO: 3619 - DNA, 24 bp, Saccharomyces cerevisiae
aatgatgtttctatgtaaattaag

SEQ ID NO: 3620 - DNA, 22 bp, Saccharomyces cerevisiae
ttcgtttgttcaagaagtggtc

SEQ ID NO: 3621 - DNA, 24 bp, Saccharomyces cerevisiae
aggtcgacgtatactggtacatga

SEQ ID NO: 3622 - DNA, 24 bp, Saccharomyces cerevisiae
tgaatgataagagacctatccgta

SEQ ID NO: 3623 - DNA, 26 bp, Saccharomyces cerevisiae
cttgattgatataggcagtttctaca

SEQ ID NO: 3624 - DNA, 25 bp, Saccharomyces cerevisiae
caacaataaagtcttagcttgacgc

SEQ ID NO: 3625 - DNA, 22 bp, Saccharomyces cerevisiae
tcggaatttttgtctatttgga

SEQ ID NO: 3626 - DNA, 27 bp, Saccharomyces cerevisiae
ctcgttaattatattttatgacatctg

SEQ ID NO: 3627 - DNA, 19 bp, Saccharomyces cerevisiae
tccctcccatcacatggac

SEQ ID NO: 3628 - DNA, 23 bp, Saccharomyces cerevisiae
aatactcgtggcttcgttatgtg

SEQ ID NO: 3629 - DNA, 20 bp, Saccharomyces cerevisiae
gtcaatatccagcatcgcag

SEQ ID NO: 3630 - DNA, 27 bp, Saccharomyces cerevisiae
agcagcattcaaagaagaataattaaa

SEQ ID NO: 3631 - DNA, 26 bp, Saccharomyces cerevisiae
gccaggtatatttttattttaaatcg

SEQ ID NO: 3632 - DNA, 20 bp, Saccharomyces cerevisiae
cggttttgtatgctgtggtg

SEQ ID NO: 3633 - DNA, 27 bp, Saccharomyces cerevisiae
tttgactcatactcttagattcttcaa

SEQ ID NO: 3634 - DNA, 22 bp, Saccharomyces cerevisiae
ttccacaaataatgcatctaaa

SEQ ID NO: 3635 - DNA, 27 bp, Saccharomyces cerevisiae
gctttttaattctatctattcgcaaaa

SEQ ID NO: 3636 - DNA, 26 bp, Saccharomyces cerevisiae
agacatgcctttactaatgaacttcc

SEQ ID NO: 3637 - DNA, 20 bp, Saccharomyces cerevisiae
aatgtttcgatccatccgct

SEQ ID NO: 3638 - DNA, 21 bp, Saccharomyces cerevisiae
gcatgaaggctatcacggtaa

SEQ ID NO: 3639 - DNA, 22 bp, Saccharomyces cerevisiae
atgctttgatctgctgatgtag

SEQ ID NO: 3640 - DNA, 24 bp, Saccharomyces cerevisiae
cgcctctagaactactctcgatct

SEQ ID NO: 3641 - DNA, 25 bp, Saccharomyces cerevisiae
gaaaattgaatatcgtatctgttta

SEQ ID NO: 3642 - DNA, 22 bp, Saccharomyces cerevisiae
atcaattaaggaaattatcagt

SEQ ID NO: 3643 - DNA, 27 bp, Saccharomyces cerevisiae
cagaaagaatgaagaaagctataaaaa

SEQ ID NO: 3644 - DNA, 25 bp, Saccharomyces cerevisiae
ggttgaaagatttttgtagtttttg

SEQ ID NO: 3645 - DNA, 23 bp, Saccharomyces cerevisiae
aggaaaggccgtttttatttacc

SEQ ID NO: 3646 - DNA, 26 bp, Saccharomyces cerevisiae
gggttaaatatcacttttatatcttt

SEQ ID NO: 3647 - DNA, 27 bp, Saccharomyces cerevisiae
taaaatgcatcagcatacaagatagac

SEQ ID NO: 3648 - DNA, 27 bp, Saccharomyces cerevisiae
tcttaggggtcagaaatatatacagtg

SEQ ID NO: 3649 - DNA, 21 bp, Saccharomyces cerevisiae
cacagaagaagtgctcacagc

SEQ ID NO: 3650 - DNA, 23 bp, Saccharomyces cerevisiae
acaactagctttcaacgaacgtg

SEQ ID NO: 3651 - DNA, 20 bp, Saccharomyces cerevisiae
tgatcgtcgtgtattgttgc

SEQ ID NO: 3652 - DNA, 19 bp, Saccharomyces cerevisiae
ttccaaccattgcttgcct

SEQ ID NO: 3653 - DNA, 24 bp, Saccharomyces cerevisiae
gctggagagtactagcgatacaaa

SEQ ID NO: 3654 - DNA, 22 bp, Saccharomyces cerevisiae
aaaccaaactacaaatagcgcc

SEQ ID NO: 3655 - DNA, 26 bp, Saccharomyces cerevisiae
tgaaagcaatcatatgtaaagttagc

SEQ ID NO: 3656 - DNA, 24 bp, Saccharomyces cerevisiae
gatagttttaattagtcgtttgaa

SEQ ID NO: 3657 - DNA, 26 bp, Saccharomyces cerevisiae
taaatgtttcgctattttagtctttg

SEQ ID NO: 3658 - DNA, 21 bp, Saccharomyces cerevisiae
gctcagcaagttaataacgcc

SEQ ID NO: 3659 - DNA, 25 bp, Saccharomyces cerevisiae
gtataggttgcttttcaagctctta

SEQ ID NO: 3660 - DNA, 27 bp, Saccharomyces cerevisiae
cagtgatgcttacatctattaatgtct

SEQ ID NO: 3661 - DNA, 23 bp, Saccharomyces cerevisiae
ttattgctcattcagctttttca

SEQ ID NO: 3662 - DNA, 27 bp, Saccharomyces cerevisiae
tttcatatactcatgatttctaaacag

SEQ ID NO: 3663 - DNA, 27 bp, Saccharomyces cerevisiae
tcctaattagttacttgtaaggctgaa

SEQ ID NO: 3664 - DNA, 27 bp, Saccharomyces cerevisiae
gtgtgcgtaatgagttgtaaaattatg

SEQ ID NO: 3665 - DNA, 23 bp, Saccharomyces cerevisiae
tcaattcaattcccatttcagtt

SEQ ID NO: 3666 - DNA, 27 bp, Saccharomyces cerevisiae
tcacttcatttatctgttaactttgag

SEQ ID NO: 3667 - DNA, 25 bp, Saccharomyces cerevisiae
tggcgactttgagttttaaaagatt

SEQ ID NO: 3668 - DNA, 26 bp, Saccharomyces cerevisiae
tatgtattttgtagcagcagcaacct

SEQ ID NO: 3669 - DNA, 24 bp, Saccharomyces cerevisiae
tatcaaggaggcagaaaaagtaaa

SEQ ID NO: 3670 - DNA, 24 bp, Saccharomyces cerevisiae
tgttaattttgatgctgatgttga

SEQ ID NO: 3671 - DNA, 18 bp, Saccharomyces cerevisiae
acaagcgcgcctctacct

SEQ ID NO: 3672 - DNA, 27 bp, Saccharomyces cerevisiae
gtagggcacaggtaaataacctatcgt

SEQ ID NO: 3673 - DNA, 27 bp, Saccharomyces cerevisiae
tccaatatatactcacatgtaacaact

SEQ ID NO: 3674 - DNA, 25 bp, Saccharomyces cerevisiae
attggctaaatagaagcatcaaaca

SEQ ID NO: 3675 - DNA, 24 bp, Saccharomyces cerevisiae
atgacgatttttctgaaatctttg

SEQ ID NO: 3676 - DNA, 19 bp, Saccharomyces cerevisiae
aagcatcttgccctgtgct

SEQ ID NO: 3677 - DNA, 24 bp, Saccharomyces cerevisiae
tttaaagattgtccatattcctcg

SEQ ID NO: 3678 - DNA, 22 bp, Saccharomyces cerevisiae
cgtaaatgagctgtcttgtgat

SEQ ID NO: 3679 - DNA, 25 bp, Saccharomyces cerevisiae
gaagagaactaaccttgatgaagaa

SEQ ID NO: 3680 - DNA, 20 bp, Saccharomyces cerevisiae
ggggaataaagccaaaatgt

SEQ ID NO: 3681 - DNA, 26 bp, Saccharomyces cerevisiae
gctaagaaataaactttaagaaaatg

SEQ ID NO: 3682 - DNA, 24 bp, Saccharomyces cerevisiae
ggccgaatttttggtatttatcta

SEQ ID NO: 3683 - DNA, 19 bp, Saccharomyces cerevisiae
gcttaaggtgggacaaccg

SEQ ID NO: 3684 - DNA, 27 bp, Saccharomyces cerevisiae
taccacaataaaggaaataaaggaaga

SEQ ID NO: 3685 - DNA, 25 bp, Saccharomyces cerevisiae
taaatagaagcaaatgacatcagaa

SEQ ID NO: 3686 - DNA, 25 bp, Saccharomyces cerevisiae
tatacgatctcatcaagtcatttgc

SEQ ID NO: 3687 - DNA, 27 bp, Saccharomyces cerevisiae
aaatttttaggataaagctaagttcca

SEQ ID NO: 3688 - DNA, 26 bp, Saccharomyces cerevisiae
actaaaggaaagctcggtaataaaaa

SEQ ID NO: 3689 - DNA, 20 bp, Saccharomyces cerevisiae
ccttctgcaggctcgatatt

SEQ ID NO: 3690 - DNA, 27 bp, Saccharomyces cerevisiae
ttttgtataactaaataatattggaaa

SEQ ID NO: 3691 - DNA, 23 bp, Saccharomyces cerevisiae
atagtgccccagaatgtctactc

SEQ ID NO: 3692 - DNA, 27 bp, Saccharomyces cerevisiae
acttattgatgcaactggagtatattt

SEQ ID NO: 3693 - DNA, 26 bp, Saccharomyces cerevisiae
tcaatcttgtatctagatgtttttgc

SEQ ID NO: 3694 - DNA, 25 bp, Saccharomyces cerevisiae
cgtgcactaaagttgacttttcttt

SEQ ID NO: 3695 - DNA, 18 bp, Saccharomyces cerevisiae
tgatttgccgtccggaat

SEQ ID NO: 3696 - DNA, 26 bp, Saccharomyces cerevisiae
gaaagctgaattgatactacgaaaaa

SEQ ID NO: 3697 - DNA, 26 bp, Saccharomyces cerevisiae
ccacctcatagaaagacaaataaaga

SEQ ID NO: 3698 - DNA, 24 bp, Saccharomyces cerevisiae
tttggattctagattaatgtattt

SEQ ID NO: 3699 - DNA, 25 bp, Saccharomyces cerevisiae
tattcagttttacttaagtgggagg

SEQ ID NO: 3700 - DNA, 27 bp, Saccharomyces cerevisiae
taaactagaatgtttttatttccttcc

SEQ ID NO: 3701 - DNA, 27 bp, Saccharomyces cerevisiae
agttttttgttttacagtatatgtttc

SEQ ID NO: 3702 - DNA, 26 bp, Saccharomyces cerevisiae
aacagaaggtagtagtgcattagagg

SEQ ID NO: 3703 - DNA, 21 bp, Saccharomyces cerevisiae
agacaaacgcctttacgaatg

SEQ ID NO: 3704 - DNA, 27 bp, Saccharomyces cerevisiae
tccatttaagaagttaaaataaaacga

SEQ ID NO: 3705 - DNA, 27 bp, Saccharomyces cerevisiae
gctcgacaaatatagaaattaaaagaa

SEQ ID NO: 3706 - DNA, 27 bp, Saccharomyces cerevisiae
aaatttatgtagctattttactggtgc

SEQ ID NO: 3707 - DNA, 22 bp, Saccharomyces cerevisiae
accctcctgcatagtctaacct

SEQ ID NO: 3708 - DNA, 27 bp, Saccharomyces cerevisiae
taattcttcatttagaaaaatttcagc

SEQ ID NO: 3709 - DNA, 27 bp, Saccharomyces cerevisiae
aaccatcttaacttctgctaacatatc

SEQ ID NO: 3710 - DNA, 23 bp, Saccharomyces cerevisiae
acactcctacaagtgttgggaaa

SEQ ID NO: 3711 - DNA, 23 bp, Saccharomyces cerevisiae
acgctcgcatagtctaaaattca

SEQ ID NO: 3712 - DNA, 27 bp, Saccharomyces cerevisiae
taaaacgatacgctaacctataacata

SEQ ID NO: 3713 - DNA, 24 bp, Saccharomyces cerevisiae
tatcggtgtctacaaaatgatacg

SEQ ID NO: 3714 - DNA, 21 bp, Saccharomyces cerevisiae
acgccctattcttctagtccg

SEQ ID NO: 3715 - DNA, 23 bp, Saccharomyces cerevisiae
aagaacgtttacacacacacaca

SEQ ID NO: 3716 - DNA, 21 bp, Saccharomyces cerevisiae
tcaattgaatttgaaacgagg

SEQ ID NO: 3717 - DNA, 24 bp, Saccharomyces cerevisiae
tcatagtacaaaagaaacgatgcc

SEQ ID NO: 3718 - DNA, 23 bp, Saccharomyces cerevisiae
caataaacgtgtgggagtattgc

SEQ ID NO: 3719 - DNA, 27 bp, Saccharomyces cerevisiae
atttaataacatcctttcacacactca

SEQ ID NO: 3720 - DNA, 23 bp, Saccharomyces cerevisiae
tagtgcctactgtgtgcaaagat

SEQ ID NO: 3721 - DNA, 23 bp, Saccharomyces cerevisiae
aaataacaaagttttggtgagca

SEQ ID NO: 3722 - DNA, 27 bp, Saccharomyces cerevisiae
atatatatcctccgtacgtaacatcac

SEQ ID NO: 3723 - DNA, 26 bp, Saccharomyces cerevisiae
ttcctataatgtaatgttctaacaaa

SEQ ID NO: 3724 - DNA, 20 bp, Saccharomyces cerevisiae
cgtatagcctgctggggaag

SEQ ID NO: 3725 - DNA, 27 bp, Saccharomyces cerevisiae
cgtataaaaaaaaaagtctaaatacaa

SEQ ID NO: 3726 - DNA, 21 bp, Saccharomyces cerevisiae
tcagcgtgaactgactgtagg

SEQ ID NO: 3727 - DNA, 27 bp, Saccharomyces cerevisiae
atatatttctttttacgcagtctcttc

SEQ ID NO: 3728 - DNA, 23 bp, Saccharomyces cerevisiae
tcatatcggttaataagacggaa

SEQ ID NO: 3729 - DNA, 23 bp, Saccharomyces cerevisiae
tttttcccatccgtatctaatga

SEQ ID NO: 3730 - DNA, 26 bp, Saccharomyces cerevisiae
tcccttaattaaaaagattagtttac

SEQ ID NO: 3731 - DNA, 20 bp, Saccharomyces cerevisiae
ttcccagaagattagggagg

SEQ ID NO: 3732 - DNA, 24 bp, Saccharomyces cerevisiae
gacgaattgtgaataacgaaataa

SEQ ID NO: 3733 - DNA, 27 bp, Saccharomyces cerevisiae
aaatatagtcacaattagataaaaaga

SEQ ID NO: 3734 - DNA, 27 bp, Saccharomyces cerevisiae
atcaccttgtaagatagtctgaatttt

SEQ ID NO: 3735 - DNA, 26 bp, Saccharomyces cerevisiae
aggagatagtaaaaacaagggatcaa

SEQ ID NO: 3736 - DNA, 27 bp, Saccharomyces cerevisiae
ctacaagatccatagttttattcttcc

SEQ ID NO: 3737 - DNA, 22 bp, Saccharomyces cerevisiae
acatatttcattgcaatctcgc

SEQ ID NO: 3738 - DNA, 26 bp, Saccharomyces cerevisiae
tctgaaatttagtgtctacgttatga

SEQ ID NO: 3739 - DNA, 25 bp, Saccharomyces cerevisiae
ttcaataaataatagattcatactt

SEQ ID NO: 3740 - DNA, 21 bp, Saccharomyces cerevisiae
gattaaggtgctaaaatgccg

SEQ ID NO: 3741 - DNA, 27 bp, Saccharomyces cerevisiae
ttcactgaatataaatacaaaaatgcg

SEQ ID NO: 3742 - DNA, 27 bp, Saccharomyces cerevisiae
ttattatatgatagatttgttaatttt

SEQ ID NO: 3743 - DNA, 21 bp, Saccharomyces cerevisiae
gtctttgcggattgcttagtt

SEQ ID NO: 3744 - DNA, 21 bp, Saccharomyces cerevisiae
gcttgaaagcattattcgatg

SEQ ID NO: 3745 - DNA, 25 bp, Saccharomyces cerevisiae
gaataataattgttttattactgcg

SEQ ID NO: 3746 - DNA, 24 bp, Saccharomyces cerevisiae
atataaaaaagaccatataaaagt

SEQ ID NO: 3747 - DNA, 27 bp, Saccharomyces cerevisiae
agggactaggaaataatactaattaaa

SEQ ID NO: 3748 - DNA, 26 bp, Saccharomyces cerevisiae
catattttgacatttacatagccatc

SEQ ID NO: 3749 - DNA, 21 bp, Saccharomyces cerevisiae
tggtggaacgtaaaagaatga

SEQ ID NO: 3750 - DNA, 24 bp, Saccharomyces cerevisiae
tagagaaagctcctatttccactg

SEQ ID NO: 3751 - DNA, 26 bp, Saccharomyces cerevisiae
gagctttagaactcggagataatact

SEQ ID NO: 3752 - DNA, 23 bp, Saccharomyces cerevisiae
taatgaaaacaattccccttttt

SEQ ID NO: 3753 - DNA, 26 bp, Saccharomyces cerevisiae
tgatagttgattttatttctgcattt

SEQ ID NO: 3754 - DNA, 25 bp, Saccharomyces cerevisiae
atgcagtaagctgtgaaattttatt

SEQ ID NO: 3755 - DNA, 27 bp, Saccharomyces cerevisiae
atgcctttaaaattacagaacataaca

SEQ ID NO: 3756 - DNA, 25 bp, Saccharomyces cerevisiae
tatgtgcctttttgtttaaatgatg

SEQ ID NO: 3757 - DNA, 26 bp, Saccharomyces cerevisiae
actacaattaccaatattttgaatgc

SEQ ID NO: 3758 - DNA, 20 bp, Saccharomyces cerevisiae
tttctcaatcgctcctcttg

SEQ ID NO: 3759 - DNA, 25 bp, Saccharomyces cerevisiae
cgaaaaccgaattatattatgctca

SEQ ID NO: 3760 - DNA, 26 bp, Saccharomyces cerevisiae
atgcaatgaaacgtatatatgaaatc

SEQ ID NO: 3761 - DNA, 26 bp, Saccharomyces cerevisiae
gcttccgaataaatataaaatcaaga

SEQ ID NO: 3762 - DNA, 27 bp, Saccharomyces cerevisiae
atatctgtgtagtgtgtactagttggc

SEQ ID NO: 3763 - DNA, 24 bp, Saccharomyces cerevisiae
aatagaaagtgaaggggttgtgtt

SEQ ID NO: 3764 - DNA, 26 bp, Saccharomyces cerevisiae
tagagaaaattatgtacgcttgattc

SEQ ID NO: 3765 - DNA, 23 bp, Saccharomyces cerevisiae
tccagccagtaaaatccatactc

SEQ ID NO: 3766 - DNA, 21 bp, Saccharomyces cerevisiae
aacatccaagatagcacaacg

SEQ ID NO: 3767 - DNA, 26 bp, Saccharomyces cerevisiae
tcttttctcacatcctcacttataga

SEQ ID NO: 3768 - DNA, 25 bp, Saccharomyces cerevisiae
ttgtaaagtgcttttaactaagaat

SEQ ID NO: 3769 - DNA, 27 bp, Saccharomyces cerevisiae
gagatgaacaacttctgtttaaaatcg

SEQ ID NO: 3770 - DNA, 25 bp, Saccharomyces cerevisiae
taatttggtctcggtatagtcagtg

SEQ ID NO: 3771 - DNA, 25 bp, Saccharomyces cerevisiae
agtaatgcatgctatgatttctttt

SEQ ID NO: 3772 - DNA, 26 bp, Saccharomyces cerevisiae
aaaaggagtgatggttttctttattt

SEQ ID NO: 3773 - DNA, 26 bp, Saccharomyces cerevisiae
tgaacatcaaattatcattacagaaa

SEQ ID NO: 3774 - DNA, 27 bp, Saccharomyces cerevisiae
agaggtatttagaagtgaagagacaaa

SEQ ID NO: 3775 - DNA, 21 bp, Saccharomyces cerevisiae
gtaacctctgcattgtcgctt

SEQ ID NO: 3776 - DNA, 27 bp, Saccharomyces cerevisiae
tgtacatacatacatacacacatacat

SEQ ID NO: 3777 - DNA, 21 bp, Saccharomyces cerevisiae
tggcattgatgtgttcatttt

SEQ ID NO: 3778 - DNA, 27 bp, Saccharomyces cerevisiae
taatgatcagtatgtattcgtaagccc

SEQ ID NO: 3779 - DNA, 24 bp, Saccharomyces cerevisiae
accttgtaaagtaaaaaaaaaaaa

SEQ ID NO: 3780 - DNA, 26 bp, Saccharomyces cerevisiae
cttcacaaataagaatagttcccata

SEQ ID NO: 3781 - DNA, 26 bp, Saccharomyces cerevisiae
tattgctgtatagtacatagaggtcg

SEQ ID NO: 3782 - DNA, 18 bp, Saccharomyces cerevisiae
cgcagacaatgcaccagc

SEQ ID NO: 3783 - DNA, 26 bp, Saccharomyces cerevisiae
gtccgatttacaaatatataatggcg

SEQ ID NO: 3784 - DNA, 24 bp, Saccharomyces cerevisiae
gtcaaataaaattagtgccgactt

SEQ ID NO: 3785 - DNA, 23 bp, Saccharomyces cerevisiae
agagaagcttttacgaacgaaat

SEQ ID NO: 3786 - DNA, 27 bp, Saccharomyces cerevisiae
ttgagtactattattatatgacacttt

SEQ ID NO: 3787 - DNA, 19 bp, Saccharomyces cerevisiae
agagtacgctcacagccgc

SEQ ID NO: 3788 - DNA, 27 bp, Saccharomyces cerevisiae
tgataaatcttttatgtagtacccctt

SEQ ID NO: 3789 - DNA, 27 bp, Saccharomyces cerevisiae
tgatttgtttgcatctttatacttaca

SEQ ID NO: 3790 - DNA, 24 bp, Saccharomyces cerevisiae
gtatcgtattatcgtcaccttcca

SEQ ID NO: 3791 - DNA, 20 bp, Saccharomyces cerevisiae
ggatgaatggttggctcttt

SEQ ID NO: 3792 - DNA, 27 bp, Saccharomyces cerevisiae
atagataacctttttcttaccttttcg

SEQ ID NO: 3793 - DNA, 22 bp, Saccharomyces cerevisiae
gtacatattaatacacatagtt

SEQ ID NO: 3794 - DNA, 24 bp, Saccharomyces cerevisiae
tcttgaaaaattgaaaatagactt

SEQ ID NO: 3795 - DNA, 22 bp, Saccharomyces cerevisiae
accctatgtaacaaaagtgttt

SEQ ID NO: 3796 - DNA, 27 bp, Saccharomyces cerevisiae
taagtggtgtatatatatgttcgaagg

SEQ ID NO: 3797 - DNA, 24 bp, Saccharomyces cerevisiae
tgggcctacaactactacaaaatc

SEQ ID NO: 3798 - DNA, 24 bp, Saccharomyces cerevisiae
agcctttttgttccatagtagttg

SEQ ID NO: 3799 - DNA, 18 bp, Saccharomyces cerevisiae
cgacccagcacaaaggct

SEQ ID NO: 3800 - DNA, 25 bp, Saccharomyces cerevisiae
tgttatcaagactttttggacaagg

SEQ ID NO: 3801 - DNA, 22 bp, Saccharomyces cerevisiae
ccaataacttgagcgaatataa

SEQ ID NO: 3802 - DNA, 23 bp, Saccharomyces cerevisiae
gaggagatgaaacaacatattcg

SEQ ID NO: 3803 - DNA, 22 bp, Saccharomyces cerevisiae
gcattgtgtcagagattttcca

SEQ ID NO: 3804 - DNA, 20 bp, Saccharomyces cerevisiae
tctgtttcgcccaatcaatc

SEQ ID NO: 3805 - DNA, 22 bp, Saccharomyces cerevisiae
gcagaagattagccatagcaga

SEQ ID NO: 3806 - DNA, 25 bp, Saccharomyces cerevisiae
tgttattgctaaattgagtacaccc

SEQ ID NO: 3807 - DNA, 21 bp, Saccharomyces cerevisiae
aatttcatgcctgccttattc

SEQ ID NO: 3808 - DNA, 25 bp, Saccharomyces cerevisiae
cgctgatttcatttaccttttattt

SEQ ID NO: 3809 - DNA, 20 bp, Saccharomyces cerevisiae
acctcgtcggtttatctgcc

SEQ ID NO: 3810 - DNA, 22 bp, Saccharomyces cerevisiae
cactccgctctttaatctcctg

SEQ ID NO: 3811 - DNA, 24 bp, Saccharomyces cerevisiae
gcaagacaaatgaccagatataaa

SEQ ID NO: 3812 - DNA, 25 bp, Saccharomyces cerevisiae
gaacaaatgttccttttccaaaata

SEQ ID NO: 3813 - DNA, 19 bp, Saccharomyces cerevisiae
ggtcagcgttcagaagcgt

SEQ ID NO: 3814 - DNA, 21 bp, Saccharomyces cerevisiae
actaaccgaaccggagaaaga

SEQ ID NO: 3815 - DNA, 22 bp, Saccharomyces cerevisiae
agaagaaaatcgtttccaccaa

SEQ ID NO: 3816 - DNA, 27 bp, Saccharomyces cerevisiae
ggtgcttaaatgatgatgaataataag

SEQ ID NO: 3817 - DNA, 27 bp, Saccharomyces cerevisiae
ctttttatcattctacaaaagaccagt

SEQ ID NO: 3818 - DNA, 27 bp, Saccharomyces cerevisiae
ccatcattatcattaaaatatcaaccc

SEQ ID NO: 3819 - DNA, 26 bp, Saccharomyces cerevisiae
aaatgaagttaacgttagaaaaatcg

SEQ ID NO: 3820 - DNA, 27 bp, Saccharomyces cerevisiae
ttttacagttacatacccatcaataca

SEQ ID NO: 3821 - DNA, 27 bp, Saccharomyces cerevisiae
atagcgataagtagtgtttctgtatga

SEQ ID NO: 3822 - DNA, 25 bp, Saccharomyces cerevisiae
taaatattgtcgaaccgtactttgc

SEQ ID NO: 3823 - DNA, 26 bp, Saccharomyces cerevisiae
ggtctgtaagtccatttttcattttt

SEQ ID NO: 3824 - DNA, 22 bp, Saccharomyces cerevisiae
tttgttaagaatttctccgctg

SEQ ID NO: 3825 - DNA, 20 bp, Saccharomyces cerevisiae
gacaaattgtaagaatggtt

SEQ ID NO: 3826 - DNA, 27 bp, Saccharomyces cerevisiae
taagtaaatgcatgtatactaaactca

SEQ ID NO: 3827 - DNA, 27 bp, Saccharomyces cerevisiae
ctacttaaataaataatgtataccccc

SEQ ID NO: 3828 - DNA, 26 bp, Saccharomyces cerevisiae
tatattttatcactcctcaaaatcgg

SEQ ID NO: 3829 - DNA, 22 bp, Saccharomyces cerevisiae
tcacttccgagcgattaataca

SEQ ID NO: 3830 - DNA, 27 bp, Saccharomyces cerevisiae
cacatgtgaattctttcttttacatac

SEQ ID NO: 3831 - DNA, 19 bp, Saccharomyces cerevisiae
caaacggagccgtcaacac

SEQ ID NO: 3832 - DNA, 25 bp, Saccharomyces cerevisiae
gatttcaaaactacatattacagaa

SEQ ID NO: 3833 - DNA, 23 bp, Saccharomyces cerevisiae
tccggtctttaacttggttatca

SEQ ID NO: 3834 - DNA, 25 bp, Saccharomyces cerevisiae
ttgctctgagaacatttatacatta

SEQ ID NO: 3835 - DNA, 26 bp, Saccharomyces cerevisiae
gggtactacaaatcgaagtaacagtg

SEQ ID NO: 3836 - DNA, 25 bp, Saccharomyces cerevisiae
tagacgatatatgttgttgcttcat

SEQ ID NO: 3837 - DNA, 27 bp, Saccharomyces cerevisiae
tttagttttgtgataattacagatttt

SEQ ID NO: 3838 - DNA, 26 bp, Saccharomyces cerevisiae
acgcaaaacactgcaatattattctc

SEQ ID NO: 3839 - DNA, 23 bp, Saccharomyces cerevisiae
aggacagaatgaccacgtaaatg

SEQ ID NO: 3840 - DNA, 25 bp, Saccharomyces cerevisiae
aaaaagatatagcattcaatgaggc

SEQ ID NO: 3841 - DNA, 27 bp, Saccharomyces cerevisiae
tatagaatcaataacaaatatataaac

SEQ ID NO: 3842 - DNA, 27 bp, Saccharomyces cerevisiae
gtgttttttatttgttgtatttttttt

SEQ ID NO: 3843 - DNA, 27 bp, Saccharomyces cerevisiae
atattttaatatttaacttagcttatg

SEQ ID NO: 3844 - DNA, 21 bp, Saccharomyces cerevisiae
actcagctggtgctcacataa

SEQ ID NO: 3845 - DNA, 19 bp, Saccharomyces cerevisiae
cggcatagatgaagagccc

SEQ ID NO: 3846 - DNA, 20 bp, Saccharomyces cerevisiae
tgaagaaatcttgtgcatct

SEQ ID NO: 3847 - DNA, 27 bp, Saccharomyces cerevisiae
aaaacagcataaatagtgtttcttcaa

SEQ ID NO: 3848 - DNA, 20 bp, Saccharomyces cerevisiae
aacgagccgatgagattttt

SEQ ID NO: 3849 - DNA, 20 bp, Saccharomyces cerevisiae
caggagagctgaatacccga

SEQ ID NO: 3850 - DNA, 27 bp, Saccharomyces cerevisiae
gtaactaatttttctattttttctgga

SEQ ID NO: 3851 - DNA, 23 bp, Saccharomyces cerevisiae
tcgatttattacgatctccacaa

SEQ ID NO: 3852 - DNA, 27 bp, Saccharomyces cerevisiae
agaagtaaacagttctttgctatttca

SEQ ID NO: 3853 - DNA, 23 bp, Saccharomyces cerevisiae
taagcttataccccttcctttgg

SEQ ID NO: 3854 - DNA, 25 bp, Saccharomyces cerevisiae
gaaaattaacagttgtggaaaagga

SEQ ID NO: 3855 - DNA, 26 bp, Saccharomyces cerevisiae
taaatctttcggaactctttgtagtt

SEQ ID NO: 3856 - DNA, 27 bp, Saccharomyces cerevisiae
ggatataaataattgccatagactttc

SEQ ID NO: 3857 - DNA, 23 bp, Saccharomyces cerevisiae
aagcagtaaactgagcgaaataa

SEQ ID NO: 3858 - DNA, 27 bp, Saccharomyces cerevisiae
gtgtggtaaaaaaaaaaaaaaagaaaa

SEQ ID NO: 3859 - DNA, 23 bp, Saccharomyces cerevisiae
gttaagcacgatttagaaggtgg

SEQ ID NO: 3860 - DNA, 21 bp, Saccharomyces cerevisiae
aagagttggagggcttcttcc

SEQ ID NO: 3861 - DNA, 26 bp, Saccharomyces cerevisiae
agagattaaactttcagaacattcat

SEQ ID NO: 3862 - DNA, 27 bp, Saccharomyces cerevisiae
ttttcatgagctctcttatcaattatg

SEQ ID NO: 3863 - DNA, 26 bp, Saccharomyces cerevisiae
gctgctgttattgttgttagtatttc

SEQ ID NO: 3864 - DNA, 22 bp, Saccharomyces cerevisiae
tgaaccaaatgtcttgtagtgc

SEQ ID NO: 3865 - DNA, 26 bp, Saccharomyces cerevisiae
agggattaattaaatcgtaaggaaaa

SEQ ID NO: 3866 - DNA, 24 bp, Saccharomyces cerevisiae
aaaatatacctccgatatgaaacg

SEQ ID NO: 3867 - DNA, 26 bp, Saccharomyces cerevisiae
actagtctttgctctctcaatttttg

SEQ ID NO: 3868 - DNA, 18 bp, Saccharomyces cerevisiae
gtttgagccaagccacgc

SEQ ID NO: 3869 - DNA, 24 bp, Saccharomyces cerevisiae
caagcatgccttttcaatttatag

SEQ ID NO: 3870 - DNA, 20 bp, Saccharomyces cerevisiae
agaaggaagaagacgcacga

SEQ ID NO: 3871 - DNA, 27 bp, Saccharomyces cerevisiae
gaaatatttgaatagtttataaaaccc

SEQ ID NO: 3872 - DNA, 27 bp, Saccharomyces cerevisiae
gagttgttctattcgtaagaactgttt

SEQ ID NO: 3873 - DNA, 25 bp, Saccharomyces cerevisiae
taaattttgtattctttatttgctc

SEQ ID NO: 3874 - DNA, 18 bp, Saccharomyces cerevisiae
tagcgcctcatgtgagca

SEQ ID NO: 3875 - DNA, 26 bp, Saccharomyces cerevisiae
taattagtcaaggttttttttttctt

SEQ ID NO: 3876 - DNA, 26 bp, Saccharomyces cerevisiae
tataggaaatagaagagaaggagcga

SEQ ID NO: 3877 - DNA, 20 bp, Saccharomyces cerevisiae
tttgtcagcctcccgaagat

SEQ ID NO: 3878 - DNA, 27 bp, Saccharomyces cerevisiae
aaataatattccacttttgttcaagga

SEQ ID NO: 3879 - DNA, 25 bp, Saccharomyces cerevisiae
tgaagccattaaatgaactaaactt

SEQ ID NO: 3880 - DNA, 21 bp, Saccharomyces cerevisiae
gaaatcaattgacaccgataa

SEQ ID NO: 3881 - DNA, 27 bp, Saccharomyces cerevisiae
tacgtcttacgactatgtttagctttg

SEQ ID NO: 3882 - DNA, 27 bp, Saccharomyces cerevisiae
aaggcttaatttcgttagattatcatt

SEQ ID NO: 3883 - DNA, 24 bp, Saccharomyces cerevisiae
aacgaagtttgatagcaatgtctg

SEQ ID NO: 3884 - DNA, 27 bp, Saccharomyces cerevisiae
atattgatgttttgttgtgtaaatgtt

SEQ ID NO: 3885 - DNA, 19 bp, Saccharomyces cerevisiae
aaaagacacacatgcgagc

SEQ ID NO: 3886 - DNA, 26 bp, Saccharomyces cerevisiae
agaacattaaagtttttgtttgagca

SEQ ID NO: 3887 - DNA, 26 bp, Saccharomyces cerevisiae
gccaggaaataacatacatatcctac

SEQ ID NO: 3888 - DNA, 22 bp, Saccharomyces cerevisiae
cggaaacgttagatttttacca

SEQ ID NO: 3889 - DNA, 21 bp, Saccharomyces cerevisiae
tagtcctggaagttgagcttg

SEQ ID NO: 3890 - DNA, 24 bp, Saccharomyces cerevisiae
atacgctgacacgtttgtactttc

SEQ ID NO: 3891 - DNA, 26 bp, Saccharomyces cerevisiae
tgatgcagaacttatgaaagcttaac

SEQ ID NO: 3892 - DNA, 23 bp, Saccharomyces cerevisiae
tcgataacaagacttatcgcatt

SEQ ID NO: 3893 - DNA, 27 bp, Saccharomyces cerevisiae
tacatttaaaaacgctatcttcataca

SEQ ID NO: 3894 - DNA, 25 bp, Saccharomyces cerevisiae
gtcgtttttctctttatatacttca

SEQ ID NO: 3895 - DNA, 25 bp, Saccharomyces cerevisiae
acggacctattcattttacttactg

SEQ ID NO: 3896 - DNA, 26 bp, Saccharomyces cerevisiae
accactgaaacttcatttactttatg

SEQ ID NO: 3897 - DNA, 27 bp, Saccharomyces cerevisiae
atagccaattgaaataagtagacacaa

SEQ ID NO: 3898 - DNA, 21 bp, Saccharomyces cerevisiae
gtatttggctcaacagaaccg

SEQ ID NO: 3899 - DNA, 23 bp, Saccharomyces cerevisiae
agtttcaagctatatgcattttt

SEQ ID NO: 3900 - DNA, 23 bp, Saccharomyces cerevisiae
gtttaacatagagttcaacaacg

SEQ ID NO: 3901 - DNA, 26 bp, Saccharomyces cerevisiae
aaaaagatcaacttattcacgattca

SEQ ID NO: 3902 - DNA, 26 bp, Saccharomyces cerevisiae
ttctagaatatggatcaaatacgctt

SEQ ID NO: 3903 - DNA, 26 bp, Saccharomyces cerevisiae
ttttcatgaacgctttaaaaatactc

SEQ ID NO: 3904 - DNA, 24 bp, Saccharomyces cerevisiae
ggattttgattaggcaactttaat

SEQ ID NO: 3905 - DNA, 27 bp, Saccharomyces cerevisiae
cattacctgtgaagaaatttcatgtat

SEQ ID NO: 3906 - DNA, 27 bp, Saccharomyces cerevisiae
tgtgatcatattcaaagttgagcagac

SEQ ID NO: 3907 - DNA, 22 bp, Saccharomyces cerevisiae
gacgcttgcagagttgtctaaa

SEQ ID NO: 3908 - DNA, 20 bp, Saccharomyces cerevisiae
cattacgttaataaataggt

SEQ ID NO: 3909 - DNA, 24 bp, Saccharomyces cerevisiae
ccttttttacgtacttgtataccg

SEQ ID NO: 3910 - DNA, 20 bp, Saccharomyces cerevisiae
gatcttcctttttaatgaat

SEQ ID NO: 3911 - DNA, 19 bp, Saccharomyces cerevisiae
tttttgggcgcaattaacc

SEQ ID NO: 3912 - DNA, 26 bp, Saccharomyces cerevisiae
tgatctagctttgatattcattcatt

SEQ ID NO: 3913 - DNA, 21 bp, Saccharomyces cerevisiae
ataaacgtctagatgccgcaa

SEQ ID NO: 3914 - DNA, 26 bp, Saccharomyces cerevisiae
aaaaacaaactttagtgcctgtaggt

SEQ ID NO: 3915 - DNA, 21 bp, Saccharomyces cerevisiae
taaaggtaatgcacacgctca

SEQ ID NO: 3916 - DNA, 25 bp, Saccharomyces cerevisiae
tcgaagtaatgtggaaatattgatt

SEQ ID NO: 3917 - DNA, 23 bp, Saccharomyces cerevisiae
gcaatcgattctcatactgtcaa

SEQ ID NO: 3918 - DNA, 27 bp, Saccharomyces cerevisiae
tgatacggattctctgtattctgtcta

SEQ ID NO: 3919 - DNA, 27 bp, Saccharomyces cerevisiae
gacaaataatcaaattgtatacaggaa

SEQ ID NO: 3920 - DNA, 25 bp, Saccharomyces cerevisiae
acatttgaagtttccatacttttga

SEQ ID NO: 3921 - DNA, 27 bp, Saccharomyces cerevisiae
atcatagtataaaaagaaatagaccaa

SEQ ID NO: 3922 - DNA, 27 bp, Saccharomyces cerevisiae
taataatattttgatttatcaagccgc

SEQ ID NO: 3923 - DNA, 18 bp, Saccharomyces cerevisiae
taagctgcccgacctcac

SEQ ID NO: 3924 - DNA, 24 bp, Saccharomyces cerevisiae
tagtttccttgagtgctttcaaat

SEQ ID NO: 3925 - DNA, 18 bp, Saccharomyces cerevisiae
acgtcaccccatcatccc

SEQ ID NO: 3926 - DNA, 21 bp, Saccharomyces cerevisiae
aacgactagaaggttaggcgg

SEQ ID NO: 3927 - DNA, 22 bp, Saccharomyces cerevisiae
tacacagggcaaggtcattaaa

SEQ ID NO: 3928 - DNA, 26 bp, Saccharomyces cerevisiae
ttcacatggtaaataacgacttttat

SEQ ID NO: 3929 - DNA, 23 bp, Saccharomyces cerevisiae
gtagtcacgcttattctgacgct

SEQ ID NO: 3930 - DNA, 21 bp, Saccharomyces cerevisiae
attgcgaacatcacttttcaa

SEQ ID NO: 3931 - DNA, 21 bp, Saccharomyces cerevisiae
tcttcgcacgataacgctagg

SEQ ID NO: 3932 - DNA, 24 bp, Saccharomyces cerevisiae
agacatcgtagtaataaggtgcaa

SEQ ID NO: 3933 - DNA, 25 bp, Saccharomyces cerevisiae
taataaggaaaaagctaccacacaa

SEQ ID NO: 3934 - DNA, 20 bp, Saccharomyces cerevisiae
actaggtgaaatatcggccc

SEQ ID NO: 3935 - DNA, 25 bp, Saccharomyces cerevisiae
tctgatgattagcttttacacacat

SEQ ID NO: 3936 - DNA, 25 bp, Saccharomyces cerevisiae
aagagaaactaaaaagcatgaattg

SEQ ID NO: 3937 - DNA, 26 bp, Saccharomyces cerevisiae
taaatagtaaaataaagccctagcgt

SEQ ID NO: 3938 - DNA, 24 bp, Saccharomyces cerevisiae
tgagagtaacattttgcttgcttt

SEQ ID NO: 3939 - DNA, 21 bp, Saccharomyces cerevisiae
tgattattccgcaccaatttt

SEQ ID NO: 3940 - DNA, 25 bp, Saccharomyces cerevisiae
tcgggctagaatatttgtattgttt

SEQ ID NO: 3941 - DNA, 27 bp, Saccharomyces cerevisiae
gtatcatctattatttgtatgtgcgtt

SEQ ID NO: 3942 - DNA, 27 bp, Saccharomyces cerevisiae
atatatgtagtccataaggggtaatgc

SEQ ID NO: 3943 - DNA, 27 bp, Saccharomyces cerevisiae
gctatataaaagttcctaattgtgcat

SEQ ID NO: 3944 - DNA, 24 bp, Saccharomyces cerevisiae
atggaccaatagtcatgcaagaga

SEQ ID NO: 3945 - DNA, 24 bp, Saccharomyces cerevisiae
tcaacttgagttctgttcgtaaat

SEQ ID NO: 3946 - DNA, 19 bp, Saccharomyces cerevisiae
aagcaaaaatgaagccgca

SEQ ID NO: 3947 - DNA, 27 bp, Saccharomyces cerevisiae
aatatagagaacatatacctacataaa

SEQ ID NO: 3948 - DNA, 24 bp, Saccharomyces cerevisiae
gaaataaacaaatagaaattatga

SEQ ID NO: 3949 - DNA, 20 bp, Saccharomyces cerevisiae
cccaagtttccatttcatcg

SEQ ID NO: 3950 - DNA, 27 bp, Saccharomyces cerevisiae
ctgtttgagctacttatgaagcacttt

SEQ ID NO: 3951 - DNA, 27 bp, Saccharomyces cerevisiae
tagcactgataagtaactatataccca

SEQ ID NO: 3952 - DNA, 23 bp, Saccharomyces cerevisiae
aattggtatcgatttcttcctcc

SEQ ID NO: 3953 - DNA, 19 bp, Saccharomyces cerevisiae
aggctcaagccgttttggt

SEQ ID NO: 3954 - DNA, 21 bp, Saccharomyces cerevisiae
ttcaatgatcgccttcttttc

SEQ ID NO: 3955 - DNA, 23 bp, Saccharomyces cerevisiae
ttcttcgcatatatagccacatc

SEQ ID NO: 3956 - DNA, 22 bp, Saccharomyces cerevisiae
gcagcatatattttctttcccc

SEQ ID NO: 3957 - DNA, 21 bp, Saccharomyces cerevisiae
gccaattagtgcacacacata

SEQ ID NO: 3958 - DNA, 18 bp, Saccharomyces cerevisiae
gaaattgtgcggtgatcg

SEQ ID NO: 3959 - DNA, 27 bp, Saccharomyces cerevisiae
tagaaatagatacaagagaataacatt

SEQ ID NO: 3960 - DNA, 25 bp, Saccharomyces cerevisiae
gatgaaagataagagataaacgcat

SEQ ID NO: 3961 - DNA, 26 bp, Saccharomyces cerevisiae
ggaatataggcacgtacgatagtaaa

SEQ ID NO: 3962 - DNA, 20 bp, Saccharomyces cerevisiae
cgtcaatgtacttttttatt

SEQ ID NO: 3963 - DNA, 27 bp, Saccharomyces cerevisiae
tattaatacgcattttttttatgtttt

SEQ ID NO: 3964 - DNA, 23 bp, Saccharomyces cerevisiae
aagagttttatcccaccttcatt

SEQ ID NO: 3965 - DNA, 27 bp, Saccharomyces cerevisiae
aattttagtgtcgttaatatctctttt

SEQ ID NO: 3966 - DNA, 25 bp, Saccharomyces cerevisiae
cttcataaagttgatcaaaggtgct

SEQ ID NO: 3967 - DNA, 22 bp, Saccharomyces cerevisiae
agcgaacaaatccatattcaaa

SEQ ID NO: 3968 - DNA, 24 bp, Saccharomyces cerevisiae
ataccgtaaactatgtgaagaaat

SEQ ID NO: 3969 - DNA, 27 bp, Saccharomyces cerevisiae
agtgactattatgtgttgataaagatt

SEQ ID NO: 3970 - DNA, 26 bp, Saccharomyces cerevisiae
aattttgtggcatatatttaaggtct

SEQ ID NO: 3971 - DNA, 22 bp, Saccharomyces cerevisiae
ctgtttgcttaatctttcaaat

SEQ ID NO: 3972 - DNA, 22 bp, Saccharomyces cerevisiae
ataagaatgggagctgttgctt

SEQ ID NO: 3973 - DNA, 24 bp, Saccharomyces cerevisiae
tacgcatgaaagactactatggaa

SEQ ID NO: 3974 - DNA, 25 bp, Saccharomyces cerevisiae
aaattcagtctgcaatatatggact

SEQ ID NO: 3975 - DNA, 23 bp, Saccharomyces cerevisiae
ggcgtcttttagataagtgcaaa

SEQ ID NO: 3976 - DNA, 26 bp, Saccharomyces cerevisiae
atgctatgtaatagacaataaaacca

SEQ ID NO: 3977 - DNA, 22 bp, Saccharomyces cerevisiae
ccaaaaggcattgtcatttatt

SEQ ID NO: 3978 - DNA, 23 bp, Saccharomyces cerevisiae
tagaaagaaaaggtaatcgtaca

SEQ ID NO: 3979 - DNA, 23 bp, Saccharomyces cerevisiae
acattttcgcttttgtagttgag

SEQ ID NO: 3980 - DNA, 19 bp, Saccharomyces cerevisiae
gccaaaacttagcgcggtt

SEQ ID NO: 3981 - DNA, 19 bp, Saccharomyces cerevisiae
gagcatcaaatgtgcgctg

SEQ ID NO: 3982 - DNA, 27 bp, Saccharomyces cerevisiae
atcttcaattaaggaacagtatataag

SEQ ID NO: 3983 - DNA, 27 bp, Saccharomyces cerevisiae
ttgtagattgaaggtagataaaaatta

SEQ ID NO: 3984 - DNA, 26 bp, Saccharomyces cerevisiae
atgaattaaaaggaaaagtattatgc

SEQ ID NO: 3985 - DNA, 26 bp, Saccharomyces cerevisiae
tgaataccgtaagaaatggaatagaa

SEQ ID NO: 3986 - DNA, 22 bp, Saccharomyces cerevisiae
attgcatcaggtccataaaatg

SEQ ID NO: 3987 - DNA, 25 bp, Saccharomyces cerevisiae
aaactttgtttttgcttcttatgga

SEQ ID NO: 3988 - DNA, 24 bp, Saccharomyces cerevisiae
tcttagttggtagcactttgatga

SEQ ID NO: 3989 - DNA, 25 bp, Saccharomyces cerevisiae
gcatggaggaaagtaattgatattt

SEQ ID NO: 3990 - DNA, 21 bp, Saccharomyces cerevisiae
ttgcatcggatttttgaattt

SEQ ID NO: 3991 - DNA, 26 bp, Saccharomyces cerevisiae
gttaaggaatagatgcacagaatatg

SEQ ID NO: 3992 - DNA, 25 bp, Saccharomyces cerevisiae
taaaccgagtatcactctcactttt

SEQ ID NO: 3993 - DNA, 26 bp, Saccharomyces cerevisiae
agtaacgaatgacttgctgtaactaa

SEQ ID NO: 3994 - DNA, 26 bp, Saccharomyces cerevisiae
cgtatatatatggttagctttacgca

SEQ ID NO: 3995 - DNA, 24 bp, Saccharomyces cerevisiae
tgaaatgtcctttacccctagtat

SEQ ID NO: 3996 - DNA, 24 bp, Saccharomyces cerevisiae
aaggaataatcggaattttatgtg

SEQ ID NO: 3997 - DNA, 27 bp, Saccharomyces cerevisiae
tatgtgttgtgtactacgaaaataagc

SEQ ID NO: 3998 - DNA, 26 bp, Saccharomyces cerevisiae
agagttaagaatatagtaaaaagaaa

SEQ ID NO: 3999 - DNA, 20 bp, Saccharomyces cerevisiae
ccgcgtttatagtaaatatg

SEQ ID NO: 4000 - DNA, 26 bp, Saccharomyces cerevisiae
tctttttaattttggtttcttccttc

SEQ ID NO: 4001 - DNA, 23 bp, Saccharomyces cerevisiae
tttgccagcttactatccttctt

SEQ ID NO: 4002 - DNA, 24 bp, Saccharomyces cerevisiae
tacaatcaatacttgcttgaacgc

SEQ ID NO: 4003 - DNA, 20 bp, Saccharomyces cerevisiae
gacagcattcgcccagtatt

SEQ ID NO: 4004 - DNA, 23 bp, Saccharomyces cerevisiae
gcctgtaacaaacgttgattgat

SEQ ID NO: 4005 - DNA, 25 bp, Saccharomyces cerevisiae
gctacttgttacaacaaccttttcg

SEQ ID NO: 4006 - DNA, 27 bp, Saccharomyces cerevisiae
tactcattctttagaaataggttttcg

SEQ ID NO: 4007 - DNA, 27 bp, Saccharomyces cerevisiae
atgtactctatctactgagaccatgtg

SEQ ID NO: 4008 - DNA, 24 bp, Saccharomyces cerevisiae
aaatcttggcgcataagaattaag

SEQ ID NO: 4009 - DNA, 24 bp, Saccharomyces cerevisiae
tcataggtttctcttcaaaaggag

SEQ ID NO: 4010 - DNA, 21 bp, Saccharomyces cerevisiae
caataatttcgagcacacaca

SEQ ID NO: 4011 - DNA, 27 bp, Saccharomyces cerevisiae
tatcctatgatttgtgttttagaggaa

SEQ ID NO: 4012 - DNA, 27 bp, Saccharomyces cerevisiae
tggcatcaataactttttattctattt

SEQ ID NO: 4013 - DNA, 27 bp, Saccharomyces cerevisiae
agaggttaccggttgatatctaaacaa

SEQ ID NO: 4014 - DNA, 24 bp, Saccharomyces cerevisiae
gcaatcttacatgtcaatttgaag

SEQ ID NO: 4015 - DNA, 20 bp, Saccharomyces cerevisiae
gcaaaggaagaggaccacac

SEQ ID NO: 4016 - DNA, 23 bp, Saccharomyces cerevisiae
ggagaaatcaaaggaaaagaagc

SEQ ID NO: 4017 - DNA, 22 bp, Saccharomyces cerevisiae
aaatagggtccttaatgcatac

SEQ ID NO: 4018 - DNA, 27 bp, Saccharomyces cerevisiae
aatgagaagataaatccttcgtatgta

SEQ ID NO: 4019 - DNA, 25 bp, Saccharomyces cerevisiae
gatggtttgtaaccgtattcttctt

SEQ ID NO: 4020 - DNA, 23 bp, Saccharomyces cerevisiae
ttttctcttcttttccaatagcc

SEQ ID NO: 4021 - DNA, 27 bp, Saccharomyces cerevisiae
taagagaaatatattcttgacaagtcg

SEQ ID NO: 4022 - DNA, 25 bp, Saccharomyces cerevisiae
attatgagttcaaacgtgtcctttt

SEQ ID NO: 4023 - DNA, 27 bp, Saccharomyces cerevisiae
gttttattattactttttacaagttca

SEQ ID NO: 4024 - DNA, 27 bp, Saccharomyces cerevisiae
tctgcttagaggtgttacataaactaa

SEQ ID NO: 4025 - DNA, 26 bp, Saccharomyces cerevisiae
gcattgtatatgtatgtatgtatttt

SEQ ID NO: 4026 - DNA, 22 bp, Saccharomyces cerevisiae
atttcctttctgcacctcttcc

SEQ ID NO: 4027 - DNA, 25 bp, Saccharomyces cerevisiae
caaaagtttgcgtataataaaccag

SEQ ID NO: 4028 - DNA, 26 bp, Saccharomyces cerevisiae
ttctagtaaataatatccagcataca

SEQ ID NO: 4029 - DNA, 24 bp, Saccharomyces cerevisiae
aagcaaagtactatcaattgagcc

SEQ ID NO: 4030 - DNA, 20 bp, Saccharomyces cerevisiae
ttgaagcgcaccaacttaaa

SEQ ID NO: 4031 - DNA, 27 bp, Saccharomyces cerevisiae
ttattttctttttctatccacttcatt

SEQ ID NO: 4032 - DNA, 27 bp, Saccharomyces cerevisiae
ggtacagtacataaacagatgaatttt

SEQ ID NO: 4033 - DNA, 20 bp, Saccharomyces cerevisiae
tgaaaaaccttacccccaaa

SEQ ID NO: 4034 - DNA, 26 bp, Saccharomyces cerevisiae
aatatgtacatgatctttaattctga

SEQ ID NO: 4035 - DNA, 25 bp, Saccharomyces cerevisiae
ttatttcaaatttttcatgtccttg

SEQ ID NO: 4036 - DNA, 25 bp, Saccharomyces cerevisiae
cgttaagatgtcattctggttaagg

SEQ ID NO: 4037 - DNA, 23 bp, Saccharomyces cerevisiae
aactactcgtgcgcattttattt

SEQ ID NO: 4038 - DNA, 27 bp, Saccharomyces cerevisiae
cataaataagaatatgataagttctct

SEQ ID NO: 4039 - DNA, 26 bp, Saccharomyces cerevisiae
attcatacctttacgactaaagcagc

SEQ ID NO: 4040 - DNA, 26 bp, Saccharomyces cerevisiae
caatcagagtaagaatcatgatgaca

SEQ ID NO: 4041 - DNA, 27 bp, Saccharomyces cerevisiae
tttttttaaaaccattttttattctcg

SEQ ID NO: 4042 - DNA, 24 bp, Saccharomyces cerevisiae
tgaatacgcttcaagaagataaaa

SEQ ID NO: 4043 - DNA, 22 bp, Saccharomyces cerevisiae
acacttgtgtacactattacat

SEQ ID NO: 4044 - DNA, 26 bp, Saccharomyces cerevisiae
ttcgactaaggttgagtaaatttgtg

SEQ ID NO: 4045 - DNA, 27 bp, Saccharomyces cerevisiae
tatcgtaagctaaacgaggtgtatagt

SEQ ID NO: 4046 - DNA, 25 bp, Saccharomyces cerevisiae
acaagatcacagaaaataaacctca

SEQ ID NO: 4047 - DNA, 22 bp, Saccharomyces cerevisiae
cagcattgacgatagcgataag

SEQ ID NO: 4048 - DNA, 27 bp, Saccharomyces cerevisiae
gggtataaataaattgaactgaaagaa

SEQ ID NO: 4049 - DNA, 22 bp, Saccharomyces cerevisiae
aacctcttttgaagtatagcca

SEQ ID NO: 4050 - DNA, 21 bp, Saccharomyces cerevisiae
accagtctttaaccgccataa

SEQ ID NO: 4051 - DNA, 28 bp, Saccharomyces cerevisiae
atgtatataagaatataacaagaaagtc

SEQ ID NO: 4052 - DNA, 24 bp, Saccharomyces cerevisiae
ttgcttataatgaaaatcacaggt

SEQ ID NO: 4053 - DNA, 21 bp, Saccharomyces cerevisiae
aaaaacgcatgaagtggttta

SEQ ID NO: 4054 - DNA, 27 bp, Saccharomyces cerevisiae
accaacgataatgtaactataccaaga

SEQ ID NO: 4055 - DNA, 24 bp, Saccharomyces cerevisiae
aagcccctgaataccataaataga

SEQ ID NO: 4056 - DNA, 27 bp, Saccharomyces cerevisiae
tcagaacatcataaaataatagcaaca

SEQ ID NO: 4057 - DNA, 25 bp, Saccharomyces cerevisiae
ataatagttaatattctcccttttt

SEQ ID NO: 4058 - DNA, 24 bp, Saccharomyces cerevisiae
attttacggagtgaagactaacca

SEQ ID NO: 4059 - DNA, 23 bp, Saccharomyces cerevisiae
aaaagaggaagttcgaaccattt

SEQ ID NO: 4060 - DNA, 26 bp, Saccharomyces cerevisiae
ataatgtgatggttagttttcataag

SEQ ID NO: 4061 - DNA, 24 bp, Saccharomyces cerevisiae
tgtaagatatgtcataaatactgt

SEQ ID NO: 4062 - DNA, 27 bp, Saccharomyces cerevisiae
ggtaagaaatagagtgttgtatgatga

SEQ ID NO: 4063 - DNA, 21 bp, Saccharomyces cerevisiae
aaccaccattcattgtggaaa

SEQ ID NO: 4064 - DNA, 24 bp, Saccharomyces cerevisiae
tttctaaatattcttgtactctgg

SEQ ID NO: 4065 - DNA, 24 bp, Saccharomyces cerevisiae
aggagaatatttcaagatgcctca

SEQ ID NO: 4066 - DNA, 22 bp, Saccharomyces cerevisiae
tcaccaaataccccttcatctc

SEQ ID NO: 4067 - DNA, 25 bp, Saccharomyces cerevisiae
cccattatactttttcagctttcaa

SEQ ID NO: 4068 - DNA, 25 bp, Saccharomyces cerevisiae
tgttaatcctcttttaaagtactca

SEQ ID NO: 4069 - DNA, 27 bp, Saccharomyces cerevisiae
attttagttactttttctatttaagtt

SEQ ID NO: 4070 - DNA, 22 bp, Saccharomyces cerevisiae
gcttctgcttaatttttatact

SEQ ID NO: 4071 - DNA, 23 bp, Saccharomyces cerevisiae
gtctggacacaaagtatcgtttc

SEQ ID NO: 4072 - DNA, 24 bp, Saccharomyces cerevisiae
gccattagtagtgtactcaaacga

SEQ ID NO: 4073 - DNA, 25 bp, Saccharomyces cerevisiae
catgatgactgaacaaagcttatac

SEQ ID NO: 4074 - DNA, 25 bp, Saccharomyces cerevisiae
gacgtcgaataaataacttaatctt

SEQ ID NO: 4075 - DNA, 26 bp, Saccharomyces cerevisiae
tttactttagaggaagcaacaaactt

SEQ ID NO: 4076 - DNA, 26 bp, Saccharomyces cerevisiae
acttagaacatacgactaaaaacgaa

SEQ ID NO: 4077 - DNA, 25 bp, Saccharomyces cerevisiae
gaataatgagaagcgagaagaattt

SEQ ID NO: 4078 - DNA, 21 bp, Saccharomyces cerevisiae
cagagaccgtgatgtcgtcaa

SEQ ID NO: 4079 - DNA, 24 bp, Saccharomyces cerevisiae
cggaaatatgatgaaaactatgtg

SEQ ID NO: 4080 - DNA, 21 bp, Saccharomyces cerevisiae
tctcgaggcttttgaagagaa

SEQ ID NO: 4081 - DNA, 27 bp, Saccharomyces cerevisiae
ctgtcctctgcttttctttatctattt

SEQ ID NO: 4082 - DNA, 27 bp, Saccharomyces cerevisiae
atagagtacacatattagcatgtaccg

SEQ ID NO: 4083 - DNA, 26 bp, Saccharomyces cerevisiae
taaataattcgctgatttcataactg

SEQ ID NO: 4084 - DNA, 18 bp, Saccharomyces cerevisiae
aggcggtggcgtatcatt

SEQ ID NO: 4085 - DNA, 20 bp, Saccharomyces cerevisiae
ctcactttctttcgcatcgc

SEQ ID NO: 4086 - DNA, 22 bp, Saccharomyces cerevisiae
aataaatcactgatgataatgc

SEQ ID NO: 4087 - DNA, 21 bp, Saccharomyces cerevisiae
ctctttcgaaaagacagcgag

SEQ ID NO: 4088 - DNA, 21 bp, Saccharomyces cerevisiae
aaaaaaatgaatggtatagaa

SEQ ID NO: 4089 - DNA, 27 bp, Saccharomyces cerevisiae
taaaaagttgttatataagggttttcg

SEQ ID NO: 4090 - DNA, 25 bp, Saccharomyces cerevisiae
attggtaactgaacgttaatcatgt

SEQ ID NO: 4091 - DNA, 24 bp, Saccharomyces cerevisiae
aaagtgaatatccaaacgagaatg

SEQ ID NO: 4092 - DNA, 21 bp, Saccharomyces cerevisiae
tgacttgcaacgaataaatgc

SEQ ID NO: 4093 - DNA, 21 bp, Saccharomyces cerevisiae
tgttataattatccccgccaa

SEQ ID NO: 4094 - DNA, 18 bp, Saccharomyces cerevisiae
aaaggggagctgtcccac

SEQ ID NO: 4095 - DNA, 20 bp, Saccharomyces cerevisiae
taatcgcactcgcatctgtc

SEQ ID NO: 4096 - DNA, 27 bp, Saccharomyces cerevisiae
tctaatatgtaaatatgtatccgtaaa

SEQ ID NO: 4097 - DNA, 25 bp, Saccharomyces cerevisiae
ccctgagatttagtttgatatcgtt

SEQ ID NO: 4098 - DNA, 27 bp, Saccharomyces cerevisiae
ttgatttatcgtaataatttggacagc

SEQ ID NO: 4099 - DNA, 26 bp, Saccharomyces cerevisiae
atgtctacatacatacatacatctcg

SEQ ID NO: 4100 - DNA, 19 bp, Saccharomyces cerevisiae
gaaagtggctctgatcccg

SEQ ID NO: 4101 - DNA, 27 bp, Saccharomyces cerevisiae
tacataacatttatagcgtaacgatga

SEQ ID NO: 4102 - DNA, 20 bp, Saccharomyces cerevisiae
aatgggagtttctgtctccc

SEQ ID NO: 4103 - DNA, 21 bp, Saccharomyces cerevisiae
tggtgctcttaatgttttccc

SEQ ID NO: 4104 - DNA, 22 bp, Saccharomyces cerevisiae
caagtccgttaaaaagatataa

SEQ ID NO: 4105 - DNA, 25 bp, Saccharomyces cerevisiae
tgataatatacttgaataaaaaccg

SEQ ID NO: 4106 - DNA, 27 bp, Saccharomyces cerevisiae
gagaagtaattcaccacagaacttttt

SEQ ID NO: 4107 - DNA, 27 bp, Saccharomyces cerevisiae
acatagcacttatgatattttcattcc

SEQ ID NO: 4108 - DNA, 24 bp, Saccharomyces cerevisiae
tcatcatgactgttacctgatttt

SEQ ID NO: 4109 - DNA, 25 bp, Saccharomyces cerevisiae
tgaggggctacataacattatttct

SEQ ID NO: 4110 - DNA, 21 bp, Saccharomyces cerevisiae
tcctctggcgtttcttatcaa

SEQ ID NO: 4111 - DNA, 26 bp, Saccharomyces cerevisiae
taaatcgttattttgtctgacttttc

SEQ ID NO: 4112 - DNA, 27 bp, Saccharomyces cerevisiae
tacagatttgcaaaagttaaataaaca

SEQ ID NO: 4113 - DNA, 21 bp, Saccharomyces cerevisiae
ctcaggaaaagttggcgatag

SEQ ID NO: 4114 - DNA, 25 bp, Saccharomyces cerevisiae
gaataagcaggagtccataatgttt

SEQ ID NO: 4115 - DNA, 27 bp, Saccharomyces cerevisiae
tttaacaaagatagtttgaaaatagtg

SEQ ID NO: 4116 - DNA, 25 bp, Saccharomyces cerevisiae
agggcttaatgagtattttatctgc

SEQ ID NO: 4117 - DNA, 23 bp, Saccharomyces cerevisiae
aattttacaaatagccttgcgtc

SEQ ID NO: 4118 - DNA, 26 bp, Saccharomyces cerevisiae
tgaaaacaatcaggagaatacctaaa

SEQ ID NO: 4119 - DNA, 26 bp, Saccharomyces cerevisiae
ctacgtaaacttgcctgtacataaac

SEQ ID NO: 4120 - DNA, 23 bp, Saccharomyces cerevisiae
agcaaagaaagagcacacataat

SEQ ID NO: 4121 - DNA, 25 bp, Saccharomyces cerevisiae
aaaatgtgattgttaataaggggtg

SEQ ID NO: 4122 - DNA, 24 bp, Saccharomyces cerevisiae
atgctcttatgattgtcacttatt

SEQ ID NO: 4123 - DNA, 27 bp, Saccharomyces cerevisiae
atcaaacatcgttatttcattcttaca

SEQ ID NO: 4124 - DNA, 27 bp, Saccharomyces cerevisiae
gttgcatagctgctagtaattatatgg

SEQ ID NO: 4125 - DNA, 20 bp, Saccharomyces cerevisiae
atcttctctccggctccttc

SEQ ID NO: 4126 - DNA, 27 bp, Saccharomyces cerevisiae
tgaacaaaaattacatctccattatag

SEQ ID NO: 4127 - DNA, 21 bp, Saccharomyces cerevisiae
gtgaggctgaagctttttacg

SEQ ID NO: 4128 - DNA, 21 bp, Saccharomyces cerevisiae
gcaagtgcttgagcttcaata

SEQ ID NO: 4129 - DNA, 23 bp, Saccharomyces cerevisiae
tttaatacaactttggttacata

SEQ ID NO: 4130 - DNA, 27 bp, Saccharomyces cerevisiae
gatcaattcgatatgtaacatttttct

SEQ ID NO: 4131 - DNA, 25 bp, Saccharomyces cerevisiae
gcatatacaacattcgttaatggtc

SEQ ID NO: 4132 - DNA, 22 bp, Saccharomyces cerevisiae
ggctctgaatgagtcaaaagtt

SEQ ID NO: 4133 - DNA, 19 bp, Saccharomyces cerevisiae
tgcagaaggcaacatctcc

SEQ ID NO: 4134 - DNA, 27 bp, Saccharomyces cerevisiae
atggaataaataagtcatatgtaaggc

SEQ ID NO: 4135 - DNA, 24 bp, Saccharomyces cerevisiae
atgttctcctgattacttgcatta

SEQ ID NO: 4136 - DNA, 24 bp, Saccharomyces cerevisiae
acaagctctttgaaaccaattttt

SEQ ID NO: 4137 - DNA, 27 bp, Saccharomyces cerevisiae
tattatttttaaagacatttttttttc

SEQ ID NO: 4138 - DNA, 27 bp, Saccharomyces cerevisiae
aaagatgattagaaatgagaacgtaaa

SEQ ID NO: 4139 - DNA, 22 bp, Saccharomyces cerevisiae
aaacggcgatatatattgggca

SEQ ID NO: 4140 - DNA, 23 bp, Saccharomyces cerevisiae
ccttgaacaggttggatattttt

SEQ ID NO: 4141 - DNA, 24 bp, Saccharomyces cerevisiae
tttaatgtccctaaccactcattc

SEQ ID NO: 4142 - DNA, 20 bp, Saccharomyces cerevisiae
tgagtaaatcgccctgaaag

SEQ ID NO: 4143 - DNA, 25 bp, Saccharomyces cerevisiae
tctacctcgtttggtatatttatcg

SEQ ID NO: 4144 - DNA, 23 bp, Saccharomyces cerevisiae
atctctttatgggtttcgctttt

SEQ ID NO: 4145 - DNA, 24 bp, Saccharomyces cerevisiae
agtggctacttgagacaagttttg

SEQ ID NO: 4146 - DNA, 25 bp, Saccharomyces cerevisiae
ttgtaagggaaaatatgcatgtacc

SEQ ID NO: 4147 - DNA, 27 bp, Saccharomyces cerevisiae
attggtgtctgatcactgtgtatagta

SEQ ID NO: 4148 - DNA, 24 bp, Saccharomyces cerevisiae
gcaaactaacttcaaaacgttaaa

SEQ ID NO: 4149 - DNA, 27 bp, Saccharomyces cerevisiae
tgatttttatttacagcctcaactaat

SEQ ID NO: 4150 - DNA, 20 bp, Saccharomyces cerevisiae
gacactttcgccgacttcta

SEQ ID NO: 4151 - DNA, 27 bp, Saccharomyces cerevisiae
aatgtttaatcgtttattttttctttc

SEQ ID NO: 4152 - DNA, 22 bp, Saccharomyces cerevisiae
cggcaatagaggaactaatcaa

SEQ ID NO: 4153 - DNA, 27 bp, Saccharomyces cerevisiae
aaacatcaattgctatgttgtaaatgg

SEQ ID NO: 4154 - DNA, 20 bp, Saccharomyces cerevisiae
cgggccgcaatattagtaca

SEQ ID NO: 4155 - DNA, 24 bp, Saccharomyces cerevisiae
attcaatgatttcctttttgttcg

SEQ ID NO: 4156 - DNA, 27 bp, Saccharomyces cerevisiae
ttggataaaggattttaggaaaataaa

SEQ ID NO: 4157 - DNA, 25 bp, Saccharomyces cerevisiae
tctgattcatacaactcattgatcc

SEQ ID NO: 4158 - DNA, 27 bp, Saccharomyces cerevisiae
gtataatcagttctgtataccaccaca

SEQ ID NO: 4159 - DNA, 22 bp, Saccharomyces cerevisiae
ttctgatcactttggtttttca

SEQ ID NO: 4160 - DNA, 27 bp, Saccharomyces cerevisiae
aatatgtttgaataatttatcatgccc

SEQ ID NO: 4161 - DNA, 28 bp, Saccharomyces cerevisiae
gattacctttacgtaactagtctcttcg

SEQ ID NO: 4162 - DNA, 24 bp, Saccharomyces cerevisiae
ttttgatatgtgccatttcttttt

SEQ ID NO: 4163 - DNA, 25 bp, Saccharomyces cerevisiae
aagtgatgacgttattttccttttt

SEQ ID NO: 4164 - DNA, 27 bp, Saccharomyces cerevisiae
cttctacattgattacaaaagacaaaa

SEQ ID NO: 4165 - DNA, 20 bp, Saccharomyces cerevisiae
gacgactgtgctcatctccc

SEQ ID NO: 4166 - DNA, 21 bp, Saccharomyces cerevisiae
atggggatctgtgaaattgaa

SEQ ID NO: 4167 - DNA, 23 bp, Saccharomyces cerevisiae
caggaaccataaatgttcaaacc

SEQ ID NO: 4168 - DNA, 24 bp, Saccharomyces cerevisiae
tcaccctttagagagacatttttg

SEQ ID NO: 4169 - DNA, 24 bp, Saccharomyces cerevisiae
taagatcttcactctgtacacgct

SEQ ID NO: 4170 - DNA, 27 bp, Saccharomyces cerevisiae
acaatataatcaaattcggtagagaag

SEQ ID NO: 4171 - DNA, 27 bp, Saccharomyces cerevisiae
attctaagtaaaaagaacggattatga

SEQ ID NO: 4172 - DNA, 24 bp, Saccharomyces cerevisiae
ggcgacaagtaagaaaaatgtaaa

SEQ ID NO: 4173 - DNA, 25 bp, Saccharomyces cerevisiae
aaaacgcaccaagtaagtaagtaaa

SEQ ID NO: 4174 - DNA, 20 bp, Saccharomyces cerevisiae
caggtttacacaatcgcacg

SEQ ID NO: 4175 - DNA, 24 bp, Saccharomyces cerevisiae
tggaattgattgtgtaaagaaatg

SEQ ID NO: 4176 - DNA, 20 bp, Saccharomyces cerevisiae
gacgttgaagccacatccat

SEQ ID NO: 4177 - DNA, 20 bp, Saccharomyces cerevisiae
acttagtgatcggaacgagc

SEQ ID NO: 4178 - DNA, 19 bp, Saccharomyces cerevisiae
aaacgccattaattgccac

SEQ ID NO: 4179 - DNA, 27 bp, Saccharomyces cerevisiae
ttaattaatgtcttcctctttgtctcg

SEQ ID NO: 4180 - DNA, 23 bp, Saccharomyces cerevisiae
aaacaaaaagcacacaaagttgc

SEQ ID NO: 4181 - DNA, 20 bp, Saccharomyces cerevisiae
tgattggggtgtcaacgtaa

SEQ ID NO: 4182 - DNA, 23 bp, Saccharomyces cerevisiae
cgatgatacattgatttgtttgg

SEQ ID NO: 4183 - DNA, 24 bp, Saccharomyces cerevisiae
aaataggccagatttgataaaaca

SEQ ID NO: 4184 - DNA, 25 bp, Saccharomyces cerevisiae
tgccagtaatcctacaactaagaaa

SEQ ID NO: 4185 - DNA, 22 bp, Saccharomyces cerevisiae
ctactcgcaggaagagttcatt

SEQ ID NO: 4186 - DNA, 22 bp, Saccharomyces cerevisiae
aaaaaaaaaataaaagcgacga

SEQ ID NO: 4187 - DNA, 19 bp, Saccharomyces cerevisiae
taattctgcgactgtgggc

SEQ ID NO: 4188 - DNA, 27 bp, Saccharomyces cerevisiae
gtgtaaaattcaaagtaatttccatcg

SEQ ID NO: 4189 - DNA, 25 bp, Saccharomyces cerevisiae
attaatgcttttgcctttagttttt

SEQ ID NO: 4190 - DNA, 19 bp, Saccharomyces cerevisiae
ctctaagcgagccgacacc

SEQ ID NO: 4191 - DNA, 27 bp, Saccharomyces cerevisiae
aatatatagcactagatttattttccg

SEQ ID NO: 4192 - DNA, 21 bp, Saccharomyces cerevisiae
acctctccttggagattctga

SEQ ID NO: 4193 - DNA, 27 bp, Saccharomyces cerevisiae
gaaatttttagccaaataaaataatgg

SEQ ID NO: 4194 - DNA, 26 bp, Saccharomyces cerevisiae
tccttttacttatataattctcatcg

SEQ ID NO: 4195 - DNA, 27 bp, Saccharomyces cerevisiae
acctaactattaaagaaagaagaaaaa

SEQ ID NO: 4196 - DNA, 20 bp, Saccharomyces cerevisiae
tttttgcagacatttttgat

SEQ ID NO: 4197 - DNA, 25 bp, Saccharomyces cerevisiae
gaccgataaaaagagattatacgga

SEQ ID NO: 4198 - DNA, 27 bp, Saccharomyces cerevisiae
tcataggtatttgtaaagtccaagaaa

SEQ ID NO: 4199 - DNA, 18 bp, Saccharomyces cerevisiae
taaacagcgtgagggggc

SEQ ID NO: 4200 - DNA, 24 bp, Saccharomyces cerevisiae
gactaggggacacttcattcattt

SEQ ID NO: 4201 - DNA, 26 bp, Saccharomyces cerevisiae
aagaaatagacattttgtgtcgaaaa

SEQ ID NO: 4202 - DNA, 27 bp, Saccharomyces cerevisiae
tgacactttacttaatcttttccttcg

SEQ ID NO: 4203 - DNA, 24 bp, Saccharomyces cerevisiae
gtttggctttcctatttctttttc

SEQ ID NO: 4204 - DNA, 26 bp, Saccharomyces cerevisiae
catgactcatcttataaggaaaaagg

SEQ ID NO: 4205 - DNA, 21 bp, Saccharomyces cerevisiae
gtggcttgagctgtggataag

SEQ ID NO: 4206 - DNA, 22 bp, Saccharomyces cerevisiae
tagagcgaataaaatgtcaccg

SEQ ID NO: 4207 - DNA, 23 bp, Saccharomyces cerevisiae
tattattcgcaagcttctctcaa

SEQ ID NO: 4208 - DNA, 26 bp, Saccharomyces cerevisiae
gccaccaagtagctatatagaatcaa

SEQ ID NO: 4209 - DNA, 20 bp, Saccharomyces cerevisiae
ttgtttttgcgtgtttctcg

SEQ ID NO: 4210 - DNA, 23 bp, Saccharomyces cerevisiae
cgattgagtttcccataattttt

SEQ ID NO: 4211 - DNA, 22 bp, Saccharomyces cerevisiae
aacatcaggatagtgtgcaacg

SEQ ID NO: 4212 - DNA, 26 bp, Saccharomyces cerevisiae
gctaagaaatagagataataagataa

SEQ ID NO: 4213 - DNA, 25 bp, Saccharomyces cerevisiae
aaaatcatacattcatataatatcc

SEQ ID NO: 4214 - DNA, 24 bp, Saccharomyces cerevisiae
atatattcatcgatttttttcctg

SEQ ID NO: 4215 - DNA, 27 bp, Saccharomyces cerevisiae
gaaatatggtaaacagaaaatgaaaaa

SEQ ID NO: 4216 - DNA, 23 bp, Saccharomyces cerevisiae
ctacccattacctgattgaaagc

SEQ ID NO: 4217 - DNA, 27 bp, Saccharomyces cerevisiae
aaatatacgcgactataactttttccc

SEQ ID NO: 4218 - DNA, 26 bp, Saccharomyces cerevisiae
gcgtaagagatacgtctacgatagca

SEQ ID NO: 4219 - DNA, 23 bp, Saccharomyces cerevisiae
ttttccgtactctccaagataaa

SEQ ID NO: 4220 - DNA, 21 bp, Saccharomyces cerevisiae
ataaaagggggcagaacagtc

SEQ ID NO: 4221 - DNA, 26 bp, Saccharomyces cerevisiae
tataccatgtttgttatatagagttt

SEQ ID NO: 4222 - DNA, 25 bp, Saccharomyces cerevisiae
catagaattgttcacgtggtctaaa

SEQ ID NO: 4223 - DNA, 27 bp, Saccharomyces cerevisiae
gctaccaaataatctatactaaaaatg

SEQ ID NO: 4224 - DNA, 24 bp, Saccharomyces cerevisiae
gctgctatttagcttttctaattt

SEQ ID NO: 4225 - DNA, 27 bp, Saccharomyces cerevisiae
agataactagaaatacactcttatctt

SEQ ID NO: 4226 - DNA, 25 bp, Saccharomyces cerevisiae
gaacttcgttaaaaacattcaaaaa

SEQ ID NO: 4227 - DNA, 21 bp, Saccharomyces cerevisiae
tttcacgctaaaccgtagtgc

SEQ ID NO: 4228 - DNA, 27 bp, Saccharomyces cerevisiae
tgcagatgaatataaagataagtacgc

SEQ ID NO: 4229 - DNA, 26 bp, Saccharomyces cerevisiae
atatatgtaagcactctatttgtacg

SEQ ID NO: 4230 - DNA, 27 bp, Saccharomyces cerevisiae
atcatatatcttgtactaaattttgcg

SEQ ID NO: 4231 - DNA, 27 bp, Saccharomyces cerevisiae
acaaaaattgaaccaaaagctatagta

SEQ ID NO: 4232 - DNA, 27 bp, Saccharomyces cerevisiae
gcttgttgtctacaaattataaaatag

SEQ ID NO: 4233 - DNA, 20 bp, Saccharomyces cerevisiae
cagttgcaaaacctttcacg

SEQ ID NO: 4234 - DNA, 25 bp, Saccharomyces cerevisiae
tacgatttcataattcgaaaaattc

SEQ ID NO: 4235 - DNA, 26 bp, Saccharomyces cerevisiae
gatgtgtaattggtaaagatattgat

SEQ ID NO: 4236 - DNA, 22 bp, Saccharomyces cerevisiae
aaccattttccgtcatttatgg

SEQ ID NO: 4237 - DNA, 20 bp, Saccharomyces cerevisiae
gcaataaatgggtgcagttt

SEQ ID NO: 4238 - DNA, 25 bp, Saccharomyces cerevisiae
tggtaaatagaaacggaactttaca

SEQ ID NO: 4239 - DNA, 22 bp, Saccharomyces cerevisiae
gcattcatctaggttctccaca

SEQ ID NO: 4240 - DNA, 26 bp, Saccharomyces cerevisiae
gcatgaattaagatcatcgtagtaag

SEQ ID NO: 4241 - DNA, 20 bp, Saccharomyces cerevisiae
tgagcgcctaacgttacagt

SEQ ID NO: 4242 - DNA, 23 bp, Saccharomyces cerevisiae
caataagttcgcatagaaaataa

SEQ ID NO: 4243 - DNA, 27 bp, Saccharomyces cerevisiae
tgttcataagtaataaatgccgtatag

SEQ ID NO: 4244 - DNA, 23 bp, Saccharomyces cerevisiae
gtgtttgttgtttatgtatccgc

SEQ ID NO: 4245 - DNA, 27 bp, Saccharomyces cerevisiae
ctctaggtatgtaccctgtgtattttc

SEQ ID NO: 4246 - DNA, 20 bp, Saccharomyces cerevisiae
cattctcgccaccttggaat

SEQ ID NO: 4247 - DNA, 22 bp, Saccharomyces cerevisiae
taggagactcttatacgtcggc

SEQ ID NO: 4248 - DNA, 26 bp, Saccharomyces cerevisiae
ttagctatatgtacgttgttagtgcc

SEQ ID NO: 4249 - DNA, 26 bp, Saccharomyces cerevisiae
atataagtgattagtatagtttttca

SEQ ID NO: 4250 - DNA, 23 bp, Saccharomyces cerevisiae
gaaattgtggggattatttttcg

SEQ ID NO: 4251 - DNA, 24 bp, Saccharomyces cerevisiae
ctttgatatccattcattgacgtg

SEQ ID NO: 4252 - DNA, 23 bp, Saccharomyces cerevisiae
gccgagatacataaggttgaaga

SEQ ID NO: 4253 - DNA, 27 bp, Saccharomyces cerevisiae
atgtgttgagtgttgttctataaatgc

SEQ ID NO: 4254 - DNA, 26 bp, Saccharomyces cerevisiae
aatttgtaactctatgtatgcttttt

SEQ ID NO: 4255 - DNA, 24 bp, Saccharomyces cerevisiae
aactagggaggcaaaaatacaaaa

SEQ ID NO: 4256 - DNA, 27 bp, Saccharomyces cerevisiae
tagaatttcctatttttattcattcca

SEQ ID NO: 4257 - DNA, 23 bp, Saccharomyces cerevisiae
cttcgaattggaaatactgtgag

SEQ ID NO: 4258 - DNA, 24 bp, Saccharomyces cerevisiae
acggcttgaaagtaaaacatagaa

SEQ ID NO: 4259 - DNA, 27 bp, Saccharomyces cerevisiae
atcaacagataacaatcagtctttctt

SEQ ID NO: 4260 - DNA, 23 bp, Saccharomyces cerevisiae
aatagaaaacggaggaggttttt

SEQ ID NO: 4261 - DNA, 23 bp, Saccharomyces cerevisiae
tcctgacgctttttatttcattt

SEQ ID NO: 4262 - DNA, 22 bp, Saccharomyces cerevisiae
gtgcacactttcaagctaacac

SEQ ID NO: 4263 - DNA, 25 bp, Saccharomyces cerevisiae
ttgcaaaactagagtgttactgtga

SEQ ID NO: 4264 - DNA, 27 bp, Saccharomyces cerevisiae
gtgtaagtttattatgtatttcgagca

SEQ ID NO: 4265 - DNA, 19 bp, Saccharomyces cerevisiae
agcagtggcaaattgcata

SEQ ID NO: 4266 - DNA, 24 bp, Saccharomyces cerevisiae
tatgaagaataaagacatctagtc

SEQ ID NO: 4267 - DNA, 27 bp, Saccharomyces cerevisiae
gtggcttaaataagaagaaatgtatca

SEQ ID NO: 4268 - DNA, 27 bp, Saccharomyces cerevisiae
ttttcagtataatgttacatgcgtaca

SEQ ID NO: 4269 - DNA, 23 bp, Saccharomyces cerevisiae
acatatattgctcaaaacgcaca

SEQ ID NO: 4270 - DNA, 23 bp, Saccharomyces cerevisiae
aactaggatcaaggatgcataga

SEQ ID NO: 4271 - DNA, 26 bp, Saccharomyces cerevisiae
cttgattaatataggtgaaacataag

SEQ ID NO: 4272 - DNA, 24 bp, Saccharomyces cerevisiae
tttcttttattgagacttattttt

SEQ ID NO: 4273 - DNA, 22 bp, Saccharomyces cerevisiae
aattcacgctaaaaggaatacg

SEQ ID NO: 4274 - DNA, 24 bp, Saccharomyces cerevisiae
ttcccataaaatggaagttatcaa

SEQ ID NO: 4275 - DNA, 21 bp, Saccharomyces cerevisiae
aattcgttcttcggatagctt

SEQ ID NO: 4276 - DNA, 26 bp, Saccharomyces cerevisiae
gtttaagcatacatttatgtgcactg

SEQ ID NO: 4277 - DNA, 24 bp, Saccharomyces cerevisiae
tttctttgaacaggtattttgagc

SEQ ID NO: 4278 - DNA, 23 bp, Saccharomyces cerevisiae
ttgaacgtgtgatcttttccttc

SEQ ID NO: 4279 - DNA, 22 bp, Saccharomyces cerevisiae
tcttagtttggctttaacaatg

SEQ ID NO: 4280 - DNA, 27 bp, Saccharomyces cerevisiae
tcataagcattataatctatttcgcta

SEQ ID NO: 4281 - DNA, 21 bp, Saccharomyces cerevisiae
agttttctgttgtgtggcagc

SEQ ID NO: 4282 - DNA, 23 bp, Saccharomyces cerevisiae
taaggagggcaatttattgagtg

SEQ ID NO: 4283 - DNA, 27 bp, Saccharomyces cerevisiae
ttatatgtgtacttgaaattccatgcg

SEQ ID NO: 4284 - DNA, 25 bp, Saccharomyces cerevisiae
ctcttttcctaatattgcgagttca

SEQ ID NO: 4285 - DNA, 20 bp, Saccharomyces cerevisiae
tcgacgaggggcatacttac

SEQ ID NO: 4286 - DNA, 19 bp, Saccharomyces cerevisiae
accaaaccaacacacgtcg

SEQ ID NO: 4287 - DNA, 22 bp, Saccharomyces cerevisiae
tacaacgcctaatctcaagtag

SEQ ID NO: 4288 - DNA, 25 bp, Saccharomyces cerevisiae
tgaaagtattgtctgcacattacca

SEQ ID NO: 4289 - DNA, 26 bp, Saccharomyces cerevisiae
ctctcctaatacttttacagcaatca

SEQ ID NO: 4290 - DNA, 20 bp, Saccharomyces cerevisiae
gtaaattggcactcaggcac

SEQ ID NO: 4291 - DNA, 20 bp, Saccharomyces cerevisiae
tttgcgagacaagcgaagag

SEQ ID NO: 4292 - DNA, 23 bp, Saccharomyces cerevisiae
gcctcatgaaaatcaaagttagc

SEQ ID NO: 4293 - DNA, 25 bp, Saccharomyces cerevisiae
ataatatttatccagagaaagcgcc

SEQ ID NO: 4294 - DNA, 20 bp, Saccharomyces cerevisiae
atgcaatgtatccggttgcc

SEQ ID NO: 4295 - DNA, 22 bp, Saccharomyces cerevisiae
gaaaatgcgtttttcagtttca

SEQ ID NO: 4296 - DNA, 27 bp, Saccharomyces cerevisiae
acattgtttataatatctttctggcct

SEQ ID NO: 4297 - DNA, 21 bp, Saccharomyces cerevisiae
gaaaatgttgccgattttgtt

SEQ ID NO: 4298 - DNA, 25 bp, Saccharomyces cerevisiae
caaaaagatatatacaaacatagga

SEQ ID NO: 4299 - DNA, 23 bp, Saccharomyces cerevisiae
aaggactttataacgaaaaagcg

SEQ ID NO: 4300 - DNA, 24 bp, Saccharomyces cerevisiae
tttccagctgcataatctgtagac

SEQ ID NO: 4301 - DNA, 24 bp, Saccharomyces cerevisiae
cctacatttcctctgatgactgtg

SEQ ID NO: 4302 - DNA, 27 bp, Saccharomyces cerevisiae
gccttatatatgaataattccaactga

SEQ ID NO: 4303 - DNA, 24 bp, Saccharomyces cerevisiae
attgagttgcatagatgttagcca

SEQ ID NO: 4304 - DNA, 24 bp, Saccharomyces cerevisiae
tcccatatataataatagaaacaa

SEQ ID NO: 4305 - DNA, 20 bp, Saccharomyces cerevisiae
atggccaaaaacgacagatg

SEQ ID NO: 4306 - DNA, 20 bp, Saccharomyces cerevisiae
tgaaggaagcacgtcagaaa

SEQ ID NO: 4307 - DNA, 21 bp, Saccharomyces cerevisiae
tagcccaaatctataatgcca

SEQ ID NO: 4308 - DNA, 20 bp, Saccharomyces cerevisiae
cagcccaactgataacgaaa

SEQ ID NO: 4309 - DNA, 24 bp, Saccharomyces cerevisiae
gaattaaattagggagaatataca

SEQ ID NO: 4310 - DNA, 22 bp, Saccharomyces cerevisiae
ccttttgattaggaaaagtcca

SEQ ID NO: 4311 - DNA, 27 bp, Saccharomyces cerevisiae
cgtagagaaaataattaaatagtggca

SEQ ID NO: 4312 - DNA, 24 bp, Saccharomyces cerevisiae
acacaggagaaacaattccataaa

SEQ ID NO: 4313 - DNA, 27 bp, Saccharomyces cerevisiae
caataaaacaacaccaaataatgtaga

SEQ ID NO: 4314 - DNA, 22 bp, Saccharomyces cerevisiae
tttcgatgtgcttgttacttgc

SEQ ID NO: 4315 - DNA, 26 bp, Saccharomyces cerevisiae
caagatacatagaccatacaactaca

SEQ ID NO: 4316 - DNA, 18 bp, Saccharomyces cerevisiae
gcgcatccacgcttcttt

SEQ ID NO: 4317 - DNA, 20 bp, Saccharomyces cerevisiae
aggcattaaaagaggagcga

SEQ ID NO: 4318 - DNA, 21 bp, Saccharomyces cerevisiae
ttatctccctggaaggtatcc

SEQ ID NO: 4319 - DNA, 27 bp, Saccharomyces cerevisiae
tatttttatgaatttagaagtgacccc

SEQ ID NO: 4320 - DNA, 27 bp, Saccharomyces cerevisiae
taggtcaaactctatttttatacagca

SEQ ID NO: 4321 - DNA, 25 bp, Saccharomyces cerevisiae
tagagaggtaaatacgttggaagaa

SEQ ID NO: 4322 - DNA, 24 bp, Saccharomyces cerevisiae
gggccttaaaaacatttacatacc

SEQ ID NO: 4323 - DNA, 26 bp, Saccharomyces cerevisiae
aaaacattgatgttatggacactttt

SEQ ID NO: 4324 - DNA, 23 bp, Saccharomyces cerevisiae
aattaatatattcgaacctttct

SEQ ID NO: 4325 - DNA, 24 bp, Saccharomyces cerevisiae
taagtctagcgaaattagaaaaat

SEQ ID NO: 4326 - DNA, 24 bp, Saccharomyces cerevisiae
tttgacgttttattccttttcttc

SEQ ID NO: 4327 - DNA, 26 bp, Saccharomyces cerevisiae
tgaaaacttagaatggacagagtacc

SEQ ID NO: 4328 - DNA, 22 bp, Saccharomyces cerevisiae
attgtcagttagtctgcttttt

SEQ ID NO: 4329 - DNA, 26 bp, Saccharomyces cerevisiae
ttctcgaaaagtactacaatcttccc

SEQ ID NO: 4330 - DNA, 24 bp, Saccharomyces cerevisiae
cgtgtaggatagtgtcatctattt

SEQ ID NO: 4331 - DNA, 25 bp, Saccharomyces cerevisiae
ttgtaaaaccaaaacactaccatcc

SEQ ID NO: 4332 - DNA, 23 bp, Saccharomyces cerevisiae
taaactgataagattattcaagc

SEQ ID NO: 4333 - DNA, 25 bp, Saccharomyces cerevisiae
atagatttctatacactttccgcca

SEQ ID NO: 4334 - DNA, 25 bp, Saccharomyces cerevisiae
aacagctgcttgggttatatagtcg

SEQ ID NO: 4335 - DNA, 27 bp, Saccharomyces cerevisiae
ataagatactgaaaactagagctagaa

SEQ ID NO: 4336 - DNA, 20 bp, Saccharomyces cerevisiae
aaccttgtccctcatgtgaa

SEQ ID NO: 4337 - DNA, 25 bp, Saccharomyces cerevisiae
tctcatttcaacgactctctttttc

SEQ ID NO: 4338 - DNA, 27 bp, Saccharomyces cerevisiae
atccttgtttaagtaaaccatttatgt

SEQ ID NO: 4339 - DNA, 27 bp, Saccharomyces cerevisiae
cagtaaaataagcaataaataatcggt

SEQ ID NO: 4340 - DNA, 25 bp, Saccharomyces cerevisiae
gccttgtaatattgcattacattct

SEQ ID NO: 4341 - DNA, 27 bp, Saccharomyces cerevisiae
actttataacacttactgggtttcacc

SEQ ID NO: 4342 - DNA, 27 bp, Saccharomyces cerevisiae
gagtagtctgctcagaattttatcttt

SEQ ID NO: 4343 - DNA, 25 bp, Saccharomyces cerevisiae
gacgtggataaaataattcgtttgc

SEQ ID NO: 4344 - DNA, 27 bp, Saccharomyces cerevisiae
caatcctaagtattttcatttacgatg

SEQ ID NO: 4345 - DNA, 18 bp, Saccharomyces cerevisiae
ggcttgcagcgttgtctt

SEQ ID NO: 4346 - DNA, 26 bp, Saccharomyces cerevisiae
attatttttcttcttcctttttctca

SEQ ID NO: 4347 - DNA, 25 bp, Saccharomyces cerevisiae
gtcatgtactgacccattaattttc

SEQ ID NO: 4348 - DNA, 25 bp, Saccharomyces cerevisiae
acaatatatacctatgcccttgacc

SEQ ID NO: 4349 - DNA, 25 bp, Saccharomyces cerevisiae
tgaatagtgggtaatttgtctttca

SEQ ID NO: 4350 - DNA, 20 bp, Saccharomyces cerevisiae
gcaacttcttttcgatggct

SEQ ID NO: 4351 - DNA, 27 bp, Saccharomyces cerevisiae
agaatatatactccacatgacatacga

SEQ ID NO: 4352 - DNA, 26 bp, Saccharomyces cerevisiae
gagtaggttagtttataatgttatgt

SEQ ID NO: 4353 - DNA, 23 bp, Saccharomyces cerevisiae
tatgcgcagtaatttttgtatgg

SEQ ID NO: 4354 - DNA, 23 bp, Saccharomyces cerevisiae
caatctctgcttttgtacattcg

SEQ ID NO: 4355 - DNA, 27 bp, Saccharomyces cerevisiae
ctcctgtgaaattaaaagtattctcca

SEQ ID NO: 4356 - DNA, 24 bp, Saccharomyces cerevisiae
attcccttcgaagtatgcattcac

SEQ ID NO: 4357 - DNA, 25 bp, Saccharomyces cerevisiae
ttattattattagttaccatgggtc

SEQ ID NO: 4358 - DNA, 20 bp, Saccharomyces cerevisiae
gaaagtgggcaggcgatact

SEQ ID NO: 4359 - DNA, 27 bp, Saccharomyces cerevisiae
tcatttctgtataagttttctcaactg

SEQ ID NO: 4360 - DNA, 26 bp, Saccharomyces cerevisiae
aaatcgcttttattcttacctttatg

SEQ ID NO: 4361 - DNA, 20 bp, Saccharomyces cerevisiae
caaagacgttgtttcatcgc

SEQ ID NO: 4362 - DNA, 22 bp, Saccharomyces cerevisiae
atgtatagttttgcgctgtgtg

SEQ ID NO: 4363 - DNA, 20 bp, Saccharomyces cerevisiae
tgaggctttgtacaacgaaa

SEQ ID NO: 4364 - DNA, 27 bp, Saccharomyces cerevisiae
acttcgtgatgtatagagtattgttga

SEQ ID NO: 4365 - DNA, 24 bp, Saccharomyces cerevisiae
aaatccaataactttttcgttgaa

SEQ ID NO: 4366 - DNA, 24 bp, Saccharomyces cerevisiae
aaatagaacattttattccatcgg

SEQ ID NO: 4367 - DNA, 27 bp, Saccharomyces cerevisiae
gcgaatttcttatgatttatgattttt

SEQ ID NO: 4368 - DNA, 27 bp, Saccharomyces cerevisiae
agactttttctgtgaaatttaatgagt

SEQ ID NO: 4369 - DNA, 25 bp, Saccharomyces cerevisiae
gtataatcgaacgctcttcttaatg

SEQ ID NO: 4370 - DNA, 22 bp, Saccharomyces cerevisiae
ggtaaggattaatgaccttgcg

SEQ ID NO: 4371 - DNA, 24 bp, Saccharomyces cerevisiae
ctattatcggtaatggaggaaaaa

SEQ ID NO: 4372 - DNA, 27 bp, Saccharomyces cerevisiae
tggtaaaattttgtatgtgaatatcat

SEQ ID NO: 4373 - DNA, 27 bp, Saccharomyces cerevisiae
atgctactatgattttagtacgtgtcg

SEQ ID NO: 4374 - DNA, 27 bp, Saccharomyces cerevisiae
tacgtttaagaacttttcaatctacga

SEQ ID NO: 4375 - DNA, 26 bp, Saccharomyces cerevisiae
tgatcttgaagtaaaagtgttaggaa

SEQ ID NO: 4376 - DNA, 27 bp, Saccharomyces cerevisiae
taaagttctgtaatatgtagttttgaa

SEQ ID NO: 4377 - DNA, 27 bp, Saccharomyces cerevisiae
aaatctgtatagaacgtttagtcatgc

SEQ ID NO: 4378 - DNA, 27 bp, Saccharomyces cerevisiae
attattttatgcttctgtctttccttt

SEQ ID NO: 4379 - DNA, 20 bp, Saccharomyces cerevisiae
tttgaggtctaatcctccgt

SEQ ID NO: 4380 - DNA, 22 bp, Saccharomyces cerevisiae
cgtttcttaattatgtctaagt

SEQ ID NO: 4381 - DNA, 27 bp, Saccharomyces cerevisiae
atttaactcataactgtttacaagatt

SEQ ID NO: 4382 - DNA, 19 bp, Saccharomyces cerevisiae
aagtccacgcagtaccctg

SEQ ID NO: 4383 - DNA, 19 bp, Saccharomyces cerevisiae
gacgagtaatcattgccgc

SEQ ID NO: 4384 - DNA, 26 bp, Saccharomyces cerevisiae
gtgttaagaatgtagctttttcgtca

SEQ ID NO: 4385 - DNA, 26 bp, Saccharomyces cerevisiae
agaatatttttagatataaggtagaa

SEQ ID NO: 4386 - DNA, 21 bp, Saccharomyces cerevisiae
gaagaggcgagggttagaatc

SEQ ID NO: 4387 - DNA, 20 bp, Saccharomyces cerevisiae
gctccaaaagaaacgacagc

SEQ ID NO: 4388 - DNA, 26 bp, Saccharomyces cerevisiae
cttattttgcaggttatgtaaagcta

SEQ ID NO: 4389 - DNA, 19 bp, Saccharomyces cerevisiae
tagatgcggtggtcgaagc

SEQ ID NO: 4390 - DNA, 20 bp, Saccharomyces cerevisiae
ggcaaataaatagcgaaggc

SEQ ID NO: 4391 - DNA, 27 bp, Saccharomyces cerevisiae
gtgttttattgattttttttttctttt

SEQ ID NO: 4392 - DNA, 18 bp, Saccharomyces cerevisiae
ccgggctgagaaacaaaa

SEQ ID NO: 4393 - DNA, 25 bp, Saccharomyces cerevisiae
gccaacaagatatttctacgttttt

SEQ ID NO: 4394 - DNA, 27 bp, Saccharomyces cerevisiae
aattccctctattctacacttatttga

SEQ ID NO: 4395 - DNA, 21 bp, Saccharomyces cerevisiae
gccaatcgctgaaaaactaga

SEQ ID NO: 4396 - DNA, 20 bp, Saccharomyces cerevisiae
aaagattcggaggatggact

SEQ ID NO: 4397 - DNA, 23 bp, Saccharomyces cerevisiae
tagcattgctcagagttagacaa

SEQ ID NO: 4398 - DNA, 22 bp, Saccharomyces cerevisiae
tgggacgtttagtgtagtagat

SEQ ID NO: 4399 - DNA, 25 bp, Saccharomyces cerevisiae
attgaactgaaaaaattataaatga

SEQ ID NO: 4400 - DNA, 23 bp, Saccharomyces cerevisiae
actgcatcactattcaggagatg

SEQ ID NO: 4401 - DNA, 22 bp, Saccharomyces cerevisiae
aaaagttcaccatttctctccc

SEQ ID NO: 4402 - DNA, 27 bp, Saccharomyces cerevisiae
atgataagattatatacgaggcacatt

SEQ ID NO: 4403 - DNA, 19 bp, Saccharomyces cerevisiae
gtgtccgtccccgctctat

SEQ ID NO: 4404 - DNA, 26 bp, Saccharomyces cerevisiae
tttttaacattttctctttttgtccc

SEQ ID NO: 4405 - DNA, 22 bp, Saccharomyces cerevisiae
gctcgtccatgatagtaataag

SEQ ID NO: 4406 - DNA, 25 bp, Saccharomyces cerevisiae
ttggattgagaatgtaggtagaagt

SEQ ID NO: 4407 - DNA, 27 bp, Saccharomyces cerevisiae
accttctaataatttgtcatttgactg

SEQ ID NO: 4408 - DNA, 23 bp, Saccharomyces cerevisiae
acgtgttctatgcggtttagatg

SEQ ID NO: 4409 - DNA, 21 bp, Saccharomyces cerevisiae
tttcagaaggcttgcaaaaag

SEQ ID NO: 4410 - DNA, 23 bp, Saccharomyces cerevisiae
taggtgaaacatccactgaaaaa

SEQ ID NO: 4411 - DNA, 18 bp, Saccharomyces cerevisiae
agggaattggcttagggg

SEQ ID NO: 4412 - DNA, 25 bp, Saccharomyces cerevisiae
acataatgaaatgaggtgtataaat

SEQ ID NO: 4413 - DNA, 19 bp, Saccharomyces cerevisiae
acgcttaagtgcttgtcgg

SEQ ID NO: 4414 - DNA, 27 bp, Saccharomyces cerevisiae
ttagcatacatattgtctgtacataag

SEQ ID NO: 4415 - DNA, 19 bp, Saccharomyces cerevisiae
gcatggcatacgctgactt

SEQ ID NO: 4416 - DNA, 27 bp, Saccharomyces cerevisiae
ccaaagtaagtattctgataaatctaa

SEQ ID NO: 4417 - DNA, 27 bp, Saccharomyces cerevisiae
ttgtaatatttacgcttgcttatttcg

SEQ ID NO: 4418 - DNA, 25 bp, Saccharomyces cerevisiae
ttcctatagaatttatgagccatcg

SEQ ID NO: 4419 - DNA, 25 bp, Saccharomyces cerevisiae
aagcatcgtctagtttattcttttg

SEQ ID NO: 4420 - DNA, 22 bp, Saccharomyces cerevisiae
gtaaggtgtagttttgcacccg

SEQ ID NO: 4421 - DNA, 24 bp, Saccharomyces cerevisiae
aagggagatgcttcaataactttt

SEQ ID NO: 4422 - DNA, 22 bp, Saccharomyces cerevisiae
tggacactttaggaaggaaaaa

SEQ ID NO: 4423 - DNA, 24 bp, Saccharomyces cerevisiae
tacatatattagtaccatgacgtt

SEQ ID NO: 4424 - DNA, 27 bp, Saccharomyces cerevisiae
acggaattatttgtatattttagcagt

SEQ ID NO: 4425 - DNA, 26 bp, Saccharomyces cerevisiae
aaagttttcattgatccttctttctc

SEQ ID NO: 4426 - DNA, 24 bp, Saccharomyces cerevisiae
gttattgcttagtttctgcgtaca

SEQ ID NO: 4427 - DNA, 25 bp, Saccharomyces cerevisiae
gtaagcagtatataacgcgaggttc

SEQ ID NO: 4428 - DNA, 27 bp, Saccharomyces cerevisiae
tttagtctatttaatacatttgacgtt

SEQ ID NO: 4429 - DNA, 19 bp, Saccharomyces cerevisiae
tgattcccggcagcataac

SEQ ID NO: 4430 - DNA, 25 bp, Saccharomyces cerevisiae
agaagtatgacttttaaaccagaca

SEQ ID NO: 4431 - DNA, 25 bp, Saccharomyces cerevisiae
taaccacatcattacttccacagaa

SEQ ID NO: 4432 - DNA, 26 bp, Saccharomyces cerevisiae
tgaactgaactgaattatatgtacga

SEQ ID NO: 4433 - DNA, 26 bp, Saccharomyces cerevisiae
acatgagaagcattatttcaaaaaca

SEQ ID NO: 4434 - DNA, 19 bp, Saccharomyces cerevisiae
ttggcatctagccccaatg

SEQ ID NO: 4435 - DNA, 25 bp, Saccharomyces cerevisiae
ctttaaatgcggtactgtacatttt

SEQ ID NO: 4436 - DNA, 22 bp, Saccharomyces cerevisiae
accgcttaaggaagtatctcgg

SEQ ID NO: 4437 - DNA, 26 bp, Saccharomyces cerevisiae
ttcataataactatgtaggctaggcg

SEQ ID NO: 4438 - DNA, 27 bp, Saccharomyces cerevisiae
atagttaatcttggctagttgcatatt

SEQ ID NO: 4439 - DNA, 21 bp, Saccharomyces cerevisiae
tggttggcataataaagacga

SEQ ID NO: 4440 - DNA, 24 bp, Saccharomyces cerevisiae
aacaatccctaaatatcatacgtt

SEQ ID NO: 4441 - DNA, 25 bp, Saccharomyces cerevisiae
agttcttgactacccctatctcaca

SEQ ID NO: 4442 - DNA, 25 bp, Saccharomyces cerevisiae
tagatacagtgttttctatacattt

SEQ ID NO: 4443 - DNA, 21 bp, Saccharomyces cerevisiae
tttacaccgctacggaatcct

SEQ ID NO: 4444 - DNA, 25 bp, Saccharomyces cerevisiae
atgtacggttaatatctttctttta

SEQ ID NO: 4445 - DNA, 27 bp, Saccharomyces cerevisiae
ataaatacaaagatgcgatgaagtagc

SEQ ID NO: 4446 - DNA, 21 bp, Saccharomyces cerevisiae
agcgtcgagtatatcaagcca

SEQ ID NO: 4447 - DNA, 26 bp, Saccharomyces cerevisiae
ttttgttacataaaactttgcttacg

SEQ ID NO: 4448 - DNA, 25 bp, Saccharomyces cerevisiae
gatctttactccaccctttatttgc

SEQ ID NO: 4449 - DNA, 19 bp, Saccharomyces cerevisiae
taatcatgcgtttccgcag

SEQ ID NO: 4450 - DNA, 26 bp, Saccharomyces cerevisiae
taagctatgacatgctgatacataaa

SEQ ID NO: 4451 - DNA, 22 bp, Saccharomyces cerevisiae
gtattttgatcctcctgtttgc

SEQ ID NO: 4452 - DNA, 24 bp, Saccharomyces cerevisiae
atcgaaatatctttaaaaaaaaaa

SEQ ID NO: 4453 - DNA, 25 bp, Saccharomyces cerevisiae
gtggtatgaaaaggatgatattgtt

SEQ ID NO: 4454 - DNA, 27 bp, Saccharomyces cerevisiae
cctaatataggaaagggaatctttctc

SEQ ID NO: 4455 - DNA, 21 bp, Saccharomyces cerevisiae
tgtcacacaattttcaaacca

SEQ ID NO: 4456 - DNA, 26 bp, Saccharomyces cerevisiae
acggaccaaataacataaatttagaa

SEQ ID NO: 4457 - DNA, 24 bp, Saccharomyces cerevisiae
tgatggaagattagaaaacaaaga

SEQ ID NO: 4458 - DNA, 27 bp, Saccharomyces cerevisiae
tctctaaactttgctataccttattcg

SEQ ID NO: 4459 - DNA, 26 bp, Saccharomyces cerevisiae
agtaggtagtatcgtttccacttttt

SEQ ID NO: 4460 - DNA, 20 bp, Saccharomyces cerevisiae
tgcacaattgttttccttca

SEQ ID NO: 4461 - DNA, 25 bp, Saccharomyces cerevisiae
ttgctatgcagatgctttatacttc

SEQ ID NO: 4462 - DNA, 23 bp, Saccharomyces cerevisiae
cgcacatagaattattggtcttg

SEQ ID NO: 4463 - DNA, 23 bp, Saccharomyces cerevisiae
ccatgaagatttaatttgctttc

SEQ ID NO: 4464 - DNA, 25 bp, Saccharomyces cerevisiae
gccatatgatgtggtttgtatagat

SEQ ID NO: 4465 - DNA, 26 bp, Saccharomyces cerevisiae
ttggaataaactagctcgactttaac

SEQ ID NO: 4466 - DNA, 27 bp, Saccharomyces cerevisiae
ctgttctaaggtatatcaattttaagt

SEQ ID NO: 4467 - DNA, 19 bp, Saccharomyces cerevisiae
taaggacgcaacggttgga

SEQ ID NO: 4468 - DNA, 27 bp, Saccharomyces cerevisiae
cttgaagaatgataagagaaggaaaaa

SEQ ID NO: 4469 - DNA, 27 bp, Saccharomyces cerevisiae
tgaatgtaacgattgtataagacatgg

SEQ ID NO: 4470 - DNA, 27 bp, Saccharomyces cerevisiae
taactgtatgtatacgtgtgtgtaact

SEQ ID NO: 4471 - DNA, 22 bp, Saccharomyces cerevisiae
tcgaatgtttaagagggaagag

SEQ ID NO: 4472 - DNA, 23 bp, Saccharomyces cerevisiae
ctgtaaccccataactatacccg

SEQ ID NO: 4473 - DNA, 24 bp, Saccharomyces cerevisiae
gtcaagagcgattgtaacatcgta

SEQ ID NO: 4474 - DNA, 22 bp, Saccharomyces cerevisiae
attgctttgcgtgaaatgtatg

SEQ ID NO: 4475 - DNA, 24 bp, Saccharomyces cerevisiae
attaaataaagatttacaaaataa

SEQ ID NO: 4476 - DNA, 22 bp, Saccharomyces cerevisiae
aaacaccctagaaagggagaga

SEQ ID NO: 4477 - DNA, 22 bp, Saccharomyces cerevisiae
gtcgaaaactgacatacatagt

SEQ ID NO: 4478 - DNA, 22 bp, Saccharomyces cerevisiae
gaatcaggtttcattcccactt

SEQ ID NO: 4479 - DNA, 20 bp, Saccharomyces cerevisiae
ggcctgacacaattttcggt

SEQ ID NO: 4480 - DNA, 24 bp, Saccharomyces cerevisiae
gatatgctatgaataaacatctta

SEQ ID NO: 4481 - DNA, 27 bp, Saccharomyces cerevisiae
attcaagccctctactatgttttatag

SEQ ID NO: 4482 - DNA, 27 bp, Saccharomyces cerevisiae
gtcctcgagtgagataagaatataaag

SEQ ID NO: 4483 - DNA, 25 bp, Saccharomyces cerevisiae
agatattaaggaattcgtagctcca

SEQ ID NO: 4484 - DNA, 22 bp, Saccharomyces cerevisiae
gatcctctcctatgcatgtacg

SEQ ID NO: 4485 - DNA, 26 bp, Saccharomyces cerevisiae
aaatgacaatagacttttagggcttt

SEQ ID NO: 4486 - DNA, 22 bp, Saccharomyces cerevisiae
tcttttggttagtgcgactgtt

SEQ ID NO: 4487 - DNA, 23 bp, Saccharomyces cerevisiae
gacaactgataataaggtgccat

SEQ ID NO: 4488 - DNA, 24 bp, Saccharomyces cerevisiae
atataattattttaacgaacttct

SEQ ID NO: 4489 - DNA, 20 bp, Saccharomyces cerevisiae
aggatcttccatccttcatt

SEQ ID NO: 4490 - DNA, 25 bp, Saccharomyces cerevisiae
atatgtatttgctttaatgttgcca

SEQ ID NO: 4491 - DNA, 26 bp, Saccharomyces cerevisiae
taaaaaggaaatagttgtagaaacgc

SEQ ID NO: 4492 - DNA, 22 bp, Saccharomyces cerevisiae
ttttcctgccgtgtgtataaag

SEQ ID NO: 4493 - DNA, 18 bp, Saccharomyces cerevisiae
gtccgcttttggcttcct

SEQ ID NO: 4494 - DNA, 24 bp, Saccharomyces cerevisiae
gtatgtcttggacctgcataattt

SEQ ID NO: 4495 - DNA, 24 bp, Saccharomyces cerevisiae
agcttatagactaagacgtatttt

SEQ ID NO: 4496 - DNA, 21 bp, Saccharomyces cerevisiae
actgaatagcttttgggcaat

SEQ ID NO: 4497 - DNA, 22 bp, Saccharomyces cerevisiae
tgatttgttggcatgatctaat

SEQ ID NO: 4498 - DNA, 25 bp, Saccharomyces cerevisiae
tcaggtatgtaagggagtactcaag

SEQ ID NO: 4499 - DNA, 22 bp, Saccharomyces cerevisiae
aaagccgatgttcttaccatga

SEQ ID NO: 4500 - DNA, 25 bp, Saccharomyces cerevisiae
tactaagtttttggatgtcttcgat

SEQ ID NO: 4501 - DNA, 27 bp, Saccharomyces cerevisiae
aaaggttaagcaattgtgtatctactt

SEQ ID NO: 4502 - DNA, 24 bp, Saccharomyces cerevisiae
tgggtttaaatatgaaaacgtcag

SEQ ID NO: 4503 - DNA, 20 bp, Saccharomyces cerevisiae
taatccggtcctgagaaaaa

SEQ ID NO: 4504 - DNA, 26 bp, Saccharomyces cerevisiae
atatcaatatataaagaggggtttgc

SEQ ID NO: 4505 - DNA, 21 bp, Saccharomyces cerevisiae
tttgtgcgttagaacagtgaa

SEQ ID NO: 4506 - DNA, 25 bp, Saccharomyces cerevisiae
aaacatgaaaatttatatacgaaaa

SEQ ID NO: 4507 - DNA, 21 bp, Saccharomyces cerevisiae
tgagaatgaatattttcgcgt

SEQ ID NO: 4508 - DNA, 27 bp, Saccharomyces cerevisiae
agacgtttaatagaaagaagaacaatg

SEQ ID NO: 4509 - DNA, 27 bp, Saccharomyces cerevisiae
aaactgtgattaacttttgaaaatcat

SEQ ID NO: 4510 - DNA, 27 bp, Saccharomyces cerevisiae
tataatataattgtgtattttccgaag

SEQ ID NO: 4511 - DNA, 21 bp, Saccharomyces cerevisiae
acgctctgaatgcaaagattc

SEQ ID NO: 4512 - DNA, 25 bp, Saccharomyces cerevisiae
gatgagtaaaaacttttatgatatt

SEQ ID NO: 4513 - DNA, 22 bp, Saccharomyces cerevisiae
ttgctcatctcttatactgtct

SEQ ID NO: 4514 - DNA, 26 bp, Saccharomyces cerevisiae
gtaactcttttgcttttcctacgatt

SEQ ID NO: 4515 - DNA, 26 bp, Saccharomyces cerevisiae
tgaagacttagtattttatgtagttg

SEQ ID NO: 4516 - DNA, 26 bp, Saccharomyces cerevisiae
tgaatggttttaacaaaagttcataa

SEQ ID NO: 4517 - DNA, 24 bp, Saccharomyces cerevisiae
agatatacaaaacaaaaaatgctt

SEQ ID NO: 4518 - DNA, 27 bp, Saccharomyces cerevisiae
gttaatttatttttttgtgtagttaaa

SEQ ID NO: 4519 - DNA, 26 bp, Saccharomyces cerevisiae
aagccataataagaagaatatatagg

SEQ ID NO: 4520 - DNA, 24 bp, Saccharomyces cerevisiae
gctctctgtgtatgtatgggttcc

SEQ ID NO: 4521 - DNA, 24 bp, Saccharomyces cerevisiae
ttgtagtacgaatttttaagttga

SEQ ID NO: 4522 - DNA, 25 bp, Saccharomyces cerevisiae
tatgtcacattttgtgcttttatcg

SEQ ID NO: 4523 - DNA, 26 bp, Saccharomyces cerevisiae
atcagtatagtaatgtccttcggatg

SEQ ID NO: 4524 - DNA, 27 bp, Saccharomyces cerevisiae
tttggaaaataattcaatacatactca

SEQ ID NO: 4525 - DNA, 23 bp, Saccharomyces cerevisiae
gagacgggatttagttttactgc

SEQ ID NO: 4526 - DNA, 20 bp, Saccharomyces cerevisiae
aaagaatgcgagagaaaccc

SEQ ID NO: 4527 - DNA, 21 bp, Saccharomyces cerevisiae
tacgagcgcaatcgtattctt

SEQ ID NO: 4528 - DNA, 25 bp, Saccharomyces cerevisiae
agctgatagaattgtacttctcgct

SEQ ID NO: 4529 - DNA, 19 bp, Saccharomyces cerevisiae
gcgaacgatctttcccaaa

SEQ ID NO: 4530 - DNA, 25 bp, Saccharomyces cerevisiae
aatcgtgcttatcaattttatgtca

SEQ ID NO: 4531 - DNA, 27 bp, Saccharomyces cerevisiae
aagggtgaaaatagatgataagaattt

SEQ ID NO: 4532 - DNA, 24 bp, Saccharomyces cerevisiae
atttcccagtactctccacatttt

SEQ ID NO: 4533 - DNA, 27 bp, Saccharomyces cerevisiae
tgaaaataattctgttttttttttttt

SEQ ID NO: 4534 - DNA, 25 bp, Saccharomyces cerevisiae
actgcaattgttagatgattcataa

SEQ ID NO: 4535 - DNA, 23 bp, Saccharomyces cerevisiae
acgcgttaattccaactattttc

SEQ ID NO: 4536 - DNA, 25 bp, Saccharomyces cerevisiae
cttgtccaatagtacgttacattca

SEQ ID NO: 4537 - DNA, 26 bp, Saccharomyces cerevisiae
gtaactaattaaccaaaataaaaaaa

SEQ ID NO: 4538 - DNA, 27 bp, Saccharomyces cerevisiae
tgtgatagttatcattatgtaagtgcg

SEQ ID NO: 4539 - DNA, 25 bp, Saccharomyces cerevisiae
tttacgtaatatctcacattaaaca

SEQ ID NO: 4540 - DNA, 20 bp, Saccharomyces cerevisiae
gcccaacaataaataagaat

SEQ ID NO: 4541 - DNA, 25 bp, Saccharomyces cerevisiae
ctagataatgtttgttcttgatggc

SEQ ID NO: 4542 - DNA, 27 bp, Saccharomyces cerevisiae
cttctacgcagatataataaggaactt

SEQ ID NO: 4543 - DNA, 22 bp, Saccharomyces cerevisiae
atttcatgaacttacgggcttg

SEQ ID NO: 4544 - DNA, 26 bp, Saccharomyces cerevisiae
gcgagttgttaaaaataaaaagctaa

SEQ ID NO: 4545 - DNA, 20 bp, Saccharomyces cerevisiae
gcctttaaagatctgtgcgg

SEQ ID NO: 4546 - DNA, 25 bp, Saccharomyces cerevisiae
ttaggttaagtcgtcaaaccaattt

SEQ ID NO: 4547 - DNA, 19 bp, Saccharomyces cerevisiae
atgtaaggtgcagcaaccg

SEQ ID NO: 4548 - DNA, 27 bp, Saccharomyces cerevisiae
gaggtatgtaaatagaaatagactagc

SEQ ID NO: 4549 - DNA, 27 bp, Saccharomyces cerevisiae
tttgtctgtttacgtaataattttgcc

SEQ ID NO: 4550 - DNA, 21 bp, Saccharomyces cerevisiae
aattaatgacggaaacgataa

SEQ ID NO: 4551 - DNA, 27 bp, Saccharomyces cerevisiae
tgataatttgacattcataatattggt

SEQ ID NO: 4552 - DNA, 27 bp, Saccharomyces cerevisiae
atagtatacatatacgcaattcttttt

SEQ ID NO: 4553 - DNA, 22 bp, Saccharomyces cerevisiae
ttggttgataattggtgcttca

SEQ ID NO: 4554 - DNA, 18 bp, Saccharomyces cerevisiae
gttggggaataagaacat

SEQ ID NO: 4555 - DNA, 24 bp, Saccharomyces cerevisiae
cgtttaggtaatcaaccctaggaa

SEQ ID NO: 4556 - DNA, 22 bp, Saccharomyces cerevisiae
gctcctcaagctttattgttcc

SEQ ID NO: 4557 - DNA, 27 bp, Saccharomyces cerevisiae
tgttgctagaagagaatatacaagaaa

SEQ ID NO: 4558 - DNA, 23 bp, Saccharomyces cerevisiae
taaaatgctttcaagctggtctt

SEQ ID NO: 4559 - DNA, 20 bp, Saccharomyces cerevisiae
actaatgattcgggtttcgc

SEQ ID NO: 4560 - DNA, 27 bp, Saccharomyces cerevisiae
actattttcttactttattcttttttc

SEQ ID NO: 4561 - DNA, 27 bp, Saccharomyces cerevisiae
taatagctaacgtcaattccaataaaa

SEQ ID NO: 4562 - DNA, 23 bp, Saccharomyces cerevisiae
acagggaacgggttatataattt

SEQ ID NO: 4563 - DNA, 21 bp, Saccharomyces cerevisiae
tgaaacaaaccagacgaaaaa

SEQ ID NO: 4564 - DNA, 23 bp, Saccharomyces cerevisiae
tgaattcattggaaaacacaaaa

SEQ ID NO: 4565 - DNA, 24 bp, Saccharomyces cerevisiae
tcagcggtataaggttgatatctt

SEQ ID NO: 4566 - DNA, 25 bp, Saccharomyces cerevisiae
tttgattgactaaactaaatacgga

SEQ ID NO: 4567 - DNA, 20 bp, Saccharomyces cerevisiae
atcaagggtgcatggtcgta

SEQ ID NO: 4568 - DNA, 26 bp, Saccharomyces cerevisiae
atttctatagcttacaaaatacgcga

SEQ ID NO: 4569 - DNA, 22 bp, Saccharomyces cerevisiae
tagctttagggttcttccattg

SEQ ID NO: 4570 - DNA, 24 bp, Saccharomyces cerevisiae
tttttttcggttcatcctaatttt

SEQ ID NO: 4571 - DNA, 26 bp, Saccharomyces cerevisiae
tatctacgtacatgtgtatacgtgcc

SEQ ID NO: 4572 - DNA, 22 bp, Saccharomyces cerevisiae
tcgttcttctaggaggatctgt

SEQ ID NO: 4573 - DNA, 27 bp, Saccharomyces cerevisiae
agtcatatatattctttagttattatc

SEQ ID NO: 4574 - DNA, 23 bp, Saccharomyces cerevisiae
tcaagaaattaatactccacctt

SEQ ID NO: 4575 - DNA, 26 bp, Saccharomyces cerevisiae
gctgtataaacagaagtccttactca

SEQ ID NO: 4576 - DNA, 22 bp, Saccharomyces cerevisiae
gtaagtttttagtagtggtaca

SEQ ID NO: 4577 - DNA, 22 bp, Saccharomyces cerevisiae
ttctaatctctgcttttgtgcg

SEQ ID NO: 4578 - DNA, 25 bp, Saccharomyces cerevisiae
tagatgaaatgaaaatactaccaat

SEQ ID NO: 4579 - DNA, 23 bp, Saccharomyces cerevisiae
tagatggctgttaaaaagaatgg

SEQ ID NO: 4580 - DNA, 22 bp, Saccharomyces cerevisiae
gctcagcagttcctctagtttt

SEQ ID NO: 4581 - DNA, 23 bp, Saccharomyces cerevisiae
taaacaactgctttcagtgaacc

SEQ ID NO: 4582 - DNA, 25 bp, Saccharomyces cerevisiae
taggcttttaatgaggtatgctttt

SEQ ID NO: 4583 - DNA, 24 bp, Saccharomyces cerevisiae
aatctactgcaattttttactttt

SEQ ID NO: 4584 - DNA, 24 bp, Saccharomyces cerevisiae
acatggacatttccttcttacacc

SEQ ID NO: 4585 - DNA, 26 bp, Saccharomyces cerevisiae
aagggaaaaatcgaattatttacacg

SEQ ID NO: 4586 - DNA, 23 bp, Saccharomyces cerevisiae
gggtagtccgttgtaaaatgttg

SEQ ID NO: 4587 - DNA, 26 bp, Saccharomyces cerevisiae
atagcactataccttgctgaaataaa

SEQ ID NO: 4588 - DNA, 24 bp, Saccharomyces cerevisiae
tagtaaaggacgctaattgaaggc

SEQ ID NO: 4589 - DNA, 21 bp, Saccharomyces cerevisiae
cgcgcgaattagtttgtaaat

SEQ ID NO: 4590 - DNA, 27 bp, Saccharomyces cerevisiae
gtttttctaccactgctattttcttca

SEQ ID NO: 4591 - DNA, 22 bp, Saccharomyces cerevisiae
tggtgaaggatagatgcagtaa

SEQ ID NO: 4592 - DNA, 19 bp, Saccharomyces cerevisiae
acgccttatacatgcgtgc

SEQ ID NO: 4593 - DNA, 24 bp, Saccharomyces cerevisiae
cgcgaagattaacttatgtgtttt

SEQ ID NO: 4594 - DNA, 22 bp, Saccharomyces cerevisiae
gtacggtttaacggaggaaaga

SEQ ID NO: 4595 - DNA, 25 bp, Saccharomyces cerevisiae
tttattttcttcgtcagtttctctg

SEQ ID NO: 4596 - DNA, 26 bp, Saccharomyces cerevisiae
ttagatagctaattgtaaagggttgg

SEQ ID NO: 4597 - DNA, 20 bp, Saccharomyces cerevisiae
aggttggccagcaaaataca

SEQ ID NO: 4598 - DNA, 27 bp, Saccharomyces cerevisiae
atgtactatacacatagatgctaggaa

SEQ ID NO: 4599 - DNA, 26 bp, Saccharomyces cerevisiae
actttacacaaaacaaaggaatgttg

SEQ ID NO: 4600 - DNA, 21 bp, Saccharomyces cerevisiae
gcataacttgagtgccagtga

SEQ ID NO: 4601 - DNA, 23 bp, Saccharomyces cerevisiae
gctggttatgaatcagcataaga

SEQ ID NO: 4602 - DNA, 23 bp, Saccharomyces cerevisiae
gctgtgcaatgtagtcacaataa

SEQ ID NO: 4603 - DNA, 27 bp, Saccharomyces cerevisiae
tccacttgagaatccttactattactg

SEQ ID NO: 4604 - DNA, 20 bp, Saccharomyces cerevisiae
tgatcaaacgatgaggcagc

SEQ ID NO: 4605 - DNA, 21 bp, Saccharomyces cerevisiae
catcgatgttttttgcagttg

SEQ ID NO: 4606 - DNA, 18 bp, Saccharomyces cerevisiae
gtgttcccataggggcgt

SEQ ID NO: 4607 - DNA, 26 bp, Saccharomyces cerevisiae
agtatcgctattgctacgtaaagtaa

SEQ ID NO: 4608 - DNA, 27 bp, Saccharomyces cerevisiae
accaatagttaaaaattacatatactc

SEQ ID NO: 4609 - DNA, 25 bp, Saccharomyces cerevisiae
ttgaattgaaaatgagacacctacc

SEQ ID NO: 4610 - DNA, 23 bp, Saccharomyces cerevisiae
tctgattatcttgaactggatgt

SEQ ID NO: 4611 - DNA, 27 bp, Saccharomyces cerevisiae
agtaataataccaagtataaaggcgtg

SEQ ID NO: 4612 - DNA, 25 bp, Saccharomyces cerevisiae
gactggtgccatcttatatattacc

SEQ ID NO: 4613 - DNA, 21 bp, Saccharomyces cerevisiae
ggtttactaaattaaaagaaa

SEQ ID NO: 4614 - DNA, 21 bp, Saccharomyces cerevisiae
aaagaaaatgcgaaccgtaga

SEQ ID NO: 4615 - DNA, 26 bp, Saccharomyces cerevisiae
aaatgtagctgaaagcagaagatacg

SEQ ID NO: 4616 - DNA, 20 bp, Saccharomyces cerevisiae
tgagcgcgctaaatagttga

SEQ ID NO: 4617 - DNA, 22 bp, Saccharomyces cerevisiae
agcgtgagaatgagtatgatgg

SEQ ID NO: 4618 - DNA, 26 bp, Saccharomyces cerevisiae
attttcttacatacgtatacacacgc

SEQ ID NO: 4619 - DNA, 27 bp, Saccharomyces cerevisiae
gctacatagctttcttttcatcttttt

SEQ ID NO: 4620 - DNA, 25 bp, Saccharomyces cerevisiae
aggggtatttttaagcctctttatc

SEQ ID NO: 4621 - DNA, 24 bp, Saccharomyces cerevisiae
tcgtcatcattttattcacacctc

SEQ ID NO: 4622 - DNA, 21 bp, Saccharomyces cerevisiae
gactgggaatgagtgattttt

SEQ ID NO: 4623 - DNA, 22 bp, Saccharomyces cerevisiae
aaaaaccccttcggtacgtaat

SEQ ID NO: 4624 - DNA, 24 bp, Saccharomyces cerevisiae
tgttccattcgtaaactttgtatg

SEQ ID NO: 4625 - DNA, 25 bp, Saccharomyces cerevisiae
cattatacattttattaacgccccc

SEQ ID NO: 4626 - DNA, 26 bp, Saccharomyces cerevisiae
ataagtttactggcttacaattcgat

SEQ ID NO: 4627 - DNA, 24 bp, Saccharomyces cerevisiae
gccaagaaataaactttttaagat

SEQ ID NO: 4628 - DNA, 26 bp, Saccharomyces cerevisiae
gtagagaagagatacatagtttcgca

SEQ ID NO: 4629 - DNA, 23 bp, Saccharomyces cerevisiae
gaagacgcttaattgattacaaa

SEQ ID NO: 4630 - DNA, 26 bp, Saccharomyces cerevisiae
cttataatacaaatataccacataca

SEQ ID NO: 4631 - DNA, 26 bp, Saccharomyces cerevisiae
atgtttttttaatgatatatgtaacg

SEQ ID NO: 4632 - DNA, 22 bp, Saccharomyces cerevisiae
cttctatacacatatagccggt

SEQ ID NO: 4633 - DNA, 23 bp, Saccharomyces cerevisiae
cggtagaaaagctcgaccttaaa

SEQ ID NO: 4634 - DNA, 26 bp, Saccharomyces cerevisiae
gcgaagaacatatttatgcttcaaac

SEQ ID NO: 4635 - DNA, 26 bp, Saccharomyces cerevisiae
accaaaaaaaaaaaaagaaacacttg

SEQ ID NO: 4636 - DNA, 26 bp, Saccharomyces cerevisiae
taatttgcgaacacttttattaattc

SEQ ID NO: 4637 - DNA, 23 bp, Saccharomyces cerevisiae
agagagctttaacatgaatataa

SEQ ID NO: 4638 - DNA, 25 bp, Saccharomyces cerevisiae
tatcactattaaggtctattagcca

SEQ ID NO: 4639 - DNA, 27 bp, Saccharomyces cerevisiae
gtcgatctgtaataagtaggttttctt

SEQ ID NO: 4640 - DNA, 25 bp, Saccharomyces cerevisiae
ctttatttccaggttgctacgtgat

SEQ ID NO: 4641 - DNA, 25 bp, Saccharomyces cerevisiae
tttgaatttggttaagaaaagaaac

SEQ ID NO: 4642 - DNA, 23 bp, Saccharomyces cerevisiae
atggtctattttgtagagcgaaa

SEQ ID NO: 4643 - DNA, 24 bp, Saccharomyces cerevisiae
gaagacgcttaaattttctttaat

SEQ ID NO: 4644 - DNA, 20 bp, Saccharomyces cerevisiae
tctatgtgaatgcaccgctt

SEQ ID NO: 4645 - DNA, 23 bp, Saccharomyces cerevisiae
ttttagtgtacgtgcccttattt

SEQ ID NO: 4646 - DNA, 26 bp, Saccharomyces cerevisiae
caaccagattttgtttggttatattt

SEQ ID NO: 4647 - DNA, 27 bp, Saccharomyces cerevisiae
gcatagacagatacataattgactaca

SEQ ID NO: 4648 - DNA, 26 bp, Saccharomyces cerevisiae
tgaaatagaaacgcttgtgtacttat

SEQ ID NO: 4649 - DNA, 25 bp, Saccharomyces cerevisiae
gaaaattaaacctgaagtagaaaaa

SEQ ID NO: 4650 - DNA, 20 bp, Saccharomyces cerevisiae
tgagttgtcaagtggcatca

SEQ ID NO: 4651 - DNA, 25 bp, Saccharomyces cerevisiae
gcatcataatcagggagtgtatttt

SEQ ID NO: 4652 - DNA, 25 bp, Saccharomyces cerevisiae
ttttgttttcaccataacaaagaga

SEQ ID NO: 4653 - DNA, 27 bp, Saccharomyces cerevisiae
atacactaattttatgaaagctaacgg

SEQ ID NO: 4654 - DNA, 26 bp, Saccharomyces cerevisiae
attaacccttttactttctcttcgtc

SEQ ID NO: 4655 - DNA, 26 bp, Saccharomyces cerevisiae
gtcgagtggtaagtaaggtgatattt

SEQ ID NO: 4656 - DNA, 25 bp, Saccharomyces cerevisiae
ttttaagctttgaataggaattttt

SEQ ID NO: 4657 - DNA, 26 bp, Saccharomyces cerevisiae
ctataagtaaccggggaagtatagaa

SEQ ID NO: 4658 - DNA, 21 bp, Saccharomyces cerevisiae
tagaagttcactcgcaatgct

SEQ ID NO: 4659 - DNA, 26 bp, Saccharomyces cerevisiae
ttcagctagaaacagaggtataaaga

SEQ ID NO: 4660 - DNA, 25 bp, Saccharomyces cerevisiae
tagaaatgcgtaatatgcaagtaga

SEQ ID NO: 4661 - DNA, 26 bp, Saccharomyces cerevisiae
tgaaatagtggtgagatacactgaca

SEQ ID NO: 4662 - DNA, 22 bp, Saccharomyces cerevisiae
ttcggcatatagaaacactttg

SEQ ID NO: 4663 - DNA, 27 bp, Saccharomyces cerevisiae
tgatatgtaacagcttatctacagtgc

SEQ ID NO: 4664 - DNA, 26 bp, Saccharomyces cerevisiae
atcagcagaacaacttttatctctcg

SEQ ID NO: 4665 - DNA, 26 bp, Saccharomyces cerevisiae
atgcagtaatcctttgtacgtactct

SEQ ID NO: 4666 - DNA, 27 bp, Saccharomyces cerevisiae
aaataggaagtacatagtatagacaaa

SEQ ID NO: 4667 - DNA, 20 bp, Saccharomyces cerevisiae
tgcagaaagggaaaaggaaa

SEQ ID NO: 4668 - DNA, 20 bp, Saccharomyces cerevisiae
ctttcaggcgcagaaaacct

SEQ ID NO: 4669 - DNA, 24 bp, Saccharomyces cerevisiae
tattttccaagcttttaatcctca

SEQ ID NO: 4670 - DNA, 20 bp, Saccharomyces cerevisiae
atggcgatcacagaatgtca

SEQ ID NO: 4671 - DNA, 19 bp, Saccharomyces cerevisiae
agcctccctagtgtcgtcc

SEQ ID NO: 4672 - DNA, 25 bp, Saccharomyces cerevisiae
aaccgctgtgtaatgtagactactg

SEQ ID NO: 4673 - DNA, 22 bp, Saccharomyces cerevisiae
catacttcctgccacaacataa

SEQ ID NO: 4674 - DNA, 26 bp, Saccharomyces cerevisiae
tgtgtttttttagaagagaagagttt

SEQ ID NO: 4675 - DNA, 27 bp, Saccharomyces cerevisiae
catgaatgatacattgttttgtacttt

SEQ ID NO: 4676 - DNA, 22 bp, Saccharomyces cerevisiae
cttgtgacagggaggttatttt

SEQ ID NO: 4677 - DNA, 23 bp, Saccharomyces cerevisiae
aaaataaaaggaaagcgagaagt

SEQ ID NO: 4678 - DNA, 27 bp, Saccharomyces cerevisiae
gtataatttgtttcaacttcatttcct

SEQ ID NO: 4679 - DNA, 27 bp, Saccharomyces cerevisiae
tacaagagacaaagaattacttgcaga

SEQ ID NO: 4680 - DNA, 24 bp, Saccharomyces cerevisiae
gaaggaaattaatacataaacgtg

SEQ ID NO: 4681 - DNA, 27 bp, Saccharomyces cerevisiae
ttcaatatatagcttggtcttcctatt

SEQ ID NO: 4682 - DNA, 24 bp, Saccharomyces cerevisiae
aaatcacataatatatgcacgcaa

SEQ ID NO: 4683 - DNA, 23 bp, Saccharomyces cerevisiae
caggcacagtgaaagatattcag

SEQ ID NO: 4684 - DNA, 20 bp, Saccharomyces cerevisiae
tttacccaatgcttccaagg

SEQ ID NO: 4685 - DNA, 27 bp, Saccharomyces cerevisiae
aggaactgtataattaaagtagtgttt

SEQ ID NO: 4686 - DNA, 21 bp, Saccharomyces cerevisiae
cgagatttcacttcttcacgc

SEQ ID NO: 4687 - DNA, 19 bp, Saccharomyces cerevisiae
cgagtgtgactcgcaccac

SEQ ID NO: 4688 - DNA, 23 bp, Saccharomyces cerevisiae
caacactgaggagaacacaaaaa

SEQ ID NO: 4689 - DNA, 22 bp, Saccharomyces cerevisiae
gaggtgaagaaaagtacaccgc

SEQ ID NO: 4690 - DNA, 26 bp, Saccharomyces cerevisiae
acactaattcatacagggtaatgagc

SEQ ID NO: 4691 - DNA, 27 bp, Saccharomyces cerevisiae
ttagacatttatgtaatttttaaggcg

SEQ ID NO: 4692 - DNA, 26 bp, Saccharomyces cerevisiae
cgttaagatttatgctcgaacttatt

SEQ ID NO: 4693 - DNA, 27 bp, Saccharomyces cerevisiae
tttcgttattctctccactaaagtaaa

SEQ ID NO: 4694 - DNA, 25 bp, Saccharomyces cerevisiae
ttgaagaaataatctggtgaacatt

SEQ ID NO: 4695 - DNA, 20 bp, Saccharomyces cerevisiae
agggaatccatctttcccat

SEQ ID NO: 4696 - DNA, 26 bp, Saccharomyces cerevisiae
aaatgttaagtaaaagggttgttttt

SEQ ID NO: 4697 - DNA, 19 bp, Saccharomyces cerevisiae
aaacttgtgggcgcaatta

SEQ ID NO: 4698 - DNA, 26 bp, Saccharomyces cerevisiae
aggaaaacggtgtttttaagtagtat

SEQ ID NO: 4699 - DNA, 18 bp, Saccharomyces cerevisiae
gatggcgaggcgatttgt

SEQ ID NO: 4700 - DNA, 23 bp, Saccharomyces cerevisiae
tcctagttaaattgcatttcgat

SEQ ID NO: 4701 - DNA, 25 bp, Saccharomyces cerevisiae
tattatataaaggacattcgagtaa

SEQ ID NO: 4702 - DNA, 27 bp, Saccharomyces cerevisiae
acgacatgaaaatgctaattaaatact

SEQ ID NO: 4703 - DNA, 24 bp, Saccharomyces cerevisiae
ggattttttaagtcaccacagaaa

SEQ ID NO: 4704 - DNA, 24 bp, Saccharomyces cerevisiae
acgaaggaatgaactgaaactatt

SEQ ID NO: 4705 - DNA, 27 bp, Saccharomyces cerevisiae
ataaatagaagaagtagcaaagtgcag

SEQ ID NO: 4706 - DNA, 24 bp, Saccharomyces cerevisiae
gcatgagagcgtacacgtatattt

SEQ ID NO: 4707 - DNA, 27 bp, Saccharomyces cerevisiae
tagatttccttagacatatactggtcc

SEQ ID NO: 4708 - DNA, 22 bp, Saccharomyces cerevisiae
ctctaatgtgcagttgtcatgc

SEQ ID NO: 4709 - DNA, 25 bp, Saccharomyces cerevisiae
cttgaagcttatattatgcgttttt

SEQ ID NO: 4710 - DNA, 23 bp, Saccharomyces cerevisiae
tgacaccgattatttaaagctgc

SEQ ID NO: 4711 - DNA, 21 bp, Saccharomyces cerevisiae
cgctttatattgagctacgca

SEQ ID NO: 4712 - DNA, 25 bp, Saccharomyces cerevisiae
tacacgcagtaataaacagtgaaaa

SEQ ID NO: 4713 - DNA, 27 bp, Saccharomyces cerevisiae
ctaaataactctaagtaaattaagaac

SEQ ID NO: 4714 - DNA, 27 bp, Saccharomyces cerevisiae
aaacaaaatttatacattacgtaacac

SEQ ID NO: 4715 - DNA, 22 bp, Saccharomyces cerevisiae
ttctgacgtgtcgacctctatc

SEQ ID NO: 4716 - DNA, 24 bp, Saccharomyces cerevisiae
tccctagaatagatgaattttcca

SEQ ID NO: 4717 - DNA, 21 bp, Saccharomyces cerevisiae
gcttaaaaagggcattctctg

SEQ ID NO: 4718 - DNA, 26 bp, Saccharomyces cerevisiae
gtagggtacattttatgagaagaaca

SEQ ID NO: 4719 - DNA, 26 bp, Saccharomyces cerevisiae
gaagtctaaatgagaaaaggtggttc

SEQ ID NO: 4720 - DNA, 27 bp, Saccharomyces cerevisiae
gaagattagtggacatgtaagcttttt

SEQ ID NO: 4721 - DNA, 26 bp, Saccharomyces cerevisiae
acagtaaattataggaacaagaagca

SEQ ID NO: 4722 - DNA, 27 bp, Saccharomyces cerevisiae
agaagattatgagttatgcatgtattg

SEQ ID NO: 4723 - DNA, 21 bp, Saccharomyces cerevisiae
ggtttggaataaaggttagtt

SEQ ID NO: 4724 - DNA, 20 bp, Saccharomyces cerevisiae
ccccgctatggaaactgtct

SEQ ID NO: 4725 - DNA, 27 bp, Saccharomyces cerevisiae
tttatagacgttgtggatatctagccg

SEQ ID NO: 4726 - DNA, 23 bp, Saccharomyces cerevisiae
gctcggttttttagtgacctaca

SEQ ID NO: 4727 - DNA, 25 bp, Saccharomyces cerevisiae
ataatataaaaaaatgtagcaacgg

SEQ ID NO: 4728 - DNA, 18 bp, Saccharomyces cerevisiae
agaaaactgaagggccgc

SEQ ID NO: 4729 - DNA, 21 bp, Saccharomyces cerevisiae
gagcgctgagaaatacaaggg

SEQ ID NO: 4730 - DNA, 25 bp, Saccharomyces cerevisiae
ttttcagactaggttgtcaagctct

SEQ ID NO: 4731 - DNA, 27 bp, Saccharomyces cerevisiae
acaatctatttttgtttctaagcaagt

SEQ ID NO: 4732 - DNA, 27 bp, Saccharomyces cerevisiae
tgagagatatttctattacgaatgcag

SEQ ID NO: 4733 - DNA, 27 bp, Saccharomyces cerevisiae
ataggcgtcgtatatagtctcttcttt

SEQ ID NO: 4734 - DNA, 24 bp, Saccharomyces cerevisiae
gctaagaagtgttcgtatcgacat

SEQ ID NO: 4735 - DNA, 27 bp, Saccharomyces cerevisiae
aatatacataaatagaggaactttaca

SEQ ID NO: 4736 - DNA, 21 bp, Saccharomyces cerevisiae
cagctcagatgccgtatcttt

SEQ ID NO: 4737 - DNA, 26 bp, Saccharomyces cerevisiae
ccaacgatttagtgtatacttttgaa

SEQ ID NO: 4738 - DNA, 24 bp, Saccharomyces cerevisiae
ccctgacatctaagatacatggtt

SEQ ID NO: 4739 - DNA, 25 bp, Saccharomyces cerevisiae
gcagaagattgagaagactactacg

SEQ ID NO: 4740 - DNA, 22 bp, Saccharomyces cerevisiae
ttaactgcggtgaaccttcaat

SEQ ID NO: 4741 - DNA, 20 bp, Saccharomyces cerevisiae
aaggcttaattggaagttca

SEQ ID NO: 4742 - DNA, 27 bp, Saccharomyces cerevisiae
tagttttgtgtaaaatgtagcaaccta

SEQ ID NO: 4743 - DNA, 20 bp, Saccharomyces cerevisiae
gtgtagcctgtgtcggctat

SEQ ID NO: 4744 - DNA, 19 bp, Saccharomyces cerevisiae
agctttacgcctgtcgctg

SEQ ID NO: 4745 - DNA, 26 bp, Saccharomyces cerevisiae
tactacgtggaagaaaggaaaagaag

SEQ ID NO: 4746 - DNA, 23 bp, Saccharomyces cerevisiae
ttgaagttccgtattcgaaagaa

SEQ ID NO: 4747 - DNA, 24 bp, Saccharomyces cerevisiae
atgaaatgatgcatataagtagcg

SEQ ID NO: 4748 - DNA, 27 bp, Saccharomyces cerevisiae
gacatatctttattattcgatcattcg

SEQ ID NO: 4749 - DNA, 27 bp, Saccharomyces cerevisiae
tgtgctaaataatagaaacgtaagtca

SEQ ID NO: 4750 - DNA, 20 bp, Saccharomyces cerevisiae
caaccgtgaagacagggagt

SEQ ID NO: 4751 - DNA, 26 bp, Saccharomyces cerevisiae
gttaatggcttcaactccatttatga

SEQ ID NO: 4752 - DNA, 20 bp, Saccharomyces cerevisiae
gttagtctctcggccttgcg

SEQ ID NO: 4753 - DNA, 20 bp, Saccharomyces cerevisiae
atgcgtttttaaagaagtta

SEQ ID NO: 4754 - DNA, 24 bp, Saccharomyces cerevisiae
ccgtcatataaagtagcacaaaca

SEQ ID NO: 4755 - DNA, 21 bp, Saccharomyces cerevisiae
aatagctctcgggcgaatatc

SEQ ID NO: 4756 - DNA, 25 bp, Saccharomyces cerevisiae
taagaacaaagtaaatatacgccca

SEQ ID NO: 4757 - DNA, 27 bp, Saccharomyces cerevisiae
taattattctaccacttttccactgtt

SEQ ID NO: 4758 - DNA, 24 bp, Saccharomyces cerevisiae
atctttataaaattgaaaaggggg

SEQ ID NO: 4759 - DNA, 24 bp, Saccharomyces cerevisiae
actttaatgtcgttctcccttttt

SEQ ID NO: 4760 - DNA, 23 bp, Saccharomyces cerevisiae
cttttaaaggaagaaggcaggtt

SEQ ID NO: 4761 - DNA, 24 bp, Saccharomyces cerevisiae
aggaagagactgtcatagggaaga

SEQ ID NO: 4762 - DNA, 26 bp, Saccharomyces cerevisiae
gccctttctagtatctcctttattcg

SEQ ID NO: 4763 - DNA, 23 bp, Saccharomyces cerevisiae
taatttggttttgcgctaatcgt

SEQ ID NO: 4764 - DNA, 26 bp, Saccharomyces cerevisiae
atgtgacgtttcctaaaagaagtagc

SEQ ID NO: 4765 - DNA, 22 bp, Saccharomyces cerevisiae
ttgccggtatattaacgctacg

SEQ ID NO: 4766 - DNA, 23 bp, Saccharomyces cerevisiae
ttgcagtgtcttgaatctcttcc

SEQ ID NO: 4767 - DNA, 25 bp, Saccharomyces cerevisiae
taaaaaaaatgtaagaaaaaaaaaa

SEQ ID NO: 4768 - DNA, 25 bp, Saccharomyces cerevisiae
taaagtcgaaattctgacgagtaaa

SEQ ID NO: 4769 - DNA, 25 bp, Saccharomyces cerevisiae
taaggagttaaaggcaaagttttct

SEQ ID NO: 4770 - DNA, 27 bp, Saccharomyces cerevisiae
aacttcaatccaataggaaggagagaa

SEQ ID NO: 4771 - DNA, 18 bp, Saccharomyces cerevisiae
aatatttggggcccctcg

SEQ ID NO: 4772 - DNA, 27 bp, Saccharomyces cerevisiae
gcgcattagagagaatataaagaaaga

SEQ ID NO: 4773 - DNA, 20 bp, Saccharomyces cerevisiae
tagaatttcctttgcggaag

SEQ ID NO: 4774 - DNA, 26 bp, Saccharomyces cerevisiae
tagaactaacgctaatcgataaaaca

SEQ ID NO: 4775 - DNA, 27 bp, Saccharomyces cerevisiae
aaggtgtaagttaactgaaatgaaaat

SEQ ID NO: 4776 - DNA, 28 bp, Saccharomyces cerevisiae
ctctgttgtcctactatcgattatttgt

SEQ ID NO: 4777 - DNA, 26 bp, Saccharomyces cerevisiae
tttacaagtatttcaacacactatcg

SEQ ID NO: 4778 - DNA, 27 bp, Saccharomyces cerevisiae
gaatacattccttttaatgtcaaggtg

SEQ ID NO: 4779 - DNA, 27 bp, Saccharomyces cerevisiae
atactattgagtacaaaccatcattca

SEQ ID NO: 4780 - DNA, 20 bp, Saccharomyces cerevisiae
cggtaggtggtaagcggtat

SEQ ID NO: 4781 - DNA, 27 bp, Saccharomyces cerevisiae
taattacatttttttcttccttttttt

SEQ ID NO: 4782 - DNA, 27 bp, Saccharomyces cerevisiae
tgataagttattatgtacaagcatcgg

SEQ ID NO: 4783 - DNA, 26 bp, Saccharomyces cerevisiae
ttcatattagtataggatattaagca

SEQ ID NO: 4784 - DNA, 26 bp, Saccharomyces cerevisiae
ggattagattagtaatagtttacgct

SEQ ID NO: 4785 - DNA, 21 bp, Saccharomyces cerevisiae
tacataggaacgatacataaa

SEQ ID NO: 4786 - DNA, 24 bp, Saccharomyces cerevisiae
tccgactagtctctttttgtctca

SEQ ID NO: 4787 - DNA, 24 bp, Saccharomyces cerevisiae
atctaggtatttttatcttataca

SEQ ID NO: 4788 - DNA, 24 bp, Saccharomyces cerevisiae
gctgtactttgatgaatggtaaaa

SEQ ID NO: 4789 - DNA, 18 bp, Saccharomyces cerevisiae
gaaatgggccaaccatgc

SEQ ID NO: 4790 - DNA, 19 bp, Saccharomyces cerevisiae
tcgaactgacgtttacccg

SEQ ID NO: 4791 - DNA, 23 bp, Saccharomyces cerevisiae
atctatgtagatattttcagtca

SEQ ID NO: 4792 - DNA, 23 bp, Saccharomyces cerevisiae
gaatacgtgatagatgcttcgtg

SEQ ID NO: 4793 - DNA, 22 bp, Saccharomyces cerevisiae
aaatggagacaaaagaagggtt

SEQ ID NO: 4794 - DNA, 19 bp, Saccharomyces cerevisiae
caaatacgcgagcccttgt

SEQ ID NO: 4795 - DNA, 22 bp, Saccharomyces cerevisiae
tggctaacaaatggaaatgaaa

SEQ ID NO: 4796 - DNA, 27 bp, Saccharomyces cerevisiae
gacaacgactttattttcactttattt

SEQ ID NO: 4797 - DNA, 26 bp, Saccharomyces cerevisiae
tagataagagatatctaacgataaaa

SEQ ID NO: 4798 - DNA, 25 bp, Saccharomyces cerevisiae
ttagataattgttggaattccgttg

SEQ ID NO: 4799 - DNA, 25 bp, Saccharomyces cerevisiae
ggatttatgtgaaatgcttcttttt

SEQ ID NO: 4800 - DNA, 24 bp, Saccharomyces cerevisiae
gagaaaagaaaaagaggattcgat

SEQ ID NO: 4801 - DNA, 27 bp, Saccharomyces cerevisiae
accttcaaataaagatatagaagaccg

SEQ ID NO: 4802 - DNA, 27 bp, Saccharomyces cerevisiae
ggtatgtattacctcgtcctcatactc

SEQ ID NO: 4803 - DNA, 21 bp, Saccharomyces cerevisiae
aacaaagacgcattctcctcc

SEQ ID NO: 4804 - DNA, 26 bp, Saccharomyces cerevisiae
gtaaacaaaaatgtgacaaaagaacg

SEQ ID NO: 4805 - DNA, 27 bp, Saccharomyces cerevisiae
cacaaaaagattttcttataatgtatg

SEQ ID NO: 4806 - DNA, 22 bp, Saccharomyces cerevisiae
aaaagtgctggctttgcaataa

SEQ ID NO: 4807 - DNA, 21 bp, Saccharomyces cerevisiae
tttggcctccaaatgtaaaaa

SEQ ID NO: 4808 - DNA, 27 bp, Saccharomyces cerevisiae
tgtatcctacgtgtttgtatagtttgg

SEQ ID NO: 4809 - DNA, 22 bp, Saccharomyces cerevisiae
agtctcctccaacgtttttatg

SEQ ID NO: 4810 - DNA, 26 bp, Saccharomyces cerevisiae
gattaagggaaaagatatacgtcaga

SEQ ID NO: 4811 - DNA, 26 bp, Saccharomyces cerevisiae
gcgaaatagaatgcataagcataagt

SEQ ID NO: 4812 - DNA, 27 bp, Saccharomyces cerevisiae
gttgttgtttaaataaaatttccaaga

SEQ ID NO: 4813 - DNA, 27 bp, Saccharomyces cerevisiae
ctcgtagaaagattttctccattatga

SEQ ID NO: 4814 - DNA, 27 bp, Saccharomyces cerevisiae
aacatctaaatttgttgattgtataag

SEQ ID NO: 4815 - DNA, 21 bp, Saccharomyces cerevisiae
tatagctgtgctgagcctgaa

SEQ ID NO: 4816 - DNA, 26 bp, Saccharomyces cerevisiae
aactattgagtccttcacaagtacaa

SEQ ID NO: 4817 - DNA, 26 bp, Saccharomyces cerevisiae
tttaacttatataactgtacaatgtc

SEQ ID NO: 4818 - DNA, 22 bp, Saccharomyces cerevisiae
tgatattgttccctgtttcagc

SEQ ID NO: 4819 - DNA, 25 bp, Saccharomyces cerevisiae
gtacttggctcacgaatacatatca

SEQ ID NO: 4820 - DNA, 23 bp, Saccharomyces cerevisiae
tgatactctgcccagtaaaactt

SEQ ID NO: 4821 - DNA, 26 bp, Saccharomyces cerevisiae
actaagcgtacgaagcaaatattaca

SEQ ID NO: 4822 - DNA, 24 bp, Saccharomyces cerevisiae
gttgaaaaggtcatccaatatacc

SEQ ID NO: 4823 - DNA, 27 bp, Saccharomyces cerevisiae
aaaatataaactcttttctttcgatgg

SEQ ID NO: 4824 - DNA, 18 bp, Saccharomyces cerevisiae
aactaatcgccagtgcca

SEQ ID NO: 4825 - DNA, 21 bp, Saccharomyces cerevisiae
ttcctgagataaacgcaaaca

SEQ ID NO: 4826 - DNA, 18 bp, Saccharomyces cerevisiae
tgggaaagaaacgaacgc

SEQ ID NO: 4827 - DNA, 26 bp, Saccharomyces cerevisiae
ttcacttatcagtttacttcatttcg

SEQ ID NO: 4828 - DNA, 27 bp, Saccharomyces cerevisiae
tatatgttttcatatcctttataattc

SEQ ID NO: 4829 - DNA, 27 bp, Saccharomyces cerevisiae
ctgtaataaagatataaagggctgaag

SEQ ID NO: 4830 - DNA, 20 bp, Saccharomyces cerevisiae
aacttcatttaatttcccgt

SEQ ID NO: 4831 - DNA, 23 bp, Saccharomyces cerevisiae
cgtgttcaggtatctttttctcg

SEQ ID NO: 4832 - DNA, 21 bp, Saccharomyces cerevisiae
tgcggatggtacgtatgttct

SEQ ID NO: 4833 - DNA, 26 bp, Saccharomyces cerevisiae
cctcatatagaaatacacagcaaaag

SEQ ID NO: 4834 - DNA, 23 bp, Saccharomyces cerevisiae
gagtatagtgtataaagatcagt

SEQ ID NO: 4835 - DNA, 19 bp, Saccharomyces cerevisiae
taatcccaacgcacttcgc

SEQ ID NO: 4836 - DNA, 25 bp, Saccharomyces cerevisiae
taacgatttttgttacagttagcct

SEQ ID NO: 4837 - DNA, 27 bp, Saccharomyces cerevisiae
taagtagattgattacccctttgttat

SEQ ID NO: 4838 - DNA, 24 bp, Saccharomyces cerevisiae
cgaagatacactacttttattttt

SEQ ID NO: 4839 - DNA, 24 bp, Saccharomyces cerevisiae
gaaaaaactgttgttgtttttatg

SEQ ID NO: 4840 - DNA, 21 bp, Saccharomyces cerevisiae
acgccgaatttacaactcgaa

SEQ ID NO: 4841 - DNA, 23 bp, Saccharomyces cerevisiae
gtctgctgctagttttcctctaa

SEQ ID NO: 4842 - DNA, 27 bp, Saccharomyces cerevisiae
ttttagaataatactccataccacaca

SEQ ID NO: 4843 - DNA, 25 bp, Saccharomyces cerevisiae
catagatgtataactagaacaattt

SEQ ID NO: 4844 - DNA, 27 bp, Saccharomyces cerevisiae
tgagattcttttgcgaatatagttctt

SEQ ID NO: 4845 - DNA, 24 bp, Saccharomyces cerevisiae
gggcaatattttccacataaactt

SEQ ID NO: 4846 - DNA, 27 bp, Saccharomyces cerevisiae
aagatgaatacaatcaataaaaaggtg

SEQ ID NO: 4847 - DNA, 20 bp, Saccharomyces cerevisiae
ttcttcctggcggtagtatg

SEQ ID NO: 4848 - DNA, 25 bp, Saccharomyces cerevisiae
gtaagaacagtagcgcagaaattca

SEQ ID NO: 4849 - DNA, 21 bp, Saccharomyces cerevisiae
ttgtatattagcgaggccgtg

SEQ ID NO: 4850 - DNA, 27 bp, Saccharomyces cerevisiae
ttcagagacgtctttcttgtatctagt

SEQ ID NO: 4851 - DNA, 20 bp, Saccharomyces cerevisiae
gcaaattaagggcagacaaa

SEQ ID NO: 4852 - DNA, 27 bp, Saccharomyces cerevisiae
gtaaagcaggaaaatgtagttcatatc

SEQ ID NO: 4853 - DNA, 27 bp, Saccharomyces cerevisiae
accggattaatacaagtaaaatcagca

SEQ ID NO: 4854 - DNA, 23 bp, Saccharomyces cerevisiae
actataatagcgtgtcattattt

SEQ ID NO: 4855 - DNA, 19 bp, Saccharomyces cerevisiae
cgagaaaagcgtgtatccg

SEQ ID NO: 4856 - DNA, 23 bp, Saccharomyces cerevisiae
gaatatcgaagcatcacgtttca

SEQ ID NO: 4857 - DNA, 22 bp, Saccharomyces cerevisiae
aaatacaggtgaatgaaatatg

SEQ ID NO: 4858 - DNA, 24 bp, Saccharomyces cerevisiae
gatttgtaaaaccgtatatatctt

SEQ ID NO: 4859 - DNA, 24 bp, Saccharomyces cerevisiae
tgatcacaaccattacatacatca

SEQ ID NO: 4860 - DNA, 23 bp, Saccharomyces cerevisiae
acataagcttcgctctgtctttt

SEQ ID NO: 4861 - DNA, 25 bp, Saccharomyces cerevisiae
caatagtggactgaaataagccttt

SEQ ID NO: 4862 - DNA, 25 bp, Saccharomyces cerevisiae
gaaactgatggtaaatagtgagtgc

SEQ ID NO: 4863 - DNA, 24 bp, Saccharomyces cerevisiae
actccgaaactttttcatattgat

SEQ ID NO: 4864 - DNA, 26 bp, Saccharomyces cerevisiae
tctagacacagatatgtctcgcaaaa

SEQ ID NO: 4865 - DNA, 27 bp, Saccharomyces cerevisiae
tagttcaaatatatacatacatacaca

SEQ ID NO: 4866 - DNA, 26 bp, Saccharomyces cerevisiae
ataccggataatttatgtacgagtca

SEQ ID NO: 4867 - DNA, 27 bp, Saccharomyces cerevisiae
aagaggtttactcattatcgagaacat

SEQ ID NO: 4868 - DNA, 19 bp, Saccharomyces cerevisiae
tctggaaagtgattgacat

SEQ ID NO: 4869 - DNA, 26 bp, Saccharomyces cerevisiae
tgaattctttagataaattcttctgt

SEQ ID NO: 4870 - DNA, 19 bp, Saccharomyces cerevisiae
tctcccttgccccagtgta

SEQ ID NO: 4871 - DNA, 27 bp, Saccharomyces cerevisiae
ttcgacgcttgaacgtatatatctaat

SEQ ID NO: 4872 - DNA, 20 bp, Saccharomyces cerevisiae
aagaaagcggcaatagcctt

SEQ ID NO: 4873 - DNA, 27 bp, Saccharomyces cerevisiae
atattatataggggtacgtagttattc

SEQ ID NO: 4874 - DNA, 27 bp, Saccharomyces cerevisiae
cttatatacccatgacatagaaacaaa

SEQ ID NO: 4875 - DNA, 21 bp, Saccharomyces cerevisiae
tgtgcccatttacatttttct

SEQ ID NO: 4876 - DNA, 21 bp, Saccharomyces cerevisiae
gttacctgatggaaggaatgc

SEQ ID NO: 4877 - DNA, 23 bp, Saccharomyces cerevisiae
tctaaccgttaagaagctaaaaa

SEQ ID NO: 4878 - DNA, 27 bp, Saccharomyces cerevisiae
tgactaatgttttgttgtattttcctc

SEQ ID NO: 4879 - DNA, 25 bp, Saccharomyces cerevisiae
agtttaataaccccctttttgtttc

SEQ ID NO: 4880 - DNA, 26 bp, Saccharomyces cerevisiae
aaaatttgaagaagtatgtacgtatg

SEQ ID NO: 4881 - DNA, 27 bp, Saccharomyces cerevisiae
ctagtagattgatcacatgaaattttg

SEQ ID NO: 4882 - DNA, 22 bp, Saccharomyces cerevisiae
aaatgcttaggcttcgattttt

SEQ ID NO: 4883 - DNA, 26 bp, Saccharomyces cerevisiae
aatttaacttacatgttaatggtatg

SEQ ID NO: 4884 - DNA, 25 bp, Saccharomyces cerevisiae
ttttaagagcttcgataaatttgaa

SEQ ID NO: 4885 - DNA, 25 bp, Saccharomyces cerevisiae
ttcagtctcaaaactttcagtacaa

SEQ ID NO: 4886 - DNA, 22 bp, Saccharomyces cerevisiae
gtaacacgttccctgagaaacc

SEQ ID NO: 4887 - DNA, 26 bp, Saccharomyces cerevisiae
ggattctttttctattccataaaacc

SEQ ID NO: 4888 - DNA, 19 bp, Saccharomyces cerevisiae
gggacaaacgagaacaagc

SEQ ID NO: 4889 - DNA, 25 bp, Saccharomyces cerevisiae
tccttcgattaatcagatttctttt

SEQ ID NO: 4890 - DNA, 20 bp, Saccharomyces cerevisiae
tatgcaacgggtcggactat

SEQ ID NO: 4891 - DNA, 26 bp, Saccharomyces cerevisiae
ttcgactaaacatacaaggaaagtca

SEQ ID NO: 4892 - DNA, 27 bp, Saccharomyces cerevisiae
gaaaaatgatgtagccctatatagaca

SEQ ID NO: 4893 - DNA, 27 bp, Saccharomyces cerevisiae
ttttctattaatttgttctctttcccc

SEQ ID NO: 4894 - DNA, 27 bp, Saccharomyces cerevisiae
gccaaaggttgataattagaatttcct

SEQ ID NO: 4895 - DNA, 26 bp, Saccharomyces cerevisiae
ttacttcttacccacatccctatttc

SEQ ID NO: 4896 - DNA, 22 bp, Saccharomyces cerevisiae
tagaaaaatgcaagcacattca

SEQ ID NO: 4897 - DNA, 23 bp, Saccharomyces cerevisiae
aaaaaagctaggacgataacaaa

SEQ ID NO: 4898 - DNA, 25 bp, Saccharomyces cerevisiae
aaaacagactaacaatctagcatct

SEQ ID NO: 4899 - DNA, 26 bp, Saccharomyces cerevisiae
tcatattagtatatgcccatcttttc

SEQ ID NO: 4900 - DNA, 27 bp, Saccharomyces cerevisiae
ttctcatgtttcaataaaagtatgcgt

SEQ ID NO: 4901 - DNA, 26 bp, Saccharomyces cerevisiae
tagtcttagtcaatgaagagtttatg

SEQ ID NO: 4902 - DNA, 27 bp, Saccharomyces cerevisiae
gaggattaaccgagttctttacttttt

SEQ ID NO: 4903 - DNA, 26 bp, Saccharomyces cerevisiae
atcactttatttctaatgggttaagg

SEQ ID NO: 4904 - DNA, 27 bp, Saccharomyces cerevisiae
tttgtataataatggaagtgatttttg

SEQ ID NO: 4905 - DNA, 27 bp, Saccharomyces cerevisiae
tagaaatatatgaatgtgtacgttggt

SEQ ID NO: 4906 - DNA, 27 bp, Saccharomyces cerevisiae
tgttaaaaagacatgtgtatgtatagg

SEQ ID NO: 4907 - DNA, 27 bp, Saccharomyces cerevisiae
tcagactaaaaaccttttatgtatctt

SEQ ID NO: 4908 - DNA, 27 bp, Saccharomyces cerevisiae
aaggcctttaacaacgtctaataaaaa

SEQ ID NO: 4909 - DNA, 25 bp, Saccharomyces cerevisiae
tgctttattaattttcttttgcttt

SEQ ID NO: 4910 - DNA, 20 bp, Saccharomyces cerevisiae
tactgtgagacatggcggtt

SEQ ID NO: 4911 - DNA, 27 bp, Saccharomyces cerevisiae
acgtttgtatagataaaagttctcaaa

SEQ ID NO: 4912 - DNA, 25 bp, Saccharomyces cerevisiae
gtgattaaataggctgaaatcagtg

SEQ ID NO: 4913 - DNA, 20 bp, Saccharomyces cerevisiae
cagggagtttgaacagtgct

SEQ ID NO: 4914 - DNA, 24 bp, Saccharomyces cerevisiae
gacgacaaatagctagcacataca

SEQ ID NO: 4915 - DNA, 27 bp, Saccharomyces cerevisiae
tagatatagcgtgcatatacaagtgtt

SEQ ID NO: 4916 - DNA, 21 bp, Saccharomyces cerevisiae
ttatttgattagaagtgccgc

SEQ ID NO: 4917 - DNA, 26 bp, Saccharomyces cerevisiae
gctcattcaataaacgaaagtaacta

SEQ ID NO: 4918 - DNA, 25 bp, Saccharomyces cerevisiae
tagtataattgcgatcctttttgaa

SEQ ID NO: 4919 - DNA, 18 bp, Saccharomyces cerevisiae
tcataacgcagcccgtca

SEQ ID NO: 4920 - DNA, 25 bp, Saccharomyces cerevisiae
gaaatgtcaatcattattgctaacg

SEQ ID NO: 4921 - DNA, 26 bp, Saccharomyces cerevisiae
ttctaagcatggattaagaggatatt

SEQ ID NO: 4922 - DNA, 23 bp, Saccharomyces cerevisiae
gccaaataaatagtttcagcagc

SEQ ID NO: 4923 - DNA, 26 bp, Saccharomyces cerevisiae
agcaaagatttttatctatgtatgtg

SEQ ID NO: 4924 - DNA, 20 bp, Saccharomyces cerevisiae
gttttcacccccgttcttta

SEQ ID NO: 4925 - DNA, 20 bp, Saccharomyces cerevisiae
gcaatcattcgaaatgcaaa

SEQ ID NO: 4926 - DNA, 27 bp, Saccharomyces cerevisiae
aacatagctcttgtctgtaatcaaaaa

SEQ ID NO: 4927 - DNA, 28 bp, Saccharomyces cerevisiae
tgagtatatatatttaaaaagtactagg

SEQ ID NO: 4928 - DNA, 24 bp, Saccharomyces cerevisiae
gaatatggttcaatttatgggaaa

SEQ ID NO: 4929 - DNA, 27 bp, Saccharomyces cerevisiae
taaaaagcagtattgttttcgaatatg

SEQ ID NO: 4930 - DNA, 25 bp, Saccharomyces cerevisiae
tctcttcgtactatccttcatgtcg

SEQ ID NO: 4931 - DNA, 26 bp, Saccharomyces cerevisiae
ctattagatatgcttgattcatgtcc

SEQ ID NO: 4932 - DNA, 27 bp, Saccharomyces cerevisiae
aaattgctctcaatttctttatacatc

SEQ ID NO: 4933 - DNA, 25 bp, Saccharomyces cerevisiae
gccagtcatatatacctaagcaact

SEQ ID NO: 4934 - DNA, 21 bp, Saccharomyces cerevisiae
gctagcaagtaatgatggtgc

SEQ ID NO: 4935 - DNA, 27 bp, Saccharomyces cerevisiae
gattatccatagagagaatgaaaggtt

SEQ ID NO: 4936 - DNA, 23 bp, Saccharomyces cerevisiae
ttcgattaagaagtgcaacatga

SEQ ID NO: 4937 - DNA, 21 bp, Saccharomyces cerevisiae
aaagagcatatttgcgaagga

SEQ ID NO: 4938 - DNA, 27 bp, Saccharomyces cerevisiae
tagaagatatgtcaggtattggtcaaa

SEQ ID NO: 4939 - DNA, 25 bp, Saccharomyces cerevisiae
actaagaaatagagagagcactacg

SEQ ID NO: 4940 - DNA, 26 bp, Saccharomyces cerevisiae
cgcaaataacacctatataccactat

SEQ ID NO: 4941 - DNA, 26 bp, Saccharomyces cerevisiae
gcaatccataaatatgtaatagcacc

SEQ ID NO: 4942 - DNA, 25 bp, Saccharomyces cerevisiae
gaggagtgattttacacaaaaagtt

SEQ ID NO: 4943 - DNA, 26 bp, Saccharomyces cerevisiae
actgtgaaactaataaaaacctgtcc

SEQ ID NO: 4944 - DNA, 22 bp, Saccharomyces cerevisiae
gtgctctatttctatatattct

SEQ ID NO: 4945 - DNA, 23 bp, Saccharomyces cerevisiae
gttgaccgcccatattaatacct

SEQ ID NO: 4946 - DNA, 25 bp, Saccharomyces cerevisiae
tactaaactatattatgtaaaaggg

SEQ ID NO: 4947 - DNA, 20 bp, Saccharomyces cerevisiae
tgtgatggcctacacacttc

SEQ ID NO: 4948 - DNA, 27 bp, Saccharomyces cerevisiae
aaatggtaaagttttattttaaagggc

SEQ ID NO: 4949 - DNA, 27 bp, Saccharomyces cerevisiae
ttatattcatgagcacatgtagttttt

SEQ ID NO: 4950 - DNA, 27 bp, Saccharomyces cerevisiae
cgtggtatgtagttatattagaaattg

SEQ ID NO: 4951 - DNA, 24 bp, Saccharomyces cerevisiae
tcccaagacttatatagccctacg

SEQ ID NO: 4952 - DNA, 23 bp, Saccharomyces cerevisiae
gaagagcccacctattctttttc

SEQ ID NO: 4953 - DNA, 20 bp, Saccharomyces cerevisiae
taaactcacccaatgaccga

SEQ ID NO: 4954 - DNA, 25 bp, Saccharomyces cerevisiae
atggaataaatataaaacatgtaga

SEQ ID NO: 4955 - DNA, 27 bp, Saccharomyces cerevisiae
agaaaagaagatttttgcttctttgag

SEQ ID NO: 4956 - DNA, 22 bp, Saccharomyces cerevisiae
ccgtaagcgctattttcttttt

SEQ ID NO: 4957 - DNA, 24 bp, Saccharomyces cerevisiae
ggttggaaagtattgtttgacttc

SEQ ID NO: 4958 - DNA, 25 bp, Saccharomyces cerevisiae
aatacgatatccgtaattgtgtaaa

SEQ ID NO: 4959 - DNA, 21 bp, Saccharomyces cerevisiae
tgtttcaccatcgtcaatagc

SEQ ID NO: 4960 - DNA, 26 bp, Saccharomyces cerevisiae
cattgaggcaaataaaatatgaaaaa

SEQ ID NO: 4961 - DNA, 27 bp, Saccharomyces cerevisiae
taaactataattaagattttttttttt

SEQ ID NO: 4962 - DNA, 19 bp, Saccharomyces cerevisiae
taaggttcactctcgcccc

SEQ ID NO: 4963 - DNA, 26 bp, Saccharomyces cerevisiae
tgagcaatcttattggtttaatacat

SEQ ID NO: 4964 - DNA, 27 bp, Saccharomyces cerevisiae
tttatacaatttgctaatcaagaagaa

SEQ ID NO: 4965 - DNA, 19 bp, Saccharomyces cerevisiae
ccattccattaaagaaaaa

SEQ ID NO: 4966 - DNA, 27 bp, Saccharomyces cerevisiae
actaaaatacatagctttccgtgttat

SEQ ID NO: 4967 - DNA, 21 bp, Saccharomyces cerevisiae
aacacgagcgagaggataaaa

SEQ ID NO: 4968 - DNA, 22 bp, Saccharomyces cerevisiae
tgaatttgaaaaaggcaaggtt

SEQ ID NO: 4969 - DNA, 20 bp, Saccharomyces cerevisiae
gaggccgtaaggtggtttta

SEQ ID NO: 4970 - DNA, 24 bp, Saccharomyces cerevisiae
ttgggagaaaactttccatacttc

SEQ ID NO: 4971 - DNA, 23 bp, Saccharomyces cerevisiae
tgcattatgtaaattcctatcaa

SEQ ID NO: 4972 - DNA, 25 bp, Saccharomyces cerevisiae
gttaagttgaccaatattttcgagg

SEQ ID NO: 4973 - DNA, 26 bp, Saccharomyces cerevisiae
taaactggttgaagtcacattacata

SEQ ID NO: 4974 - DNA, 24 bp, Saccharomyces cerevisiae
taaaaggtaaaagggcgttaaatg

SEQ ID NO: 4975 - DNA, 19 bp, Saccharomyces cerevisiae
taatcattggcacctgggc

SEQ ID NO: 4976 - DNA, 23 bp, Saccharomyces cerevisiae
accaagaagtagtaaaagctcat

SEQ ID NO: 4977 - DNA, 25 bp, Saccharomyces cerevisiae
ttcaatatattttgcagcttgttca

SEQ ID NO: 4978 - DNA, 20 bp, Saccharomyces cerevisiae
tgttatttttggatttttca

SEQ ID NO: 4979 - DNA, 27 bp, Saccharomyces cerevisiae
gttaaaattagagaaattcattgtcca

SEQ ID NO: 4980 - DNA, 23 bp, Saccharomyces cerevisiae
tctgaacattttaactagcggga

SEQ ID NO: 4981 - DNA, 20 bp, Saccharomyces cerevisiae
ggcgaatagtgagaatcggt

SEQ ID NO: 4982 - DNA, 21 bp, Saccharomyces cerevisiae
gaaagagatcaaaactgcgaa

SEQ ID NO: 4983 - DNA, 25 bp, Saccharomyces cerevisiae
gaattttcttcagtaatgattcagc

SEQ ID NO: 4984 - DNA, 22 bp, Saccharomyces cerevisiae
aaattgttctactgtgcactcg

SEQ ID NO: 4985 - DNA, 21 bp, Saccharomyces cerevisiae
tctgcaaaataaataaggatt

SEQ ID NO: 4986 - DNA, 24 bp, Saccharomyces cerevisiae
tatttttctagtatgactgtattt

SEQ ID NO: 4987 - DNA, 23 bp, Saccharomyces cerevisiae
atgcaatcctgaatttgtcataa

SEQ ID NO: 4988 - DNA, 25 bp, Saccharomyces cerevisiae
cagtagagagattactttacataga

SEQ ID NO: 4989 - DNA, 20 bp, Saccharomyces cerevisiae
catgggtttcccagtatcca

SEQ ID NO: 4990 - DNA, 27 bp, Saccharomyces cerevisiae
ccgtgatatcttccgtataatttcaga

SEQ ID NO: 4991 - DNA, 20 bp, Saccharomyces cerevisiae
tcacaaggcaaagcggatag

SEQ ID NO: 4992 - DNA, 27 bp, Saccharomyces cerevisiae
tgttaatgcagcaaagtaactagaaaa

SEQ ID NO: 4993 - DNA, 24 bp, Saccharomyces cerevisiae
ctttgattttgaatttaggagcac

SEQ ID NO: 4994 - DNA, 27 bp, Saccharomyces cerevisiae
atatttgtatattattagatatgtatg

SEQ ID NO: 4995 - DNA, 25 bp, Saccharomyces cerevisiae
cagaatgtgtgaagagatgtttatc

SEQ ID NO: 4996 - DNA, 25 bp, Saccharomyces cerevisiae
ccttagtgttgttgctattattgct

SEQ ID NO: 4997 - DNA, 27 bp, Saccharomyces cerevisiae
aaagtctgaataatagaatgagttaca

SEQ ID NO: 4998 - DNA, 24 bp, Saccharomyces cerevisiae
gaactatgaacgctcgtaagtaaa

SEQ ID NO: 4999 - DNA, 26 bp, Saccharomyces cerevisiae
acatttgtatcgctattctttctttc

SEQ ID NO: 5000 - DNA, 25 bp, Saccharomyces cerevisiae
gtattaacttttttttactcgcttc

SEQ ID NO: 5001 - DNA, 22 bp, Saccharomyces cerevisiae
tgagcaaccactgatattgtga

SEQ ID NO: 5002 - DNA, 19 bp, Saccharomyces cerevisiae
gcacagaggtgagatgccc

SEQ ID NO: 5003 - DNA, 27 bp, Saccharomyces cerevisiae
catatgtagtatttacccaagtagtgg

SEQ ID NO: 5004 - DNA, 26 bp, Saccharomyces cerevisiae
tagaataatgtaaattgcacaatggc

SEQ ID NO: 5005 - DNA, 25 bp, Saccharomyces cerevisiae
tccaaagtttagttttatcctcaaa

SEQ ID NO: 5006 - DNA, 25 bp, Saccharomyces cerevisiae
caatttgaaatatagtcatccctgc

SEQ ID NO: 5007 - DNA, 21 bp, Saccharomyces cerevisiae
tcagtcctcgcaatattttca

SEQ ID NO: 5008 - DNA, 26 bp, Saccharomyces cerevisiae
tacaagaaataagacaattgagctgc

SEQ ID NO: 5009 - DNA, 24 bp, Saccharomyces cerevisiae
gtatctgattttcctttttcaccc

SEQ ID NO: 5010 - DNA, 22 bp, Saccharomyces cerevisiae
gctccctaataacagaatcgca

SEQ ID NO: 5011 - DNA, 25 bp, Saccharomyces cerevisiae
tcttgaagccaataggataatacca

SEQ ID NO: 5012 - DNA, 24 bp, Saccharomyces cerevisiae
ctgaatgtgaagaaaaagatcaac

SEQ ID NO: 5013 - DNA, 27 bp, Saccharomyces cerevisiae
gatcattctaggacattagtaattgga

SEQ ID NO: 5014 - DNA, 20 bp, Saccharomyces cerevisiae
tgaaatgaggctgaaacggt

SEQ ID NO: 5015 - DNA, 23 bp, Saccharomyces cerevisiae
ttgtgactggtgcatctatgtat

SEQ ID NO: 5016 - DNA, 26 bp, Saccharomyces cerevisiae
ctttttctgttcactaaccacaaacg

SEQ ID NO: 5017 - DNA, 20 bp, Saccharomyces cerevisiae
accgcggtactctcacaatg

SEQ ID NO: 5018 - DNA, 24 bp, Saccharomyces cerevisiae
ggctaaaagggaatcaatgataaa

SEQ ID NO: 5019 - DNA, 24 bp, Saccharomyces cerevisiae
tgaactatagaactgacatggacc

SEQ ID NO: 5020 - DNA, 23 bp, Saccharomyces cerevisiae
cttgcacatatgtatgcctgttt

SEQ ID NO: 5021 - DNA, 22 bp, Saccharomyces cerevisiae
agaaataaaattaacaagatga

SEQ ID NO: 5022 - DNA, 27 bp, Saccharomyces cerevisiae
gaaaacttgtgatctacttttgttttt

SEQ ID NO: 5023 - DNA, 22 bp, Saccharomyces cerevisiae
tgattatgccattattatattt

SEQ ID NO: 5024 - DNA, 27 bp, Saccharomyces cerevisiae
cagaagagatgaaggtgatatataggt

SEQ ID NO: 5025 - DNA, 20 bp, Saccharomyces cerevisiae
agcgggaactttatggaaaa

SEQ ID NO: 5026 - DNA, 18 bp, Saccharomyces cerevisiae
cattgaaggtgcggcttg

SEQ ID NO: 5027 - DNA, 26 bp, Saccharomyces cerevisiae
agaagattaacttaaatactagccat

SEQ ID NO: 5028 - DNA, 26 bp, Saccharomyces cerevisiae
ttaaatattactggctacattcattg

SEQ ID NO: 5029 - DNA, 24 bp, Saccharomyces cerevisiae
gggaaaatataaaaacagcaaaaa

SEQ ID NO: 5030 - DNA, 27 bp, Saccharomyces cerevisiae
gagctgaataatacttcttcaacctga

SEQ ID NO: 5031 - DNA, 26 bp, Saccharomyces cerevisiae
tgaaaaagggctacttattaattctt

SEQ ID NO: 5032 - DNA, 24 bp, Saccharomyces cerevisiae
ctttcctggttagtcttttggttt

SEQ ID NO: 5033 - DNA, 21 bp, Saccharomyces cerevisiae
gttttagttaatttttttgct

SEQ ID NO: 5034 - DNA, 21 bp, Saccharomyces cerevisiae
aggtccgacagatttttgttc

SEQ ID NO: 5035 - DNA, 27 bp, Saccharomyces cerevisiae
tttgaagtcgagtacatctctttcagt

SEQ ID NO: 5036 - DNA, 25 bp, Saccharomyces cerevisiae
ggttagaatgaaaataaaattcgcc

SEQ ID NO: 5037 - DNA, 25 bp, Saccharomyces cerevisiae
atatattatcagaaatcggcgagaa

SEQ ID NO: 5038 - DNA, 22 bp, Saccharomyces cerevisiae
gggcaagtcttaatagcgtctt

SEQ ID NO: 5039 - DNA, 25 bp, Saccharomyces cerevisiae
agtaattctatcttgcgttgttttc

SEQ ID NO: 5040 - DNA, 25 bp, Saccharomyces cerevisiae
ttcgataattgatatttatatgagc

SEQ ID NO: 5041 - DNA, 25 bp, Saccharomyces cerevisiae
gttcttacgaatgctttttcttttt

SEQ ID NO: 5042 - DNA, 22 bp, Saccharomyces cerevisiae
ccagaaaactaagtcatcttat

SEQ ID NO: 5043 - DNA, 24 bp, Saccharomyces cerevisiae
ctgttttaaatagtgttcgcagca

SEQ ID NO: 5044 - DNA, 24 bp, Saccharomyces cerevisiae
ttttcagggaattgaagaaaataa

SEQ ID NO: 5045 - DNA, 27 bp, Saccharomyces cerevisiae
aaggcttaaagttagaaagcagtaaaa

SEQ ID NO: 5046 - DNA, 26 bp, Saccharomyces cerevisiae
attagtgaagatcgcaacaaataaaa

SEQ ID NO: 5047 - DNA, 27 bp, Saccharomyces cerevisiae
gttgtatctgtacaaaatccaaagctg

SEQ ID NO: 5048 - DNA, 24 bp, Saccharomyces cerevisiae
ttttaaattagagtattgcagtga

SEQ ID NO: 5049 - DNA, 27 bp, Saccharomyces cerevisiae
ttattcttctatagtgttctatttagc

SEQ ID NO: 5050 - DNA, 24 bp, Saccharomyces cerevisiae
taaatagaacttttatgtgccgcc

SEQ ID NO: 5051 - DNA, 23 bp, Saccharomyces cerevisiae
tgggagtagatggaaaaagtacg

SEQ ID NO: 5052 - DNA, 20 bp, Saccharomyces cerevisiae
atgggcttttagcaatgtca

SEQ ID NO: 5053 - DNA, 24 bp, Saccharomyces cerevisiae
gctaaacttttcttacttctccgc

SEQ ID NO: 5054 - DNA, 25 bp, Saccharomyces cerevisiae
aggatggaataaagttttgttgtga

SEQ ID NO: 5055 - DNA, 25 bp, Saccharomyces cerevisiae
ctggccaaataagattagtatagtt

SEQ ID NO: 5056 - DNA, 21 bp, Saccharomyces cerevisiae
gttgaagcttgattttatttt

SEQ ID NO: 5057 - DNA, 22 bp, Saccharomyces cerevisiae
tgagcacgctatttgtagtttg

SEQ ID NO: 5058 - DNA, 27 bp, Saccharomyces cerevisiae
cattctaatgacataactatttgacga

SEQ ID NO: 5059 - DNA, 26 bp, Saccharomyces cerevisiae
tctatttctatgtactttgccattca

SEQ ID NO: 5060 - DNA, 26 bp, Saccharomyces cerevisiae
gttttgcatatgtattatgcaggttc

SEQ ID NO: 5061 - DNA, 27 bp, Saccharomyces cerevisiae
agctgattcatttatatttcatctttt

SEQ ID NO: 5062 - DNA, 22 bp, Saccharomyces cerevisiae
ccagtgacttagctgggagttt

SEQ ID NO: 5063 - DNA, 21 bp, Saccharomyces cerevisiae
ggcaagtcaattaaacgtcaa

SEQ ID NO: 5064 - DNA, 24 bp, Saccharomyces cerevisiae
tatgcaacaatatgtaggctcatt

SEQ ID NO: 5065 - DNA, 18 bp, Saccharomyces cerevisiae
tttgcggtcaacgaagtt

SEQ ID NO: 5066 - DNA, 27 bp, Saccharomyces cerevisiae
tttaagagtttgctattcggttaatct

SEQ ID NO: 5067 - DNA, 23 bp, Saccharomyces cerevisiae
atagatttcactttttttttggc

SEQ ID NO: 5068 - DNA, 23 bp, Saccharomyces cerevisiae
tttttagtcaggctgaaacactg

SEQ ID NO: 5069 - DNA, 24 bp, Saccharomyces cerevisiae
tagccagtaggtagatacggcgtt

SEQ ID NO: 5070 - DNA, 22 bp, Saccharomyces cerevisiae
tgggcaagttgaaataaatagc

SEQ ID NO: 5071 - DNA, 25 bp, Saccharomyces cerevisiae
tcttcctgaacgtaatgtttaaggt

SEQ ID NO: 5072 - DNA, 23 bp, Saccharomyces cerevisiae
ataaatatacggccttgttagcg

SEQ ID NO: 5073 - DNA, 27 bp, Saccharomyces cerevisiae
aagaagtaaaacataatgtagggaaca

SEQ ID NO: 5074 - DNA, 26 bp, Saccharomyces cerevisiae
ggtcctaaataaacgagctaaatacc

SEQ ID NO: 5075 - DNA, 27 bp, Saccharomyces cerevisiae
tagaagtaagatttccgagaaataaag

SEQ ID NO: 5076 - DNA, 27 bp, Saccharomyces cerevisiae
caaagactttagatcagtaaacagaca

SEQ ID NO: 5077 - DNA, 25 bp, Saccharomyces cerevisiae
ttaaagtgtatggtttccttgtttc

SEQ ID NO: 5078 - DNA, 18 bp, Saccharomyces cerevisiae
tagccatgggcggctact

SEQ ID NO: 5079 - DNA, 19 bp, Saccharomyces cerevisiae
tgacgtccgctttctcagt

SEQ ID NO: 5080 - DNA, 25 bp, Saccharomyces cerevisiae
atctcataagaatggtggtgattat

SEQ ID NO: 5081 - DNA, 23 bp, Saccharomyces cerevisiae
atagtttggcagactcctaatgg

SEQ ID NO: 5082 - DNA, 25 bp, Saccharomyces cerevisiae
ataccgcataaatccattaactagg

SEQ ID NO: 5083 - DNA, 20 bp, Saccharomyces cerevisiae
accgttttgttgcgttcgta

SEQ ID NO: 5084 - DNA, 27 bp, Saccharomyces cerevisiae
tttgactaaatagtgcgaatattcctt

SEQ ID NO: 5085 - DNA, 25 bp, Saccharomyces cerevisiae
aatactcattcatgggaatatcaag

SEQ ID NO: 5086 - DNA, 26 bp, Saccharomyces cerevisiae
ataaggtaagttcaaacgatttgttg

SEQ ID NO: 5087 - DNA, 22 bp, Saccharomyces cerevisiae
tagaccccaaaagaacaaattc

SEQ ID NO: 5088 - DNA, 21 bp, Saccharomyces cerevisiae
aacatttgtggctgttcaaat

SEQ ID NO: 5089 - DNA, 27 bp, Saccharomyces cerevisiae
gatatttgaccaagagttgttctagtc

SEQ ID NO: 5090 - DNA, 25 bp, Saccharomyces cerevisiae
acacaaattttgacaatcacaaaga

SEQ ID NO: 5091 - DNA, 22 bp, Saccharomyces cerevisiae
atggctcaacagagtgagtgtc

SEQ ID NO: 5092 - DNA, 25 bp, Saccharomyces cerevisiae
caatgtgtgtgattgttaagtctgg

SEQ ID NO: 5093 - DNA, 22 bp, Saccharomyces cerevisiae
tccaggtactgctgctatttga

SEQ ID NO: 5094 - DNA, 23 bp, Saccharomyces cerevisiae
agaatacacaagatgtatagagt

SEQ ID NO: 5095 - DNA, 20 bp, Saccharomyces cerevisiae
cacacaaaactgccttcgat

SEQ ID NO: 5096 - DNA, 27 bp, Saccharomyces cerevisiae
aaaatataactgatgtaggcagaaaaa

SEQ ID NO: 5097 - DNA, 27 bp, Saccharomyces cerevisiae
tctattacacctttatccttactacgc

SEQ ID NO: 5098 - DNA, 25 bp, Saccharomyces cerevisiae
ttagttactgaagagtacgtgagcg

SEQ ID NO: 5099 - DNA, 25 bp, Saccharomyces cerevisiae
gtctgaagaatgaatgatttgatga

SEQ ID NO: 5100 - DNA, 24 bp, Saccharomyces cerevisiae
ggtaaatgatttcacaaatgacaa

SEQ ID NO: 5101 - DNA, 27 bp, Saccharomyces cerevisiae
ggaatttgattatacgtcagaatttta

SEQ ID NO: 5102 - DNA, 26 bp, Saccharomyces cerevisiae
caaatcaggcaactaaaacattactc

SEQ ID NO: 5103 - DNA, 26 bp, Saccharomyces cerevisiae
tatataacaattactcatcccctcaa

SEQ ID NO: 5104 - DNA, 22 bp, Saccharomyces cerevisiae
tgaatttcaaagatgcaggttg

SEQ ID NO: 5105 - DNA, 22 bp, Saccharomyces cerevisiae
atttttcacctttcctcttcaa

SEQ ID NO: 5106 - DNA, 24 bp, Saccharomyces cerevisiae
agaaaattcaatgtggtaacctcg

SEQ ID NO: 5107 - DNA, 24 bp, Saccharomyces cerevisiae
tccgattgagagcgtatatactta

SEQ ID NO: 5108 - DNA, 24 bp, Saccharomyces cerevisiae
gcaaagaaataagcatcacataag

SEQ ID NO: 5109 - DNA, 26 bp, Saccharomyces cerevisiae
gtcaaatattgtgttgcttatacagg

SEQ ID NO: 5110 - DNA, 22 bp, Saccharomyces cerevisiae
tcgaccagcagcttgtatacct

SEQ ID NO: 5111 - DNA, 26 bp, Saccharomyces cerevisiae
aagactgagtaaataaagtattgtga

SEQ ID NO: 5112 - DNA, 26 bp, Saccharomyces cerevisiae
taatagggagattgaggatatagctg

SEQ ID NO: 5113 - DNA, 25 bp, Saccharomyces cerevisiae
aaaatgtgatcattaagagtagagg

SEQ ID NO: 5114 - DNA, 27 bp, Saccharomyces cerevisiae
cactttcataagatatgtgtaaaatgg

SEQ ID NO: 5115 - DNA, 21 bp, Saccharomyces cerevisiae
tataatagcacgagggagggt

SEQ ID NO: 5116 - DNA, 27 bp, Saccharomyces cerevisiae
attagtttaacgcactttacaaatgtc

SEQ ID NO: 5117 - DNA, 22 bp, Saccharomyces cerevisiae
aaatggcggagtaagatctctg

SEQ ID NO: 5118 - DNA, 23 bp, Saccharomyces cerevisiae
ttatactgtaatcagcccacgtt

SEQ ID NO: 5119 - DNA, 22 bp, Saccharomyces cerevisiae
attcctgcttaaaagatactgg

SEQ ID NO: 5120 - DNA, 24 bp, Saccharomyces cerevisiae
cgttaagactgcattcatcacata

SEQ ID NO: 5121 - DNA, 21 bp, Saccharomyces cerevisiae
gctgtttaggattgccttttt

SEQ ID NO: 5122 - DNA, 22 bp, Saccharomyces cerevisiae
tttgaatgccatgaagtgtagc

SEQ ID NO: 5123 - DNA, 26 bp, Saccharomyces cerevisiae
tgcaagactcttacgaaatattaaag

SEQ ID NO: 5124 - DNA, 27 bp, Saccharomyces cerevisiae
aactaagggagacaaaaacttcttaaa

SEQ ID NO: 5125 - DNA, 18 bp, Saccharomyces cerevisiae
tgcgatagcacacgttgg

SEQ ID NO: 5126 - DNA, 27 bp, Saccharomyces cerevisiae
tagataaatacaaacttcgttttcctt

SEQ ID NO: 5127 - DNA, 26 bp, Saccharomyces cerevisiae
cgttgttcttactaaatatttcaacg

SEQ ID NO: 5128 - DNA, 24 bp, Saccharomyces cerevisiae
aggtagaagagcagcactattttt

SEQ ID NO: 5129 - DNA, 22 bp, Saccharomyces cerevisiae
gaaactgtgtaaacaaaataaa

SEQ ID NO: 5130 - DNA, 21 bp, Saccharomyces cerevisiae
gcctccgcttaaaaatcagtt

SEQ ID NO: 5131 - DNA, 20 bp, Saccharomyces cerevisiae
gctctcttttgtcgttggtt

SEQ ID NO: 5132 - DNA, 20 bp, Saccharomyces cerevisiae
tggatccactttctggagga

SEQ ID NO: 5133 - DNA, 24 bp, Saccharomyces cerevisiae
tggacctaattattcagttatggg

SEQ ID NO: 5134 - DNA, 24 bp, Saccharomyces cerevisiae
gtaggtttttagtccataaatagt

SEQ ID NO: 5135 - DNA, 20 bp, Saccharomyces cerevisiae
agatctgcgggagtgatgag

SEQ ID NO: 5136 - DNA, 22 bp, Saccharomyces cerevisiae
taggtgcatccttgtgattttt

SEQ ID NO: 5137 - DNA, 21 bp, Saccharomyces cerevisiae
acgagagggagcgtcttaatg

SEQ ID NO: 5138 - DNA, 20 bp, Saccharomyces cerevisiae
tttacccgatgctggttttg

SEQ ID NO: 5139 - DNA, 22 bp, Saccharomyces cerevisiae
aagctcaactgaaacagatgta

SEQ ID NO: 5140 - DNA, 26 bp, Saccharomyces cerevisiae
aaatcttggaacatactgtttctttg

SEQ ID NO: 5141 - DNA, 24 bp, Saccharomyces cerevisiae
tcttgttaatttcgaaaatgttat

SEQ ID NO: 5142 - DNA, 27 bp, Saccharomyces cerevisiae
ttacatatctaagtacataactacaca

SEQ ID NO: 5143 - DNA, 20 bp, Saccharomyces cerevisiae
aagtgcgctttgacgagatt

SEQ ID NO: 5144 - DNA, 27 bp, Saccharomyces cerevisiae
taggcttctttacattgatacacaata

SEQ ID NO: 5145 - DNA, 27 bp, Saccharomyces cerevisiae
gtattagaagagttgttagttgtactt

SEQ ID NO: 5146 - DNA, 20 bp, Saccharomyces cerevisiae
gatgttgtttggcttatggc

SEQ ID NO: 5147 - DNA, 25 bp, Saccharomyces cerevisiae
gtagattggattatatctatcaaca

SEQ ID NO: 5148 - DNA, 19 bp, Saccharomyces cerevisiae
taagtcaacgacggggtgc

SEQ ID NO: 5149 - DNA, 21 bp, Saccharomyces cerevisiae
ggtaaaatgcgctttcaaatg

SEQ ID NO: 5150 - DNA, 24 bp, Saccharomyces cerevisiae
ttgttaaaattctcacatcatcca

SEQ ID NO: 5151 - DNA, 23 bp, Saccharomyces cerevisiae
agagattttcgagtaagtgtcgg

SEQ ID NO: 5152 - DNA, 27 bp, Saccharomyces cerevisiae
taataagatctcgatattcattgctct

SEQ ID NO: 5153 - DNA, 27 bp, Saccharomyces cerevisiae
tagctatgaatttttctttataaaccg

SEQ ID NO: 5154 - DNA, 25 bp, Saccharomyces cerevisiae
tcaatgaaagtaaataaaaaaaact

SEQ ID NO: 5155 - DNA, 22 bp, Saccharomyces cerevisiae
gacattcctatttatagttgaa

SEQ ID NO: 5156 - DNA, 25 bp, Saccharomyces cerevisiae
gataattaacttttgttagtttttt

SEQ ID NO: 5157 - DNA, 22 bp, Saccharomyces cerevisiae
ttcaaaaattaacataacataa

SEQ ID NO: 5158 - DNA, 20 bp, Saccharomyces cerevisiae
tacacgcgctcgtacggata

SEQ ID NO: 5159 - DNA, 23 bp, Saccharomyces cerevisiae
cacacaaggagaaatctgcataa

SEQ ID NO: 5160 - DNA, 19 bp, Saccharomyces cerevisiae
taaccgctctgcctggaac

SEQ ID NO: 5161 - DNA, 23 bp, Saccharomyces cerevisiae
atgatatgtgaataatcatgcgg

SEQ ID NO: 5162 - DNA, 23 bp, Saccharomyces cerevisiae
gagcatgcttctctttttttttg

SEQ ID NO: 5163 - DNA, 27 bp, Saccharomyces cerevisiae
atacaataactttatgtgtcacgttcc

SEQ ID NO: 5164 - DNA, 26 bp, Saccharomyces cerevisiae
tctctgaataagtactgacactcaca

SEQ ID NO: 5165 - DNA, 24 bp, Saccharomyces cerevisiae
gccatcataaataaacaatgacga

SEQ ID NO: 5166 - DNA, 24 bp, Saccharomyces cerevisiae
aaggaaatcttttctttatgtccc

SEQ ID NO: 5167 - DNA, 21 bp, Saccharomyces cerevisiae
gtcattcgctcatgctttctt

SEQ ID NO: 5168 - DNA, 23 bp, Saccharomyces cerevisiae
ataaataaggacatcgcagaagc

SEQ ID NO: 5169 - DNA, 26 bp, Saccharomyces cerevisiae
aaacacgattaaacttattagtacat

SEQ ID NO: 5170 - DNA, 21 bp, Saccharomyces cerevisiae
gaaacaacagttcgcgtctaa

SEQ ID NO: 5171 - DNA, 20 bp, Saccharomyces cerevisiae
aacggttggtgaaacaaaaa

SEQ ID NO: 5172 - DNA, 27 bp, Saccharomyces cerevisiae
caaaagagtatatttagcttatagttt

SEQ ID NO: 5173 - DNA, 26 bp, Saccharomyces cerevisiae
gcgagtgtatagtaccttcctaaagc

SEQ ID NO: 5174 - DNA, 20 bp, Saccharomyces cerevisiae
gttcaaggcttacgccgagt

SEQ ID NO: 5175 - DNA, 19 bp, Saccharomyces cerevisiae
aacgcttttgaggtggcag

SEQ ID NO: 5176 - DNA, 26 bp, Saccharomyces cerevisiae
gaaactgtatcattcatcaaatagga

SEQ ID NO: 5177 - DNA, 25 bp, Saccharomyces cerevisiae
acaaaaaagagtaaagaagataaaa

SEQ ID NO: 5178 - DNA, 25 bp, Saccharomyces cerevisiae
gaaaagagaaagggaacacttctaa

SEQ ID NO: 5179 - DNA, 27 bp, Saccharomyces cerevisiae
gaacatttttatttcctttattttttt

SEQ ID NO: 5180 - DNA, 22 bp, Saccharomyces cerevisiae
tccaaataagcggattatgagt

SEQ ID NO: 5181 - DNA, 26 bp, Saccharomyces cerevisiae
accttatccctcatttatcaacattt

SEQ ID NO: 5182 - DNA, 21 bp, Saccharomyces cerevisiae
agtttcaggcagaacaagacc

SEQ ID NO: 5183 - DNA, 25 bp, Saccharomyces cerevisiae
gcttgttaaatgagtcgttaaatgt

SEQ ID NO: 5184 - DNA, 25 bp, Saccharomyces cerevisiae
ttgtgatctgtattttcttcgtacc

SEQ ID NO: 5185 - DNA, 23 bp, Saccharomyces cerevisiae
caaattagttagttggctctgcc

SEQ ID NO: 5186 - DNA, 24 bp, Saccharomyces cerevisiae
ttatgttacccacattctccactc

SEQ ID NO: 5187 - DNA, 27 bp, Saccharomyces cerevisiae
gtgtactgttcacatcaagtatttctg

SEQ ID NO: 5188 - DNA, 27 bp, Saccharomyces cerevisiae
tgatatccttctctgtagttttgtaga

SEQ ID NO: 5189 - DNA, 22 bp, Saccharomyces cerevisiae
cacggttgaacaaagaaagatt

SEQ ID NO: 5190 - DNA, 22 bp, Saccharomyces cerevisiae
ttaaacgtgtggtttatgggtg

SEQ ID NO: 5191 - DNA, 25 bp, Saccharomyces cerevisiae
ttttgcgttagaataactacgtacc

SEQ ID NO: 5192 - DNA, 23 bp, Saccharomyces cerevisiae
gatggttacgtatcctgtgcagc

SEQ ID NO: 5193 - DNA, 23 bp, Saccharomyces cerevisiae
ttcgatcaaaagcgaagtatttt

SEQ ID NO: 5194 - DNA, 18 bp, Saccharomyces cerevisiae
ggggtgcagtgagtgtat

SEQ ID NO: 5195 - DNA, 27 bp, Saccharomyces cerevisiae
gtatatacattatcgttacgctgacat

SEQ ID NO: 5196 - DNA, 22 bp, Saccharomyces cerevisiae
gagtgtctcgatctctcagtcg

SEQ ID NO: 5197 - DNA, 25 bp, Saccharomyces cerevisiae
tattgtagccttttctatgtatttg

SEQ ID NO: 5198 - DNA, 25 bp, Saccharomyces cerevisiae
aaaagttatcgttccttcttctttt

SEQ ID NO: 5199 - DNA, 25 bp, Saccharomyces cerevisiae
tgctctatgtaatcacctacttccc

SEQ ID NO: 5200 - DNA, 27 bp, Saccharomyces cerevisiae
cgtagattataattaaggcgacttttc

SEQ ID NO: 5201 - DNA, 27 bp, Saccharomyces cerevisiae
accctctaagtagaaggcaatttaata

SEQ ID NO: 5202 - DNA, 18 bp, Saccharomyces cerevisiae
tagttcgggaatcgaggc

SEQ ID NO: 5203 - DNA, 27 bp, Saccharomyces cerevisiae
tagctttcttgaaataaaactgaaagt

SEQ ID NO: 5204 - DNA, 23 bp, Saccharomyces cerevisiae
atgctcgtgtagtgaacctaaat

SEQ ID NO: 5205 - DNA, 25 bp, Saccharomyces cerevisiae
tcgaaataatataaacaaacgtgcg

SEQ ID NO: 5206 - DNA, 21 bp, Saccharomyces cerevisiae
taaatcccctgtttcctttcg

SEQ ID NO: 5207 - DNA, 23 bp, Saccharomyces cerevisiae
gcaggtcttcttcttttgaagtt

SEQ ID NO: 5208 - DNA, 26 bp, Saccharomyces cerevisiae
gtaagtattttgtatgtgttgtgtga

SEQ ID NO: 5209 - DNA, 25 bp, Saccharomyces cerevisiae
atacgaatgtgggcgtatataataa

SEQ ID NO: 5210 - DNA, 24 bp, Saccharomyces cerevisiae
cctaaatattagttgacctataca

SEQ ID NO: 5211 - DNA, 26 bp, Saccharomyces cerevisiae
tagagcgtataaagatttttgtcatt

SEQ ID NO: 5212 - DNA, 26 bp, Saccharomyces cerevisiae
tctagtttttttttttttctctcttc

SEQ ID NO: 5213 - DNA, 25 bp, Saccharomyces cerevisiae
tcatctaaattagtggaagctgaaa

SEQ ID NO: 5214 - DNA, 20 bp, Saccharomyces cerevisiae
ggcatcctgcaactgttctg

SEQ ID NO: 5215 - DNA, 23 bp, Saccharomyces cerevisiae
caactttcccttctgtttcaatc

SEQ ID NO: 5216 - DNA, 22 bp, Saccharomyces cerevisiae
ccctcaggtgtcgttaaataag

SEQ ID NO: 5217 - DNA, 26 bp, Saccharomyces cerevisiae
gttattaacgtaacataatccagttt

SEQ ID NO: 5218 - DNA, 26 bp, Saccharomyces cerevisiae
gagctttaaacaaggaggagtataaa

SEQ ID NO: 5219 - DNA, 27 bp, Saccharomyces cerevisiae
tatgatggttgagtaaaaagaaaacaa

SEQ ID NO: 5220 - DNA, 25 bp, Saccharomyces cerevisiae
acggtgtgatgttcattagtacttt

SEQ ID NO: 5221 - DNA, 25 bp, Saccharomyces cerevisiae
aaaaattaaaagttttccgattgaa

SEQ ID NO: 5222 - DNA, 19 bp, Saccharomyces cerevisiae
gcgctcaaaccaggctttt

SEQ ID NO: 5223 - DNA, 22 bp, Saccharomyces cerevisiae
cccaaggtttaaagtccttttc

SEQ ID NO: 5224 - DNA, 25 bp, Saccharomyces cerevisiae
cccatttaatatatctctgcgtaca

SEQ ID NO: 5225 - DNA, 23 bp, Saccharomyces cerevisiae
ttccgtggataaacctagctaaa

SEQ ID NO: 5226 - DNA, 27 bp, Saccharomyces cerevisiae
aaggaatttcaaaaatagtcatctcaa

SEQ ID NO: 5227 - DNA, 26 bp, Saccharomyces cerevisiae
tattcagcttctttattctaaatgcg

SEQ ID NO: 5228 - DNA, 22 bp, Saccharomyces cerevisiae
tgtattcgtttcacttggctca

SEQ ID NO: 5229 - DNA, 20 bp, Saccharomyces cerevisiae
acgtgaacatgtgtgcgtat

SEQ ID NO: 5230 - DNA, 23 bp, Saccharomyces cerevisiae
tgttaagttagattttcatgggc

SEQ ID NO: 5231 - DNA, 26 bp, Saccharomyces cerevisiae
attatggatatataacgtcattttga

SEQ ID NO: 5232 - DNA, 18 bp, Saccharomyces cerevisiae
tagaggaggcccctgcat

SEQ ID NO: 5233 - DNA, 25 bp, Saccharomyces cerevisiae
ttttaaatggaatttttaatgttcg

SEQ ID NO: 5234 - DNA, 27 bp, Saccharomyces cerevisiae
tatgttatatagtctttttatttatgt

SEQ ID NO: 5235 - DNA, 23 bp, Saccharomyces cerevisiae
tcacgtaaatgatacgtaagaag

SEQ ID NO: 5236 - DNA, 21 bp, Saccharomyces cerevisiae
agcggaaactaagtagttcat

SEQ ID NO: 5237 - DNA, 25 bp, Saccharomyces cerevisiae
atgttaaaatggcatcatcaataca

SEQ ID NO: 5238 - DNA, 27 bp, Saccharomyces cerevisiae
aaaagatgaatgtctctttgttaattt

SEQ ID NO: 5239 - DNA, 26 bp, Saccharomyces cerevisiae
gcaaataagtgagatttttagctttt

SEQ ID NO: 5240 - DNA, 23 bp, Saccharomyces cerevisiae
tttttccttttctgtttacatgg

SEQ ID NO: 5241 - DNA, 27 bp, Saccharomyces cerevisiae
cactattaatcaagcagaaagtaattg

SEQ ID NO: 5242 - DNA, 23 bp, Saccharomyces cerevisiae
tgcagtagctaaatgaccacaga

SEQ ID NO: 5243 - DNA, 24 bp, Saccharomyces cerevisiae
gtcatcttatgtgtctcggttaaa

SEQ ID NO: 5244 - DNA, 27 bp, Saccharomyces cerevisiae
atgattagtatatacctacacaattac

SEQ ID NO: 5245 - DNA, 20 bp, Saccharomyces cerevisiae
gcttaagcgcaatcattgaa

SEQ ID NO: 5246 - DNA, 23 bp, Saccharomyces cerevisiae
gaggcaactcacctatatcctca

SEQ ID NO: 5247 - DNA, 21 bp, Saccharomyces cerevisiae
gcccaagagtaacgtgaaaaa

SEQ ID NO: 5248 - DNA, 24 bp, Saccharomyces cerevisiae
ggatagaatggttcttttgctttt

SEQ ID NO: 5249 - DNA, 24 bp, Saccharomyces cerevisiae
tcaagctaaattttgaggactttt

SEQ ID NO: 5250 - DNA, 19 bp, Saccharomyces cerevisiae
tttcccttgtgtgcctgct

SEQ ID NO: 5251 - DNA, 27 bp, Saccharomyces cerevisiae
attctctaacttaagatgaccagatgt

SEQ ID NO: 5252 - DNA, 20 bp, Saccharomyces cerevisiae
tcatctttgaaggcttgtgc

SEQ ID NO: 5253 - DNA, 20 bp, Saccharomyces cerevisiae
atcaaccaacggcttcttct

SEQ ID NO: 5254 - DNA, 21 bp, Saccharomyces cerevisiae
tgaaccggtagatgaaaatgt

SEQ ID NO: 5255 - DNA, 20 bp, Saccharomyces cerevisiae
acgatgattcagttcgcctt

SEQ ID NO: 5256 - DNA, 23 bp, Saccharomyces cerevisiae
ctgctattctaaaacgggtactg

SEQ ID NO: 5257 - DNA, 24 bp, Saccharomyces cerevisiae
aactaagctggttctaactggaaa

SEQ ID NO: 5258 - DNA, 27 bp, Saccharomyces cerevisiae
tcgtgaaataaaaaggtagtaagtaca

SEQ ID NO: 5259 - DNA, 23 bp, Saccharomyces cerevisiae
gttttcctcatctataccggtcg

SEQ ID NO: 5260 - DNA, 25 bp, Saccharomyces cerevisiae
aaatatgcgcacgtctatacacaca

SEQ ID NO: 5261 - DNA, 20 bp, Saccharomyces cerevisiae
tgagcgcgctacattacagt

SEQ ID NO: 5262 - DNA, 27 bp, Saccharomyces cerevisiae
tactgtcctatatatacttttttgtca

SEQ ID NO: 5263 - DNA, 22 bp, Saccharomyces cerevisiae
gagatattttgcagcagttgcg

SEQ ID NO: 5264 - DNA, 26 bp, Saccharomyces cerevisiae
aaataagctttgaaataaacgacttt

SEQ ID NO: 5265 - DNA, 27 bp, Saccharomyces cerevisiae
atttagctttgatctgtagcctaagta

SEQ ID NO: 5266 - DNA, 26 bp, Saccharomyces cerevisiae
gattctaaacgcatagttgtaaggtt

SEQ ID NO: 5267 - DNA, 23 bp, Saccharomyces cerevisiae
tataaatgctagcgtactgcctg

SEQ ID NO: 5268 - DNA, 27 bp, Saccharomyces cerevisiae
taggacttgctcagttatatttcattt

SEQ ID NO: 5269 - DNA, 26 bp, Saccharomyces cerevisiae
ctataaacgtccgttgtagtgaactt

SEQ ID NO: 5270 - DNA, 27 bp, Saccharomyces cerevisiae
ttaggctaatatgaatgtatttgatct

SEQ ID NO: 5271 - DNA, 26 bp, Saccharomyces cerevisiae
tttagtttgtttatcatcgatagtct

SEQ ID NO: 5272 - DNA, 25 bp, Saccharomyces cerevisiae
tctcgagaaaaacaaaagagttaat

SEQ ID NO: 5273 - DNA, 27 bp, Saccharomyces cerevisiae
ggaaagctttttaaaacactatgcaat

SEQ ID NO: 5274 - DNA, 26 bp, Saccharomyces cerevisiae
aggccaccatttgaatatacacagta

SEQ ID NO: 5275 - DNA, 27 bp, Saccharomyces cerevisiae
ttttgagtgatattattggtttacaca

SEQ ID NO: 5276 - DNA, 23 bp, Saccharomyces cerevisiae
aaggacttgtaagaagttttgtt

SEQ ID NO: 5277 - DNA, 26 bp, Saccharomyces cerevisiae
acataatgtttttaatgctgatttcc

SEQ ID NO: 5278 - DNA, 20 bp, Saccharomyces cerevisiae
cctgcaactcctcaatgtgt

SEQ ID NO: 5279 - DNA, 24 bp, Saccharomyces cerevisiae
gaaccactttgttcttctttcctc

SEQ ID NO: 5280 - DNA, 27 bp, Saccharomyces cerevisiae
tattgttcgttttttatcatagttttt

SEQ ID NO: 5281 - DNA, 24 bp, Saccharomyces cerevisiae
acacttctcgattaacaaattccc

SEQ ID NO: 5282 - DNA, 24 bp, Saccharomyces cerevisiae
taagctggttgatggaaaatataa

SEQ ID NO: 5283 - DNA, 20 bp, Saccharomyces cerevisiae
gcggattgagagcaaatcgt

SEQ ID NO: 5284 - DNA, 26 bp, Saccharomyces cerevisiae
ataaacaattttcttgttttccttca

SEQ ID NO: 5285 - DNA, 25 bp, Saccharomyces cerevisiae
gataaggaactgtaacagagtgcca

SEQ ID NO: 5286 - DNA, 21 bp, Saccharomyces cerevisiae
agccagtttattcttgccatc

SEQ ID NO: 5287 - DNA, 21 bp, Saccharomyces cerevisiae
taaagcgtgtatgtgtaggca

SEQ ID NO: 5288 - DNA, 24 bp, Saccharomyces cerevisiae
taaagtaagagcgctacattggtc

SEQ ID NO: 5289 - DNA, 23 bp, Saccharomyces cerevisiae
gaagcttatttgcagattgaagg

SEQ ID NO: 5290 - DNA, 23 bp, Saccharomyces cerevisiae
agcctgatcagtgacttttcatc

SEQ ID NO: 5291 - DNA, 21 bp, Saccharomyces cerevisiae
tcgaatttacgtagcccaatc

SEQ ID NO: 5292 - DNA, 27 bp, Saccharomyces cerevisiae
gtctactcaattgtaaaaaaaaacaaa

SEQ ID NO: 5293 - DNA, 19 bp, Saccharomyces cerevisiae
gaggacggttgctgaagaa

SEQ ID NO: 5294 - DNA, 22 bp, Saccharomyces cerevisiae
tctagcacaaggttcctacgtc

SEQ ID NO: 5295 - DNA, 24 bp, Saccharomyces cerevisiae
atttcttaacagatggctgaaaaa

SEQ ID NO: 5296 - DNA, 21 bp, Saccharomyces cerevisiae
ttctggaaaactgtacacccg

SEQ ID NO: 5297 - DNA, 20 bp, Saccharomyces cerevisiae
aacaattttcagcattgggg

SEQ ID NO: 5298 - DNA, 20 bp, Saccharomyces cerevisiae
ggtggagtactgtccgttcc

SEQ ID NO: 5299 - DNA, 20 bp, Saccharomyces cerevisiae
gaatggatcaaagcccaaga

SEQ ID NO: 5300 - DNA, 20 bp, Saccharomyces cerevisiae
caacgccacttatctgagca

SEQ ID NO: 5301 - DNA, 20 bp, Saccharomyces cerevisiae
atgtgttcgcgaagtaaccc

SEQ ID NO: 5302 - DNA, 20 bp, Saccharomyces cerevisiae
aagaagaacaaggtggcgaa

SEQ ID NO: 5303 - DNA, 20 bp, Saccharomyces cerevisiae
tagaagaggcacgcgaaaac

SEQ ID NO: 5304 - DNA, 20 bp, Saccharomyces cerevisiae
gatttccgtttacgggtacg

SEQ ID NO: 5305 - DNA, 20 bp, Saccharomyces cerevisiae
atgaaggctcatctcatcgg

SEQ ID NO: 5306 - DNA, 20 bp, Saccharomyces cerevisiae
tcgggctgctgagaaataat

SEQ ID NO: 5307 - DNA, 20 bp, Saccharomyces cerevisiae
attatgctcgggttctcacg

SEQ ID NO: 5308 - DNA, 20 bp, Saccharomyces cerevisiae
attccaaggaagctggactg

SEQ ID NO: 5309 - DNA, 20 bp, Saccharomyces cerevisiae
atgagcattcgcataatccc

SEQ ID NO: 5310 - DNA, 21 bp, Saccharomyces cerevisiae
tccgggatataggaatcaaca

SEQ ID NO: 5311 - DNA, 20 bp, Saccharomyces cerevisiae
cattgcagttgcaagaatgg

SEQ ID NO: 5312 - DNA, 20 bp, Saccharomyces cerevisiae
agcagacaaattcattgcca

SEQ ID NO: 5313 - DNA, 20 bp, Saccharomyces cerevisiae
atcagttttcttcccagcga

SEQ ID NO: 5314 - DNA, 20 bp, Saccharomyces cerevisiae
cacgtagttgctattgccga

SEQ ID NO: 5315 - DNA, 20 bp, Saccharomyces cerevisiae
tataagtgatggggccgtgt

SEQ ID NO: 5316 - DNA, 20 bp, Saccharomyces cerevisiae
tttaattggggcgacttttg

SEQ ID NO: 5317 - DNA, 20 bp, Saccharomyces cerevisiae
gcaccaaagcagatgtgaga

SEQ ID NO: 5318 - DNA, 20 bp, Saccharomyces cerevisiae
accaggcgtcaccaatagac

SEQ ID NO: 5319 - DNA, 20 bp, Saccharomyces cerevisiae
tcttcctctggacctcttcg

SEQ ID NO: 5320 - DNA, 20 bp, Saccharomyces cerevisiae
ccagacatcaacgacgaaac

SEQ ID NO: 5321 - DNA, 21 bp, Saccharomyces cerevisiae
tcttccttgatctcctgcatt

SEQ ID NO: 5322 - DNA, 20 bp, Saccharomyces cerevisiae
tccaggtctggatacggttc

SEQ ID NO: 5323 - DNA, 20 bp, Saccharomyces cerevisiae
gtaaatcggccggatctctc

SEQ ID NO: 5324 - DNA, 20 bp, Saccharomyces cerevisiae
ctgaaagcggaagaacaagc

SEQ ID NO: 5325 - DNA, 20 bp, Saccharomyces cerevisiae
ctgccacctggcaagattat

SEQ ID NO: 5326 - DNA, 20 bp, Saccharomyces cerevisiae
tgacggtccctacaatctcc

SEQ ID NO: 5327 - DNA, 20 bp, Saccharomyces cerevisiae
aaaggtgtttcgtggtcgtc

SEQ ID NO: 5328 - DNA, 20 bp, Saccharomyces cerevisiae
ttgccatttttcatcatcca

SEQ ID NO: 5329 - DNA, 20 bp, Saccharomyces cerevisiae
ctctgacaattctggcgtga

SEQ ID NO: 5330 - DNA, 20 bp, Saccharomyces cerevisiae
cacttgcggatggtttttct

SEQ ID NO: 5331 - DNA, 20 bp, Saccharomyces cerevisiae
cccctttttcttcgagttcc

SEQ ID NO: 5332 - DNA, 21 bp, Saccharomyces cerevisiae
tctatggagttctctcgcgtt

SEQ ID NO: 5333 - DNA, 20 bp, Saccharomyces cerevisiae
tggtggttacacaaaggcaa

SEQ ID NO: 5334 - DNA, 25 bp, Saccharomyces cerevisiae
tggtattagacacttctggggttta

SEQ ID NO: 5335 - DNA, 23 bp, Saccharomyces cerevisiae
tggttgtttcaactgattatcca

SEQ ID NO: 5336 - DNA, 20 bp, Saccharomyces cerevisiae
gtgttgccattgttgctgtt

SEQ ID NO: 5337 - DNA, 20 bp, Saccharomyces cerevisiae
tcagctcatattgcgtggag

SEQ ID NO: 5338 - DNA, 21 bp, Saccharomyces cerevisiae
gaaaatggaaacgagagcaaa

SEQ ID NO: 5339 - DNA, 20 bp, Saccharomyces cerevisiae
cacgatcattgttacgcgag

SEQ ID NO: 5340 - DNA, 20 bp, Saccharomyces cerevisiae
acccacacattaccgaaagc

SEQ ID NO: 5341 - DNA, 20 bp, Saccharomyces cerevisiae
cggcgtcaccaattaatctt

SEQ ID NO: 5342 - DNA, 20 bp, Saccharomyces cerevisiae
gccaaacttggcagattgtt

SEQ ID NO: 5343 - DNA, 20 bp, Saccharomyces cerevisiae
tggaggacgaaaggagaaga

SEQ ID NO: 5344 - DNA, 25 bp, Saccharomyces cerevisiae
taggaaaatcatcaacacgtacaaa

SEQ ID NO: 5345 - DNA, 20 bp, Saccharomyces cerevisiae
tcggaaagaactatgtggca

SEQ ID NO: 5346 - DNA, 20 bp, Saccharomyces cerevisiae
aattgcacgacatcctttcc

SEQ ID NO: 5347 - DNA, 22 bp, Saccharomyces cerevisiae
tgcaatttctttgtcttgtttg

SEQ ID NO: 5348 - DNA, 20 bp, Saccharomyces cerevisiae
cgtctctggtagcgcttctt

SEQ ID NO: 5349 - DNA, 20 bp, Saccharomyces cerevisiae
cctgtttgcttttgttgctg

SEQ ID NO: 5350 - DNA, 20 bp, Saccharomyces cerevisiae
gccaatgcctgttcttgtct

SEQ ID NO: 5351 - DNA, 20 bp, Saccharomyces cerevisiae
agactggggtgagctgaaga

SEQ ID NO: 5352 - DNA, 20 bp, Saccharomyces cerevisiae
tccgccaatacatcaacaaa

SEQ ID NO: 5353 - DNA, 20 bp, Saccharomyces cerevisiae
taatccgccttgcgaatatc

SEQ ID NO: 5354 - DNA, 20 bp, Saccharomyces cerevisiae
gggtttcctgtgccttacaa

SEQ ID NO: 5355 - DNA, 20 bp, Saccharomyces cerevisiae
atgtaagccttttcgtggga

SEQ ID NO: 5356 - DNA, 20 bp, Saccharomyces cerevisiae
ccggcccagactatgtaaga

SEQ ID NO: 5357 - DNA, 21 bp, Saccharomyces cerevisiae
tcccatatttgtgagacaccc

SEQ ID NO: 5358 - DNA, 20 bp, Saccharomyces cerevisiae
ggcagttattgcttcctcca

SEQ ID NO: 5359 - DNA, 20 bp, Saccharomyces cerevisiae
tccattgacagtttggcgta

SEQ ID NO: 5360 - DNA, 21 bp, Saccharomyces cerevisiae
cttcttcacccaatcttgctg

SEQ ID NO: 5361 - DNA, 20 bp, Saccharomyces cerevisiae
taagcaggcgaattcaaagg

SEQ ID NO: 5362 - DNA, 20 bp, Saccharomyces cerevisiae
atatttcaaattcgcggcaa

SEQ ID NO: 5363 - DNA, 20 bp, Saccharomyces cerevisiae
gaaagcgttaatagcgccaa

SEQ ID NO: 5364 - DNA, 20 bp, Saccharomyces cerevisiae
gaaagctggatcgaagatgc

SEQ ID NO: 5365 - DNA, 20 bp, Saccharomyces cerevisiae
tgtgccagagattcaacagc

SEQ ID NO: 5366 - DNA, 21 bp, Saccharomyces cerevisiae
cgttccctgtagatagcttcg

SEQ ID NO: 5367 - DNA, 24 bp, Saccharomyces cerevisiae
tttccttttgtgaagtatttgtgc

SEQ ID NO: 5368 - DNA, 20 bp, Saccharomyces cerevisiae
agcaggaacgtgcaatctct

SEQ ID NO: 5369 - DNA, 20 bp, Saccharomyces cerevisiae
gagtcagtcggcacttgtca

SEQ ID NO: 5370 - DNA, 20 bp, Saccharomyces cerevisiae
gatgcagcgaagacaatcaa

SEQ ID NO: 5371 - DNA, 20 bp, Saccharomyces cerevisiae
gaacaggtcctttgtcccaa

SEQ ID NO: 5372 - DNA, 20 bp, Saccharomyces cerevisiae
tatacaccgggcatcagtca

SEQ ID NO: 5373 - DNA, 20 bp, Saccharomyces cerevisiae
catcgtcaaggtcgtctgaa

SEQ ID NO: 5374 - DNA, 20 bp, Saccharomyces cerevisiae
ccagagattccgttaggcaa

SEQ ID NO: 5375 - DNA, 20 bp, Saccharomyces cerevisiae
tcagagcacccaaaatctcc

SEQ ID NO: 5376 - DNA, 20 bp, Saccharomyces cerevisiae
gcattggaaagaaagcaagc

SEQ ID NO: 5377 - DNA, 20 bp, Saccharomyces cerevisiae
aaaacaggttcattttgcgg

SEQ ID NO: 5378 - DNA, 21 bp, Saccharomyces cerevisiae
tcagtgcataacataccgagc

SEQ ID NO: 5379 - DNA, 20 bp, Saccharomyces cerevisiae
gaatgttgtcaccaacacgg

SEQ ID NO: 5380 - DNA, 20 bp, Saccharomyces cerevisiae
tcaaaaggggtttccaactg

SEQ ID NO: 5381 - DNA, 20 bp, Saccharomyces cerevisiae
tcgattaggaaagcggaaga

SEQ ID NO: 5382 - DNA, 20 bp, Saccharomyces cerevisiae
gtcatcatcctcgtcgtcct

SEQ ID NO: 5383 - DNA, 20 bp, Saccharomyces cerevisiae
aacaaaaccttgtcgatggc

SEQ ID NO: 5384 - DNA, 20 bp, Saccharomyces cerevisiae
ccattgacacgaagtttcca

SEQ ID NO: 5385 - DNA, 21 bp, Saccharomyces cerevisiae
tgttgatgacgacaatggaaa

SEQ ID NO: 5386 - DNA, 20 bp, Saccharomyces cerevisiae
ggtgggtgattattatgggg

SEQ ID NO: 5387 - DNA, 20 bp, Saccharomyces cerevisiae
gtacttccattgttcgcgct

SEQ ID NO: 5388 - DNA, 20 bp, Saccharomyces cerevisiae
gtccataagccggaattgaa

SEQ ID NO: 5389 - DNA, 20 bp, Saccharomyces cerevisiae
gaatagcccaatgccaaaaa

SEQ ID NO: 5390 - DNA, 20 bp, Saccharomyces cerevisiae
tttacctgtcttggcgcttt

SEQ ID NO: 5391 - DNA, 22 bp, Saccharomyces cerevisiae
tttgactctcccttgtttttga

SEQ ID NO: 5392 - DNA, 20 bp, Saccharomyces cerevisiae
ttgcatcagtccttgtgtcc

SEQ ID NO: 5393 - DNA, 20 bp, Saccharomyces cerevisiae
tatgggttcgcaattcttcc

SEQ ID NO: 5394 - DNA, 21 bp, Saccharomyces cerevisiae
cagtggagtctgcacaacaaa

SEQ ID NO: 5395 - DNA, 20 bp, Saccharomyces cerevisiae
cgaagcatcatctgaaatgg

SEQ ID NO: 5396 - DNA, 20 bp, Saccharomyces cerevisiae
ttctggatgcagctctctga

SEQ ID NO: 5397 - DNA, 20 bp, Saccharomyces cerevisiae
aatttggcctgccataagaa

SEQ ID NO: 5398 - DNA, 20 bp, Saccharomyces cerevisiae
tcctcctcaagtgccttctg

SEQ ID NO: 5399 - DNA, 20 bp, Saccharomyces cerevisiae
atgacgaggcatttggctac

SEQ ID NO: 5400 - DNA, 20 bp, Saccharomyces cerevisiae
cacgcagtgtgttcactcct

SEQ ID NO: 5401 - DNA, 20 bp, Saccharomyces cerevisiae
ttttgccattgttgtttcca

SEQ ID NO: 5402 - DNA, 27 bp, Saccharomyces cerevisiae
gttctctgacttgagaagaagtgatct

SEQ ID NO: 5403 - DNA, 20 bp, Saccharomyces cerevisiae
ttttgatctgtgacgggagg

SEQ ID NO: 5404 - DNA, 20 bp, Saccharomyces cerevisiae
ccgatgattccttcgtcaat

SEQ ID NO: 5405 - DNA, 20 bp, Saccharomyces cerevisiae
ggtgaagagaaaaagcgtcg

SEQ ID NO: 5406 - DNA, 20 bp, Saccharomyces cerevisiae
tgagattgaaagctccttcg

SEQ ID NO: 5407 - DNA, 20 bp, Saccharomyces cerevisiae
ggaaggcccccatatactgt

SEQ ID NO: 5408 - DNA, 20 bp, Saccharomyces cerevisiae
gccaccaaaggatttttcaa

SEQ ID NO: 5409 - DNA, 20 bp, Saccharomyces cerevisiae
tagcggcgttgggttactac

SEQ ID NO: 5410 - DNA, 20 bp, Saccharomyces cerevisiae
gaacccttttcattggctga

SEQ ID NO: 5411 - DNA, 20 bp, Saccharomyces cerevisiae
cccgtaaccctgattaccct

SEQ ID NO: 5412 - DNA, 23 bp, Saccharomyces cerevisiae
ccaaatttgaatctaccaatcca

SEQ ID NO: 5413 - DNA, 20 bp, Saccharomyces cerevisiae
tccaccaaacgtgacttgac

SEQ ID NO: 5414 - DNA, 20 bp, Saccharomyces cerevisiae
ggtccgtagccaaccagtta

SEQ ID NO: 5415 - DNA, 20 bp, Saccharomyces cerevisiae
ccaacttatcagcaatggca

SEQ ID NO: 5416 - DNA, 20 bp, Saccharomyces cerevisiae
tgcagcttcttctttgtcca

SEQ ID NO: 5417 - DNA, 20 bp, Saccharomyces cerevisiae
aacggaattccaagggaaac

SEQ ID NO: 5418 - DNA, 20 bp, Saccharomyces cerevisiae
gcgaccaaacaggcaagtta

SEQ ID NO: 5419 - DNA, 20 bp, Saccharomyces cerevisiae
aacttgggtattggtgcctg

SEQ ID NO: 5420 - DNA, 21 bp, Saccharomyces cerevisiae
cgtgtttaccatctaatgggg

SEQ ID NO: 5421 - DNA, 20 bp, Saccharomyces cerevisiae
tttcaaaattcgcgccatac

SEQ ID NO: 5422 - DNA, 20 bp, Saccharomyces cerevisiae
gcttgcctgacttgtgtcaa

SEQ ID NO: 5423 - DNA, 20 bp, Saccharomyces cerevisiae
acctctggatggcatttgtc

SEQ ID NO: 5424 - DNA, 20 bp, Saccharomyces cerevisiae
ttctgattgcccgtacatga

SEQ ID NO: 5425 - DNA, 20 bp, Saccharomyces cerevisiae
gcccttcgaggaagaatagg

SEQ ID NO: 5426 - DNA, 20 bp, Saccharomyces cerevisiae
gtgcgttggtgtgaacactt

SEQ ID NO: 5427 - DNA, 23 bp, Saccharomyces cerevisiae
gattgagacaagggaagaaaaga

SEQ ID NO: 5428 - DNA, 20 bp, Saccharomyces cerevisiae
tcaattggtttgtccgatga

SEQ ID NO: 5429 - DNA, 20 bp, Saccharomyces cerevisiae
gatcattgcaccgtttacca

SEQ ID NO: 5430 - DNA, 20 bp, Saccharomyces cerevisiae
cgcatcggaaaacctaagac

SEQ ID NO: 5431 - DNA, 22 bp, Saccharomyces cerevisiae
ccacggatctacaacgttatcc

SEQ ID NO: 5432 - DNA, 20 bp, Saccharomyces cerevisiae
atcttgagttgttgggtggg

SEQ ID NO: 5433 - DNA, 25 bp, Saccharomyces cerevisiae
atcaaatctattggaagctgaaatg

SEQ ID NO: 5434 - DNA, 20 bp, Saccharomyces cerevisiae
gcatgatcataccaacggag

SEQ ID NO: 5435 - DNA, 25 bp, Saccharomyces cerevisiae
ggaagaagagacagaactagctgaa

SEQ ID NO: 5436 - DNA, 20 bp, Saccharomyces cerevisiae
acgacttggattttggaacg

SEQ ID NO: 5437 - DNA, 20 bp, Saccharomyces cerevisiae
ccttttcaaatccatccgtg

SEQ ID NO: 5438 - DNA, 20 bp, Saccharomyces cerevisiae
gacaacctccgtcgttgaag

SEQ ID NO: 5439 - DNA, 25 bp, Saccharomyces cerevisiae
ttgttacttcgataaggtcacaaca

SEQ ID NO: 5440 - DNA, 20 bp, Saccharomyces cerevisiae
atggttaggtcccatctccc

SEQ ID NO: 5441 - DNA, 22 bp, Saccharomyces cerevisiae
ttggatgaggacaaaatgtgtt

SEQ ID NO: 5442 - DNA, 20 bp, Saccharomyces cerevisiae
gctggcgaataaacggatac

SEQ ID NO: 5443 - DNA, 20 bp, Saccharomyces cerevisiae
ctgcaggggatttgatagga

SEQ ID NO: 5444 - DNA, 20 bp, Saccharomyces cerevisiae
gccacgttgcctgtattttt

SEQ ID NO: 5445 - DNA, 20 bp, Saccharomyces cerevisiae
attctgcacgggctcattac

SEQ ID NO: 5446 - DNA, 20 bp, Saccharomyces cerevisiae
tgaaaatctcagttcgccct

SEQ ID NO: 5447 - DNA, 20 bp, Saccharomyces cerevisiae
tatccgccttttcaaacctg

SEQ ID NO: 5448 - DNA, 20 bp, Saccharomyces cerevisiae
ctgtcgtcagcttcaagacg

SEQ ID NO: 5449 - DNA, 20 bp, Saccharomyces cerevisiae
ttgaagtggaaaacaaagcg

SEQ ID NO: 5450 - DNA, 20 bp, Saccharomyces cerevisiae
aacgcccaattcttgtctga

SEQ ID NO: 5451 - DNA, 20 bp, Saccharomyces cerevisiae
tcatcgaatctttgaacgca

SEQ ID NO: 5452 - DNA, 20 bp, Saccharomyces cerevisiae
ttgcaacgaattccatcaac

SEQ ID NO: 5453 - DNA, 21 bp, Saccharomyces cerevisiae
gcggagtacattggaaaatca

SEQ ID NO: 5454 - DNA, 20 bp, Saccharomyces cerevisiae
acatcatcatgtggaccgag

SEQ ID NO: 5455 - DNA, 21 bp, Saccharomyces cerevisiae
ttggaggtttaccaatatgcg

SEQ ID NO: 5456 - DNA, 21 bp, Saccharomyces cerevisiae
gatacaacaaaaagcaaggcg

SEQ ID NO: 5457 - DNA, 20 bp, Saccharomyces cerevisiae
tccaccaattttgtcacagc

SEQ ID NO: 5458 - DNA, 20 bp, Saccharomyces cerevisiae
tgcctgaacagagaggcttt

SEQ ID NO: 5459 - DNA, 25 bp, Saccharomyces cerevisiae
cgaatttagatttaagaccctcgtt

SEQ ID NO: 5460 - DNA, 20 bp, Saccharomyces cerevisiae
acggccaagatccttgaata

SEQ ID NO: 5461 - DNA, 20 bp, Saccharomyces cerevisiae
tgcaataagcagaggctacg

SEQ ID NO: 5462 - DNA, 20 bp, Saccharomyces cerevisiae
cacgtggatacgtaccgttg

SEQ ID NO: 5463 - DNA, 20 bp, Saccharomyces cerevisiae
cccacacacggttgttatcc

SEQ ID NO: 5464 - DNA, 20 bp, Saccharomyces cerevisiae
atctttgacgtcgaatccca

SEQ ID NO: 5465 - DNA, 20 bp, Saccharomyces cerevisiae
tgtcaactttggtgtttggc

SEQ ID NO: 5466 - DNA, 20 bp, Saccharomyces cerevisiae
aaagcccgcttctgaaaact

SEQ ID NO: 5467 - DNA, 25 bp, Saccharomyces cerevisiae
ccaagtgtgattttaaaggtgatct

SEQ ID NO: 5468 - DNA, 20 bp, Saccharomyces cerevisiae
atatggagtatgggcaaccg

SEQ ID NO: 5469 - DNA, 21 bp, Saccharomyces cerevisiae
aaagcctcctcaatcaaatca

SEQ ID NO: 5470 - DNA, 24 bp, Saccharomyces cerevisiae
tgctttttaaacctagttcctcca

SEQ ID NO: 5471 - DNA, 21 bp, Saccharomyces cerevisiae
ttgagctgtaactatgagccg

SEQ ID NO: 5472 - DNA, 20 bp, Saccharomyces cerevisiae
cactggaaattgtgtggtcg

SEQ ID NO: 5473 - DNA, 20 bp, Saccharomyces cerevisiae
agtggaagaagcgcaagaaa

SEQ ID NO: 5474 - DNA, 20 bp, Saccharomyces cerevisiae
cacagcaacactaaccccct

SEQ ID NO: 5475 - DNA, 20 bp, Saccharomyces cerevisiae
ggcttatgttatttgtgccg

SEQ ID NO: 5476 - DNA, 20 bp, Saccharomyces cerevisiae
accggaatttaatggcactg

SEQ ID NO: 5477 - DNA, 20 bp, Saccharomyces cerevisiae
ccaaagaagctagaaccccc

SEQ ID NO: 5478 - DNA, 20 bp, Saccharomyces cerevisiae
actagcctggccatcttgaa

SEQ ID NO: 5479 - DNA, 20 bp, Saccharomyces cerevisiae
tcatcgtcagaagggtcctc

SEQ ID NO: 5480 - DNA, 20 bp, Saccharomyces cerevisiae
caatatgcgctcactcagga

SEQ ID NO: 5481 - DNA, 20 bp, Saccharomyces cerevisiae
ggtttcggacctctaccaca

SEQ ID NO: 5482 - DNA, 20 bp, Saccharomyces cerevisiae
aggactgagcgttggagaaa

SEQ ID NO: 5483 - DNA, 20 bp, Saccharomyces cerevisiae
accggtaccaaattatgcga

SEQ ID NO: 5484 - DNA, 20 bp, Saccharomyces cerevisiae
ctggaaagtaaaagcgagcg

SEQ ID NO: 5485 - DNA, 20 bp, Saccharomyces cerevisiae
cggaaaaggtagtttggggt

SEQ ID NO: 5486 - DNA, 20 bp, Saccharomyces cerevisiae
cttctgttgccgcactatca

SEQ ID NO: 5487 - DNA, 20 bp, Saccharomyces cerevisiae
ggtggcatactttcaaggga

SEQ ID NO: 5488 - DNA, 20 bp, Saccharomyces cerevisiae
tgtggaacctcactggtttg

SEQ ID NO: 5489 - DNA, 20 bp, Saccharomyces cerevisiae
agctttggttccgcttgtta

SEQ ID NO: 5490 - DNA, 20 bp, Saccharomyces cerevisiae
tgggatttgttaatggcagg

SEQ ID NO: 5491 - DNA, 20 bp, Saccharomyces cerevisiae
attcttgtttgctcatcgcc

SEQ ID NO: 5492 - DNA, 20 bp, Saccharomyces cerevisiae
tgactcaaagctgtcgttcg

SEQ ID NO: 5493 - DNA, 20 bp, Saccharomyces cerevisiae
cgttagactgaaggccaagc

SEQ ID NO: 5494 - DNA, 20 bp, Saccharomyces cerevisiae
ttacagagcgaaggagaggc

SEQ ID NO: 5495 - DNA, 20 bp, Saccharomyces cerevisiae
gcgtttgcctcttcactttc

SEQ ID NO: 5496 - DNA, 21 bp, Saccharomyces cerevisiae
cctacatcgccatagaattgc

SEQ ID NO: 5497 - DNA, 20 bp, Saccharomyces cerevisiae
taagacctgatgcgattccg

SEQ ID NO: 5498 - DNA, 20 bp, Saccharomyces cerevisiae
aatcggaggcgtcctaactt

SEQ ID NO: 5499 - DNA, 20 bp, Saccharomyces cerevisiae
tgctttacttcggggtatgg

SEQ ID NO: 5500 - DNA, 20 bp, Saccharomyces cerevisiae
tggtaggaggtaaggcgttg

SEQ ID NO: 5501 - DNA, 20 bp, Saccharomyces cerevisiae
gccacattcacaacaaggtg

SEQ ID NO: 5502 - DNA, 20 bp, Saccharomyces cerevisiae
ccgtaggcttaagattgcca

SEQ ID NO: 5503 - DNA, 20 bp, Saccharomyces cerevisiae
tatattcggtcttgctgccc

SEQ ID NO: 5504 - DNA, 20 bp, Saccharomyces cerevisiae
cggcataacctattgccact

SEQ ID NO: 5505 - DNA, 20 bp, Saccharomyces cerevisiae
aaacccttcaaattcgcctt

SEQ ID NO: 5506 - DNA, 20 bp, Saccharomyces cerevisiae
caggtggcgtgttgaagttt

SEQ ID NO: 5507 - DNA, 20 bp, Saccharomyces cerevisiae
ggggcttacccaaataggaa

SEQ ID NO: 5508 - DNA, 20 bp, Saccharomyces cerevisiae
cgctatggtggcatccttat

SEQ ID NO: 5509 - DNA, 20 bp, Saccharomyces cerevisiae
cttcttgatccctgatccca

SEQ ID NO: 5510 - DNA, 20 bp, Saccharomyces cerevisiae
cgaacggaaggtcgttttta

SEQ ID NO: 5511 - DNA, 20 bp, Saccharomyces cerevisiae
atgtttgcaaatgcgagtct

SEQ ID NO: 5512 - DNA, 20 bp, Saccharomyces cerevisiae
atggccataacggatcttga

SEQ ID NO: 5513 - DNA, 20 bp, Saccharomyces cerevisiae
cacattttacgcgatgatgg

SEQ ID NO: 5514 - DNA, 20 bp, Saccharomyces cerevisiae
tatgcccgcttggtattttc

SEQ ID NO: 5515 - DNA, 20 bp, Saccharomyces cerevisiae
gtgccaggtaaaaatgcagg

SEQ ID NO: 5516 - DNA, 23 bp, Saccharomyces cerevisiae
tgattgctacaaggccttaattc

SEQ ID NO: 5517 - DNA, 20 bp, Saccharomyces cerevisiae
ttaaaccggccattttcaag

SEQ ID NO: 5518 - DNA, 26 bp, Saccharomyces cerevisiae
tctatttacaatgtatggcgtattga

SEQ ID NO: 5519 - DNA, 20 bp, Saccharomyces cerevisiae
gctctccgtgatatcttccg

SEQ ID NO: 5520 - DNA, 20 bp, Saccharomyces cerevisiae
acgccagaagcagacttgtt

SEQ ID NO: 5521 - DNA, 20 bp, Saccharomyces cerevisiae
aatacatcgtatgcctcgcc

SEQ ID NO: 5522 - DNA, 20 bp, Saccharomyces cerevisiae
aatatgcgcggaaagtcaag

SEQ ID NO: 5523 - DNA, 20 bp, Saccharomyces cerevisiae
ccttcttatataggccccgc

SEQ ID NO: 5524 - DNA, 23 bp, Saccharomyces cerevisiae
tgaaatgttgctgttaaaccctt

SEQ ID NO: 5525 - DNA, 21 bp, Saccharomyces cerevisiae
cgatgtaccatcacatgacca

SEQ ID NO: 5526 - DNA, 20 bp, Saccharomyces cerevisiae
aggatttgcatggcctaatg

SEQ ID NO: 5527 - DNA, 20 bp, Saccharomyces cerevisiae
ccacacacaacgaagagcat

SEQ ID NO: 5528 - DNA, 20 bp, Saccharomyces cerevisiae
tggagcggtaatcgataagg

SEQ ID NO: 5529 - DNA, 20 bp, Saccharomyces cerevisiae
tacccattggacgttgtgaa

SEQ ID NO: 5530 - DNA, 20 bp, Saccharomyces cerevisiae
cggaaactggaggcaaaata

SEQ ID NO: 5531 - DNA, 20 bp, Saccharomyces cerevisiae
atccttttgcccactgattg

SEQ ID NO: 5532 - DNA, 21 bp, Saccharomyces cerevisiae
gcttcccttacggactactgg

SEQ ID NO: 5533 - DNA, 20 bp, Saccharomyces cerevisiae
ctgcccagcttgataacgat

SEQ ID NO: 5534 - DNA, 20 bp, Saccharomyces cerevisiae
ttgttggatggagagaaggg

SEQ ID NO: 5535 - DNA, 20 bp, Saccharomyces cerevisiae
tcaaatcatgctgccagaac

SEQ ID NO: 5536 - DNA, 20 bp, Saccharomyces cerevisiae
tcacttgccaaacaatttcg

SEQ ID NO: 5537 - DNA, 20 bp, Saccharomyces cerevisiae
tcccaatgctgaaatgtgtc

SEQ ID NO: 5538 - DNA, 21 bp, Saccharomyces cerevisiae
tcgttacagctggtttgttca

SEQ ID NO: 5539 - DNA, 20 bp, Saccharomyces cerevisiae
tcacagattttcccttcgct

SEQ ID NO: 5540 - DNA, 22 bp, Saccharomyces cerevisiae
tcagcttccattaaatctgctg

SEQ ID NO: 5541 - DNA, 20 bp, Saccharomyces cerevisiae
ttggtgagaaaccccagaag

SEQ ID NO: 5542 - DNA, 20 bp, Saccharomyces cerevisiae
gcaaaggagactttgaacgc

SEQ ID NO: 5543 - DNA, 20 bp, Saccharomyces cerevisiae
taacgaccgggatcaacttc

SEQ ID NO: 5544 - DNA, 22 bp, Saccharomyces cerevisiae
caagaatggctttttccttctg

SEQ ID NO: 5545 - DNA, 20 bp, Saccharomyces cerevisiae
taaacctggatggtttgcct

SEQ ID NO: 5546 - DNA, 22 bp, Saccharomyces cerevisiae
ggatgctactgagttgtggaaa

SEQ ID NO: 5547 - DNA, 20 bp, Saccharomyces cerevisiae
ctgcttaactccacgattgc

SEQ ID NO: 5548 - DNA, 20 bp, Saccharomyces cerevisiae
accctatggaaagtggaccc

SEQ ID NO: 5549 - DNA, 20 bp, Saccharomyces cerevisiae
ggagcacaacctagcgaaac

SEQ ID NO: 5550 - DNA, 20 bp, Saccharomyces cerevisiae
gatggactctcgtacccgaa

SEQ ID NO: 5551 - DNA, 20 bp, Saccharomyces cerevisiae
ctacgatgggagcgttatgc

SEQ ID NO: 5552 - DNA, 20 bp, Saccharomyces cerevisiae
atgttggaagcaggaaatcg

SEQ ID NO: 5553 - DNA, 21 bp, Saccharomyces cerevisiae
aagttttgggattgttgcaga

SEQ ID NO: 5554 - DNA, 20 bp, Saccharomyces cerevisiae
tgaatgaagaaggtttgggg

SEQ ID NO: 5555 - DNA, 20 bp, Saccharomyces cerevisiae
ttgtgctgctggtgtttctc

SEQ ID NO: 5556 - DNA, 20 bp, Saccharomyces cerevisiae
ggctccacggtacacaaagt

SEQ ID NO: 5557 - DNA, 20 bp, Saccharomyces cerevisiae
aagctcttaagccatgccaa

SEQ ID NO: 5558 - DNA, 20 bp, Saccharomyces cerevisiae
gcaatgccagaacgttgtta

SEQ ID NO: 5559 - DNA, 23 bp, Saccharomyces cerevisiae
gcagaactaacccattgttgttt

SEQ ID NO: 5560 - DNA, 20 bp, Saccharomyces cerevisiae
gagcggatccagataccaaa

SEQ ID NO: 5561 - DNA, 20 bp, Saccharomyces cerevisiae
catgtcagagcaacaatggc

SEQ ID NO: 5562 - DNA, 20 bp, Saccharomyces cerevisiae
cgaatgctgctgaaaaatca

SEQ ID NO: 5563 - DNA, 20 bp, Saccharomyces cerevisiae
ttttcttccatgcgctctct

SEQ ID NO: 5564 - DNA, 20 bp, Saccharomyces cerevisiae
tcaaagcaatgatcacccaa

SEQ ID NO: 5565 - DNA, 20 bp, Saccharomyces cerevisiae
gcggctttccttaagctttt

SEQ ID NO: 5566 - DNA, 21 bp, Saccharomyces cerevisiae
gccaaagagtttttccaatga

SEQ ID NO: 5567 - DNA, 20 bp, Saccharomyces cerevisiae
ggtatcccacctccatacga

SEQ ID NO: 5568 - DNA, 20 bp, Saccharomyces cerevisiae
aagaatcccattgtttcccc

SEQ ID NO: 5569 - DNA, 20 bp, Saccharomyces cerevisiae
tccatggaattgagggagac

SEQ ID NO: 5570 - DNA, 20 bp, Saccharomyces cerevisiae
ctaacgtgaccggtttcacc

SEQ ID NO: 5571 - DNA, 22 bp, Saccharomyces cerevisiae
aaccttttgaaaatcatagcgg

SEQ ID NO: 5572 - DNA, 20 bp, Saccharomyces cerevisiae
taacgactccaaaagtgggg

SEQ ID NO: 5573 - DNA, 20 bp, Saccharomyces cerevisiae
agtgggaagctgagcaaaaa

SEQ ID NO: 5574 - DNA, 20 bp, Saccharomyces cerevisiae
tcttagcctcttccaaagcg

SEQ ID NO: 5575 - DNA, 20 bp, Saccharomyces cerevisiae
tttcaagaattttcgcgctt

SEQ ID NO: 5576 - DNA, 20 bp, Saccharomyces cerevisiae
tatcaatgtggatcgcaagc

SEQ ID NO: 5577 - DNA, 27 bp, Saccharomyces cerevisiae
taatctcatttttccaaaatcaagaaa

SEQ ID NO: 5578 - DNA, 23 bp, Saccharomyces cerevisiae
ggccttgtaattcagtttgttca

SEQ ID NO: 5579 - DNA, 20 bp, Saccharomyces cerevisiae
gtgggcgtatacgatctggt

SEQ ID NO: 5580 - DNA, 21 bp, Saccharomyces cerevisiae
ctggatttgacccaacctaca

SEQ ID NO: 5581 - DNA, 20 bp, Saccharomyces cerevisiae
actgctcagaggctcattcg

SEQ ID NO: 5582 - DNA, 20 bp, Saccharomyces cerevisiae
tccaattttgaaatagcgca

SEQ ID NO: 5583 - DNA, 20 bp, Saccharomyces cerevisiae
gaccacacacgaaaatcctg

SEQ ID NO: 5584 - DNA, 20 bp, Saccharomyces cerevisiae
aacggaagcacactttgagg

SEQ ID NO: 5585 - DNA, 20 bp, Saccharomyces cerevisiae
ggtagcctcaacgccaaata

SEQ ID NO: 5586 - DNA, 20 bp, Saccharomyces cerevisiae
tctttatgacgagccatccc

SEQ ID NO: 5587 - DNA, 20 bp, Saccharomyces cerevisiae
caccatacgcgtaaacgtga

SEQ ID NO: 5588 - DNA, 20 bp, Saccharomyces cerevisiae
agaaaaagctgctctgtcgg

SEQ ID NO: 5589 - DNA, 20 bp, Saccharomyces cerevisiae
tatgactaataagcccccgc

SEQ ID NO: 5590 - DNA, 20 bp, Saccharomyces cerevisiae
tcctgtgggatgcagcttat

SEQ ID NO: 5591 - DNA, 20 bp, Saccharomyces cerevisiae
tcttgctgttgacggtatgc

SEQ ID NO: 5592 - DNA, 20 bp, Saccharomyces cerevisiae
tgagatctcgctgttgatcg

SEQ ID NO: 5593 - DNA, 20 bp, Saccharomyces cerevisiae
ccaagcgcctgatacaaagt

SEQ ID NO: 5594 - DNA, 20 bp, Saccharomyces cerevisiae
ccaggtatccatgacccatc

SEQ ID NO: 5595 - DNA, 25 bp, Saccharomyces cerevisiae
attgttaccatagcaacacatgtca

SEQ ID NO: 5596 - DNA, 20 bp, Saccharomyces cerevisiae
cggaatccataagctccaga

SEQ ID NO: 5597 - DNA, 20 bp, Saccharomyces cerevisiae
tgctcagataagtggcgttg

SEQ ID NO: 5598 - DNA, 20 bp, Saccharomyces cerevisiae
aacaacaagttggacccagg

SEQ ID NO: 5599 - DNA, 20 bp, Saccharomyces cerevisiae
gcaaaccccaagatcgtaga

SEQ ID NO: 5600 - DNA, 20 bp, Saccharomyces cerevisiae
tccataccttccaccagctc

SEQ ID NO: 5601 - DNA, 22 bp, Saccharomyces cerevisiae
aagtgggtacactaaatgagcg

SEQ ID NO: 5602 - DNA, 20 bp, Saccharomyces cerevisiae
atagctcttgtggtcctcgc

SEQ ID NO: 5603 - DNA, 24 bp, Saccharomyces cerevisiae
tcaagacagagtgaacaaaaagga

SEQ ID NO: 5604 - DNA, 20 bp, Saccharomyces cerevisiae
gagcacaacttgaaggcgtc

SEQ ID NO: 5605 - DNA, 20 bp, Saccharomyces cerevisiae
ggaaatccaaaacgtgatcg

SEQ ID NO: 5606 - DNA, 23 bp, Saccharomyces cerevisiae
tgtgaatcttgctcttttcatgt

SEQ ID NO: 5607 - DNA, 20 bp, Saccharomyces cerevisiae
ggcaatatcgaggatgagga

SEQ ID NO: 5608 - DNA, 20 bp, Saccharomyces cerevisiae
tcatctacccacttgcgctt

SEQ ID NO: 5609 - DNA, 20 bp, Saccharomyces cerevisiae
agagctatgggatgtgtggc

SEQ ID NO: 5610 - DNA, 20 bp, Saccharomyces cerevisiae
caccgtccacacgtaacatc

SEQ ID NO: 5611 - DNA, 20 bp, Saccharomyces cerevisiae
tcgcctgggtaaagaagttg

SEQ ID NO: 5612 - DNA, 20 bp, Saccharomyces cerevisiae
agcggttcatattaggctca

SEQ ID NO: 5613 - DNA, 20 bp, Saccharomyces cerevisiae
atagccattgggctgaaatg

SEQ ID NO: 5614 - DNA, 20 bp, Saccharomyces cerevisiae
gctaaagaaatgttggcgga

SEQ ID NO: 5615 - DNA, 23 bp, Saccharomyces cerevisiae
aacatgttcgaattagcacaaca

SEQ ID NO: 5616 - DNA, 20 bp, Saccharomyces cerevisiae
gaaattgcgaaatgcttgtg

SEQ ID NO: 5617 - DNA, 20 bp, Saccharomyces cerevisiae
tccggttgttcacgactaca

SEQ ID NO: 5618 - DNA, 20 bp, Saccharomyces cerevisiae
attctggcaatggctgtacc

SEQ ID NO: 5619 - DNA, 20 bp, Saccharomyces cerevisiae
tgtgaaaatcttcccttggc

SEQ ID NO: 5620 - DNA, 20 bp, Saccharomyces cerevisiae
tcatcatggcctgaaatgaa

SEQ ID NO: 5621 - DNA, 20 bp, Saccharomyces cerevisiae
aaaaatgcttgagcgaatgg

SEQ ID NO: 5622 - DNA, 20 bp, Saccharomyces cerevisiae
agtcagatccgcctctttca

SEQ ID NO: 5623 - DNA, 20 bp, Saccharomyces cerevisiae
gtgttgcccatttttacgct

SEQ ID NO: 5624 - DNA, 20 bp, Saccharomyces cerevisiae
tgtttgcccttcctcctatt

SEQ ID NO: 5625 - DNA, 20 bp, Saccharomyces cerevisiae
aaggcactgagcaggacaat

SEQ ID NO: 5626 - DNA, 20 bp, Saccharomyces cerevisiae
catggactcgataagctggc

SEQ ID NO: 5627 - DNA, 20 bp, Saccharomyces cerevisiae
cgaaagtgacttcattgcga

SEQ ID NO: 5628 - DNA, 20 bp, Saccharomyces cerevisiae
atcaaactcgttggaatcgg

SEQ ID NO: 5629 - DNA, 20 bp, Saccharomyces cerevisiae
atagggccaccagtgtcaag

SEQ ID NO: 5630 - DNA, 20 bp, Saccharomyces cerevisiae
atgataaagggcgaaaagcc

SEQ ID NO: 5631 - DNA, 20 bp, Saccharomyces cerevisiae
gcgcatcttatgatgggttt

SEQ ID NO: 5632 - DNA, 20 bp, Saccharomyces cerevisiae
ttgatccaaagaaagggtgg

SEQ ID NO: 5633 - DNA, 20 bp, Saccharomyces cerevisiae
ttgcttttatgggatacccg

SEQ ID NO: 5634 - DNA, 20 bp, Saccharomyces cerevisiae
tcggcatctccctgtttatc

SEQ ID NO: 5635 - DNA, 20 bp, Saccharomyces cerevisiae
tcgaaagttggtggcttttt

SEQ ID NO: 5636 - DNA, 20 bp, Saccharomyces cerevisiae
tatcgtgaagccatggatga

SEQ ID NO: 5637 - DNA, 23 bp, Saccharomyces cerevisiae
taaacggttgccgtaattactat

SEQ ID NO: 5638 - DNA, 20 bp, Saccharomyces cerevisiae
acaataagtaacacgccggg

SEQ ID NO: 5639 - DNA, 20 bp, Saccharomyces cerevisiae
gtacgtgatcagcaaaccga

SEQ ID NO: 5640 - DNA, 20 bp, Saccharomyces cerevisiae
tggccatcaaaatacatgct

SEQ ID NO: 5641 - DNA, 20 bp, Saccharomyces cerevisiae
cacctttaatgccataccgc

SEQ ID NO: 5642 - DNA, 19 bp, Saccharomyces cerevisiae
ccctttccgggtttctttt

SEQ ID NO: 5643 - DNA, 20 bp, Saccharomyces cerevisiae
ggaacccgcaatatacgaaa

SEQ ID NO: 5644 - DNA, 20 bp, Saccharomyces cerevisiae
cgacagtttggagtgcagtg

SEQ ID NO: 5645 - DNA, 21 bp, Saccharomyces cerevisiae
tgcgacacaggtgacaataaa

SEQ ID NO: 5646 - DNA, 21 bp, Saccharomyces cerevisiae
ccttatgcgatttcttggtca

SEQ ID NO: 5647 - DNA, 21 bp, Saccharomyces cerevisiae
tgccatacgaataaggtggtc

SEQ ID NO: 5648 - DNA, 20 bp, Saccharomyces cerevisiae
tggcgctgaaaaagatccta

SEQ ID NO: 5649 - DNA, 20 bp, Saccharomyces cerevisiae
caatggtcttgcaatcatgc

SEQ ID NO: 5650 - DNA, 20 bp, Saccharomyces cerevisiae
ggcaggaaaacagtttccaa

SEQ ID NO: 5651 - DNA, 20 bp, Saccharomyces cerevisiae
cgcggaacttcttttcgtta

SEQ ID NO: 5652 - DNA, 20 bp, Saccharomyces cerevisiae
ccggcctctgatttctctaa

SEQ ID NO: 5653 - DNA, 20 bp, Saccharomyces cerevisiae
ttgcgaaagcaagttcatca

SEQ ID NO: 5654 - DNA, 20 bp, Saccharomyces cerevisiae
cgtgatagacgaacaagcca

SEQ ID NO: 5655 - DNA, 20 bp, Saccharomyces cerevisiae
accattgttcttgccctcac

SEQ ID NO: 5656 - DNA, 20 bp, Saccharomyces cerevisiae
catcaccaacgattaccagc

SEQ ID NO: 5657 - DNA, 21 bp, Saccharomyces cerevisiae
cacgcggaatattgtgaaatc

SEQ ID NO: 5658 - DNA, 21 bp, Saccharomyces cerevisiae
gcgaaaggatgagagtgaaag

SEQ ID NO: 5659 - DNA, 20 bp, Saccharomyces cerevisiae
ccattccacccaactacacc

SEQ ID NO: 5660 - DNA, 20 bp, Saccharomyces cerevisiae
tatccccggtcaagtagtcg

SEQ ID NO: 5661 - DNA, 20 bp, Saccharomyces cerevisiae
gtctcgggtttttcgattca

SEQ ID NO: 5662 - DNA, 20 bp, Saccharomyces cerevisiae
acactctttgcgttcctgct

SEQ ID NO: 5663 - DNA, 20 bp, Saccharomyces cerevisiae
cgatgccatttttcttccat

SEQ ID NO: 5664 - DNA, 21 bp, Saccharomyces cerevisiae
ccgtttttcagttcgacttgt

SEQ ID NO: 5665 - DNA, 20 bp, Saccharomyces cerevisiae
gaaaaaccccttcatgagca

SEQ ID NO: 5666 - DNA, 20 bp, Saccharomyces cerevisiae
gccattttgctagaactgcc

SEQ ID NO: 5667 - DNA, 20 bp, Saccharomyces cerevisiae
tgccctcttcactccttttg

SEQ ID NO: 5668 - DNA, 20 bp, Saccharomyces cerevisiae
gcgaaatccatgaatacggt

SEQ ID NO: 5669 - DNA, 20 bp, Saccharomyces cerevisiae
tcagaagatcggaaacgagt

SEQ ID NO: 5670 - DNA, 20 bp, Saccharomyces cerevisiae
acgaaggacaaaacgaaagc

SEQ ID NO: 5671 - DNA, 20 bp, Saccharomyces cerevisiae
cttcctcgaatgtctagccg

SEQ ID NO: 5672 - DNA, 20 bp, Saccharomyces cerevisiae
ttcttaggatcatgggtcgc

SEQ ID NO: 5673 - DNA, 22 bp, Saccharomyces cerevisiae
ttggacatttgtattaggagcg

SEQ ID NO: 5674 - DNA, 22 bp, Saccharomyces cerevisiae
tcgatatccatattttggttgc

SEQ ID NO: 5675 - DNA, 22 bp, Saccharomyces cerevisiae
tgcttgtcttgataggcaacat

SEQ ID NO: 5676 - DNA, 20 bp, Saccharomyces cerevisiae
tcaccaatttcagaaagccc

SEQ ID NO: 5677 - DNA, 20 bp, Saccharomyces cerevisiae
ttcggcaaatagatgggaaa

SEQ ID NO: 5678 - DNA, 20 bp, Saccharomyces cerevisiae
tggttcgttgtccttcatca

SEQ ID NO: 5679 - DNA, 20 bp, Saccharomyces cerevisiae
ggatgcatgtagcgagggta

SEQ ID NO: 5680 - DNA, 20 bp, Saccharomyces cerevisiae
gtagacattggcttcgaggg

SEQ ID NO: 5681 - DNA, 20 bp, Saccharomyces cerevisiae
tcatcgtcttaccatcgtgc

SEQ ID NO: 5682 - DNA, 20 bp, Saccharomyces cerevisiae
ccaactctctgagcggtttc

SEQ ID NO: 5683 - DNA, 20 bp, Saccharomyces cerevisiae
cggcctgctgatttattttc

SEQ ID NO: 5684 - DNA, 20 bp, Saccharomyces cerevisiae
aatgtctgatccgaacctgc

SEQ ID NO: 5685 - DNA, 20 bp, Saccharomyces cerevisiae
cgaacgacgactctggtgta

SEQ ID NO: 5686 - DNA, 20 bp, Saccharomyces cerevisiae
aatgcggcttttgtaacgac

SEQ ID NO: 5687 - DNA, 23 bp, Saccharomyces cerevisiae
tgttttgctattggccattactt

SEQ ID NO: 5688 - DNA, 20 bp, Saccharomyces cerevisiae
taagcgcactgcagatagga

SEQ ID NO: 5689 - DNA, 20 bp, Saccharomyces cerevisiae
gcacccggtatattttccct

SEQ ID NO: 5690 - DNA, 20 bp, Saccharomyces cerevisiae
aggcggaaaacctttgctat

SEQ ID NO: 5691 - DNA, 20 bp, Saccharomyces cerevisiae
gtggaaagacccaaacctga

SEQ ID NO: 5692 - DNA, 20 bp, Saccharomyces cerevisiae
tggcacatcaatggaattgt

SEQ ID NO: 5693 - DNA, 20 bp, Saccharomyces cerevisiae
ccttcacatcgaacaccctt

SEQ ID NO: 5694 - DNA, 20 bp, Saccharomyces cerevisiae
ttttcccacgcctgttttac

SEQ ID NO: 5695 - DNA, 22 bp, Saccharomyces cerevisiae
gggatactcgtaatgtcaaccg

SEQ ID NO: 5696 - DNA, 20 bp, Saccharomyces cerevisiae
gccggaatagtgcaaattgt

SEQ ID NO: 5697 - DNA, 20 bp, Saccharomyces cerevisiae
cacgagggttctaagggtca

SEQ ID NO: 5698 - DNA, 20 bp, Saccharomyces cerevisiae
cgatcgaaaaccacattcct

SEQ ID NO: 5699 - DNA, 24 bp, Saccharomyces cerevisiae
tgagtatcatcataatgcgttcaa

SEQ ID NO: 5700 - DNA, 20 bp, Saccharomyces cerevisiae
gcaaccctaattttcgcact

SEQ ID NO: 5701 - DNA, 20 bp, Saccharomyces cerevisiae
ccgctacgtccgatattagc

SEQ ID NO: 5702 - DNA, 20 bp, Saccharomyces cerevisiae
tccatccaattgggatctgt

SEQ ID NO: 5703 - DNA, 20 bp, Saccharomyces cerevisiae
tgcttcttccgcttcatttt

SEQ ID NO: 5704 - DNA, 23 bp, Saccharomyces cerevisiae
cagctcacttcgaagacttatgg

SEQ ID NO: 5705 - DNA, 20 bp, Saccharomyces cerevisiae
agcaacggaaagctgtgaat

SEQ ID NO: 5706 - DNA, 22 bp, Saccharomyces cerevisiae
gctttggtatggagaagaatcg

SEQ ID NO: 5707 - DNA, 20 bp, Saccharomyces cerevisiae
tctttgagaaaaggaggcca

SEQ ID NO: 5708 - DNA, 21 bp, Saccharomyces cerevisiae
cgtaagtgaggatgacaaggg

SEQ ID NO: 5709 - DNA, 20 bp, Saccharomyces cerevisiae
catggtagcagtcccaacct

SEQ ID NO: 5710 - DNA, 20 bp, Saccharomyces cerevisiae
gttggatccatcgcctagaa

SEQ ID NO: 5711 - DNA, 20 bp, Saccharomyces cerevisiae
cgcaatgagcaggttaccat

SEQ ID NO: 5712 - DNA, 20 bp, Saccharomyces cerevisiae
cagctcgtggtttgccttat

SEQ ID NO: 5713 - DNA, 20 bp, Saccharomyces cerevisiae
tgcattgttggaaaatctgc

SEQ ID NO: 5714 - DNA, 20 bp, Saccharomyces cerevisiae
ttcgatgttcaaggcacaag

SEQ ID NO: 5715 - DNA, 20 bp, Saccharomyces cerevisiae
tactgcaaatctgcccacaa

SEQ ID NO: 5716 - DNA, 21 bp, Saccharomyces cerevisiae
tgcattctcgtcgtcattaag

SEQ ID NO: 5717 - DNA, 20 bp, Saccharomyces cerevisiae
cgtaatggggtctcacgtct

SEQ ID NO: 5718 - DNA, 20 bp, Saccharomyces cerevisiae
attcaaacgtaaaaacgcgg

SEQ ID NO: 5719 - DNA, 21 bp, Saccharomyces cerevisiae
gcaaagaattgatatcgtgcg

SEQ ID NO: 5720 - DNA, 20 bp, Saccharomyces cerevisiae
aattggcggttcttttgatg

SEQ ID NO: 5721 - DNA, 20 bp, Saccharomyces cerevisiae
cgttctgctgaaatttttgg

SEQ ID NO: 5722 - DNA, 20 bp, Saccharomyces cerevisiae
ggttgcaaacgcaacttctt

SEQ ID NO: 5723 - DNA, 20 bp, Saccharomyces cerevisiae
attcacattagcgcaagcaa

SEQ ID NO: 5724 - DNA, 21 bp, Saccharomyces cerevisiae
gccagagtgaaaaagtcgaaa

SEQ ID NO: 5725 - DNA, 20 bp, Saccharomyces cerevisiae
tcgggcttacaatacttggg

SEQ ID NO: 5726 - DNA, 20 bp, Saccharomyces cerevisiae
agaaacgggcaaatgctaaa

SEQ ID NO: 5727 - DNA, 20 bp, Saccharomyces cerevisiae
tgccaccataactctgatcg

SEQ ID NO: 5728 - DNA, 20 bp, Saccharomyces cerevisiae
taaatcctaaaaagggccgc

SEQ ID NO: 5729 - DNA, 25 bp, Saccharomyces cerevisiae
accaggaatacacataagtgcaaat

SEQ ID NO: 5730 - DNA, 20 bp, Saccharomyces cerevisiae
aattgtggggttacctgctg

SEQ ID NO: 5731 - DNA, 20 bp, Saccharomyces cerevisiae
ctactaggcggtttgttcgg

SEQ ID NO: 5732 - DNA, 20 bp, Saccharomyces cerevisiae
attacgaaaccactggcagg

SEQ ID NO: 5733 - DNA, 20 bp, Saccharomyces cerevisiae
gcaggcagaaccacacatta

SEQ ID NO: 5734 - DNA, 20 bp, Saccharomyces cerevisiae
atcagatatcgaagccgtgg

SEQ ID NO: 5735 - DNA, 20 bp, Saccharomyces cerevisiae
tgaacgatgactccaatcca

SEQ ID NO: 5736 - DNA, 20 bp, Saccharomyces cerevisiae
atccaaatacgtgaaagcgg

SEQ ID NO: 5737 - DNA, 20 bp, Saccharomyces cerevisiae
acgtgctccgtatttatggc

SEQ ID NO: 5738 - DNA, 20 bp, Saccharomyces cerevisiae
ttgaggagttgttgcgatga

SEQ ID NO: 5739 - DNA, 20 bp, Saccharomyces cerevisiae
cttgctgaacgaaacaacca

SEQ ID NO: 5740 - DNA, 20 bp, Saccharomyces cerevisiae
ggcgtttactcctggtcaag

SEQ ID NO: 5741 - DNA, 20 bp, Saccharomyces cerevisiae
catcgattcttccacgctct

SEQ ID NO: 5742 - DNA, 20 bp, Saccharomyces cerevisiae
aagcgtaacgtttttggtcg

SEQ ID NO: 5743 - DNA, 20 bp, Saccharomyces cerevisiae
ccgataacaggtgacgaggt

SEQ ID NO: 5744 - DNA, 20 bp, Saccharomyces cerevisiae
aaggatgtgacgtttttgcc

SEQ ID NO: 5745 - DNA, 20 bp, Saccharomyces cerevisiae
gcaatccatacgtccattca

SEQ ID NO: 5746 - DNA, 20 bp, Saccharomyces cerevisiae
ccaggttaaaagtgagccgt

SEQ ID NO: 5747 - DNA, 20 bp, Saccharomyces cerevisiae
ggttgcagggaatacaatgg

SEQ ID NO: 5748 - DNA, 25 bp, Saccharomyces cerevisiae
tttcttttggttgttgttatgattg

SEQ ID NO: 5749 - DNA, 20 bp, Saccharomyces cerevisiae
ctaggggtgccaaggtcata

SEQ ID NO: 5750 - DNA, 20 bp, Saccharomyces cerevisiae
gcctactacggaggaacgag

SEQ ID NO: 5751 - DNA, 20 bp, Saccharomyces cerevisiae
ggaggcaggggaaaaagata

SEQ ID NO: 5752 - DNA, 20 bp, Saccharomyces cerevisiae
cagccgatagatcagcatca

SEQ ID NO: 5753 - DNA, 20 bp, Saccharomyces cerevisiae
gtcttgcaccagcagaccat

SEQ ID NO: 5754 - DNA, 20 bp, Saccharomyces cerevisiae
tccacttcctttcctgttgc

SEQ ID NO: 5755 - DNA, 22 bp, Saccharomyces cerevisiae
ccgttagaggtgaaggttcatt

SEQ ID NO: 5756 - DNA, 20 bp, Saccharomyces cerevisiae
gccaggaataaacaaaccca

SEQ ID NO: 5757 - DNA, 20 bp, Saccharomyces cerevisiae
gcttgcaaggcatgagaaat

SEQ ID NO: 5758 - DNA, 20 bp, Saccharomyces cerevisiae
cgacccagtgccagttattt

SEQ ID NO: 5759 - DNA, 20 bp, Saccharomyces cerevisiae
cgattgggtatgcgatgata

SEQ ID NO: 5760 - DNA, 20 bp, Saccharomyces cerevisiae
agggtattgatggttctgcg

SEQ ID NO: 5761 - DNA, 20 bp, Saccharomyces cerevisiae
tggaacatcccagtgcataa

SEQ ID NO: 5762 - DNA, 20 bp, Saccharomyces cerevisiae
ttagaaagcgcacgttgttg

SEQ ID NO: 5763 - DNA, 20 bp, Saccharomyces cerevisiae
tgccacatgtcttccgtaaa

SEQ ID NO: 5764 - DNA, 20 bp, Saccharomyces cerevisiae
gaacatcgatgccttcacct

SEQ ID NO: 5765 - DNA, 20 bp, Saccharomyces cerevisiae
aacaaagacgtacggcatca

SEQ ID NO: 5766 - DNA, 20 bp, Saccharomyces cerevisiae
tgcgtgcctgttgttgttat

SEQ ID NO: 5767 - DNA, 20 bp, Saccharomyces cerevisiae
gacccacaaagggtttagca

SEQ ID NO: 5768 - DNA, 20 bp, Saccharomyces cerevisiae
tgatggatccgatgatgaag

SEQ ID NO: 5769 - DNA, 20 bp, Saccharomyces cerevisiae
tttcttaagctgcaccgaca

SEQ ID NO: 5770 - DNA, 27 bp, Saccharomyces cerevisiae
tgttctgttatggttttctgtactatc

SEQ ID NO: 5771 - DNA, 21 bp, Saccharomyces cerevisiae
tccgacaattatgtcgctacc

SEQ ID NO: 5772 - DNA, 20 bp, Saccharomyces cerevisiae
tttagcttcatggcaaggct

SEQ ID NO: 5773 - DNA, 20 bp, Saccharomyces cerevisiae
ggaattctgatcgcgttttt

SEQ ID NO: 5774 - DNA, 20 bp, Saccharomyces cerevisiae
ggaaccagtagcacccaaaa

SEQ ID NO: 5775 - DNA, 20 bp, Saccharomyces cerevisiae
caccatcagctccccatagt

SEQ ID NO: 5776 - DNA, 20 bp, Saccharomyces cerevisiae
ggacagctgcttctcgtacc

SEQ ID NO: 5777 - DNA, 20 bp, Saccharomyces cerevisiae
aaaaagcgcagttccactgt

SEQ ID NO: 5778 - DNA, 20 bp, Saccharomyces cerevisiae
gtagacaggctgccactcct

SEQ ID NO: 5779 - DNA, 20 bp, Saccharomyces cerevisiae
gggacataccttcttggggt

SEQ ID NO: 5780 - DNA, 20 bp, Saccharomyces cerevisiae
ccaccgagaggagttcaaga

SEQ ID NO: 5781 - DNA, 20 bp, Saccharomyces cerevisiae
tgcaagcagaagaattgtgg

SEQ ID NO: 5782 - DNA, 20 bp, Saccharomyces cerevisiae
tgcaaaagaaaaacctgcct

SEQ ID NO: 5783 - DNA, 21 bp, Saccharomyces cerevisiae
ttccacattttcttgtggagg

SEQ ID NO: 5784 - DNA, 20 bp, Saccharomyces cerevisiae
gtattgccaaacgaaccgat

SEQ ID NO: 5785 - DNA, 20 bp, Saccharomyces cerevisiae
tgcgtcgagaggtagaggtt

SEQ ID NO: 5786 - DNA, 20 bp, Saccharomyces cerevisiae
ggcacgttggaatgaatctt

SEQ ID NO: 5787 - DNA, 20 bp, Saccharomyces cerevisiae
gcagaagaacagggtgaagg

SEQ ID NO: 5788 - DNA, 20 bp, Saccharomyces cerevisiae
catataagacgcgccacaga

SEQ ID NO: 5789 - DNA, 20 bp, Saccharomyces cerevisiae
gtagggcatgcttgtggttt

SEQ ID NO: 5790 - DNA, 20 bp, Saccharomyces cerevisiae
atcgttggaggagacaaacg

SEQ ID NO: 5791 - DNA, 20 bp, Saccharomyces cerevisiae
tacaggcgccttcttagtgc

SEQ ID NO: 5792 - DNA, 20 bp, Saccharomyces cerevisiae
gtccagttcgcttatctcgg

SEQ ID NO: 5793 - DNA, 25 bp, Saccharomyces cerevisiae
aactccacgagctacaacaaaatac

SEQ ID NO: 5794 - DNA, 21 bp, Saccharomyces cerevisiae
ccaaggtggtcttggttgtag

SEQ ID NO: 5795 - DNA, 20 bp, Saccharomyces cerevisiae
acattttctcgtcggctcag

SEQ ID NO: 5796 - DNA, 20 bp, Saccharomyces cerevisiae
ttatacccgtgaagaagccg

SEQ ID NO: 5797 - DNA, 20 bp, Saccharomyces cerevisiae
ccattcagtgcaagaaccaa

SEQ ID NO: 5798 - DNA, 22 bp, Saccharomyces cerevisiae
gaaaaatgagaagaaagcagca

SEQ ID NO: 5799 - DNA, 20 bp, Saccharomyces cerevisiae
ttcttgcaatgcgaacaaag

SEQ ID NO: 5800 - DNA, 20 bp, Saccharomyces cerevisiae
gtccagcagacgccattatt

SEQ ID NO: 5801 - DNA, 20 bp, Saccharomyces cerevisiae
ttcccaacatggacaaggat

SEQ ID NO: 5802 - DNA, 20 bp, Saccharomyces cerevisiae
cgaatttgttctgcgtcctt

SEQ ID NO: 5803 - DNA, 20 bp, Saccharomyces cerevisiae
cacctgcaacatagtccctg

SEQ ID NO: 5804 - DNA, 20 bp, Saccharomyces cerevisiae
ggttgcattctcaaaacggt

SEQ ID NO: 5805 - DNA, 20 bp, Saccharomyces cerevisiae
gctggaaacccaaactgtgt

SEQ ID NO: 5806 - DNA, 21 bp, Saccharomyces cerevisiae
tccaaagcctcattaaaagtg

SEQ ID NO: 5807 - DNA, 20 bp, Saccharomyces cerevisiae
aacgatataggcgcatcctg

SEQ ID NO: 5808 - DNA, 20 bp, Saccharomyces cerevisiae
ggaaaagaattccgaccctt

SEQ ID NO: 5809 - DNA, 20 bp, Saccharomyces cerevisiae
gccatgagagctacgttgaa

SEQ ID NO: 5810 - DNA, 20 bp, Saccharomyces cerevisiae
tggcataattggactgcaaa

SEQ ID NO: 5811 - DNA, 20 bp, Saccharomyces cerevisiae
acactcaacccacctccaaa

SEQ ID NO: 5812 - DNA, 20 bp, Saccharomyces cerevisiae
tcggttcaaatttggggtaa

SEQ ID NO: 5813 - DNA, 20 bp, Saccharomyces cerevisiae
gcaggcattcttttatcagg

SEQ ID NO: 5814 - DNA, 20 bp, Saccharomyces cerevisiae
agcatttgtaaggtccgtgt

SEQ ID NO: 5815 - DNA, 20 bp, Saccharomyces cerevisiae
tcatcctcatcttcatcccc

SEQ ID NO: 5816 - DNA, 20 bp, Saccharomyces cerevisiae
caacccgtgctttaggagag

SEQ ID NO: 5817 - DNA, 20 bp, Saccharomyces cerevisiae
ccttacgatagagtggggca

SEQ ID NO: 5818 - DNA, 21 bp, Saccharomyces cerevisiae
tgaattgtcctgagctgacct

SEQ ID NO: 5819 - DNA, 20 bp, Saccharomyces cerevisiae
gaaccaccgacaaaaccaat

SEQ ID NO: 5820 - DNA, 20 bp, Saccharomyces cerevisiae
tcgcggcttccattttatta

SEQ ID NO: 5821 - DNA, 20 bp, Saccharomyces cerevisiae
gacactcgcaggacactcaa

SEQ ID NO: 5822 - DNA, 20 bp, Saccharomyces cerevisiae
cccattgctactccacctgt

SEQ ID NO: 5823 - DNA, 20 bp, Saccharomyces cerevisiae
ccgaaaaaggaaataacgca

SEQ ID NO: 5824 - DNA, 20 bp, Saccharomyces cerevisiae
ccatccatttgaagctggtt

SEQ ID NO: 5825 - DNA, 26 bp, Saccharomyces cerevisiae
ccaacatctaaatttgttgattgtat

SEQ ID NO: 5826 - DNA, 20 bp, Saccharomyces cerevisiae
accgcattacttccagttga

SEQ ID NO: 5827 - DNA, 20 bp, Saccharomyces cerevisiae
tgtgcgtgttgtgaattgtg

SEQ ID NO: 5828 - DNA, 20 bp, Saccharomyces cerevisiae
ggaaagtaaacgttccctgg

SEQ ID NO: 5829 - DNA, 20 bp, Saccharomyces cerevisiae
agttccatttaggccctggt

SEQ ID NO: 5830 - DNA, 21 bp, Saccharomyces cerevisiae
tttggttgaagccactaatgc

SEQ ID NO: 5831 - DNA, 20 bp, Saccharomyces cerevisiae
gggggatctaatcagggtgt

SEQ ID NO: 5832 - DNA, 20 bp, Saccharomyces cerevisiae
cggcgtaatggatcagaaat

SEQ ID NO: 5833 - DNA, 20 bp, Saccharomyces cerevisiae
cgaaacttgctggtacaccc

SEQ ID NO: 5834 - DNA, 20 bp, Saccharomyces cerevisiae
tggtggtaatgaagccacaa

SEQ ID NO: 5835 - DNA, 22 bp, Saccharomyces cerevisiae
cgataactatcaagacatggcg

SEQ ID NO: 5836 - DNA, 20 bp, Saccharomyces cerevisiae
ggcagatattttaccgctgg

SEQ ID NO: 5837 - DNA, 20 bp, Saccharomyces cerevisiae
ggatttcgcatcctagacca

SEQ ID NO: 5838 - DNA, 20 bp, Saccharomyces cerevisiae
tcatttcgggttttctcacc

SEQ ID NO: 5839 - DNA, 20 bp, Saccharomyces cerevisiae
tatcattttcctgcatcggg

SEQ ID NO: 5840 - DNA, 20 bp, Saccharomyces cerevisiae
agattggctggttttggttg

SEQ ID NO: 5841 - DNA, 20 bp, Saccharomyces cerevisiae
catcacctaaaggcacgaca

SEQ ID NO: 5842 - DNA, 20 bp, Saccharomyces cerevisiae
tgcgtggagtttttacagga

SEQ ID NO: 5843 - DNA, 20 bp, Saccharomyces cerevisiae
gttcgacccaacaaaaagga

SEQ ID NO: 5844 - DNA, 20 bp, Saccharomyces cerevisiae
tgcaacataagattcctgcg

SEQ ID NO: 5845 - DNA, 20 bp, Saccharomyces cerevisiae
attgtgccctaacgttccag

SEQ ID NO: 5846 - DNA, 22 bp, Saccharomyces cerevisiae
caaacgaacaggtcagagagaa

SEQ ID NO: 5847 - DNA, 20 bp, Saccharomyces cerevisiae
ccagatgtgccaactgtgtc

SEQ ID NO: 5848 - DNA, 20 bp, Saccharomyces cerevisiae
accttcctcggacagtagca

SEQ ID NO: 5849 - DNA, 20 bp, Saccharomyces cerevisiae
cagaacaaagcggtttcaca

SEQ ID NO: 5850 - DNA, 21 bp, Saccharomyces cerevisiae
ttcaccttccgttttcaaaga

SEQ ID NO: 5851 - DNA, 20 bp, Saccharomyces cerevisiae
tccagttacaacagcggtga

SEQ ID NO: 5852 - DNA, 20 bp, Saccharomyces cerevisiae
tacttggcatctgggaaacc

SEQ ID NO: 5853 - DNA, 20 bp, Saccharomyces cerevisiae
cagtgcatcatttgtgaggg

SEQ ID NO: 5854 - DNA, 20 bp, Saccharomyces cerevisiae
aataaattcgcagaggccag

SEQ ID NO: 5855 - DNA, 23 bp, Saccharomyces cerevisiae
gaaagagaaaaacgaaatgtcca

SEQ ID NO: 5856 - DNA, 20 bp, Saccharomyces cerevisiae
cgatgtcaactcggaatcaa

SEQ ID NO: 5857 - DNA, 20 bp, Saccharomyces cerevisiae
tcacccccttcttttgtgtc

SEQ ID NO: 5858 - DNA, 20 bp, Saccharomyces cerevisiae
ctgcatgtacactgttgggg

SEQ ID NO: 5859 - DNA, 20 bp, Saccharomyces cerevisiae
tggtgtaggcacagttggaa

SEQ ID NO: 5860 - DNA, 22 bp, Saccharomyces cerevisiae
tcgggactatttaaggaccaaa

SEQ ID NO: 5861 - DNA, 20 bp, Saccharomyces cerevisiae
gcactgtatcagacaccgct

SEQ ID NO: 5862 - DNA, 20 bp, Saccharomyces cerevisiae
ccggaccactcaaacaaaat

SEQ ID NO: 5863 - DNA, 20 bp, Saccharomyces cerevisiae
accgcagaacggatttactg

SEQ ID NO: 5864 - DNA, 21 bp, Saccharomyces cerevisiae
cagagaaaagtcaccagcctc

SEQ ID NO: 5865 - DNA, 20 bp, Saccharomyces cerevisiae
atcttgcccgatgatgaaag

SEQ ID NO: 5866 - DNA, 20 bp, Saccharomyces cerevisiae
cccgctctgtgagtttcttc

SEQ ID NO: 5867 - DNA, 20 bp, Saccharomyces cerevisiae
gctttcatttcttgggggtc

SEQ ID NO: 5868 - DNA, 20 bp, Saccharomyces cerevisiae
tttcaagccgggagatattg

SEQ ID NO: 5869 - DNA, 20 bp, Saccharomyces cerevisiae
gcgggtgtaaatcatcacct

SEQ ID NO: 5870 - DNA, 20 bp, Saccharomyces cerevisiae
catatagccgagtcccatcg

SEQ ID NO: 5871 - DNA, 23 bp, Saccharomyces cerevisiae
gcatctaatggtcataaatccca

SEQ ID NO: 5872 - DNA, 22 bp, Saccharomyces cerevisiae
tggtgttctcttctcattgctt

SEQ ID NO: 5873 - DNA, 21 bp, Saccharomyces cerevisiae
gcgctataaaacaaaggaccc

SEQ ID NO: 5874 - DNA, 20 bp, Saccharomyces cerevisiae
tgaaagccaagcagaaacaa

SEQ ID NO: 5875 - DNA, 21 bp, Saccharomyces cerevisiae
acttcattaagggttggcgtt

SEQ ID NO: 5876 - DNA, 21 bp, Saccharomyces cerevisiae
cgatttgaattgctcctgttc

SEQ ID NO: 5877 - DNA, 21 bp, Saccharomyces cerevisiae
cccgtagattggaaaacatga

SEQ ID NO: 5878 - DNA, 23 bp, Saccharomyces cerevisiae
gagaagaaaaagggttcttggaa

SEQ ID NO: 5879 - DNA, 20 bp, Saccharomyces cerevisiae
tgaaaaatgcgatacgttgg

SEQ ID NO: 5880 - DNA, 23 bp, Saccharomyces cerevisiae
tcatctaaaaataggaggggtga

SEQ ID NO: 5881 - DNA, 20 bp, Saccharomyces cerevisiae
ctaagacgactggaaacggc

SEQ ID NO: 5882 - DNA, 20 bp, Saccharomyces cerevisiae
tcgactatggaatcccaaca

SEQ ID NO: 5883 - DNA, 20 bp, Saccharomyces cerevisiae
gccgagctactctccacatc

SEQ ID NO: 5884 - DNA, 20 bp, Saccharomyces cerevisiae
ggaaaaatggctcgtctttg

SEQ ID NO: 5885 - DNA, 21 bp, Saccharomyces cerevisiae
tttagcgaagctgaaacacag

SEQ ID NO: 5886 - DNA, 20 bp, Saccharomyces cerevisiae
cgcaaaatgattctgtgagc

SEQ ID NO: 5887 - DNA, 20 bp, Saccharomyces cerevisiae
aattttgtcgaattgctggg

SEQ ID NO: 5888 - DNA, 20 bp, Saccharomyces cerevisiae
gtacgattcttcggtgccat

SEQ ID NO: 5889 - DNA, 20 bp, Saccharomyces cerevisiae
ttttgggtgtcctttccaag

SEQ ID NO: 5890 - DNA, 20 bp, Saccharomyces cerevisiae
cttataaccgttgttgccgc

SEQ ID NO: 5891 - DNA, 20 bp, Saccharomyces cerevisiae
tggtgtggttggacatcagt

SEQ ID NO: 5892 - DNA, 20 bp, Saccharomyces cerevisiae
tgacctagttttggaagggc

SEQ ID NO: 5893 - DNA, 20 bp, Saccharomyces cerevisiae
acgtccactggatttggaag

SEQ ID NO: 5894 - DNA, 20 bp, Saccharomyces cerevisiae
acgaaaacaagagcttggga

SEQ ID NO: 5895 - DNA, 20 bp, Saccharomyces cerevisiae
tcccattgattcctagtggc

SEQ ID NO: 5896 - DNA, 20 bp, Saccharomyces cerevisiae
aggaagctgctgctaccaag

SEQ ID NO: 5897 - DNA, 20 bp, Saccharomyces cerevisiae
agttggcctcctcactacca

SEQ ID NO: 5898 - DNA, 21 bp, Saccharomyces cerevisiae
tgcagttaaaagtgccactca

SEQ ID NO: 5899 - DNA, 20 bp, Saccharomyces cerevisiae
tgagtattcccatctggacg

SEQ ID NO: 5900 - DNA, 22 bp, Saccharomyces cerevisiae
tgaaatcttctgcttctggaca

SEQ ID NO: 5901 - DNA, 20 bp, Saccharomyces cerevisiae
gagggagaggtatgccaatg

SEQ ID NO: 5902 - DNA, 20 bp, Saccharomyces cerevisiae
tcttgttcctgacggaaggt

SEQ ID NO: 5903 - DNA, 20 bp, Saccharomyces cerevisiae
caggctggtcatttgatcct

SEQ ID NO: 5904 - DNA, 20 bp, Saccharomyces cerevisiae
cgatcgtcattgcttggatt

SEQ ID NO: 5905 - DNA, 20 bp, Saccharomyces cerevisiae
atgagataggcctgctcgaa

SEQ ID NO: 5906 - DNA, 19 bp, Saccharomyces cerevisiae
agcagaatcatttccgctg

SEQ ID NO: 5907 - DNA, 20 bp, Saccharomyces cerevisiae
tcacccacttcgcaagtaca

SEQ ID NO: 5908 - DNA, 20 bp, Saccharomyces cerevisiae
gtagggcttggcgtcagtag

SEQ ID NO: 5909 - DNA, 20 bp, Saccharomyces cerevisiae
gtggggagactatgggatca

SEQ ID NO: 5910 - DNA, 20 bp, Saccharomyces cerevisiae
ccattcggtcatcttcttcc

SEQ ID NO: 5911 - DNA, 20 bp, Saccharomyces cerevisiae
attccgcgcgttatgattta

SEQ ID NO: 5912 - DNA, 20 bp, Saccharomyces cerevisiae
gatcgcccgatacaaacaat

SEQ ID NO: 5913 - DNA, 21 bp, Saccharomyces cerevisiae
aatagacgtagccacatgcag

SEQ ID NO: 5914 - DNA, 20 bp, Saccharomyces cerevisiae
actctggcagaacctcagga

SEQ ID NO: 5915 - DNA, 22 bp, Saccharomyces cerevisiae
ctgtcttagttcgcaaccattt

SEQ ID NO: 5916 - DNA, 20 bp, Saccharomyces cerevisiae
tcttcagaatgacgacggtg

SEQ ID NO: 5917 - DNA, 20 bp, Saccharomyces cerevisiae
ccatagcataacgaacgacg

SEQ ID NO: 5918 - DNA, 20 bp, Saccharomyces cerevisiae
atctaatcctgtgatgccgc

SEQ ID NO: 5919 - DNA, 20 bp, Saccharomyces cerevisiae
ttcaactccgggtaatggag

SEQ ID NO: 5920 - DNA, 20 bp, Saccharomyces cerevisiae
gctggtttttcttcgactgc

SEQ ID NO: 5921 - DNA, 20 bp, Saccharomyces cerevisiae
acaaaaccagggaacagcac

SEQ ID NO: 5922 - DNA, 20 bp, Saccharomyces cerevisiae
ggtggcaactggattgaagt

SEQ ID NO: 5923 - DNA, 20 bp, Saccharomyces cerevisiae
ccagatccaaagggcaagta

SEQ ID NO: 5924 - DNA, 20 bp, Saccharomyces cerevisiae
acagtcccgacgttgttttc

SEQ ID NO: 5925 - DNA, 20 bp, Saccharomyces cerevisiae
taccgatttcgtcctggttc

SEQ ID NO: 5926 - DNA, 21 bp, Saccharomyces cerevisiae
tgaatgtaggacagcatttgg

SEQ ID NO: 5927 - DNA, 20 bp, Saccharomyces cerevisiae
aaactgtgccaacccaaaaa

SEQ ID NO: 5928 - DNA, 20 bp, Saccharomyces cerevisiae
gttgatcttcgcctcttgga

SEQ ID NO: 5929 - DNA, 20 bp, Saccharomyces cerevisiae
ggtccagaaaagccaaacaa

SEQ ID NO: 5930 - DNA, 20 bp, Saccharomyces cerevisiae
ttccgaaaactttgaggcac

SEQ ID NO: 5931 - DNA, 20 bp, Saccharomyces cerevisiae
agggagaatactggacaccg

SEQ ID NO: 5932 - DNA, 21 bp, Saccharomyces cerevisiae
tgacagactagtcaacgacgc

SEQ ID NO: 5933 - DNA, 20 bp, Saccharomyces cerevisiae
acaacaaagtctcaacccgc

SEQ ID NO: 5934 - DNA, 20 bp, Saccharomyces cerevisiae
tgtaccaggttcaccaacca

SEQ ID NO: 5935 - DNA, 20 bp, Saccharomyces cerevisiae
gatcttggtgttggctggtt

SEQ ID NO: 5936 - DNA, 20 bp, Saccharomyces cerevisiae
caagcaggatgttgaattgg

SEQ ID NO: 5937 - DNA, 20 bp, Saccharomyces cerevisiae
ttacgtcgaggaggttgagg

SEQ ID NO: 5938 - DNA, 20 bp, Saccharomyces cerevisiae
gcgttccggtgactatcatt

SEQ ID NO: 5939 - DNA, 20 bp, Saccharomyces cerevisiae
aacaaaagccgtgctgaaac

SEQ ID NO: 5940 - DNA, 20 bp, Saccharomyces cerevisiae
cgaggtgtcagcagtgtcat

SEQ ID NO: 5941 - DNA, 20 bp, Saccharomyces cerevisiae
gcgttctacggacatttgtg

SEQ ID NO: 5942 - DNA, 20 bp, Saccharomyces cerevisiae
tggtagctgcacgacaaaaa

SEQ ID NO: 5943 - DNA, 20 bp, Saccharomyces cerevisiae
cgtgtgttttgtttgcacct

SEQ ID NO: 5944 - DNA, 25 bp, Saccharomyces cerevisiae
atcccacattgaattagttgtcact

SEQ ID NO: 5945 - DNA, 20 bp, Saccharomyces cerevisiae
attgagtgctgtgacaagcg

SEQ ID NO: 5946 - DNA, 21 bp, Saccharomyces cerevisiae
ccgatttcattggagttttca

SEQ ID NO: 5947 - DNA, 20 bp, Saccharomyces cerevisiae
aagctgcaagagggtttcaa

SEQ ID NO: 5948 - DNA, 20 bp, Saccharomyces cerevisiae
accatcttgtctcgtggtcc

SEQ ID NO: 5949 - DNA, 22 bp, Saccharomyces cerevisiae
tctgtgtaaactgaaccaggct

SEQ ID NO: 5950 - DNA, 27 bp, Saccharomyces cerevisiae
cggaaccttttatttaagatttagagc

SEQ ID NO: 5951 - DNA, 25 bp, Saccharomyces cerevisiae
gtaggtgaactattttggaaggtca

SEQ ID NO: 5952 - DNA, 20 bp, Saccharomyces cerevisiae
agaaaaagccatttggcaga

SEQ ID NO: 5953 - DNA, 20 bp, Saccharomyces cerevisiae
ctttggtttcatggcgaaat

SEQ ID NO: 5954 - DNA, 20 bp, Saccharomyces cerevisiae
aaacaaaaacgggtacgctc

SEQ ID NO: 5955 - DNA, 20 bp, Saccharomyces cerevisiae
gtcgcaatgccagtttaaca

SEQ ID NO: 5956 - DNA, 20 bp, Saccharomyces cerevisiae
ttcccagtggttgttcatca

SEQ ID NO: 5957 - DNA, 20 bp, Saccharomyces cerevisiae
caagatctggaacggtgttg

SEQ ID NO: 5958 - DNA, 20 bp, Saccharomyces cerevisiae
ctgccttctttcctttgcac

SEQ ID NO: 5959 - DNA, 20 bp, Saccharomyces cerevisiae
gcaagttatgcaggtgctga

SEQ ID NO: 5960 - DNA, 20 bp, Saccharomyces cerevisiae
ttagccgttcgtatggaacc

SEQ ID NO: 5961 - DNA, 20 bp, Saccharomyces cerevisiae
tacgaaacttctgccgcttt

SEQ ID NO: 5962 - DNA, 20 bp, Saccharomyces cerevisiae
atgcattggagtgtagccgt

SEQ ID NO: 5963 - DNA, 20 bp, Saccharomyces cerevisiae
gggggaaactggaatgaaat

SEQ ID NO: 5964 - DNA, 20 bp, Saccharomyces cerevisiae
acagttcgcgtgttcctacc

SEQ ID NO: 5965 - DNA, 20 bp, Saccharomyces cerevisiae
tttaaaggcctccaccaatg

SEQ ID NO: 5966 - DNA, 23 bp, Saccharomyces cerevisiae
tgttcacttttgttacgctgaaa

SEQ ID NO: 5967 - DNA, 20 bp, Saccharomyces cerevisiae
aagtaacctgggacaccacg

SEQ ID NO: 5968 - DNA, 20 bp, Saccharomyces cerevisiae
aaaaatgggctaccattccc

SEQ ID NO: 5969 - DNA, 20 bp, Saccharomyces cerevisiae
catcagaggggttttcctca

SEQ ID NO: 5970 - DNA, 23 bp, Saccharomyces cerevisiae
tttttgcttaattgctttaaccg

SEQ ID NO: 5971 - DNA, 21 bp, Saccharomyces cerevisiae
aactgtttattcagctgggca

SEQ ID NO: 5972 - DNA, 20 bp, Saccharomyces cerevisiae
acgcaattagcgtgcctaag

SEQ ID NO: 5973 - DNA, 21 bp, Saccharomyces cerevisiae
tttttacgccgcatatgatac

SEQ ID NO: 5974 - DNA, 20 bp, Saccharomyces cerevisiae
aaagagagcgcgattgaaga

SEQ ID NO: 5975 - DNA, 20 bp, Saccharomyces cerevisiae
tttgcctttttctgtgctcc

SEQ ID NO: 5976 - DNA, 20 bp, Saccharomyces cerevisiae
cttcataagcggctcgaatc

SEQ ID NO: 5977 - DNA, 25 bp, Saccharomyces cerevisiae
atggaatccactagaagttttcctc

SEQ ID NO: 5978 - DNA, 20 bp, Saccharomyces cerevisiae
agatgttggtactagcgccg

SEQ ID NO: 5979 - DNA, 20 bp, Saccharomyces cerevisiae
gtccattcaaccgggactta

SEQ ID NO: 5980 - DNA, 20 bp, Saccharomyces cerevisiae
aagaaaggctaaagctccgc

SEQ ID NO: 5981 - DNA, 20 bp, Saccharomyces cerevisiae
gtttgcttttcccccatttt

SEQ ID NO: 5982 - DNA, 20 bp, Saccharomyces cerevisiae
catcctcgtttggatggatt

SEQ ID NO: 5983 - DNA, 20 bp, Saccharomyces cerevisiae
aatgattcgggtttcgcata

SEQ ID NO: 5984 - DNA, 20 bp, Saccharomyces cerevisiae
gcaatgaatttttccgtgct

SEQ ID NO: 5985 - DNA, 20 bp, Saccharomyces cerevisiae
ggacgctaaagacaccgaag

SEQ ID NO: 5986 - DNA, 21 bp, Saccharomyces cerevisiae
tggtaagcaattggaagatgg

SEQ ID NO: 5987 - DNA, 20 bp, Saccharomyces cerevisiae
aagtcacggtgcgtcttttt

SEQ ID NO: 5988 - DNA, 20 bp, Saccharomyces cerevisiae
caacaacacgctacgctctg

SEQ ID NO: 5989 - DNA, 20 bp, Saccharomyces cerevisiae
ttattttgtgccacattgcc

SEQ ID NO: 5990 - DNA, 20 bp, Saccharomyces cerevisiae
tgatccatttgggaacacct

SEQ ID NO: 5991 - DNA, 21 bp, Saccharomyces cerevisiae
tttcaaaactgatgaatccgc

SEQ ID NO: 5992 - DNA, 20 bp, Saccharomyces cerevisiae
aaatgaaatccaagggctca

SEQ ID NO: 5993 - DNA, 20 bp, Saccharomyces cerevisiae
tggcctcgctagttaagctc

SEQ ID NO: 5994 - DNA, 20 bp, Saccharomyces cerevisiae
cgatttaaagcgttggaacc

SEQ ID NO: 5995 - DNA, 20 bp, Saccharomyces cerevisiae
aagtcgcccttgtgtatcgt

SEQ ID NO: 5996 - DNA, 20 bp, Saccharomyces cerevisiae
gaggccagtagcccctttac

SEQ ID NO: 5997 - DNA, 18 bp, Saccharomyces cerevisiae
gcgaatgcgtcgaagttt

SEQ ID NO: 5998 - DNA, 20 bp, Saccharomyces cerevisiae
gtcaggaactcttcaagcgg

SEQ ID NO: 5999 - DNA, 20 bp, Saccharomyces cerevisiae
ggctatgcgcgtgataaaat

SEQ ID NO: 6000 - DNA, 20 bp, Saccharomyces cerevisiae
gtctgaagacattgcgggtt

SEQ ID NO: 6001 - DNA, 20 bp, Saccharomyces cerevisiae
tgccagtcaagatttcccat

SEQ ID NO: 6002 - DNA, 20 bp, Saccharomyces cerevisiae
ggggcaattactgtcgaaga

SEQ ID NO: 6003 - DNA, 20 bp, Saccharomyces cerevisiae
taagcgaagaacacgcttca

SEQ ID NO: 6004 - DNA, 20 bp, Saccharomyces cerevisiae
ttaaggtggcaacggtaagg

SEQ ID NO: 6005 - DNA, 20 bp, Saccharomyces cerevisiae
ggaatcagcgggtaaaatca

SEQ ID NO: 6006 - DNA, 20 bp, Saccharomyces cerevisiae
tgatgtgctcgtcattggat

SEQ ID NO: 6007 - DNA, 20 bp, Saccharomyces cerevisiae
tcttggcaccaccaatacaa

SEQ ID NO: 6008 - DNA, 20 bp, Saccharomyces cerevisiae
gcgaggacgatgatgagatt

SEQ ID NO: 6009 - DNA, 20 bp, Saccharomyces cerevisiae
tttccccattgatgaccagt

SEQ ID NO: 6010 - DNA, 20 bp, Saccharomyces cerevisiae
gagatgaaaggacgccgtag

SEQ ID NO: 6011 - DNA, 20 bp, Saccharomyces cerevisiae
ggtcaaggcatgcaatctct

SEQ ID NO: 6012 - DNA, 23 bp, Saccharomyces cerevisiae
ttgaacataacgtcttcatctcc

SEQ ID NO: 6013 - DNA, 20 bp, Saccharomyces cerevisiae
ggtacaagtgcaagccaaca

SEQ ID NO: 6014 - DNA, 20 bp, Saccharomyces cerevisiae
tggactttagcgcaggattt

SEQ ID NO: 6015 - DNA, 20 bp, Saccharomyces cerevisiae
cccctcatacaaggctgaaa

SEQ ID NO: 6016 - DNA, 20 bp, Saccharomyces cerevisiae
gattggggttatgccttcaa

SEQ ID NO: 6017 - DNA, 20 bp, Saccharomyces cerevisiae
agtcagtggaggcgaaaaga

SEQ ID NO: 6018 - DNA, 20 bp, Saccharomyces cerevisiae
agtcccgtagcctcatcaga

SEQ ID NO: 6019 - DNA, 20 bp, Saccharomyces cerevisiae
ctgccgtcgtcctttaagtc

SEQ ID NO: 6020 - DNA, 20 bp, Saccharomyces cerevisiae
gcttggctcaaactctgtcc

SEQ ID NO: 6021 - DNA, 23 bp, Saccharomyces cerevisiae
gacacgatttttaacctaaaggc

SEQ ID NO: 6022 - DNA, 20 bp, Saccharomyces cerevisiae
acgttctcactttgtgccct

SEQ ID NO: 6023 - DNA, 20 bp, Saccharomyces cerevisiae
gaaacaacagcgagacctcc

SEQ ID NO: 6024 - DNA, 20 bp, Saccharomyces cerevisiae
atggtgaccaattgggaatg

SEQ ID NO: 6025 - DNA, 20 bp, Saccharomyces cerevisiae
ttgtcttatcgacgacgctg

SEQ ID NO: 6026 - DNA, 20 bp, Saccharomyces cerevisiae
cgacaacgacattgctgttt

SEQ ID NO: 6027 - DNA, 20 bp, Saccharomyces cerevisiae
tcccgcataagtacgtcaca

SEQ ID NO: 6028 - DNA, 22 bp, Saccharomyces cerevisiae
aagcaagacattcacacacaca

SEQ ID NO: 6029 - DNA, 20 bp, Saccharomyces cerevisiae
gcgaaactcgccaaaataag

SEQ ID NO: 6030 - DNA, 25 bp, Saccharomyces cerevisiae
ccaagagaccattctattgttgaag

SEQ ID NO: 6031 - DNA, 20 bp, Saccharomyces cerevisiae
ctccgagggtttaaaaaggc

SEQ ID NO: 6032 - DNA, 20 bp, Saccharomyces cerevisiae
gttgaagccattccctttga

SEQ ID NO: 6033 - DNA, 20 bp, Saccharomyces cerevisiae
cttgcctgtggcgttaaaat

SEQ ID NO: 6034 - DNA, 20 bp, Saccharomyces cerevisiae
ccaatgatgaaactacggca

SEQ ID NO: 6035 - DNA, 20 bp, Saccharomyces cerevisiae
agcattcgtcagcattaggc

SEQ ID NO: 6036 - DNA, 20 bp, Saccharomyces cerevisiae
attcggattggactgattcg

SEQ ID NO: 6037 - DNA, 20 bp, Saccharomyces cerevisiae
tccgattgttgcactttgaa

SEQ ID NO: 6038 - DNA, 20 bp, Saccharomyces cerevisiae
agccttagggcaacatgaaa

SEQ ID NO: 6039 - DNA, 20 bp, Saccharomyces cerevisiae
agtgcggcagaaaattcatc

SEQ ID NO: 6040 - DNA, 20 bp, Saccharomyces cerevisiae
tgctgtcgtggtagagttgg

SEQ ID NO: 6041 - DNA, 20 bp, Saccharomyces cerevisiae
gtgatgacttgaagagcgca

SEQ ID NO: 6042 - DNA, 20 bp, Saccharomyces cerevisiae
aaaaatgcaaacaaccgctc

SEQ ID NO: 6043 - DNA, 20 bp, Saccharomyces cerevisiae
acgatttgaaggaaattgcg

SEQ ID NO: 6044 - DNA, 20 bp, Saccharomyces cerevisiae
accagctgggataggggtat

SEQ ID NO: 6045 - DNA, 22 bp, Saccharomyces cerevisiae
tgagaccattcagaccattcaa

SEQ ID NO: 6046 - DNA, 20 bp, Saccharomyces cerevisiae
ttgggcaattcgttgagttt

SEQ ID NO: 6047 - DNA, 20 bp, Saccharomyces cerevisiae
gccaggaaactcacacgact

SEQ ID NO: 6048 - DNA, 20 bp, Saccharomyces cerevisiae
tgtcgccacattttgtccta

SEQ ID NO: 6049 - DNA, 20 bp, Saccharomyces cerevisiae
aagtttcagctgggtccaaa

SEQ ID NO: 6050 - DNA, 20 bp, Saccharomyces cerevisiae
gactaactggacgctggctt

SEQ ID NO: 6051 - DNA, 20 bp, Saccharomyces cerevisiae
attcccacacacacagacga

SEQ ID NO: 6052 - DNA, 20 bp, Saccharomyces cerevisiae
tgtggtaatgcgatattggg

SEQ ID NO: 6053 - DNA, 20 bp, Saccharomyces cerevisiae
gtagcggctcaacctttttg

SEQ ID NO: 6054 - DNA, 21 bp, Saccharomyces cerevisiae
gcatgcgagatttaatcgttc

SEQ ID NO: 6055 - DNA, 20 bp, Saccharomyces cerevisiae
gctccgcaagaaatagcagt

SEQ ID NO: 6056 - DNA, 20 bp, Saccharomyces cerevisiae
agatatcccgaccacgtctg

SEQ ID NO: 6057 - DNA, 21 bp, Saccharomyces cerevisiae
ttccattttgaggattcaacc

SEQ ID NO: 6058 - DNA, 20 bp, Saccharomyces cerevisiae
ctttgaacccattccgctaa

SEQ ID NO: 6059 - DNA, 20 bp, Saccharomyces cerevisiae
ctgtagtcagcaagcaccca

SEQ ID NO: 6060 - DNA, 20 bp, Saccharomyces cerevisiae
gtacagagggcatggtgcat

SEQ ID NO: 6061 - DNA, 20 bp, Saccharomyces cerevisiae
cctcccttcttttcactgga

SEQ ID NO: 6062 - DNA, 21 bp, Saccharomyces cerevisiae
ctcgatcaagaaaccgtcaag

SEQ ID NO: 6063 - DNA, 20 bp, Saccharomyces cerevisiae
gaagccgccagagaactaga

SEQ ID NO: 6064 - DNA, 20 bp, Saccharomyces cerevisiae
tcctcgctgtcaatttgttg

SEQ ID NO: 6065 - DNA, 20 bp, Saccharomyces cerevisiae
tcagggtttcttcgttgacc

SEQ ID NO: 6066 - DNA, 20 bp, Saccharomyces cerevisiae
attgcagcagtccttgcttt

SEQ ID NO: 6067 - DNA, 20 bp, Saccharomyces cerevisiae
gccgttgtaattgcctttgt

SEQ ID NO: 6068 - DNA, 20 bp, Saccharomyces cerevisiae
cgccaggagtggttaatgtt

SEQ ID NO: 6069 - DNA, 20 bp, Saccharomyces cerevisiae
ggaattggttcgcagtgttt

SEQ ID NO: 6070 - DNA, 20 bp, Saccharomyces cerevisiae
ctcatggtatggcgctcttt

SEQ ID NO: 6071 - DNA, 20 bp, Saccharomyces cerevisiae
ttgctcctcattgcaacttt

SEQ ID NO: 6072 - DNA, 20 bp, Saccharomyces cerevisiae
ggtgacgccgtttatctgtt

SEQ ID NO: 6073 - DNA, 20 bp, Saccharomyces cerevisiae
cccttttcgtgactgcaaat

SEQ ID NO: 6074 - DNA, 20 bp, Saccharomyces cerevisiae
tgaagttggggataacgctc

SEQ ID NO: 6075 - DNA, 20 bp, Saccharomyces cerevisiae
aatggtgcatgggtgaaaat

SEQ ID NO: 6076 - DNA, 20 bp, Saccharomyces cerevisiae
ccgtaccagaaaaggaacca

SEQ ID NO: 6077 - DNA, 20 bp, Saccharomyces cerevisiae
aaagaggaggtccccgacta

SEQ ID NO: 6078 - DNA, 20 bp, Saccharomyces cerevisiae
tgggtaaagagccaggtttg

SEQ ID NO: 6079 - DNA, 20 bp, Saccharomyces cerevisiae
gcaaacatagaacggggtgt

SEQ ID NO: 6080 - DNA, 20 bp, Saccharomyces cerevisiae
ccaggcgtcatgataattca

SEQ ID NO: 6081 - DNA, 20 bp, Saccharomyces cerevisiae
gcgtcgtaagcatcagacaa

SEQ ID NO: 6082 - DNA, 21 bp, Saccharomyces cerevisiae
tggtgttacaaaattctcggc

SEQ ID NO: 6083 - DNA, 20 bp, Saccharomyces cerevisiae
attctccagcgcgtaatgat

SEQ ID NO: 6084 - DNA, 21 bp, Saccharomyces cerevisiae
ttgcaggttcagatgatgaca

SEQ ID NO: 6085 - DNA, 20 bp, Saccharomyces cerevisiae
tggtccttcttttccaccat

SEQ ID NO: 6086 - DNA, 23 bp, Saccharomyces cerevisiae
caatccaaacaaatggagaatgt

SEQ ID NO: 6087 - DNA, 20 bp, Saccharomyces cerevisiae
ctgtgtgagaatttggccct

SEQ ID NO: 6088 - DNA, 20 bp, Saccharomyces cerevisiae
aacaacctggtcgtgagtga

SEQ ID NO: 6089 - DNA, 20 bp, Saccharomyces cerevisiae
caaggtctatcttagcggcg

SEQ ID NO: 6090 - DNA, 20 bp, Saccharomyces cerevisiae
gggtaaatcgcaccaacact

SEQ ID NO: 6091 - DNA, 20 bp, Saccharomyces cerevisiae
ggttatcaaccggaccaaga

SEQ ID NO: 6092 - DNA, 20 bp, Saccharomyces cerevisiae
gcgatacgaatacccctcaa

SEQ ID NO: 6093 - DNA, 20 bp, Saccharomyces cerevisiae
gggcgctgcacattattatt

SEQ ID NO: 6094 - DNA, 20 bp, Saccharomyces cerevisiae
cctttttccaggactggttg

SEQ ID NO: 6095 - DNA, 20 bp, Saccharomyces cerevisiae
ggccatggaagttcagtgag

SEQ ID NO: 6096 - DNA, 19 bp, Saccharomyces cerevisiae
tagcatagacgcagtcggg

SEQ ID NO: 6097 - DNA, 20 bp, Saccharomyces cerevisiae
cccacgtcgatcttattgaa

SEQ ID NO: 6098 - DNA, 20 bp, Saccharomyces cerevisiae
agtggcttcaggctttgagt

SEQ ID NO: 6099 - DNA, 20 bp, Saccharomyces cerevisiae
caacgggaaatcttgacaca

SEQ ID NO: 6100 - DNA, 20 bp, Saccharomyces cerevisiae
ggcgcctatctcagagaaca

SEQ ID NO: 6101 - DNA, 20 bp, Saccharomyces cerevisiae
acattcaacgaatatccgca

SEQ ID NO: 6102 - DNA, 20 bp, Saccharomyces cerevisiae
tcgtcatttttggcatgtgt

SEQ ID NO: 6103 - DNA, 20 bp, Saccharomyces cerevisiae
tccaattatgcgatgcatgt

SEQ ID NO: 6104 - DNA, 20 bp, Saccharomyces cerevisiae
ttcgaggtcttcaaacgtga

SEQ ID NO: 6105 - DNA, 20 bp, Saccharomyces cerevisiae
tgccaaggaactctgatttg

SEQ ID NO: 6106 - DNA, 20 bp, Saccharomyces cerevisiae
aacgattcttcttgcagcgt

SEQ ID NO: 6107 - DNA, 20 bp, Saccharomyces cerevisiae
tagcgcggtgtagtatgctg

SEQ ID NO: 6108 - DNA, 20 bp, Saccharomyces cerevisiae
atgctcaaatgcatcgttgt

SEQ ID NO: 6109 - DNA, 20 bp, Saccharomyces cerevisiae
tgcagaaaattttggagtcg

SEQ ID NO: 6110 - DNA, 20 bp, Saccharomyces cerevisiae
tgtgtggcatatggattcgt

SEQ ID NO: 6111 - DNA, 20 bp, Saccharomyces cerevisiae
caaccaagacaaccgcacta

SEQ ID NO: 6112 - DNA, 20 bp, Saccharomyces cerevisiae
atttggcccgattagtgtca

SEQ ID NO: 6113 - DNA, 21 bp, Saccharomyces cerevisiae
ttgccggtactaaataccacg

SEQ ID NO: 6114 - DNA, 20 bp, Saccharomyces cerevisiae
tgacataacgctcccgtgta

SEQ ID NO: 6115 - DNA, 21 bp, Saccharomyces cerevisiae
aagctcaaaagacctcagcaa

SEQ ID NO: 6116 - DNA, 21 bp, Saccharomyces cerevisiae
ctgcagttgttaagtcggtga

SEQ ID NO: 6117 - DNA, 20 bp, Saccharomyces cerevisiae
tcagttttcttgccaaagcc

SEQ ID NO: 6118 - DNA, 20 bp, Saccharomyces cerevisiae
atgggacctgtggcacatac

SEQ ID NO: 6119 - DNA, 22 bp, Saccharomyces cerevisiae
ttccatagatttgtacgcaagg

SEQ ID NO: 6120 - DNA, 25 bp, Saccharomyces cerevisiae
ggtaatgaggaattagatgcaaaga

SEQ ID NO: 6121 - DNA, 20 bp, Saccharomyces cerevisiae
gtttaagaattgcgcaggga

SEQ ID NO: 6122 - DNA, 23 bp, Saccharomyces cerevisiae
tcgattatttatccttccgttca

SEQ ID NO: 6123 - DNA, 20 bp, Saccharomyces cerevisiae
actgttccccgctctgtaaa

SEQ ID NO: 6124 - DNA, 20 bp, Saccharomyces cerevisiae
tccacagtgctttctgatcg

SEQ ID NO: 6125 - DNA, 20 bp, Saccharomyces cerevisiae
atttttgagccgtcgtttga

SEQ ID NO: 6126 - DNA, 20 bp, Saccharomyces cerevisiae
gtatggcgagggatcaaaaa

SEQ ID NO: 6127 - DNA, 20 bp, Saccharomyces cerevisiae
tcgattgctgttttgagtgc

SEQ ID NO: 6128 - DNA, 20 bp, Saccharomyces cerevisiae
cttcagaacgcattgaaacg

SEQ ID NO: 6129 - DNA, 20 bp, Saccharomyces cerevisiae
tcagccagttggtttttcaa

SEQ ID NO: 6130 - DNA, 20 bp, Saccharomyces cerevisiae
ttgcccgggttctaacatag

SEQ ID NO: 6131 - DNA, 20 bp, Saccharomyces cerevisiae
cgcaaaagcgtaaaattgaa

SEQ ID NO: 6132 - DNA, 20 bp, Saccharomyces cerevisiae
aagcatgaatcacaatcccc

SEQ ID NO: 6133 - DNA, 20 bp, Saccharomyces cerevisiae
attttcggacgaaatgttgc

SEQ ID NO: 6134 - DNA, 20 bp, Saccharomyces cerevisiae
cgctagagaggagcaattcg

SEQ ID NO: 6135 - DNA, 20 bp, Saccharomyces cerevisiae
tccagctgatgctgaaaaga

SEQ ID NO: 6136 - DNA, 20 bp, Saccharomyces cerevisiae
cgaaaaagttgaaagctggc

SEQ ID NO: 6137 - DNA, 20 bp, Saccharomyces cerevisiae
caaatttgccaccctcgtaa

SEQ ID NO: 6138 - DNA, 21 bp, Saccharomyces cerevisiae
tggagagaaaaggcatgattg

SEQ ID NO: 6139 - DNA, 21 bp, Saccharomyces cerevisiae
tgtatcccaaaatcccatacg

SEQ ID NO: 6140 - DNA, 20 bp, Saccharomyces cerevisiae
ctgagatcgatgcccatttt

SEQ ID NO: 6141 - DNA, 20 bp, Saccharomyces cerevisiae
ccaggccagactgacagaag

SEQ ID NO: 6142 - DNA, 20 bp, Saccharomyces cerevisiae
attgccaagtaagcacccac

SEQ ID NO: 6143 - DNA, 20 bp, Saccharomyces cerevisiae
ttgaaggccgaattggatag

SEQ ID NO: 6144 - DNA, 20 bp, Saccharomyces cerevisiae
tgtgatatggggttgggagt

SEQ ID NO: 6145 - DNA, 21 bp, Saccharomyces cerevisiae
tcgatcatgaaagaggctgtc

SEQ ID NO: 6146 - DNA, 20 bp, Saccharomyces cerevisiae
ccgcccttacctcctatacc

SEQ ID NO: 6147 - DNA, 20 bp, Saccharomyces cerevisiae
gtaccgaattccgacaatgg

SEQ ID NO: 6148 - DNA, 20 bp, Saccharomyces cerevisiae
ccatcttctgcaacgaaaga

SEQ ID NO: 6149 - DNA, 22 bp, Saccharomyces cerevisiae
tgtgtatcaaaccaattcctgc

SEQ ID NO: 6150 - DNA, 20 bp, Saccharomyces cerevisiae
ggcggcattgatattgaatc

SEQ ID NO: 6151 - DNA, 20 bp, Saccharomyces cerevisiae
cagctcaacgctatcttccc

SEQ ID NO: 6152 - DNA, 20 bp, Saccharomyces cerevisiae
ggatcgactagaatctgcgg

SEQ ID NO: 6153 - DNA, 20 bp, Saccharomyces cerevisiae
ccagagttcgttgctgtcaa

SEQ ID NO: 6154 - DNA, 20 bp, Saccharomyces cerevisiae
cgggcgtattacaatccact

SEQ ID NO: 6155 - DNA, 20 bp, Saccharomyces cerevisiae
acgaggaaaaggaggaggac

SEQ ID NO: 6156 - DNA, 20 bp, Saccharomyces cerevisiae
gttgtgttacaaggacggca

SEQ ID NO: 6157 - DNA, 20 bp, Saccharomyces cerevisiae
caaaagtcattgggccagag

SEQ ID NO: 6158 - DNA, 20 bp, Saccharomyces cerevisiae
tctcggttgagatttccgat

SEQ ID NO: 6159 - DNA, 20 bp, Saccharomyces cerevisiae
aaaaatgcaaatgcgaaacc

SEQ ID NO: 6160 - DNA, 20 bp, Saccharomyces cerevisiae
tgtattttgccacgcctttt

SEQ ID NO: 6161 - DNA, 20 bp, Saccharomyces cerevisiae
ctggtgcagccattcttaca

SEQ ID NO: 6162 - DNA, 20 bp, Saccharomyces cerevisiae
atttgcgagcagcgttagat

SEQ ID NO: 6163 - DNA, 20 bp, Saccharomyces cerevisiae
ataagcccctaacacccacc

SEQ ID NO: 6164 - DNA, 20 bp, Saccharomyces cerevisiae
agaaaggcgcatttgatagg

SEQ ID NO: 6165 - DNA, 20 bp, Saccharomyces cerevisiae
agggtagcagatgatggtgg

SEQ ID NO: 6166 - DNA, 20 bp, Saccharomyces cerevisiae
gatcgagaatggcagctctt

SEQ ID NO: 6167 - DNA, 20 bp, Saccharomyces cerevisiae
catgttatcttctggcagcg

SEQ ID NO: 6168 - DNA, 20 bp, Saccharomyces cerevisiae
agtttcgagcaagacacggt

SEQ ID NO: 6169 - DNA, 20 bp, Saccharomyces cerevisiae
ccgtctcttccataaaaggc

SEQ ID NO: 6170 - DNA, 21 bp, Saccharomyces cerevisiae
tctccattttatgccaatcca

SEQ ID NO: 6171 - DNA, 20 bp, Saccharomyces cerevisiae
gaagaatgcacatgaccgtg

SEQ ID NO: 6172 - DNA, 20 bp, Saccharomyces cerevisiae
taagatggttgcgattgctg

SEQ ID NO: 6173 - DNA, 20 bp, Saccharomyces cerevisiae
ccgctgaaaaaggtgtcatt

SEQ ID NO: 6174 - DNA, 20 bp, Saccharomyces cerevisiae
gcttggaacaaccaaggaaa

SEQ ID NO: 6175 - DNA, 20 bp, Saccharomyces cerevisiae
gttatggccattgcaacctt

SEQ ID NO: 6176 - DNA, 20 bp, Saccharomyces cerevisiae
actgactggtgggaatccag

SEQ ID NO: 6177 - DNA, 20 bp, Saccharomyces cerevisiae
tatgttctgtttcgacgcgg

SEQ ID NO: 6178 - DNA, 20 bp, Saccharomyces cerevisiae
aatgggacctgatttgttgc

SEQ ID NO: 6179 - DNA, 21 bp, Saccharomyces cerevisiae
ggctaaacgtaaagccaatga

SEQ ID NO: 6180 - DNA, 20 bp, Saccharomyces cerevisiae
tccacgtccatcattactgc

SEQ ID NO: 6181 - DNA, 20 bp, Saccharomyces cerevisiae
tttttcaacgctggtacgaa

SEQ ID NO: 6182 - DNA, 20 bp, Saccharomyces cerevisiae
tgcaaaatcgtccaagatga

SEQ ID NO: 6183 - DNA, 20 bp, Saccharomyces cerevisiae
gaagaggatttgccgacttg

SEQ ID NO: 6184 - DNA, 20 bp, Saccharomyces cerevisiae
tctgatgcggctaagagaca

SEQ ID NO: 6185 - DNA, 20 bp, Saccharomyces cerevisiae
cgtcagtggggctttctaag

SEQ ID NO: 6186 - DNA, 20 bp, Saccharomyces cerevisiae
caaaatcgggatggtaaacg

SEQ ID NO: 6187 - DNA, 20 bp, Saccharomyces cerevisiae
cgactaggggcattttcaga

SEQ ID NO: 6188 - DNA, 21 bp, Saccharomyces cerevisiae
caagcggctgaataatttctg

SEQ ID NO: 6189 - DNA, 20 bp, Saccharomyces cerevisiae
tagctgacattcggcctttc

SEQ ID NO: 6190 - DNA, 20 bp, Saccharomyces cerevisiae
taccaaatgcgccaatcata

SEQ ID NO: 6191 - DNA, 20 bp, Saccharomyces cerevisiae
ctgtcaaagatccgtctccc

SEQ ID NO: 6192 - DNA, 20 bp, Saccharomyces cerevisiae
tcttcaatgtttgcacgctc

SEQ ID NO: 6193 - DNA, 20 bp, Saccharomyces cerevisiae
tttttcggttttggcataca

SEQ ID NO: 6194 - DNA, 21 bp, Saccharomyces cerevisiae
aattgatgaaaatcccgttcc

SEQ ID NO: 6195 - DNA, 20 bp, Saccharomyces cerevisiae
ccattcagcacttcatcacc

SEQ ID NO: 6196 - DNA, 20 bp, Saccharomyces cerevisiae
cggcggaattaacaactcat

SEQ ID NO: 6197 - DNA, 20 bp, Saccharomyces cerevisiae
tgaacgatatgtcggtggaa

SEQ ID NO: 6198 - DNA, 21 bp, Saccharomyces cerevisiae
tccaaacacgaacaaaaggtc

SEQ ID NO: 6199 - DNA, 20 bp, Saccharomyces cerevisiae
gagaccagcgattacctgga

SEQ ID NO: 6200 - DNA, 24 bp, Saccharomyces cerevisiae
ttgactgctgtagcaacaatagag

SEQ ID NO: 6201 - DNA, 22 bp, Saccharomyces cerevisiae
tggtttagtgtatgttgcgctt

SEQ ID NO: 6202 - DNA, 20 bp, Saccharomyces cerevisiae
aattgcaactggtttttcgg

SEQ ID NO: 6203 - DNA, 20 bp, Saccharomyces cerevisiae
gcttagcatttcgtggcttc

SEQ ID NO: 6204 - DNA, 20 bp, Saccharomyces cerevisiae
gtgcgattgcgttgaatatg

SEQ ID NO: 6205 - DNA, 20 bp, Saccharomyces cerevisiae
gatgctgtggttgacatggt

SEQ ID NO: 6206 - DNA, 20 bp, Saccharomyces cerevisiae
tgacgcccctaatttttgtc

SEQ ID NO: 6207 - DNA, 20 bp, Saccharomyces cerevisiae
gaagtcgctcacggtttctc

SEQ ID NO: 6208 - DNA, 20 bp, Saccharomyces cerevisiae
ggggagcactttgtatttgc

SEQ ID NO: 6209 - DNA, 20 bp, Saccharomyces cerevisiae
cgtaatacgacacccttccg

SEQ ID NO: 6210 - DNA, 20 bp, Saccharomyces cerevisiae
tttggctgattcatttgctg

SEQ ID NO: 6211 - DNA, 20 bp, Saccharomyces cerevisiae
caagcgttgaaatgaaggaa

SEQ ID NO: 6212 - DNA, 20 bp, Saccharomyces cerevisiae
agggccttgtgttttctcaa

SEQ ID NO: 6213 - DNA, 20 bp, Saccharomyces cerevisiae
tgagcattcaggctcacaac

SEQ ID NO: 6214 - DNA, 20 bp, Saccharomyces cerevisiae
atgtgcagaaaggatggctc

SEQ ID NO: 6215 - DNA, 19 bp, Saccharomyces cerevisiae
atttccgggaagagtcacg

SEQ ID NO: 6216 - DNA, 20 bp, Saccharomyces cerevisiae
tacatccttgtcgagccttg

SEQ ID NO: 6217 - DNA, 20 bp, Saccharomyces cerevisiae
gacaccccaacctactccaa

SEQ ID NO: 6218 - DNA, 20 bp, Saccharomyces cerevisiae
tcggcataaacccaaaaagt

SEQ ID NO: 6219 - DNA, 20 bp, Saccharomyces cerevisiae
gacagcacccttgtacagca

SEQ ID NO: 6220 - DNA, 20 bp, Saccharomyces cerevisiae
gatggtgggaagaacaggaa

SEQ ID NO: 6221 - DNA, 20 bp, Saccharomyces cerevisiae
taaggtgggttcgtctttgg

SEQ ID NO: 6222 - DNA, 20 bp, Saccharomyces cerevisiae
tcaagcagaaagccaaacct

SEQ ID NO: 6223 - DNA, 20 bp, Saccharomyces cerevisiae
attaaagcacgaaacgcgaa

SEQ ID NO: 6224 - DNA, 20 bp, Saccharomyces cerevisiae
tgagccccctttcctttatt

SEQ ID NO: 6225 - DNA, 20 bp, Saccharomyces cerevisiae
cttctggtacgggcttcttg

SEQ ID NO: 6226 - DNA, 20 bp, Saccharomyces cerevisiae
aagcggaaatgttgagttgg

SEQ ID NO: 6227 - DNA, 20 bp, Saccharomyces cerevisiae
ggcaaaagagaaatccctca

SEQ ID NO: 6228 - DNA, 20 bp, Saccharomyces cerevisiae
tttttcacttctatcgcgcc

SEQ ID NO: 6229 - DNA, 20 bp, Saccharomyces cerevisiae
gcacgcctacacttttcgtt

SEQ ID NO: 6230 - DNA, 20 bp, Saccharomyces cerevisiae
ggtggtaatttggacatggg

SEQ ID NO: 6231 - DNA, 23 bp, Saccharomyces cerevisiae
tcgtcaagtaaattgattcagca

SEQ ID NO: 6232 - DNA, 20 bp, Saccharomyces cerevisiae
tgttgaagaatgaacagccg

SEQ ID NO: 6233 - DNA, 20 bp, Saccharomyces cerevisiae
gactaatatccctggcccaa

SEQ ID NO: 6234 - DNA, 20 bp, Saccharomyces cerevisiae
aatgattctgccattcaggg

SEQ ID NO: 6235 - DNA, 20 bp, Saccharomyces cerevisiae
aagtgcatcatcatcaagcg

SEQ ID NO: 6236 - DNA, 20 bp, Saccharomyces cerevisiae
cgaaacaaaatgttaacgcc

SEQ ID NO: 6237 - DNA, 20 bp, Saccharomyces cerevisiae
gcgatgccaaagaaaagaag

SEQ ID NO: 6238 - DNA, 20 bp, Saccharomyces cerevisiae
gtaaaccgcggatgtaccaa

SEQ ID NO: 6239 - DNA, 20 bp, Saccharomyces cerevisiae
cccaattcctatcatgggtg

SEQ ID NO: 6240 - DNA, 20 bp, Saccharomyces cerevisiae
gcctcaattcaacaaatggc

SEQ ID NO: 6241 - DNA, 21 bp, Saccharomyces cerevisiae
tttcttaatgcgtgggaaaaa

SEQ ID NO: 6242 - DNA, 20 bp, Saccharomyces cerevisiae
tgttgatgcccaaaaagtca

SEQ ID NO: 6243 - DNA, 20 bp, Saccharomyces cerevisiae
agaaagtggagcaaccgcta

SEQ ID NO: 6244 - DNA, 20 bp, Saccharomyces cerevisiae
accttgagaaacgccatcaa

SEQ ID NO: 6245 - DNA, 20 bp, Saccharomyces cerevisiae
gttcaaaactcgcccaggta

SEQ ID NO: 6246 - DNA, 20 bp, Saccharomyces cerevisiae
tcccttcacctctgtgctct

SEQ ID NO: 6247 - DNA, 21 bp, Saccharomyces cerevisiae
tcgcaattgcaactctactca

SEQ ID NO: 6248 - DNA, 20 bp, Saccharomyces cerevisiae
ccagagattatggcaaagcc

SEQ ID NO: 6249 - DNA, 23 bp, Saccharomyces cerevisiae
ccacatcttcatctgatatggac

SEQ ID NO: 6250 - DNA, 20 bp, Saccharomyces cerevisiae
gtgcgaaagcattgtttgaa

SEQ ID NO: 6251 - DNA, 20 bp, Saccharomyces cerevisiae
cgcaacccagaaattttgat

SEQ ID NO: 6252 - DNA, 20 bp, Saccharomyces cerevisiae
tagttttccccgaactccct

SEQ ID NO: 6253 - DNA, 20 bp, Saccharomyces cerevisiae
acggaggaattcactgatgc

SEQ ID NO: 6254 - DNA, 22 bp, Saccharomyces cerevisiae
aaaatctttgcatttgtcatcc

SEQ ID NO: 6255 - DNA, 20 bp, Saccharomyces cerevisiae
cacagattaaagggctggga

SEQ ID NO: 6256 - DNA, 20 bp, Saccharomyces cerevisiae
aaagggaacattgcgatgag

SEQ ID NO: 6257 - DNA, 20 bp, Saccharomyces cerevisiae
ttagctggtgggctatcagg

SEQ ID NO: 6258 - DNA, 20 bp, Saccharomyces cerevisiae
ctgcttgacttcttttgcga

SEQ ID NO: 6259 - DNA, 20 bp, Saccharomyces cerevisiae
taaactgccaatcacttgcg

SEQ ID NO: 6260 - DNA, 20 bp, Saccharomyces cerevisiae
ccggttcagcaagagaaaag

SEQ ID NO: 6261 - DNA, 20 bp, Saccharomyces cerevisiae
aaccgcgtagaagttccctt

SEQ ID NO: 6262 - DNA, 20 bp, Saccharomyces cerevisiae
gaaagattttcccattgccc

SEQ ID NO: 6263 - DNA, 20 bp, Saccharomyces cerevisiae
gggtaatggcaaatctgctt

SEQ ID NO: 6264 - DNA, 20 bp, Saccharomyces cerevisiae
taaagtgctctggccgattt

SEQ ID NO: 6265 - DNA, 20 bp, Saccharomyces cerevisiae
aacccctcaaattgcagaaa

SEQ ID NO: 6266 - DNA, 25 bp, Saccharomyces cerevisiae
tcaggcatttatacgtttggttagt

SEQ ID NO: 6267 - DNA, 20 bp, Saccharomyces cerevisiae
tccatggatacggaagcatt

SEQ ID NO: 6268 - DNA, 20 bp, Saccharomyces cerevisiae
catggatgtcgacgagaaaa

SEQ ID NO: 6269 - DNA, 20 bp, Saccharomyces cerevisiae
ttgccactttgccaattaga

SEQ ID NO: 6270 - DNA, 20 bp, Saccharomyces cerevisiae
acattcgcactcccattagc

SEQ ID NO: 6271 - DNA, 20 bp, Saccharomyces cerevisiae
accttttcatccggcaatta

SEQ ID NO: 6272 - DNA, 20 bp, Saccharomyces cerevisiae
gggatgcagatatggaggaa

SEQ ID NO: 6273 - DNA, 20 bp, Saccharomyces cerevisiae
agcaggaaatcgtgttgctt

SEQ ID NO: 6274 - DNA, 20 bp, Saccharomyces cerevisiae
tttcgattgccttaacgctt

SEQ ID NO: 6275 - DNA, 20 bp, Saccharomyces cerevisiae
agatttccatgtggctgagg

SEQ ID NO: 6276 - DNA, 20 bp, Saccharomyces cerevisiae
aaactctgctgatgggttcg

SEQ ID NO: 6277 - DNA, 20 bp, Saccharomyces cerevisiae
gggcaagagaacacctttca

SEQ ID NO: 6278 - DNA, 20 bp, Saccharomyces cerevisiae
gtagaggttgaaacgcgagg

SEQ ID NO: 6279 - DNA, 20 bp, Saccharomyces cerevisiae
aacgccgttctagggtttct

SEQ ID NO: 6280 - DNA, 20 bp, Saccharomyces cerevisiae
ccgatggtaatggcattttg

SEQ ID NO: 6281 - DNA, 20 bp, Saccharomyces cerevisiae
ttcgtcaaatctcaacgcag

SEQ ID NO: 6282 - DNA, 20 bp, Saccharomyces cerevisiae
gcaccggctcttgtttagtt

SEQ ID NO: 6283 - DNA, 20 bp, Saccharomyces cerevisiae
tgcgaatcatttgaatccat

SEQ ID NO: 6284 - DNA, 20 bp, Saccharomyces cerevisiae
tacggaaagctagggacgag

SEQ ID NO: 6285 - DNA, 20 bp, Saccharomyces cerevisiae
tcggtgaacaaggtaagcct

SEQ ID NO: 6286 - DNA, 21 bp, Saccharomyces cerevisiae
gacggaccctgtgactaaaaa

SEQ ID NO: 6287 - DNA, 20 bp, Saccharomyces cerevisiae
catttccaccttcctttccc

SEQ ID NO: 6288 - DNA, 20 bp, Saccharomyces cerevisiae
atcgcagcagtgattcaaca

SEQ ID NO: 6289 - DNA, 20 bp, Saccharomyces cerevisiae
aattggcaccatctccactc

SEQ ID NO: 6290 - DNA, 20 bp, Saccharomyces cerevisiae
taattagcggggatcaggtg

SEQ ID NO: 6291 - DNA, 20 bp, Saccharomyces cerevisiae
tccttgaaattgacggttcc

SEQ ID NO: 6292 - DNA, 20 bp, Saccharomyces cerevisiae
gttctcggtggcattgagtt

SEQ ID NO: 6293 - DNA, 20 bp, Saccharomyces cerevisiae
attgccatcgcttaatttgc

SEQ ID NO: 6294 - DNA, 20 bp, Saccharomyces cerevisiae
acccctccacgtatacaacg

SEQ ID NO: 6295 - DNA, 20 bp, Saccharomyces cerevisiae
agcgagctggtattctccaa

SEQ ID NO: 6296 - DNA, 20 bp, Saccharomyces cerevisiae
cgcaacactgcaaaacttgt

SEQ ID NO: 6297 - DNA, 20 bp, Saccharomyces cerevisiae
tgccagaagttccacaacac

SEQ ID NO: 6298 - DNA, 23 bp, Saccharomyces cerevisiae
tgtggtatcattttctacagcca

SEQ ID NO: 6299 - DNA, 20 bp, Saccharomyces cerevisiae
gcaacctgacatgcaacagt

SEQ ID NO: 6300 - DNA, 25 bp, Saccharomyces cerevisiae
tttttgttaatccaacacaattgaa

SEQ ID NO: 6301 - DNA, 20 bp, Saccharomyces cerevisiae
caaacggagaggaagcagtc

SEQ ID NO: 6302 - DNA, 20 bp, Saccharomyces cerevisiae
atgtcaccttcctatgccgt

SEQ ID NO: 6303 - DNA, 20 bp, Saccharomyces cerevisiae
tcgtggaaaggcaagagatt

SEQ ID NO: 6304 - DNA, 20 bp, Saccharomyces cerevisiae
ggtagctgttgcgagcgtat

SEQ ID NO: 6305 - DNA, 20 bp, Saccharomyces cerevisiae
tcacccaaagtccattgtga

SEQ ID NO: 6306 - DNA, 20 bp, Saccharomyces cerevisiae
gttgcccacacctacgagtt

SEQ ID NO: 6307 - DNA, 26 bp, Saccharomyces cerevisiae
gacaaaagtgaggatatcaacagaga

SEQ ID NO: 6308 - DNA, 20 bp, Saccharomyces cerevisiae
tcaccatctgattcgtcacc

SEQ ID NO: 6309 - DNA, 20 bp, Saccharomyces cerevisiae
tgacccgtctgcaacagata

SEQ ID NO: 6310 - DNA, 20 bp, Saccharomyces cerevisiae
gctcgggctttttgtgataa

SEQ ID NO: 6311 - DNA, 20 bp, Saccharomyces cerevisiae
aaactgttttgccggacttg

SEQ ID NO: 6312 - DNA, 20 bp, Saccharomyces cerevisiae
gccgggtgtcattcttctaa

SEQ ID NO: 6313 - DNA, 20 bp, Saccharomyces cerevisiae
gacaaaccgtggtacaaggc

SEQ ID NO: 6314 - DNA, 20 bp, Saccharomyces cerevisiae
gcaatggaggatgaaaatgg

SEQ ID NO: 6315 - DNA, 20 bp, Saccharomyces cerevisiae
tttctgtgaaaattggtgcg

SEQ ID NO: 6316 - DNA, 20 bp, Saccharomyces cerevisiae
tccattggccccaagtatag

SEQ ID NO: 6317 - DNA, 20 bp, Saccharomyces cerevisiae
gcaaccttgtttcttctggc

SEQ ID NO: 6318 - DNA, 20 bp, Saccharomyces cerevisiae
tctcggtttcacagaaagca

SEQ ID NO: 6319 - DNA, 20 bp, Saccharomyces cerevisiae
gcaggtgtgttttcagacga

SEQ ID NO: 6320 - DNA, 20 bp, Saccharomyces cerevisiae
cggtaactcgtgtgctctca

SEQ ID NO: 6321 - DNA, 20 bp, Saccharomyces cerevisiae
gggctgaaaccatcaagaaa

SEQ ID NO: 6322 - DNA, 20 bp, Saccharomyces cerevisiae
cagggactcaaaaatcccaa

SEQ ID NO: 6323 - DNA, 20 bp, Saccharomyces cerevisiae
gttttcgacgattggctcat

SEQ ID NO: 6324 - DNA, 20 bp, Saccharomyces cerevisiae
ataccccgagcattatgcag

SEQ ID NO: 6325 - DNA, 20 bp, Saccharomyces cerevisiae
cggtgaatcattccggtaac

SEQ ID NO: 6326 - DNA, 20 bp, Saccharomyces cerevisiae
gatccgtgtcccattgaatc

SEQ ID NO: 6327 - DNA, 20 bp, Saccharomyces cerevisiae
gcctcatcattgaaaaggga

SEQ ID NO: 6328 - DNA, 20 bp, Saccharomyces cerevisiae
aatcgatgaattctttgcgg

SEQ ID NO: 6329 - DNA, 20 bp, Saccharomyces cerevisiae
gcagatgaaggaaaagctgg

SEQ ID NO: 6330 - DNA, 22 bp, Saccharomyces cerevisiae
cgtggcagtagttcttgaaatg

SEQ ID NO: 6331 - DNA, 20 bp, Saccharomyces cerevisiae
agaggagaagcatccaacga

SEQ ID NO: 6332 - DNA, 20 bp, Saccharomyces cerevisiae
ggtctcctctgcttctgctg

SEQ ID NO: 6333 - DNA, 20 bp, Saccharomyces cerevisiae
ccgcctaatgacacatgaag

SEQ ID NO: 6334 - DNA, 20 bp, Saccharomyces cerevisiae
gcgaatttggagaaccttca

SEQ ID NO: 6335 - DNA, 20 bp, Saccharomyces cerevisiae
tcgccaaagtagcattttcc

SEQ ID NO: 6336 - DNA, 20 bp, Saccharomyces cerevisiae
attactctgccaacgccaag

SEQ ID NO: 6337 - DNA, 21 bp, Saccharomyces cerevisiae
tctcgttccaacatattgcct

SEQ ID NO: 6338 - DNA, 23 bp, Saccharomyces cerevisiae
tcacaccaagtaattcaacctga

SEQ ID NO: 6339 - DNA, 20 bp, Saccharomyces cerevisiae
tacgggtccttttgttttcg

SEQ ID NO: 6340 - DNA, 20 bp, Saccharomyces cerevisiae
tcggacttgccttcctagtt

SEQ ID NO: 6341 - DNA, 20 bp, Saccharomyces cerevisiae
gcctgcgagtaaatcgtttc

SEQ ID NO: 6342 - DNA, 20 bp, Saccharomyces cerevisiae
tttaaccctcgtccaaaacg

SEQ ID NO: 6343 - DNA, 20 bp, Saccharomyces cerevisiae
ctttttaaacgttgtggccc

SEQ ID NO: 6344 - DNA, 20 bp, Saccharomyces cerevisiae
actctagttatccggggcgt

SEQ ID NO: 6345 - DNA, 20 bp, Saccharomyces cerevisiae
ggccatttggaaacttctga

SEQ ID NO: 6346 - DNA, 21 bp, Saccharomyces cerevisiae
cattatggctgctgactgtga

SEQ ID NO: 6347 - DNA, 21 bp, Saccharomyces cerevisiae
tccctctctctttcaacctca

SEQ ID NO: 6348 - DNA, 20 bp, Saccharomyces cerevisiae
gcttcctcagaagcatccat

SEQ ID NO: 6349 - DNA, 20 bp, Saccharomyces cerevisiae
atttccggtcctgcttctct

SEQ ID NO: 6350 - DNA, 20 bp, Saccharomyces cerevisiae
ttcaaaagtttcaccagcca

SEQ ID NO: 6351 - DNA, 20 bp, Saccharomyces cerevisiae
tgactccgtaactcgcactg

SEQ ID NO: 6352 - DNA, 20 bp, Saccharomyces cerevisiae
attcccggatcaaatgagtg

SEQ ID NO: 6353 - DNA, 20 bp, Saccharomyces cerevisiae
caacgtcgaatccaaattga

SEQ ID NO: 6354 - DNA, 20 bp, Saccharomyces cerevisiae
agggtactatcaggtggggg

SEQ ID NO: 6355 - DNA, 20 bp, Saccharomyces cerevisiae
aaccaaaagcgggaagaagt

SEQ ID NO: 6356 - DNA, 20 bp, Saccharomyces cerevisiae
actgaaacggaacttgtggg

SEQ ID NO: 6357 - DNA, 20 bp, Saccharomyces cerevisiae
gatttcggtttgttgccatt

SEQ ID NO: 6358 - DNA, 20 bp, Saccharomyces cerevisiae
gtccatgacgctcccaatag

SEQ ID NO: 6359 - DNA, 25 bp, Saccharomyces cerevisiae
tttcaacggaagattcataagtagc

SEQ ID NO: 6360 - DNA, 20 bp, Saccharomyces cerevisiae
tcagcgacgaagaagaaggt

SEQ ID NO: 6361 - DNA, 20 bp, Saccharomyces cerevisiae
gcatcaaacccagcagaaat

SEQ ID NO: 6362 - DNA, 20 bp, Saccharomyces cerevisiae
gtgatcgacgtaccatgacg

SEQ ID NO: 6363 - DNA, 20 bp, Saccharomyces cerevisiae
actttcggcggttttctctt

SEQ ID NO: 6364 - DNA, 20 bp, Saccharomyces cerevisiae
cgctggatttgctattggtt

SEQ ID NO: 6365 - DNA, 20 bp, Saccharomyces cerevisiae
cagcctggtattacgggaaa

SEQ ID NO: 6366 - DNA, 20 bp, Saccharomyces cerevisiae
aacatcaacatgagggcaca

SEQ ID NO: 6367 - DNA, 20 bp, Saccharomyces cerevisiae
actaccaacttgcgtcagca

SEQ ID NO: 6368 - DNA, 20 bp, Saccharomyces cerevisiae
ttgcaaagactgcgctaatg

SEQ ID NO: 6369 - DNA, 20 bp, Saccharomyces cerevisiae
ggatgtccttttccgtggta

SEQ ID NO: 6370 - DNA, 20 bp, Saccharomyces cerevisiae
cggcactatttgattcagca

SEQ ID NO: 6371 - DNA, 20 bp, Saccharomyces cerevisiae
ttcccttatgaacacgcaca

SEQ ID NO: 6372 - DNA, 20 bp, Saccharomyces cerevisiae
gtaacggcacgttgggtaat

SEQ ID NO: 6373 - DNA, 20 bp, Saccharomyces cerevisiae
gtttgatgataaccggtgcc

SEQ ID NO: 6374 - DNA, 20 bp, Saccharomyces cerevisiae
ggaaatcaagaaattcgcca

SEQ ID NO: 6375 - DNA, 21 bp, Saccharomyces cerevisiae
tgcttctcactgtcattgtcg

SEQ ID NO: 6376 - DNA, 20 bp, Saccharomyces cerevisiae
cacgatgcgtgcaattaaga

SEQ ID NO: 6377 - DNA, 20 bp, Saccharomyces cerevisiae
gatgcgttgacgctaatgaa

SEQ ID NO: 6378 - DNA, 20 bp, Saccharomyces cerevisiae
ggcacctctcacctgcatac

SEQ ID NO: 6379 - DNA, 20 bp, Saccharomyces cerevisiae
tggagaaggaggacatttcg

SEQ ID NO: 6380 - DNA, 20 bp, Saccharomyces cerevisiae
actccaagcgctgaagaaaa

SEQ ID NO: 6381 - DNA, 20 bp, Saccharomyces cerevisiae
gcagatgcaaacaaaaagca

SEQ ID NO: 6382 - DNA, 20 bp, Saccharomyces cerevisiae
gaagctccaatcccgaatta

SEQ ID NO: 6383 - DNA, 20 bp, Saccharomyces cerevisiae
ccggatcttgtaaatttcgc

SEQ ID NO: 6384 - DNA, 20 bp, Saccharomyces cerevisiae
cgccagaaacgaaaacagtg

SEQ ID NO: 6385 - DNA, 21 bp, Saccharomyces cerevisiae
ggttgagtgtaccagaggcaa

SEQ ID NO: 6386 - DNA, 20 bp, Saccharomyces cerevisiae
ataccagaaccgcctttgaa

SEQ ID NO: 6387 - DNA, 21 bp, Saccharomyces cerevisiae
ttatgcgagtatcttgcgctt

SEQ ID NO: 6388 - DNA, 20 bp, Saccharomyces cerevisiae
acagaattccaaaggcagga

SEQ ID NO: 6389 - DNA, 20 bp, Saccharomyces cerevisiae
tatggaggcaccaaaaggag

SEQ ID NO: 6390 - DNA, 21 bp, Saccharomyces cerevisiae
ggaagatgcaatggagaacaa

SEQ ID NO: 6391 - DNA, 20 bp, Saccharomyces cerevisiae
atactgggcaataaggcgtg

SEQ ID NO: 6392 - DNA, 20 bp, Saccharomyces cerevisiae
ccctggtttattgtcgatgg

SEQ ID NO: 6393 - DNA, 20 bp, Saccharomyces cerevisiae
cgccatcaaacctggtactt

SEQ ID NO: 6394 - DNA, 20 bp, Saccharomyces cerevisiae
ggtggaagggttcagtgaga

SEQ ID NO: 6395 - DNA, 22 bp, Saccharomyces cerevisiae
tctggaaattcttcacgattct

SEQ ID NO: 6396 - DNA, 20 bp, Saccharomyces cerevisiae
gccttgtttgttgagccatt

SEQ ID NO: 6397 - DNA, 20 bp, Saccharomyces cerevisiae
ctaaagaaggcactgctggg

SEQ ID NO: 6398 - DNA, 20 bp, Saccharomyces cerevisiae
cctggaagctccacatcatt

SEQ ID NO: 6399 - DNA, 20 bp, Saccharomyces cerevisiae
ggtttcgttcgagaaaggac

SEQ ID NO: 6400 - DNA, 25 bp, Saccharomyces cerevisiae
aaacctggcttattagaacagacaa

SEQ ID NO: 6401 - DNA, 20 bp, Saccharomyces cerevisiae
cgacgtcgacgaataaaaag

SEQ ID NO: 6402 - DNA, 20 bp, Saccharomyces cerevisiae
ctggctaatcccactggaac

SEQ ID NO: 6403 - DNA, 20 bp, Saccharomyces cerevisiae
gcacacacaattcctccctt

SEQ ID NO: 6404 - DNA, 20 bp, Saccharomyces cerevisiae
ctgaggggtttttggtcctt

SEQ ID NO: 6405 - DNA, 20 bp, Saccharomyces cerevisiae
ccatgacgaagatcatgctg

SEQ ID NO: 6406 - DNA, 21 bp, Saccharomyces cerevisiae
tcccgttaatgaaaatgcttg

SEQ ID NO: 6407 - DNA, 20 bp, Saccharomyces cerevisiae
gtcgaaattatgccacgctt

SEQ ID NO: 6408 - DNA, 20 bp, Saccharomyces cerevisiae
ttcaacaaactttccggtcc

SEQ ID NO: 6409 - DNA, 20 bp, Saccharomyces cerevisiae
ccaacgccgtatactaaccg

SEQ ID NO: 6410 - DNA, 20 bp, Saccharomyces cerevisiae
tctgttgcttctcggctaca

SEQ ID NO: 6411 - DNA, 20 bp, Saccharomyces cerevisiae
taggctaggcaggcgataaa

SEQ ID NO: 6412 - DNA, 20 bp, Saccharomyces cerevisiae
aggtccgatggaactcaatg

SEQ ID NO: 6413 - DNA, 20 bp, Saccharomyces cerevisiae
tttgcagatcggtattgtcg

SEQ ID NO: 6414 - DNA, 20 bp, Saccharomyces cerevisiae
ttcatgctttaggtcagcct

SEQ ID NO: 6415 - DNA, 20 bp, Saccharomyces cerevisiae
ctttgtcgaattttggggtc

SEQ ID NO: 6416 - DNA, 20 bp, Saccharomyces cerevisiae
aaattttggattccgatggc

SEQ ID NO: 6417 - DNA, 20 bp, Saccharomyces cerevisiae
tgatgcacgtgaaaaaccat

SEQ ID NO: 6418 - DNA, 20 bp, Saccharomyces cerevisiae
aactttgcgatgcaggctat

SEQ ID NO: 6419 - DNA, 20 bp, Saccharomyces cerevisiae
actcagatttttcggctgct

SEQ ID NO: 6420 - DNA, 20 bp, Saccharomyces cerevisiae
acgacaacaacaaccattgc

SEQ ID NO: 6421 - DNA, 20 bp, Saccharomyces cerevisiae
tcagactggattcagggtcc

SEQ ID NO: 6422 - DNA, 20 bp, Saccharomyces cerevisiae
tcaacgatccagcctacctc

SEQ ID NO: 6423 - DNA, 20 bp, Saccharomyces cerevisiae
agaatacgagcgtccttcca

SEQ ID NO: 6424 - DNA, 20 bp, Saccharomyces cerevisiae
gcagcgaatcacatcaccta

SEQ ID NO: 6425 - DNA, 20 bp, Saccharomyces cerevisiae
tgggtatgagctgttggaaa

SEQ ID NO: 6426 - DNA, 20 bp, Saccharomyces cerevisiae
tcgagattggtcatccactg

SEQ ID NO: 6427 - DNA, 21 bp, Saccharomyces cerevisiae
aaatcgtttttgcttggaaag

SEQ ID NO: 6428 - DNA, 20 bp, Saccharomyces cerevisiae
cacaaaacgatgccaacaaa

SEQ ID NO: 6429 - DNA, 20 bp, Saccharomyces cerevisiae
tgttcttctcgtatttgggg

SEQ ID NO: 6430 - DNA, 20 bp, Saccharomyces cerevisiae
gtctaaagggagggaaaccg

SEQ ID NO: 6431 - DNA, 20 bp, Saccharomyces cerevisiae
atggatttggagtcacaggc

SEQ ID NO: 6432 - DNA, 20 bp, Saccharomyces cerevisiae
agaccccaagaaagagggaa

SEQ ID NO: 6433 - DNA, 20 bp, Saccharomyces cerevisiae
gagaaccctggaatgaacca

SEQ ID NO: 6434 - DNA, 20 bp, Saccharomyces cerevisiae
tgtgtggaagcagtggtgat

SEQ ID NO: 6435 - DNA, 20 bp, Saccharomyces cerevisiae
tacgtttgcaacagcaggac

SEQ ID NO: 6436 - DNA, 21 bp, Saccharomyces cerevisiae
tccaataaagcttttccacca

SEQ ID NO: 6437 - DNA, 20 bp, Saccharomyces cerevisiae
accgctttgttcacgttctt

SEQ ID NO: 6438 - DNA, 20 bp, Saccharomyces cerevisiae
tgttcgaggacccaataagg

SEQ ID NO: 6439 - DNA, 20 bp, Saccharomyces cerevisiae
caaggtcaagctgcatgaga

SEQ ID NO: 6440 - DNA, 20 bp, Saccharomyces cerevisiae
atggctctattggggaggat

SEQ ID NO: 6441 - DNA, 20 bp, Saccharomyces cerevisiae
acctgttgttgttgctgctg

SEQ ID NO: 6442 - DNA, 20 bp, Saccharomyces cerevisiae
ctctcgaaaataggcgcaac

SEQ ID NO: 6443 - DNA, 20 bp, Saccharomyces cerevisiae
ctcctatcagcctggaaacg

SEQ ID NO: 6444 - DNA, 20 bp, Saccharomyces cerevisiae
tagatgcacccacctcactg

SEQ ID NO: 6445 - DNA, 20 bp, Saccharomyces cerevisiae
cctgaaaatgctcccagaaa

SEQ ID NO: 6446 - DNA, 20 bp, Saccharomyces cerevisiae
aaaaagcaactcctggatcg

SEQ ID NO: 6447 - DNA, 20 bp, Saccharomyces cerevisiae
tgcagagatgtgcggaatag

SEQ ID NO: 6448 - DNA, 21 bp, Saccharomyces cerevisiae
cagaggaatgatcaagcagga

SEQ ID NO: 6449 - DNA, 20 bp, Saccharomyces cerevisiae
tttccctgttgaaatgagcc

SEQ ID NO: 6450 - DNA, 25 bp, Saccharomyces cerevisiae
ttttgacaatcacaaagaagaaaaa

SEQ ID NO: 6451 - DNA, 20 bp, Saccharomyces cerevisiae
agaaaagttgccaatgacgg

SEQ ID NO: 6452 - DNA, 20 bp, Saccharomyces cerevisiae
ttccatgcggtttttatggt

SEQ ID NO: 6453 - DNA, 20 bp, Saccharomyces cerevisiae
tgtgctgagaaaggatggag

SEQ ID NO: 6454 - DNA, 20 bp, Saccharomyces cerevisiae
attggccactgttgatttgg

SEQ ID NO: 6455 - DNA, 20 bp, Saccharomyces cerevisiae
cccaaacaacatcccaaact

SEQ ID NO: 6456 - DNA, 20 bp, Saccharomyces cerevisiae
gtatggcggggtaatgtgtc

SEQ ID NO: 6457 - DNA, 20 bp, Saccharomyces cerevisiae
actacggctacggacaatgc

SEQ ID NO: 6458 - DNA, 20 bp, Saccharomyces cerevisiae
cacgcacacatacacgagag

SEQ ID NO: 6459 - DNA, 20 bp, Saccharomyces cerevisiae
cgattctgatgaaacgcact

SEQ ID NO: 6460 - DNA, 20 bp, Saccharomyces cerevisiae
aagcggcacttggaaactta

SEQ ID NO: 6461 - DNA, 20 bp, Saccharomyces cerevisiae
taggatttgacgcccttacg

SEQ ID NO: 6462 - DNA, 20 bp, Saccharomyces cerevisiae
gcatcttgcttttccgaatg

SEQ ID NO: 6463 - DNA, 20 bp, Saccharomyces cerevisiae
tgcgagtgcaaatggtaaag

SEQ ID NO: 6464 - DNA, 20 bp, Saccharomyces cerevisiae
tcgctcgaagggtagtgaat

SEQ ID NO: 6465 - DNA, 20 bp, Saccharomyces cerevisiae
atcgcaaagccaacagaact

SEQ ID NO: 6466 - DNA, 20 bp, Saccharomyces cerevisiae
aagacgaggagcaaccagaa

SEQ ID NO: 6467 - DNA, 20 bp, Saccharomyces cerevisiae
cttgaagggacctgtccaaa

SEQ ID NO: 6468 - DNA, 20 bp, Saccharomyces cerevisiae
ccaaccagaagcgtctaagc

SEQ ID NO: 6469 - DNA, 20 bp, Saccharomyces cerevisiae
ttccggttcctacttccctt

SEQ ID NO: 6470 - DNA, 20 bp, Saccharomyces cerevisiae
ctcaggaagggaaattcggt

SEQ ID NO: 6471 - DNA, 20 bp, Saccharomyces cerevisiae
actgcgagaaatacgcaacc

SEQ ID NO: 6472 - DNA, 20 bp, Saccharomyces cerevisiae
tgatgcagaattgtggtggt

SEQ ID NO: 6473 - DNA, 20 bp, Saccharomyces cerevisiae
cccattatctccaacacgct

SEQ ID NO: 6474 - DNA, 20 bp, Saccharomyces cerevisiae
atgcatacataacgcagcga

SEQ ID NO: 6475 - DNA, 20 bp, Saccharomyces cerevisiae
atcagggattccaccctctt

SEQ ID NO: 6476 - DNA, 20 bp, Saccharomyces cerevisiae
cttagtgcattaggcccacg

SEQ ID NO: 6477 - DNA, 21 bp, Saccharomyces cerevisiae
tgcaaagacttcatcgatttg

SEQ ID NO: 6478 - DNA, 20 bp, Saccharomyces cerevisiae
caccgtagaacccaaagcat

SEQ ID NO: 6479 - DNA, 20 bp, Saccharomyces cerevisiae
tattgaacatgttgcccgtg

SEQ ID NO: 6480 - DNA, 20 bp, Saccharomyces cerevisiae
gtgcagcgtgcatctacttc

SEQ ID NO: 6481 - DNA, 20 bp, Saccharomyces cerevisiae
cgccaaagtttccagaatgt

SEQ ID NO: 6482 - DNA, 21 bp, Saccharomyces cerevisiae
gggttcccttcttagttgggt

SEQ ID NO: 6483 - DNA, 21 bp, Saccharomyces cerevisiae
ggatggtaataacggtggtga

SEQ ID NO: 6484 - DNA, 20 bp, Saccharomyces cerevisiae
ttttcactgcgaagcacatc

SEQ ID NO: 6485 - DNA, 20 bp, Saccharomyces cerevisiae
tgtccgggtacaattggttt

SEQ ID NO: 6486 - DNA, 20 bp, Saccharomyces cerevisiae
ataaatttaggcgcaaagcg

SEQ ID NO: 6487 - DNA, 20 bp, Saccharomyces cerevisiae
gatgacggcagtaataccca

SEQ ID NO: 6488 - DNA, 20 bp, Saccharomyces cerevisiae
gtaactcgcactgccctgat

SEQ ID NO: 6489 - DNA, 21 bp, Saccharomyces cerevisiae
cctttctcttcttgtctgcga

SEQ ID NO: 6490 - DNA, 20 bp, Saccharomyces cerevisiae
ccacaaaccggtatgctctt

SEQ ID NO: 6491 - DNA, 20 bp, Saccharomyces cerevisiae
gaagccaggcaagagacagt

SEQ ID NO: 6492 - DNA, 20 bp, Saccharomyces cerevisiae
ttctcaatgcgacgtggtag

SEQ ID NO: 6493 - DNA, 20 bp, Saccharomyces cerevisiae
tagacctccagaggctgcac

SEQ ID NO: 6494 - DNA, 20 bp, Saccharomyces cerevisiae
tgtgccatgaagtagggatg

SEQ ID NO: 6495 - DNA, 20 bp, Saccharomyces cerevisiae
cgcgataatttgacccagtt

SEQ ID NO: 6496 - DNA, 20 bp, Saccharomyces cerevisiae
aatcaaacaaaatttgccgc

SEQ ID NO: 6497 - DNA, 20 bp, Saccharomyces cerevisiae
cgccagtgcaaagtgtagaa

SEQ ID NO: 6498 - DNA, 20 bp, Saccharomyces cerevisiae
gaagcgcatgacaagttgaa

SEQ ID NO: 6499 - DNA, 20 bp, Saccharomyces cerevisiae
gctatggcaaaatcccaaaa

SEQ ID NO: 6500 - DNA, 20 bp, Saccharomyces cerevisiae
agcttcttgacgttggcaat

SEQ ID NO: 6501 - DNA, 20 bp, Saccharomyces cerevisiae
atctggatgtcaggagccac

SEQ ID NO: 6502 - DNA, 20 bp, Saccharomyces cerevisiae
tcaaaaacgagaaatgggct

SEQ ID NO: 6503 - DNA, 20 bp, Saccharomyces cerevisiae
ccccgttcaaaagtgagtgt

SEQ ID NO: 6504 - DNA, 22 bp, Saccharomyces cerevisiae
cctcctggtgttatttagtccg

SEQ ID NO: 6505 - DNA, 20 bp, Saccharomyces cerevisiae
ttgcctgatcatttttcgtg

SEQ ID NO: 6506 - DNA, 20 bp, Saccharomyces cerevisiae
tgaacatggtgctacgttgg

SEQ ID NO: 6507 - DNA, 20 bp, Saccharomyces cerevisiae
gcgagacctgcataaggcta

SEQ ID NO: 6508 - DNA, 20 bp, Saccharomyces cerevisiae
aagggaattctttgatcccg

SEQ ID NO: 6509 - DNA, 20 bp, Saccharomyces cerevisiae
tgatgcgctattgcattgtt

SEQ ID NO: 6510 - DNA, 20 bp, Saccharomyces cerevisiae
tttgttccctcaaaagaccg

SEQ ID NO: 6511 - DNA, 24 bp, Saccharomyces cerevisiae
caaaactaaacacgtaaatggtgc

SEQ ID NO: 6512 - DNA, 21 bp, Saccharomyces cerevisiae
aagggatatggggaatgaaaa

SEQ ID NO: 6513 - DNA, 20 bp, Saccharomyces cerevisiae
tgaatccactcgcatctttg

SEQ ID NO: 6514 - DNA, 20 bp, Saccharomyces cerevisiae
gccaacgcctacaacagatt

SEQ ID NO: 6515 - DNA, 20 bp, Saccharomyces cerevisiae
gaacccattttcataggcca

SEQ ID NO: 6516 - DNA, 25 bp, Saccharomyces cerevisiae
ctacgatgaaatcaagaaggttgtc

SEQ ID NO: 6517 - DNA, 20 bp, Saccharomyces cerevisiae
ggcgattcatctggttcatt

SEQ ID NO: 6518 - DNA, 20 bp, Saccharomyces cerevisiae
tttcttccgtggcaataacc

SEQ ID NO: 6519 - DNA, 20 bp, Saccharomyces cerevisiae
aaggaatgcaattacgtcgc

SEQ ID NO: 6520 - DNA, 20 bp, Saccharomyces cerevisiae
gcaaccgcaattttatcgtt

SEQ ID NO: 6521 - DNA, 20 bp, Saccharomyces cerevisiae
tcagtctaccatcgtgccag

SEQ ID NO: 6522 - DNA, 20 bp, Saccharomyces cerevisiae
ggctcgaaaaagacgaaaaa

SEQ ID NO: 6523 - DNA, 21 bp, Saccharomyces cerevisiae
agaagtggtggaagatggtga

SEQ ID NO: 6524 - DNA, 20 bp, Saccharomyces cerevisiae
tggatcttcaccccgataag

SEQ ID NO: 6525 - DNA, 23 bp, Saccharomyces cerevisiae
catccaatgttttcgtaaagtca

SEQ ID NO: 6526 - DNA, 20 bp, Saccharomyces cerevisiae
gaaatggcccaagaaattga

SEQ ID NO: 6527 - DNA, 20 bp, Saccharomyces cerevisiae
ccatctttgaaagctttggc

SEQ ID NO: 6528 - DNA, 20 bp, Saccharomyces cerevisiae
ccaacaccttcacctccact

SEQ ID NO: 6529 - DNA, 20 bp, Saccharomyces cerevisiae
agagccggctgttagacaaa

SEQ ID NO: 6530 - DNA, 20 bp, Saccharomyces cerevisiae
tgccaaagccatctagaaca

SEQ ID NO: 6531 - DNA, 20 bp, Saccharomyces cerevisiae
aaaatcgtctccagactccg

SEQ ID NO: 6532 - DNA, 20 bp, Saccharomyces cerevisiae
ctccatgtacaaaccaccga

SEQ ID NO: 6533 - DNA, 20 bp, Saccharomyces cerevisiae
ggtcacctgagtgtccgttt

SEQ ID NO: 6534 - DNA, 20 bp, Saccharomyces cerevisiae
cgcttcgcttctacaaatca

SEQ ID NO: 6535 - DNA, 25 bp, Saccharomyces cerevisiae
tttcacatgaccatattatattcgc

SEQ ID NO: 6536 - DNA, 20 bp, Saccharomyces cerevisiae
aatgcctgcagaagagttgg

SEQ ID NO: 6537 - DNA, 20 bp, Saccharomyces cerevisiae
gcctctaatccgtgctgtct

SEQ ID NO: 6538 - DNA, 20 bp, Saccharomyces cerevisiae
cccctcagatttcgaggttt

SEQ ID NO: 6539 - DNA, 21 bp, Saccharomyces cerevisiae
tgcttgtttaagtgcgctttc

SEQ ID NO: 6540 - DNA, 20 bp, Saccharomyces cerevisiae
gacggtgggttacgaagaga

SEQ ID NO: 6541 - DNA, 20 bp, Saccharomyces cerevisiae
tatggtccaattctgggagc

SEQ ID NO: 6542 - DNA, 20 bp, Saccharomyces cerevisiae
gcatccattcctttgcattt

SEQ ID NO: 6543 - DNA, 20 bp, Saccharomyces cerevisiae
atacgaattgggcaagcaag

SEQ ID NO: 6544 - DNA, 20 bp, Saccharomyces cerevisiae
cgattaagagaacgctggga

SEQ ID NO: 6545 - DNA, 22 bp, Saccharomyces cerevisiae
aaaggcaaataaagctctgctc

SEQ ID NO: 6546 - DNA, 20 bp, Saccharomyces cerevisiae
atgccattgctctcgaacat

SEQ ID NO: 6547 - DNA, 20 bp, Saccharomyces cerevisiae
acagatggagggggaaaaat

SEQ ID NO: 6548 - DNA, 20 bp, Saccharomyces cerevisiae
accgtttcagccttcttcaa

SEQ ID NO: 6549 - DNA, 20 bp, Saccharomyces cerevisiae
ctccagcagcttgcaatttt

SEQ ID NO: 6550 - DNA, 20 bp, Saccharomyces cerevisiae
atggccactggaatgaagag

SEQ ID NO: 6551 - DNA, 21 bp, Saccharomyces cerevisiae
aattggttaaaacattggggg

SEQ ID NO: 6552 - DNA, 21 bp, Saccharomyces cerevisiae
tgctgcacgtgtagtctaatg

SEQ ID NO: 6553 - DNA, 20 bp, Saccharomyces cerevisiae
tcctcatacgtgagggtcaa

SEQ ID NO: 6554 - DNA, 20 bp, Saccharomyces cerevisiae
cgtaagttccccacgaaaaa

SEQ ID NO: 6555 - DNA, 20 bp, Saccharomyces cerevisiae
gaggagaaaggatgtggcaa

SEQ ID NO: 6556 - DNA, 20 bp, Saccharomyces cerevisiae
gacttgggttcttcaatggc

SEQ ID NO: 6557 - DNA, 20 bp, Saccharomyces cerevisiae
cccggtcacgtactgaaagt

SEQ ID NO: 6558 - DNA, 20 bp, Saccharomyces cerevisiae
tctgtggaaaatggaaccct

SEQ ID NO: 6559 - DNA, 20 bp, Saccharomyces cerevisiae
tcacgtgaaaaagatcaccg

SEQ ID NO: 6560 - DNA, 20 bp, Saccharomyces cerevisiae
cgaaagaccctttgtttgga

SEQ ID NO: 6561 - DNA, 20 bp, Saccharomyces cerevisiae
ttgaaatcgggaatcctctg

SEQ ID NO: 6562 - DNA, 20 bp, Saccharomyces cerevisiae
gcggcacaaaacctctctaa

SEQ ID NO: 6563 - DNA, 20 bp, Saccharomyces cerevisiae
gttgggcatccaaacaaaat

SEQ ID NO: 6564 - DNA, 22 bp, Saccharomyces cerevisiae
gggaactacttcacagtgacca

SEQ ID NO: 6565 - DNA, 20 bp, Saccharomyces cerevisiae
cagggtcaaagaaaagctcg

SEQ ID NO: 6566 - DNA, 20 bp, Saccharomyces cerevisiae
gtgccggaatacgaggtaaa

SEQ ID NO: 6567 - DNA, 20 bp, Saccharomyces cerevisiae
gaggactgacgagggaatca

SEQ ID NO: 6568 - DNA, 20 bp, Saccharomyces cerevisiae
aaaactggcgaggactggat

SEQ ID NO: 6569 - DNA, 20 bp, Saccharomyces cerevisiae
accataaaagttgttgcccg

SEQ ID NO: 6570 - DNA, 20 bp, Saccharomyces cerevisiae
agttccaccgcttcatcatc

SEQ ID NO: 6571 - DNA, 20 bp, Saccharomyces cerevisiae
tcagtaacatcgccaaacga

SEQ ID NO: 6572 - DNA, 20 bp, Saccharomyces cerevisiae
tcccacaaaatatgagccgt

SEQ ID NO: 6573 - DNA, 21 bp, Saccharomyces cerevisiae
tttgacatcaaggctggaatc

SEQ ID NO: 6574 - DNA, 20 bp, Saccharomyces cerevisiae
gaccaaaacctccgctgtta

SEQ ID NO: 6575 - DNA, 20 bp, Saccharomyces cerevisiae
ccctcgcctgaatcattaaa

SEQ ID NO: 6576 - DNA, 20 bp, Saccharomyces cerevisiae
gcgctttcaaccaaattcat

SEQ ID NO: 6577 - DNA, 22 bp, Saccharomyces cerevisiae
tcgtcattggaaaactctgaaa

SEQ ID NO: 6578 - DNA, 22 bp, Saccharomyces cerevisiae
tgtgttaacaaaatcgatccct

SEQ ID NO: 6579 - DNA, 20 bp, Saccharomyces cerevisiae
ataagtcgccaggaaattcg

SEQ ID NO: 6580 - DNA, 20 bp, Saccharomyces cerevisiae
tgaggcaagtgcaaagaatg

SEQ ID NO: 6581 - DNA, 20 bp, Saccharomyces cerevisiae
gggcctttgaggaaaaactc

SEQ ID NO: 6582 - DNA, 20 bp, Saccharomyces cerevisiae
cgcatgattatccgtttgtc

SEQ ID NO: 6583 - DNA, 20 bp, Saccharomyces cerevisiae
acgacgaccgtgtgttcttt

SEQ ID NO: 6584 - DNA, 20 bp, Saccharomyces cerevisiae
atcatggcgttccataccat

SEQ ID NO: 6585 - DNA, 20 bp, Saccharomyces cerevisiae
tgcgcgcatccttaataaaa

SEQ ID NO: 6586 - DNA, 20 bp, Saccharomyces cerevisiae
gttcgatttccaccgtttgt

SEQ ID NO: 6587 - DNA, 20 bp, Saccharomyces cerevisiae
ttgttgaatgacaagtcgcc

SEQ ID NO: 6588 - DNA, 20 bp, Saccharomyces cerevisiae
aatggccactgattcagaca

SEQ ID NO: 6589 - DNA, 20 bp, Saccharomyces cerevisiae
tcatagccatcaagcacgag

SEQ ID NO: 6590 - DNA, 20 bp, Saccharomyces cerevisiae
ctttaaatcgacccgggaat

SEQ ID NO: 6591 - DNA, 21 bp, Saccharomyces cerevisiae
aacagcattcttctgatggga

SEQ ID NO: 6592 - DNA, 25 bp, Saccharomyces cerevisiae
gggatataaggcaagatacacaaaa

SEQ ID NO: 6593 - DNA, 20 bp, Saccharomyces cerevisiae
tatcggttccatttcttggc

SEQ ID NO: 6594 - DNA, 20 bp, Saccharomyces cerevisiae
tggggaagaacttatcgcag

SEQ ID NO: 6595 - DNA, 20 bp, Saccharomyces cerevisiae
catcaatcacggtcaaacca

SEQ ID NO: 6596 - DNA, 20 bp, Saccharomyces cerevisiae
tgctaaagcagccttccaat

SEQ ID NO: 6597 - DNA, 25 bp, Saccharomyces cerevisiae
atttaagatgcttgttggaatgaaa

SEQ ID NO: 6598 - DNA, 20 bp, Saccharomyces cerevisiae
ttattcggcctgttttccag

SEQ ID NO: 6599 - DNA, 20 bp, Saccharomyces cerevisiae
cttgtcgagtgaaacgccta

SEQ ID NO: 6600 - DNA, 20 bp, Saccharomyces cerevisiae
agctactgccgtgcaaaaat

SEQ ID NO: 6601 - DNA, 21 bp, Saccharomyces cerevisiae
agttgggcaaagatgtgattg

SEQ ID NO: 6602 - DNA, 20 bp, Saccharomyces cerevisiae
aagaaattgggggcagaagt

SEQ ID NO: 6603 - DNA, 20 bp, Saccharomyces cerevisiae
aacatccggtctcaacttgc

SEQ ID NO: 6604 - DNA, 20 bp, Saccharomyces cerevisiae
ttcaattgagggattttgcc

SEQ ID NO: 6605 - DNA, 20 bp, Saccharomyces cerevisiae
tggccgttataggttccact

SEQ ID NO: 6606 - DNA, 20 bp, Saccharomyces cerevisiae
ttggtggccaaatctctttc

SEQ ID NO: 6607 - DNA, 20 bp, Saccharomyces cerevisiae
gaaagccgttgagcttcact

SEQ ID NO: 6608 - DNA, 20 bp, Saccharomyces cerevisiae
aattcaaaggacctgatggc

SEQ ID NO: 6609 - DNA, 20 bp, Saccharomyces cerevisiae
caaatcgggtcataaaggga

SEQ ID NO: 6610 - DNA, 20 bp, Saccharomyces cerevisiae
tgtggatcgaggaatatgga

SEQ ID NO: 6611 - DNA, 20 bp, Saccharomyces cerevisiae
gcttcaggaccgtttttgat

SEQ ID NO: 6612 - DNA, 20 bp, Saccharomyces cerevisiae
aaagatcgggtaatttgggc

SEQ ID NO: 6613 - DNA, 20 bp, Saccharomyces cerevisiae
gtttcccgctagcaatttga

SEQ ID NO: 6614 - DNA, 20 bp, Saccharomyces cerevisiae
ctgtatgcccgagacactga

SEQ ID NO: 6615 - DNA, 20 bp, Saccharomyces cerevisiae
ttccccaacatcaccaagtt

SEQ ID NO: 6616 - DNA, 20 bp, Saccharomyces cerevisiae
cgtcgtcccaagacattttt

SEQ ID NO: 6617 - DNA, 20 bp, Saccharomyces cerevisiae
gttgttcgttcccgatctgt

SEQ ID NO: 6618 - DNA, 20 bp, Saccharomyces cerevisiae
tgaaaaacaaggaagccctg

SEQ ID NO: 6619 - DNA, 20 bp, Saccharomyces cerevisiae
tgaagaatgcgggaataacc

SEQ ID NO: 6620 - DNA, 20 bp, Saccharomyces cerevisiae
ggggactgtttatgtgggaa

SEQ ID NO: 6621 - DNA, 20 bp, Saccharomyces cerevisiae
cagcaagagtgcaacagcat

SEQ ID NO: 6622 - DNA, 22 bp, Saccharomyces cerevisiae
tcaagaggatgaatttgaagca

SEQ ID NO: 6623 - DNA, 20 bp, Saccharomyces cerevisiae
gggcatacgcttggtaaaaa

SEQ ID NO: 6624 - DNA, 20 bp, Saccharomyces cerevisiae
gacaaccatcccgcattatt

SEQ ID NO: 6625 - DNA, 20 bp, Saccharomyces cerevisiae
aaattcctgccgttctttcc

SEQ ID NO: 6626 - DNA, 20 bp, Saccharomyces cerevisiae
catagagagggtatgcgcga

SEQ ID NO: 6627 - DNA, 20 bp, Saccharomyces cerevisiae
tatcgcttacgcgcaataaa

SEQ ID NO: 6628 - DNA, 24 bp, Saccharomyces cerevisiae
ttttggtactgcattctaaaacac

SEQ ID NO: 6629 - DNA, 20 bp, Saccharomyces cerevisiae
acattgcatatgagccaagg

SEQ ID NO: 6630 - DNA, 19 bp, Saccharomyces cerevisiae
ggatcaaaaatcgggcttg

SEQ ID NO: 6631 - DNA, 20 bp, Saccharomyces cerevisiae
ccgatcgtcctccacactta

SEQ ID NO: 6632 - DNA, 20 bp, Saccharomyces cerevisiae
ggctgtcgggggttagtaga

SEQ ID NO: 6633 - DNA, 20 bp, Saccharomyces cerevisiae
aatcgaagaaaagtggggct

SEQ ID NO: 6634 - DNA, 20 bp, Saccharomyces cerevisiae
agaagaaggacccaaatgcc

SEQ ID NO: 6635 - DNA, 20 bp, Saccharomyces cerevisiae
taacgaaccaaataaccgcc

SEQ ID NO: 6636 - DNA, 20 bp, Saccharomyces cerevisiae
ccggcaatgaatattttgct

SEQ ID NO: 6637 - DNA, 20 bp, Saccharomyces cerevisiae
aatgatggcgacggtaaaag

SEQ ID NO: 6638 - DNA, 20 bp, Saccharomyces cerevisiae
tgggttgagcgatacagttg

SEQ ID NO: 6639 - DNA, 20 bp, Saccharomyces cerevisiae
tttgacacgctgtccattct

SEQ ID NO: 6640 - DNA, 20 bp, Saccharomyces cerevisiae
cgataatcctaagtggcgga

SEQ ID NO: 6641 - DNA, 20 bp, Saccharomyces cerevisiae
cgtacttttatggccctgga

SEQ ID NO: 6642 - DNA, 20 bp, Saccharomyces cerevisiae
aatcttccgcgtctctctca

SEQ ID NO: 6643 - DNA, 20 bp, Saccharomyces cerevisiae
ttgagctttacctcctccca

SEQ ID NO: 6644 - DNA, 20 bp, Saccharomyces cerevisiae
ccttgaaaactgcgtaacca

SEQ ID NO: 6645 - DNA, 20 bp, Saccharomyces cerevisiae
ctgcttcataatctgcgacg

SEQ ID NO: 6646 - DNA, 20 bp, Saccharomyces cerevisiae
ggctgcgctaatacatccat

SEQ ID NO: 6647 - DNA, 20 bp, Saccharomyces cerevisiae
agcctctgcaatagcggtta

SEQ ID NO: 6648 - DNA, 20 bp, Saccharomyces cerevisiae
tccgtgtcttctgagcatga

SEQ ID NO: 6649 - DNA, 20 bp, Saccharomyces cerevisiae
ctttctccctgtctctgcgt

SEQ ID NO: 6650 - DNA, 20 bp, Saccharomyces cerevisiae
agtggcttcctgcctacaga

SEQ ID NO: 6651 - DNA, 21 bp, Saccharomyces cerevisiae
tctatcgaaaaggtgctcacg

SEQ ID NO: 6652 - DNA, 20 bp, Saccharomyces cerevisiae
ggacgtcaagctagcaagga

SEQ ID NO: 6653 - DNA, 20 bp, Saccharomyces cerevisiae
cctttagcaattgcgatcaa

SEQ ID NO: 6654 - DNA, 20 bp, Saccharomyces cerevisiae
cgaccttcttgaagtcggag

SEQ ID NO: 6655 - DNA, 20 bp, Saccharomyces cerevisiae
ttgaaaacgatgaactggca

SEQ ID NO: 6656 - DNA, 20 bp, Saccharomyces cerevisiae
tcaagatcctttaacggcca

SEQ ID NO: 6657 - DNA, 20 bp, Saccharomyces cerevisiae
cgggttttgtggtcaatagg

SEQ ID NO: 6658 - DNA, 20 bp, Saccharomyces cerevisiae
tgctcgacaaggtgggaata

SEQ ID NO: 6659 - DNA, 20 bp, Saccharomyces cerevisiae
aaaacccagttggagaaggc

SEQ ID NO: 6660 - DNA, 20 bp, Saccharomyces cerevisiae
ttttgcgaatatgggaggag

SEQ ID NO: 6661 - DNA, 20 bp, Saccharomyces cerevisiae
gccctttcattgtcattgct

SEQ ID NO: 6662 - DNA, 20 bp, Saccharomyces cerevisiae
atcgacaatgttgcaaacca

SEQ ID NO: 6663 - DNA, 20 bp, Saccharomyces cerevisiae
tatgccgtacaaacttgcca

SEQ ID NO: 6664 - DNA, 20 bp, Saccharomyces cerevisiae
tagattctgcccaatacgcc

SEQ ID NO: 6665 - DNA, 21 bp, Saccharomyces cerevisiae
caacatgaatccattcccaat

SEQ ID NO: 6666 - DNA, 20 bp, Saccharomyces cerevisiae
cctcgcaactagcacaatca

SEQ ID NO: 6667 - DNA, 20 bp, Saccharomyces cerevisiae
ttggcagaagatgtggatga

SEQ ID NO: 6668 - DNA, 23 bp, Saccharomyces cerevisiae
ggaagagaatatttcccatccaa

SEQ ID NO: 6669 - DNA, 20 bp, Saccharomyces cerevisiae
cggaggaagcaccaataaac

SEQ ID NO: 6670 - DNA, 20 bp, Saccharomyces cerevisiae
tggaatgtgagggaacaaca

SEQ ID NO: 6671 - DNA, 20 bp, Saccharomyces cerevisiae
gagatgctttcacgcaacaa

SEQ ID NO: 6672 - DNA, 20 bp, Saccharomyces cerevisiae
gagaggaagggggaaatcag

SEQ ID NO: 6673 - DNA, 20 bp, Saccharomyces cerevisiae
aattgcgtttggtcgttcat

SEQ ID NO: 6674 - DNA, 20 bp, Saccharomyces cerevisiae
ttcctctgcacgttgtcttg

SEQ ID NO: 6675 - DNA, 20 bp, Saccharomyces cerevisiae
tcagctaaacctcggtggac

SEQ ID NO: 6676 - DNA, 20 bp, Saccharomyces cerevisiae
aattgcatgctctgctgatg

SEQ ID NO: 6677 - DNA, 20 bp, Saccharomyces cerevisiae
gacctcagttgcatgcttca

SEQ ID NO: 6678 - DNA, 20 bp, Saccharomyces cerevisiae
ttcgaaagtcaaagtgccat

SEQ ID NO: 6679 - DNA, 20 bp, Saccharomyces cerevisiae
aaggttacagatgcgttggc

SEQ ID NO: 6680 - DNA, 20 bp, Saccharomyces cerevisiae
tcgggtcaccctcattttta

SEQ ID NO: 6681 - DNA, 25 bp, Saccharomyces cerevisiae
agatgttaacttgctcaacattcaa

SEQ ID NO: 6682 - DNA, 20 bp, Saccharomyces cerevisiae
gccagaatcggcagtatcat

SEQ ID NO: 6683 - DNA, 20 bp, Saccharomyces cerevisiae
gccagaaggttgggataggt

SEQ ID NO: 6684 - DNA, 21 bp, Saccharomyces cerevisiae
catattgccagggtcgaataa

SEQ ID NO: 6685 - DNA, 22 bp, Saccharomyces cerevisiae
gaaattagaccgagaggcattt

SEQ ID NO: 6686 - DNA, 20 bp, Saccharomyces cerevisiae
ctctgatcattccatccggt

SEQ ID NO: 6687 - DNA, 20 bp, Saccharomyces cerevisiae
cagggaaagatgcagaggaa

SEQ ID NO: 6688 - DNA, 21 bp, Saccharomyces cerevisiae
aactttttcagatgacgcgaa

SEQ ID NO: 6689 - DNA, 20 bp, Saccharomyces cerevisiae
ccatatcatcgaaaaacggc

SEQ ID NO: 6690 - DNA, 20 bp, Saccharomyces cerevisiae
tgcttttgtaaggaaacggg

SEQ ID NO: 6691 - DNA, 20 bp, Saccharomyces cerevisiae
aaaaccttggtgcgagattg

SEQ ID NO: 6692 - DNA, 20 bp, Saccharomyces cerevisiae
gaaaatcgccattcctgaaa

SEQ ID NO: 6693 - DNA, 20 bp, Saccharomyces cerevisiae
atccattgagatcgactcgg

SEQ ID NO: 6694 - DNA, 20 bp, Saccharomyces cerevisiae
aaggggagacgaaagttgct

SEQ ID NO: 6695 - DNA, 20 bp, Saccharomyces cerevisiae
cttcctgtggatgtttcggt

SEQ ID NO: 6696 - DNA, 20 bp, Saccharomyces cerevisiae
ctgtgtgagtttgacgcctt

SEQ ID NO: 6697 - DNA, 19 bp, Saccharomyces cerevisiae
ccgaatgttggaacaggtg

SEQ ID NO: 6698 - DNA, 20 bp, Saccharomyces cerevisiae
atggcgttggttcttagtgc

SEQ ID NO: 6699 - DNA, 20 bp, Saccharomyces cerevisiae
cgcaagaggaagaatcagga

SEQ ID NO: 6700 - DNA, 20 bp, Saccharomyces cerevisiae
cattatcatggcaaaagggg

SEQ ID NO: 6701 - DNA, 20 bp, Saccharomyces cerevisiae
aagtcgtcatcggtattggc

SEQ ID NO: 6702 - DNA, 20 bp, Saccharomyces cerevisiae
cattgcacatccatctttcg

SEQ ID NO: 6703 - DNA, 20 bp, Saccharomyces cerevisiae
cacttggccttactggcaat

SEQ ID NO: 6704 - DNA, 20 bp, Saccharomyces cerevisiae
agtttgaccgaaagggaagg

SEQ ID NO: 6705 - DNA, 20 bp, Saccharomyces cerevisiae
tccaaactctttgtcgtccc

SEQ ID NO: 6706 - DNA, 20 bp, Saccharomyces cerevisiae
ctacccatgttgctccacct

SEQ ID NO: 6707 - DNA, 20 bp, Saccharomyces cerevisiae
aacatcgcctgatatttgcc

SEQ ID NO: 6708 - DNA, 20 bp, Saccharomyces cerevisiae
ggtgcatcaaaaggagcaat

SEQ ID NO: 6709 - DNA, 20 bp, Saccharomyces cerevisiae
gttgctcaatgttccgacct

SEQ ID NO: 6710 - DNA, 20 bp, Saccharomyces cerevisiae
gttttcgcccagtttttgaa

SEQ ID NO: 6711 - DNA, 20 bp, Saccharomyces cerevisiae
acccaagtgttgcatgttga

SEQ ID NO: 6712 - DNA, 20 bp, Saccharomyces cerevisiae
gaagattgtttggcctggaa

SEQ ID NO: 6713 - DNA, 20 bp, Saccharomyces cerevisiae
cttggggtatggaaaaagca

SEQ ID NO: 6714 - DNA, 21 bp, Saccharomyces cerevisiae
gaacagtggcaatcaggtctt

SEQ ID NO: 6715 - DNA, 20 bp, Saccharomyces cerevisiae
tccattccaagcattcatca

SEQ ID NO: 6716 - DNA, 20 bp, Saccharomyces cerevisiae
accaaggcagccagtacaac

SEQ ID NO: 6717 - DNA, 20 bp, Saccharomyces cerevisiae
tggagggagagaactccaaa

SEQ ID NO: 6718 - DNA, 20 bp, Saccharomyces cerevisiae
cattgaaaaatggactgcca

SEQ ID NO: 6719 - DNA, 20 bp, Saccharomyces cerevisiae
ctggcgcaaagttgtttgta

SEQ ID NO: 6720 - DNA, 20 bp, Saccharomyces cerevisiae
tcgatgatgatattccccgt

SEQ ID NO: 6721 - DNA, 20 bp, Saccharomyces cerevisiae
taacgccgggcagtagtaac

SEQ ID NO: 6722 - DNA, 25 bp, Saccharomyces cerevisiae
tttctttttcttttaccagacttgg

SEQ ID NO: 6723 - DNA, 21 bp, Saccharomyces cerevisiae
ggatttggaagagaaggttcg

SEQ ID NO: 6724 - DNA, 20 bp, Saccharomyces cerevisiae
aaagtcaaaatcggcaccac

SEQ ID NO: 6725 - DNA, 20 bp, Saccharomyces cerevisiae
cgaggagaaattgaagctgg

SEQ ID NO: 6726 - DNA, 20 bp, Saccharomyces cerevisiae
cctccaaaagatgtcgcatt

SEQ ID NO: 6727 - DNA, 20 bp, Saccharomyces cerevisiae
cggttttggctgagagagat

SEQ ID NO: 6728 - DNA, 21 bp, Saccharomyces cerevisiae
ttctttggtcatgctttcaca

SEQ ID NO: 6729 - DNA, 20 bp, Saccharomyces cerevisiae
tcttcgataaaaggagcgga

SEQ ID NO: 6730 - DNA, 20 bp, Saccharomyces cerevisiae
tggtggagttgtttgtttgc

SEQ ID NO: 6731 - DNA, 20 bp, Saccharomyces cerevisiae
tgtagcagcacaacctggac

SEQ ID NO: 6732 - DNA, 20 bp, Saccharomyces cerevisiae
tatatgcgagcaaatcccct

SEQ ID NO: 6733 - DNA, 20 bp, Saccharomyces cerevisiae
cctcagttccccagtaacca

SEQ ID NO: 6734 - DNA, 20 bp, Saccharomyces cerevisiae
gcccggattgttcttgttta

SEQ ID NO: 6735 - DNA, 23 bp, Saccharomyces cerevisiae
gattcaatggatatcccactagc

SEQ ID NO: 6736 - DNA, 20 bp, Saccharomyces cerevisiae
gatgcgctagaaagaatcgg

SEQ ID NO: 6737 - DNA, 20 bp, Saccharomyces cerevisiae
aatgttgcaattttcctgcc

SEQ ID NO: 6738 - DNA, 20 bp, Saccharomyces cerevisiae
tatcatacccaattgcgggc

SEQ ID NO: 6739 - DNA, 22 bp, Saccharomyces cerevisiae
tgatcaacatttccaccttttg

SEQ ID NO: 6740 - DNA, 20 bp, Saccharomyces cerevisiae
ccccggtcttaatatcccat

SEQ ID NO: 6741 - DNA, 20 bp, Saccharomyces cerevisiae
gaccaaaagcattaccgctg

SEQ ID NO: 6742 - DNA, 20 bp, Saccharomyces cerevisiae
aacgactttaccgatttggc

SEQ ID NO: 6743 - DNA, 20 bp, Saccharomyces cerevisiae
cgcatcaatcttgagcatgt

SEQ ID NO: 6744 - DNA, 20 bp, Saccharomyces cerevisiae
gcatttgctcaattgcttca

SEQ ID NO: 6745 - DNA, 20 bp, Saccharomyces cerevisiae
atctgctgcatctttgcctt

SEQ ID NO: 6746 - DNA, 24 bp, Saccharomyces cerevisiae
aaagttttctctgctggtactctg

SEQ ID NO: 6747 - DNA, 20 bp, Saccharomyces cerevisiae
cccgatactttttgccttca

SEQ ID NO: 6748 - DNA, 20 bp, Saccharomyces cerevisiae
ggtttcccagtgttgcaagt

SEQ ID NO: 6749 - DNA, 20 bp, Saccharomyces cerevisiae
ataaccaagggcttgccttc

SEQ ID NO: 6750 - DNA, 20 bp, Saccharomyces cerevisiae
ccgataatgagaaacgccat

SEQ ID NO: 6751 - DNA, 20 bp, Saccharomyces cerevisiae
ccttgggcagctcctataca

SEQ ID NO: 6752 - DNA, 20 bp, Saccharomyces cerevisiae
atttgtcaacctcgtgggag

SEQ ID NO: 6753 - DNA, 20 bp, Saccharomyces cerevisiae
tcaaagagcttccagccatt

SEQ ID NO: 6754 - DNA, 20 bp, Saccharomyces cerevisiae
tcgaaagtgtccctttgtcc

SEQ ID NO: 6755 - DNA, 20 bp, Saccharomyces cerevisiae
tgggcttgatttgtgaatga

SEQ ID NO: 6756 - DNA, 20 bp, Saccharomyces cerevisiae
cttctttaaatcgcggttcg

SEQ ID NO: 6757 - DNA, 20 bp, Saccharomyces cerevisiae
ataataaggccttcacgcca

SEQ ID NO: 6758 - DNA, 20 bp, Saccharomyces cerevisiae
atcacgcacaaatggattga

SEQ ID NO: 6759 - DNA, 20 bp, Saccharomyces cerevisiae
tattttggtcggttggaacg

SEQ ID NO: 6760 - DNA, 20 bp, Saccharomyces cerevisiae
atatcgcttctccgtgcaat

SEQ ID NO: 6761 - DNA, 20 bp, Saccharomyces cerevisiae
tgagtcaaggtacaccagcg

SEQ ID NO: 6762 - DNA, 20 bp, Saccharomyces cerevisiae
gacaagcaatttgccggtat

SEQ ID NO: 6763 - DNA, 20 bp, Saccharomyces cerevisiae
caaattggcttcattcagca

SEQ ID NO: 6764 - DNA, 20 bp, Saccharomyces cerevisiae
tcccgataaataccaagccc

SEQ ID NO: 6765 - DNA, 20 bp, Saccharomyces cerevisiae
aattctcaatggtatcgccg

SEQ ID NO: 6766 - DNA, 20 bp, Saccharomyces cerevisiae
cctgtgccaatacgattcaa

SEQ ID NO: 6767 - DNA, 20 bp, Saccharomyces cerevisiae
gtaatggcaatcccaaccac

SEQ ID NO: 6768 - DNA, 20 bp, Saccharomyces cerevisiae
caattggctgttgcaaatga

SEQ ID NO: 6769 - DNA, 20 bp, Saccharomyces cerevisiae
agaaggcttcgcatgttgat

SEQ ID NO: 6770 - DNA, 20 bp, Saccharomyces cerevisiae
ttccggaagaatttcgaatg

SEQ ID NO: 6771 - DNA, 20 bp, Saccharomyces cerevisiae
acatgggcgatgacttgaat

SEQ ID NO: 6772 - DNA, 20 bp, Saccharomyces cerevisiae
caaacgcatgaatcgctaga

SEQ ID NO: 6773 - DNA, 20 bp, Saccharomyces cerevisiae
caaagcgaccatgactttcc

SEQ ID NO: 6774 - DNA, 20 bp, Saccharomyces cerevisiae
acggctgctgctaattcagt

SEQ ID NO: 6775 - DNA, 25 bp, Saccharomyces cerevisiae
cggttaagttgattttaatctggaa

SEQ ID NO: 6776 - DNA, 20 bp, Saccharomyces cerevisiae
tgcaattggaaccatcaaaa

SEQ ID NO: 6777 - DNA, 20 bp, Saccharomyces cerevisiae
ggagatgatgcagtcaacga

SEQ ID NO: 6778 - DNA, 20 bp, Saccharomyces cerevisiae
tactgtcatggactcgctgg

SEQ ID NO: 6779 - DNA, 24 bp, Saccharomyces cerevisiae
ggggataaaatgaagaaaagaaga

SEQ ID NO: 6780 - DNA, 20 bp, Saccharomyces cerevisiae
ctactctccgggttctggtg

SEQ ID NO: 6781 - DNA, 20 bp, Saccharomyces cerevisiae
aagagcagaggaatttgcca

SEQ ID NO: 6782 - DNA, 20 bp, Saccharomyces cerevisiae
taacgtgggcgaagaagaag

SEQ ID NO: 6783 - DNA, 23 bp, Saccharomyces cerevisiae
gctgtgtttgttgtttttgtttt

SEQ ID NO: 6784 - DNA, 23 bp, Saccharomyces cerevisiae
tcaagaagatgatggtgattcaa

SEQ ID NO: 6785 - DNA, 20 bp, Saccharomyces cerevisiae
tttccggcagatagcaaaac

SEQ ID NO: 6786 - DNA, 20 bp, Saccharomyces cerevisiae
acatatccggttttcgaacg

SEQ ID NO: 6787 - DNA, 20 bp, Saccharomyces cerevisiae
aactggcacaacagattgga

SEQ ID NO: 6788 - DNA, 20 bp, Saccharomyces cerevisiae
tgggaaatggttcaagaagg

SEQ ID NO: 6789 - DNA, 20 bp, Saccharomyces cerevisiae
tgatcatcgtgggcatctaa

SEQ ID NO: 6790 - DNA, 20 bp, Saccharomyces cerevisiae
atcggattcgctatttgtgg

SEQ ID NO: 6791 - DNA, 20 bp, Saccharomyces cerevisiae
tggcttaaaggctgtctcca

SEQ ID NO: 6792 - DNA, 20 bp, Saccharomyces cerevisiae
gtcaatggggttttgctcat

SEQ ID NO: 6793 - DNA, 20 bp, Saccharomyces cerevisiae
atgaaaacccattggctgac

SEQ ID NO: 6794 - DNA, 20 bp, Saccharomyces cerevisiae
ttctattccatagcaccgca

SEQ ID NO: 6795 - DNA, 23 bp, Saccharomyces cerevisiae
cgccttgaaaacaaatgactatc

SEQ ID NO: 6796 - DNA, 20 bp, Saccharomyces cerevisiae
cgactttctccctctctcca

SEQ ID NO: 6797 - DNA, 20 bp, Saccharomyces cerevisiae
aatgccgagccgatattatg

SEQ ID NO: 6798 - DNA, 20 bp, Saccharomyces cerevisiae
aaccatcgaggggcttagtt

SEQ ID NO: 6799 - DNA, 20 bp, Saccharomyces cerevisiae
cagcagcagggcctaataac

SEQ ID NO: 6800 - DNA, 22 bp, Saccharomyces cerevisiae
ttcacttatggataccattggc

SEQ ID NO: 6801 - DNA, 20 bp, Saccharomyces cerevisiae
atgaacaaagtgcatcgcat

SEQ ID NO: 6802 - DNA, 20 bp, Saccharomyces cerevisiae
ttgtgttccacttgctttcg

SEQ ID NO: 6803 - DNA, 20 bp, Saccharomyces cerevisiae
caacaagcgcgttcaataaa

SEQ ID NO: 6804 - DNA, 20 bp, Saccharomyces cerevisiae
tgatgagaatgtgcaggcat

SEQ ID NO: 6805 - DNA, 20 bp, Saccharomyces cerevisiae
ctgcggaaatattgccaagt

SEQ ID NO: 6806 - DNA, 20 bp, Saccharomyces cerevisiae
ttttgctttgagccttgtca

SEQ ID NO: 6807 - DNA, 20 bp, Saccharomyces cerevisiae
attgaaagcaacggatttgc

SEQ ID NO: 6808 - DNA, 21 bp, Saccharomyces cerevisiae
ttgttataccgatttttgccg

SEQ ID NO: 6809 - DNA, 20 bp, Saccharomyces cerevisiae
ttggtcgtcaaatctgcaag

SEQ ID NO: 6810 - DNA, 20 bp, Saccharomyces cerevisiae
tgctcaaaatggcaacagag

SEQ ID NO: 6811 - DNA, 20 bp, Saccharomyces cerevisiae
ggtggatatcagccctacga

SEQ ID NO: 6812 - DNA, 20 bp, Saccharomyces cerevisiae
aagcgtgcttcgagaaatgt

SEQ ID NO: 6813 - DNA, 20 bp, Saccharomyces cerevisiae
atttcagggtatggtggacg

SEQ ID NO: 6814 - DNA, 20 bp, Saccharomyces cerevisiae
gctgaacctcctgtggaaaa

SEQ ID NO: 6815 - DNA, 21 bp, Saccharomyces cerevisiae
cctattagacccaatgctggc

SEQ ID NO: 6816 - DNA, 20 bp, Saccharomyces cerevisiae
cttgtagcgcctagtgaggg

SEQ ID NO: 6817 - DNA, 20 bp, Saccharomyces cerevisiae
ggcccagcaacagacaataa

SEQ ID NO: 6818 - DNA, 20 bp, Saccharomyces cerevisiae
tgcagagtgggtagcatgtc

SEQ ID NO: 6819 - DNA, 20 bp, Saccharomyces cerevisiae
ggagcggggaatctttagtc

SEQ ID NO: 6820 - DNA, 20 bp, Saccharomyces cerevisiae
agtgtattgcacctaccggc

SEQ ID NO: 6821 - DNA, 20 bp, Saccharomyces cerevisiae
cttcgcccagaggaacatta

SEQ ID NO: 6822 - DNA, 20 bp, Saccharomyces cerevisiae
taaatcgcaagagcaaaggg

SEQ ID NO: 6823 - DNA, 20 bp, Saccharomyces cerevisiae
tttcctggcttttctcctca

SEQ ID NO: 6824 - DNA, 20 bp, Saccharomyces cerevisiae
caggccaaattgaagggtta

SEQ ID NO: 6825 - DNA, 20 bp, Saccharomyces cerevisiae
ggtttctcggagtcaagctg

SEQ ID NO: 6826 - DNA, 20 bp, Saccharomyces cerevisiae
gaacgggcgttgtagtcagt

SEQ ID NO: 6827 - DNA, 20 bp, Saccharomyces cerevisiae
tggaaggacaaacaatgcaa

SEQ ID NO: 6828 - DNA, 20 bp, Saccharomyces cerevisiae
tctgtacggtccaaaagcaa

SEQ ID NO: 6829 - DNA, 20 bp, Saccharomyces cerevisiae
aggggacaattccatgtgag

SEQ ID NO: 6830 - DNA, 20 bp, Saccharomyces cerevisiae
aaacgccatatggaaatcgt

SEQ ID NO: 6831 - DNA, 20 bp, Saccharomyces cerevisiae
tgctagccgtattagggtgg

SEQ ID NO: 6832 - DNA, 20 bp, Saccharomyces cerevisiae
cggcgtgaaaccattaattt

SEQ ID NO: 6833 - DNA, 20 bp, Saccharomyces cerevisiae
atgggaaacttcattgtggc

SEQ ID NO: 6834 - DNA, 20 bp, Saccharomyces cerevisiae
gatatgcgcaagccacctac

SEQ ID NO: 6835 - DNA, 20 bp, Saccharomyces cerevisiae
tggacaatcccaaaaccatt

SEQ ID NO: 6836 - DNA, 25 bp, Saccharomyces cerevisiae
ctgtcttgtcatagacggataggat

SEQ ID NO: 6837 - DNA, 20 bp, Saccharomyces cerevisiae
gcaagttgcgtccaagagta

SEQ ID NO: 6838 - DNA, 20 bp, Saccharomyces cerevisiae
attggacttcgccttagtgc

SEQ ID NO: 6839 - DNA, 20 bp, Saccharomyces cerevisiae
agcaaagtgtcaaaaccgct

SEQ ID NO: 6840 - DNA, 20 bp, Saccharomyces cerevisiae
attgactcagccgatgacct

SEQ ID NO: 6841 - DNA, 20 bp, Saccharomyces cerevisiae
ggttaccacgggcttgaaat

SEQ ID NO: 6842 - DNA, 20 bp, Saccharomyces cerevisiae
aaattggttgctgaactggg

SEQ ID NO: 6843 - DNA, 20 bp, Saccharomyces cerevisiae
aaaatcgcgggtatgaagtg

SEQ ID NO: 6844 - DNA, 20 bp, Saccharomyces cerevisiae
cgcagtaatctggacccact

SEQ ID NO: 6845 - DNA, 20 bp, Saccharomyces cerevisiae
agacgcttcagccgagtatg

SEQ ID NO: 6846 - DNA, 20 bp, Saccharomyces cerevisiae
aacgccttttgagctagcaa

SEQ ID NO: 6847 - DNA, 20 bp, Saccharomyces cerevisiae
cgtgccagaacagacaagaa

SEQ ID NO: 6848 - DNA, 20 bp, Saccharomyces cerevisiae
tgggaggaggtaaagctcaa

SEQ ID NO: 6849 - DNA, 22 bp, Saccharomyces cerevisiae
tttttaaaacttgatcccaacg

SEQ ID NO: 6850 - DNA, 20 bp, Saccharomyces cerevisiae
attgccttgcctatacccct

SEQ ID NO: 6851 - DNA, 19 bp, Saccharomyces cerevisiae
acattcttccttggacggc

SEQ ID NO: 6852 - DNA, 20 bp, Saccharomyces cerevisiae
gatagcaccgggaactctca

SEQ ID NO: 6853 - DNA, 20 bp, Saccharomyces cerevisiae
gcattagcgtatgcgaaaca

SEQ ID NO: 6854 - DNA, 20 bp, Saccharomyces cerevisiae
gtaacagcgagtcttcggga

SEQ ID NO: 6855 - DNA, 20 bp, Saccharomyces cerevisiae
acagattccacatcggtggt

SEQ ID NO: 6856 - DNA, 20 bp, Saccharomyces cerevisiae
cacgcaaaaggtatttggct

SEQ ID NO: 6857 - DNA, 20 bp, Saccharomyces cerevisiae
cgtttccttgaccgcactat

SEQ ID NO: 6858 - DNA, 20 bp, Saccharomyces cerevisiae
agtatgactggcgcgtctct

SEQ ID NO: 6859 - DNA, 20 bp, Saccharomyces cerevisiae
tttcccagcacctaaaccac

SEQ ID NO: 6860 - DNA, 20 bp, Saccharomyces cerevisiae
tttcttccttcgggctaggt

SEQ ID NO: 6861 - DNA, 22 bp, Saccharomyces cerevisiae
caagtgagcatatgttcgagga

SEQ ID NO: 6862 - DNA, 20 bp, Saccharomyces cerevisiae
agccaaacgagcttgatgtt

SEQ ID NO: 6863 - DNA, 20 bp, Saccharomyces cerevisiae
aaaggattacgaagctgcca

SEQ ID NO: 6864 - DNA, 20 bp, Saccharomyces cerevisiae
gctcttttcatgatgtgcca

SEQ ID NO: 6865 - DNA, 20 bp, Saccharomyces cerevisiae
gccggattttatcatccaaa

SEQ ID NO: 6866 - DNA, 20 bp, Saccharomyces cerevisiae
attcctacttggagggggtg

SEQ ID NO: 6867 - DNA, 20 bp, Saccharomyces cerevisiae
gcacgaaatttgtcggctat

SEQ ID NO: 6868 - DNA, 20 bp, Saccharomyces cerevisiae
gttggaatgctgtgggattt

SEQ ID NO: 6869 - DNA, 20 bp, Saccharomyces cerevisiae
gaaaggctctgcttttggtg

SEQ ID NO: 6870 - DNA, 24 bp, Saccharomyces cerevisiae
ttcaaagaaagtttcatcttgtca

SEQ ID NO: 6871 - DNA, 20 bp, Saccharomyces cerevisiae
agtgtgatccgacttcgtcc

SEQ ID NO: 6872 - DNA, 20 bp, Saccharomyces cerevisiae
tcgctagtggatcgtcacag

SEQ ID NO: 6873 - DNA, 20 bp, Saccharomyces cerevisiae
tcaaaaggccatgtttaggg

SEQ ID NO: 6874 - DNA, 20 bp, Saccharomyces cerevisiae
tccagagagaaacaagccgt

SEQ ID NO: 6875 - DNA, 21 bp, Saccharomyces cerevisiae
cctttttgcagtcttcaatcc

SEQ ID NO: 6876 - DNA, 20 bp, Saccharomyces cerevisiae
caattacaaaaccgatcccg

SEQ ID NO: 6877 - DNA, 21 bp, Saccharomyces cerevisiae
ggacacctgtagagctagcca

SEQ ID NO: 6878 - DNA, 20 bp, Saccharomyces cerevisiae
cgctcgcaatgaagaaaaat

SEQ ID NO: 6879 - DNA, 20 bp, Saccharomyces cerevisiae
ggttttgagtttgcgttggt

SEQ ID NO: 6880 - DNA, 20 bp, Saccharomyces cerevisiae
atttaatggcgagtgatggg

SEQ ID NO: 6881 - DNA, 20 bp, Saccharomyces cerevisiae
ggtaaatggctctctcagcg

SEQ ID NO: 6882 - DNA, 19 bp, Saccharomyces cerevisiae
gccgcagatgtgtatgtcc

SEQ ID NO: 6883 - DNA, 20 bp, Saccharomyces cerevisiae
accatcgttgccttatcgtc

SEQ ID NO: 6884 - DNA, 20 bp, Saccharomyces cerevisiae
tgaaatttggtcgcaaatga

SEQ ID NO: 6885 - DNA, 20 bp, Saccharomyces cerevisiae
taaaggtgcggaagagcatt

SEQ ID NO: 6886 - DNA, 20 bp, Saccharomyces cerevisiae
tgttgtattggacaaagcgg

SEQ ID NO: 6887 - DNA, 20 bp, Saccharomyces cerevisiae
aaattcactcaccaaaccgc

SEQ ID NO: 6888 - DNA, 20 bp, Saccharomyces cerevisiae
cttctggcaaagaagccttg

SEQ ID NO: 6889 - DNA, 20 bp, Saccharomyces cerevisiae
ccattcatggtgtttgtcgt

SEQ ID NO: 6890 - DNA, 20 bp, Saccharomyces cerevisiae
atcatgtggaagaccttggg

SEQ ID NO: 6891 - DNA, 20 bp, Saccharomyces cerevisiae
ggactcgaagatttgccctt

SEQ ID NO: 6892 - DNA, 20 bp, Saccharomyces cerevisiae
gtgttcgccctttgtcgtat

SEQ ID NO: 6893 - DNA, 20 bp, Saccharomyces cerevisiae
gctcacaggtcttaatccgc

SEQ ID NO: 6894 - DNA, 20 bp, Saccharomyces cerevisiae
ctaacgtggtttggtgcctt

SEQ ID NO: 6895 - DNA, 20 bp, Saccharomyces cerevisiae
tcccaattttgttttgaggc

SEQ ID NO: 6896 - DNA, 20 bp, Saccharomyces cerevisiae
tttgggcagaaagatatccg

SEQ ID NO: 6897 - DNA, 20 bp, Saccharomyces cerevisiae
ttgctgatctctaccaccgt

SEQ ID NO: 6898 - DNA, 20 bp, Saccharomyces cerevisiae
ggcaactggaccatcgttat

SEQ ID NO: 6899 - DNA, 20 bp, Saccharomyces cerevisiae
gtctcgggttggtcagacat

SEQ ID NO: 6900 - DNA, 21 bp, Saccharomyces cerevisiae
tactttggtaaaagcacgcca

SEQ ID NO: 6901 - DNA, 20 bp, Saccharomyces cerevisiae
cgttagcaccttgcatcaaa

SEQ ID NO: 6902 - DNA, 20 bp, Saccharomyces cerevisiae
gatcattttcatgtgcgtgc

SEQ ID NO: 6903 - DNA, 20 bp, Saccharomyces cerevisiae
tgtctgagaacacaggtggc

SEQ ID NO: 6904 - DNA, 20 bp, Saccharomyces cerevisiae
gaggctcagtggacttgcat

SEQ ID NO: 6905 - DNA, 20 bp, Saccharomyces cerevisiae
ggctctttatcaacgccaat

SEQ ID NO: 6906 - DNA, 20 bp, Saccharomyces cerevisiae
ctgggaaatcttcacggtgt

SEQ ID NO: 6907 - DNA, 20 bp, Saccharomyces cerevisiae
atgtttatcagggcccacaa

SEQ ID NO: 6908 - DNA, 20 bp, Saccharomyces cerevisiae
ccatcataaccgtctgggat

SEQ ID NO: 6909 - DNA, 20 bp, Saccharomyces cerevisiae
gctcctgctatgagcattcc

SEQ ID NO: 6910 - DNA, 20 bp, Saccharomyces cerevisiae
tcatctgcaatgacaatggc

SEQ ID NO: 6911 - DNA, 20 bp, Saccharomyces cerevisiae
taaaagggcaattctggctg

SEQ ID NO: 6912 - DNA, 20 bp, Saccharomyces cerevisiae
atctttagcgcatgccaagt

SEQ ID NO: 6913 - DNA, 20 bp, Saccharomyces cerevisiae
ttcatggttggttttggtga

SEQ ID NO: 6914 - DNA, 22 bp, Saccharomyces cerevisiae
gcgaaagagttgaccaagagtt

SEQ ID NO: 6915 - DNA, 20 bp, Saccharomyces cerevisiae
tgcgggaggaaggtaaagta

SEQ ID NO: 6916 - DNA, 20 bp, Saccharomyces cerevisiae
ttgcgttcctctctcgttct

SEQ ID NO: 6917 - DNA, 21 bp, Saccharomyces cerevisiae
ggtttagatccaagattccgc

SEQ ID NO: 6918 - DNA, 20 bp, Saccharomyces cerevisiae
gctctttctccgtcgtcaac

SEQ ID NO: 6919 - DNA, 20 bp, Saccharomyces cerevisiae
tgatttgaactgggcaacag

SEQ ID NO: 6920 - DNA, 20 bp, Saccharomyces cerevisiae
atccagtgcaattaaaggcg

SEQ ID NO: 6921 - DNA, 20 bp, Saccharomyces cerevisiae
acctcttttcccctgtgacg

SEQ ID NO: 6922 - DNA, 20 bp, Saccharomyces cerevisiae
cgacgtgctcttttcgagat

SEQ ID NO: 6923 - DNA, 25 bp, Saccharomyces cerevisiae
tcaagacaaacaggttactataggg

SEQ ID NO: 6924 - DNA, 20 bp, Saccharomyces cerevisiae
ttagaggcgctcctggataa

SEQ ID NO: 6925 - DNA, 20 bp, Saccharomyces cerevisiae
cgacaaagactgcccagata

SEQ ID NO: 6926 - DNA, 20 bp, Saccharomyces cerevisiae
ttcctacatgataaggcccc

SEQ ID NO: 6927 - DNA, 20 bp, Saccharomyces cerevisiae
gggatcataccaccaccagt

SEQ ID NO: 6928 - DNA, 20 bp, Saccharomyces cerevisiae
acgcataaacatcattccga

SEQ ID NO: 6929 - DNA, 20 bp, Saccharomyces cerevisiae
tctggaaagctgtcatcgaa

SEQ ID NO: 6930 - DNA, 20 bp, Saccharomyces cerevisiae
tcggcatccacacattagaa

SEQ ID NO: 6931 - DNA, 20 bp, Saccharomyces cerevisiae
agtgtcacttggaaacgcct

SEQ ID NO: 6932 - DNA, 20 bp, Saccharomyces cerevisiae
accttccgtttctgacccat

SEQ ID NO: 6933 - DNA, 20 bp, Saccharomyces cerevisiae
ggggaaacttggatacgtga

SEQ ID NO: 6934 - DNA, 20 bp, Saccharomyces cerevisiae
ctgcggatgcatttactcag

SEQ ID NO: 6935 - DNA, 21 bp, Saccharomyces cerevisiae
cactctcgggaaaatgtgttt

SEQ ID NO: 6936 - DNA, 20 bp, Saccharomyces cerevisiae
gcgtcttcttcatccgaaac

SEQ ID NO: 6937 - DNA, 20 bp, Saccharomyces cerevisiae
ctgctgccattcactctcct

SEQ ID NO: 6938 - DNA, 20 bp, Saccharomyces cerevisiae
ttgttccttgataaaggcgg

SEQ ID NO: 6939 - DNA, 20 bp, Saccharomyces cerevisiae
acttgaggcagaagacggaa

SEQ ID NO: 6940 - DNA, 20 bp, Saccharomyces cerevisiae
tggcagaaatttagggatgc

SEQ ID NO: 6941 - DNA, 20 bp, Saccharomyces cerevisiae
tgctgagagaagcattcgtg

SEQ ID NO: 6942 - DNA, 20 bp, Saccharomyces cerevisiae
cgacttggaagctcctgttc

SEQ ID NO: 6943 - DNA, 20 bp, Saccharomyces cerevisiae
agcccattatttgctgggtc

SEQ ID NO: 6944 - DNA, 20 bp, Saccharomyces cerevisiae
tgaattccgcgaatgataca

SEQ ID NO: 6945 - DNA, 20 bp, Saccharomyces cerevisiae
tcctgtaaaaactccacgca

SEQ ID NO: 6946 - DNA, 20 bp, Saccharomyces cerevisiae
ggtacctcgatggcttcaaa

SEQ ID NO: 6947 - DNA, 20 bp, Saccharomyces cerevisiae
agcttcggcggtatctacaa

SEQ ID NO: 6948 - DNA, 20 bp, Saccharomyces cerevisiae
ggaaggccctaaccaaaagt

SEQ ID NO: 6949 - DNA, 20 bp, Saccharomyces cerevisiae
ctatggtcacggccagattt

SEQ ID NO: 6950 - DNA, 20 bp, Saccharomyces cerevisiae
tgaaaagtgagcaaatgcct

SEQ ID NO: 6951 - DNA, 20 bp, Saccharomyces cerevisiae
agtgtttttccgattgcgag

SEQ ID NO: 6952 - DNA, 20 bp, Saccharomyces cerevisiae
agaatcgcagatgggttttg

SEQ ID NO: 6953 - DNA, 20 bp, Saccharomyces cerevisiae
ttgaaatatcacgaaggggc

SEQ ID NO: 6954 - DNA, 20 bp, Saccharomyces cerevisiae
ccaaggttgcaccgtatctt

SEQ ID NO: 6955 - DNA, 20 bp, Saccharomyces cerevisiae
cggatacggttgatcgtctt

SEQ ID NO: 6956 - DNA, 20 bp, Saccharomyces cerevisiae
ggaagactaccaacaccgga

SEQ ID NO: 6957 - DNA, 20 bp, Saccharomyces cerevisiae
tttaatcgtggttcgcagtg

SEQ ID NO: 6958 - DNA, 20 bp, Saccharomyces cerevisiae
caatgatgttggcagtctgg

SEQ ID NO: 6959 - DNA, 20 bp, Saccharomyces cerevisiae
aatgaagtccggtgcaaatc

SEQ ID NO: 6960 - DNA, 20 bp, Saccharomyces cerevisiae
gcagcgaaaaaggaaaagtg

SEQ ID NO: 6961 - DNA, 21 bp, Saccharomyces cerevisiae
agcctgtggtgctataagtgc

SEQ ID NO: 6962 - DNA, 20 bp, Saccharomyces cerevisiae
accaatttcttcgtgccaac

SEQ ID NO: 6963 - DNA, 20 bp, Saccharomyces cerevisiae
ggtgcattgccgtctttatt

SEQ ID NO: 6964 - DNA, 20 bp, Saccharomyces cerevisiae
caaagagcaattgaggacga

SEQ ID NO: 6965 - DNA, 22 bp, Saccharomyces cerevisiae
cggttggtaaaatttatcctgg

SEQ ID NO: 6966 - DNA, 20 bp, Saccharomyces cerevisiae
cgattcacctttctccggta

SEQ ID NO: 6967 - DNA, 20 bp, Saccharomyces cerevisiae
aagtgacaagttctggcggt

SEQ ID NO: 6968 - DNA, 20 bp, Saccharomyces cerevisiae
aaatccaaggtacggtgtgc

SEQ ID NO: 6969 - DNA, 20 bp, Saccharomyces cerevisiae
ggtcctgatccaagttgtgc

SEQ ID NO: 6970 - DNA, 21 bp, Saccharomyces cerevisiae
gatgctcagctatttgggaaa

SEQ ID NO: 6971 - DNA, 20 bp, Saccharomyces cerevisiae
ttttgcagaaacacaaagcg

SEQ ID NO: 6972 - DNA, 20 bp, Saccharomyces cerevisiae
caagaaaagctacaagggcg

SEQ ID NO: 6973 - DNA, 20 bp, Saccharomyces cerevisiae
cctgcccgagacataggtta

SEQ ID NO: 6974 - DNA, 20 bp, Saccharomyces cerevisiae
gccatcaacgaatttaacgg

SEQ ID NO: 6975 - DNA, 21 bp, Saccharomyces cerevisiae
tgcagttgttagagaggggaa

SEQ ID NO: 6976 - DNA, 20 bp, Saccharomyces cerevisiae
caggagcgttcagaacatga

SEQ ID NO: 6977 - DNA, 20 bp, Saccharomyces cerevisiae
cactaccagcctgcttcctc

SEQ ID NO: 6978 - DNA, 20 bp, Saccharomyces cerevisiae
aatgcagcgttcctgtaagc

SEQ ID NO: 6979 - DNA, 20 bp, Saccharomyces cerevisiae
agttgggtgctttgatttgg

SEQ ID NO: 6980 - DNA, 20 bp, Saccharomyces cerevisiae
gagaggctgaaggcagagaa

SEQ ID NO: 6981 - DNA, 20 bp, Saccharomyces cerevisiae
gaggtcttcccaacaccaga

SEQ ID NO: 6982 - DNA, 20 bp, Saccharomyces cerevisiae
gaaatccgtaaagacgccaa

SEQ ID NO: 6983 - DNA, 20 bp, Saccharomyces cerevisiae
atatggattggaagccaacg

SEQ ID NO: 6984 - DNA, 21 bp, Saccharomyces cerevisiae
ttcttttccgtgaatttttcc

SEQ ID NO: 6985 - DNA, 20 bp, Saccharomyces cerevisiae
ttcattgggggacctttgta

SEQ ID NO: 6986 - DNA, 20 bp, Saccharomyces cerevisiae
agaagaagccaagtggtgga

SEQ ID NO: 6987 - DNA, 20 bp, Saccharomyces cerevisiae
caaggactctgttgttggca

SEQ ID NO: 6988 - DNA, 20 bp, Saccharomyces cerevisiae
accttgaaaccacagccaaa

SEQ ID NO: 6989 - DNA, 20 bp, Saccharomyces cerevisiae
gcctaattgtgggttatgcg

SEQ ID NO: 6990 - DNA, 20 bp, Saccharomyces cerevisiae
aaaattatggcaaacgcgag

SEQ ID NO: 6991 - DNA, 21 bp, Saccharomyces cerevisiae
catttgggaaaatcgtcatca

SEQ ID NO: 6992 - DNA, 20 bp, Saccharomyces cerevisiae
acttcaatggaaaggtcccc

SEQ ID NO: 6993 - DNA, 20 bp, Saccharomyces cerevisiae
acaaacggctccgtattcag

SEQ ID NO: 6994 - DNA, 20 bp, Saccharomyces cerevisiae
cagatcatttgccccattct

SEQ ID NO: 6995 - DNA, 20 bp, Saccharomyces cerevisiae
gaattaccatagcccaggca

SEQ ID NO: 6996 - DNA, 20 bp, Saccharomyces cerevisiae
cacggtcgcaggatagagat

SEQ ID NO: 6997 - DNA, 20 bp, Saccharomyces cerevisiae
cgaatcccagatattcgagc

SEQ ID NO: 6998 - DNA, 20 bp, Saccharomyces cerevisiae
acatgctgctaatcatggca

SEQ ID NO: 6999 - DNA, 20 bp, Saccharomyces cerevisiae
ggatgaattaattgccgcag

SEQ ID NO: 7000 - DNA, 20 bp, Saccharomyces cerevisiae
gactgcagaaaccaagacgc

SEQ ID NO: 7001 - DNA, 20 bp, Saccharomyces cerevisiae
ctctggctccattcgaggta

SEQ ID NO: 7002 - DNA, 20 bp, Saccharomyces cerevisiae
ccaggaaaatgcaagcacta

SEQ ID NO: 7003 - DNA, 22 bp, Saccharomyces cerevisiae
tcttaatgacgcattgttgctc

SEQ ID NO: 7004 - DNA, 20 bp, Saccharomyces cerevisiae
agaagagataacgtgggggc

SEQ ID NO: 7005 - DNA, 20 bp, Saccharomyces cerevisiae
caccaaatgttacgccctct

SEQ ID NO: 7006 - DNA, 20 bp, Saccharomyces cerevisiae
gacggtgcctttgactgttt

SEQ ID NO: 7007 - DNA, 20 bp, Saccharomyces cerevisiae
cttttattgccacgctttgg

SEQ ID NO: 7008 - DNA, 20 bp, Saccharomyces cerevisiae
ttgaattcacatttcgacgc

SEQ ID NO: 7009 - DNA, 20 bp, Saccharomyces cerevisiae
ttcaaaagttgagcaccacg

SEQ ID NO: 7010 - DNA, 20 bp, Saccharomyces cerevisiae
cgaaggttccacccatctaa

SEQ ID NO: 7011 - DNA, 20 bp, Saccharomyces cerevisiae
atcgtgatcgctggattttt

SEQ ID NO: 7012 - DNA, 20 bp, Saccharomyces cerevisiae
ggcactcggtaaatcgtcac

SEQ ID NO: 7013 - DNA, 20 bp, Saccharomyces cerevisiae
gggaaagcccatattcatca

SEQ ID NO: 7014 - DNA, 20 bp, Saccharomyces cerevisiae
cctcgggagatatcgaggat

SEQ ID NO: 7015 - DNA, 20 bp, Saccharomyces cerevisiae
gccttattgcgtttttccaa

SEQ ID NO: 7016 - DNA, 20 bp, Saccharomyces cerevisiae
gctctacgacgtggttggat

SEQ ID NO: 7017 - DNA, 20 bp, Saccharomyces cerevisiae
aggttgggaaattggcttct

SEQ ID NO: 7018 - DNA, 20 bp, Saccharomyces cerevisiae
gcctttgcaggatactgagg

SEQ ID NO: 7019 - DNA, 21 bp, Saccharomyces cerevisiae
ccacgatgaaggaactgactc

SEQ ID NO: 7020 - DNA, 20 bp, Saccharomyces cerevisiae
ttggaggttcaagtcatgga

SEQ ID NO: 7021 - DNA, 20 bp, Saccharomyces cerevisiae
tgactgctactttgttggcg

SEQ ID NO: 7022 - DNA, 20 bp, Saccharomyces cerevisiae
aaagaacggggctcttgatt

SEQ ID NO: 7023 - DNA, 20 bp, Saccharomyces cerevisiae
gtcgctggagtaggcttctg

SEQ ID NO: 7024 - DNA, 20 bp, Saccharomyces cerevisiae
tatgccttggactaaacggg

SEQ ID NO: 7025 - DNA, 20 bp, Saccharomyces cerevisiae
cctggatagttccgttgagc

SEQ ID NO: 7026 - DNA, 23 bp, Saccharomyces cerevisiae
tcagtggaagtgataacagacca

SEQ ID NO: 7027 - DNA, 20 bp, Saccharomyces cerevisiae
tcgaatatgaggctgaacga

SEQ ID NO: 7028 - DNA, 21 bp, Saccharomyces cerevisiae
cgacaaaatacagtgggatgg

SEQ ID NO: 7029 - DNA, 20 bp, Saccharomyces cerevisiae
ctggagcagacattgggaat

SEQ ID NO: 7030 - DNA, 20 bp, Saccharomyces cerevisiae
acaaatcgttggtaccgtgc

SEQ ID NO: 7031 - DNA, 20 bp, Saccharomyces cerevisiae
aaaatctttcccttttcggc

SEQ ID NO: 7032 - DNA, 20 bp, Saccharomyces cerevisiae
acgaactttcccctccatct

SEQ ID NO: 7033 - DNA, 20 bp, Saccharomyces cerevisiae
tgcctccagcaagagtaaca

SEQ ID NO: 7034 - DNA, 22 bp, Saccharomyces cerevisiae
attagattattggaaaggcgca

SEQ ID NO: 7035 - DNA, 19 bp, Saccharomyces cerevisiae
agtgattggccgttccttc

SEQ ID NO: 7036 - DNA, 20 bp, Saccharomyces cerevisiae
ttgatggtatcagtgtccgc

SEQ ID NO: 7037 - DNA, 20 bp, Saccharomyces cerevisiae
aggtcttggtaggaacgggt

SEQ ID NO: 7038 - DNA, 20 bp, Saccharomyces cerevisiae
atgtttgaaccaccctgagc

SEQ ID NO: 7039 - DNA, 22 bp, Saccharomyces cerevisiae
cgaataatgttgaagagggtga

SEQ ID NO: 7040 - DNA, 20 bp, Saccharomyces cerevisiae
cgaaggctcctatcgtcatc

SEQ ID NO: 7041 - DNA, 20 bp, Saccharomyces cerevisiae
atccaacaacaatgggcaat

SEQ ID NO: 7042 - DNA, 21 bp, Saccharomyces cerevisiae
tctgatcggtgataatcctgg

SEQ ID NO: 7043 - DNA, 20 bp, Saccharomyces cerevisiae
tagagtttggtggcttgcct

SEQ ID NO: 7044 - DNA, 20 bp, Saccharomyces cerevisiae
tgcttggcgctaacctctat

SEQ ID NO: 7045 - DNA, 20 bp, Saccharomyces cerevisiae
ggacgaacgtgggaataatg

SEQ ID NO: 7046 - DNA, 20 bp, Saccharomyces cerevisiae
cattaccgtggaaggttgct

SEQ ID NO: 7047 - DNA, 23 bp, Saccharomyces cerevisiae
aacccttcatgatcaaaaactga

SEQ ID NO: 7048 - DNA, 20 bp, Saccharomyces cerevisiae
cggatcttgaaaaacgcaat

SEQ ID NO: 7049 - DNA, 20 bp, Saccharomyces cerevisiae
gacttggtagcccgaagtca

SEQ ID NO: 7050 - DNA, 20 bp, Saccharomyces cerevisiae
tactcctgtttcccgaatgc

SEQ ID NO: 7051 - DNA, 20 bp, Saccharomyces cerevisiae
aatccgatttgagcgatttg

SEQ ID NO: 7052 - DNA, 20 bp, Saccharomyces cerevisiae
gttaaaaccacagcgggaag

SEQ ID NO: 7053 - DNA, 20 bp, Saccharomyces cerevisiae
ttcatcaagaccgcgacata

SEQ ID NO: 7054 - DNA, 25 bp, Saccharomyces cerevisiae
ttgcttatgtgttcatttattctcg

SEQ ID NO: 7055 - DNA, 20 bp, Saccharomyces cerevisiae
atcaatcaactgcacgaacg

SEQ ID NO: 7056 - DNA, 23 bp, Saccharomyces cerevisiae
ttcgctgaacattttatgtgatg

SEQ ID NO: 7057 - DNA, 20 bp, Saccharomyces cerevisiae
cggtcaggtgttgatcgtta

SEQ ID NO: 7058 - DNA, 20 bp, Saccharomyces cerevisiae
agcgacttgtcagggttcag

SEQ ID NO: 7059 - DNA, 23 bp, Saccharomyces cerevisiae
gatccagctttaacattttctgg

SEQ ID NO: 7060 - DNA, 24 bp, Saccharomyces cerevisiae
tccgtgagttagtaggaacattca

SEQ ID NO: 7061 - DNA, 20 bp, Saccharomyces cerevisiae
atccagaagcgggacctact

SEQ ID NO: 7062 - DNA, 20 bp, Saccharomyces cerevisiae
cctcgtcaaaatcgaaggag

SEQ ID NO: 7063 - DNA, 20 bp, Saccharomyces cerevisiae
cgcttctggcgaaatctaaa

SEQ ID NO: 7064 - DNA, 20 bp, Saccharomyces cerevisiae
ccacgagcattgtgttgtgt

SEQ ID NO: 7065 - DNA, 20 bp, Saccharomyces cerevisiae
tcgtagttttgggccttctc

SEQ ID NO: 7066 - DNA, 20 bp, Saccharomyces cerevisiae
aacttatgccaacgtgacca

SEQ ID NO: 7067 - DNA, 22 bp, Saccharomyces cerevisiae
tttcacaagcactaagggagag

SEQ ID NO: 7068 - DNA, 24 bp, Saccharomyces cerevisiae
ggcctttaacaacaataaaattcc

SEQ ID NO: 7069 - DNA, 20 bp, Saccharomyces cerevisiae
accttatctggcgctcacac

SEQ ID NO: 7070 - DNA, 20 bp, Saccharomyces cerevisiae
cataatcggagtcggagtcg

SEQ ID NO: 7071 - DNA, 20 bp, Saccharomyces cerevisiae
aacgagttcttcgcttctgc

SEQ ID NO: 7072 - DNA, 20 bp, Saccharomyces cerevisiae
tgcaggtctgatttctgctc

SEQ ID NO: 7073 - DNA, 20 bp, Saccharomyces cerevisiae
catgacatgttgggaatgga

SEQ ID NO: 7074 - DNA, 20 bp, Saccharomyces cerevisiae
ggcacagcacacactctgtt

SEQ ID NO: 7075 - DNA, 21 bp, Saccharomyces cerevisiae
agacaccagatatgcggaaaa

SEQ ID NO: 7076 - DNA, 20 bp, Saccharomyces cerevisiae
cgaggcaaaactgaaggaaa

SEQ ID NO: 7077 - DNA, 20 bp, Saccharomyces cerevisiae
tggctctgatgtctcgtcaa

SEQ ID NO: 7078 - DNA, 20 bp, Saccharomyces cerevisiae
gattgcctagcccatttgaa

SEQ ID NO: 7079 - DNA, 20 bp, Saccharomyces cerevisiae
ggaaaggctcgtcatttgtc

SEQ ID NO: 7080 - DNA, 20 bp, Saccharomyces cerevisiae
tgacgggtctttcacctttt

SEQ ID NO: 7081 - DNA, 20 bp, Saccharomyces cerevisiae
gtcatggcgaatagtgcaaa

SEQ ID NO: 7082 - DNA, 20 bp, Saccharomyces cerevisiae
cgctggtaagttgatgcaaa

SEQ ID NO: 7083 - DNA, 24 bp, Saccharomyces cerevisiae
aaaataccggtgaatatcggtaaa

SEQ ID NO: 7084 - DNA, 22 bp, Saccharomyces cerevisiae
ggagacgaatattaatgcctgc

SEQ ID NO: 7085 - DNA, 20 bp, Saccharomyces cerevisiae
tggtgctaggtggtgatgaa

SEQ ID NO: 7086 - DNA, 20 bp, Saccharomyces cerevisiae
gaaaattgggcaatcgagaa

SEQ ID NO: 7087 - DNA, 20 bp, Saccharomyces cerevisiae
atggcttccccgctatactt

SEQ ID NO: 7088 - DNA, 20 bp, Saccharomyces cerevisiae
tggaaaaaggtgaaaaccca

SEQ ID NO: 7089 - DNA, 25 bp, Saccharomyces cerevisiae
tcgcatatatgtcattcataaaacg

SEQ ID NO: 7090 - DNA, 20 bp, Saccharomyces cerevisiae
tacgataccgttacccgagg

SEQ ID NO: 7091 - DNA, 20 bp, Saccharomyces cerevisiae
ttggtaccagcaatgtcgag

SEQ ID NO: 7092 - DNA, 20 bp, Saccharomyces cerevisiae
acgcctttttcctttccttc

SEQ ID NO: 7093 - DNA, 20 bp, Saccharomyces cerevisiae
gatgagcttgcgtgttgaga

SEQ ID NO: 7094 - DNA, 20 bp, Saccharomyces cerevisiae
cggcgaaaacaaattcaact

SEQ ID NO: 7095 - DNA, 24 bp, Saccharomyces cerevisiae
cccttttcaaaaatatgtaagcca

SEQ ID NO: 7096 - DNA, 20 bp, Saccharomyces cerevisiae
tcctaaacgtctacccggtg

SEQ ID NO: 7097 - DNA, 20 bp, Saccharomyces cerevisiae
tattctcagggtggagccag

SEQ ID NO: 7098 - DNA, 20 bp, Saccharomyces cerevisiae
acggataacacgtcggctac

SEQ ID NO: 7099 - DNA, 23 bp, Saccharomyces cerevisiae
cgaaactgagaaggaagaagtga

SEQ ID NO: 7100 - DNA, 20 bp, Saccharomyces cerevisiae
atttcgaaaggggttatggg

SEQ ID NO: 7101 - DNA, 20 bp, Saccharomyces cerevisiae
acagtgcgctctctacccat

SEQ ID NO: 7102 - DNA, 20 bp, Saccharomyces cerevisiae
ttcaggcctagttttgagcc

SEQ ID NO: 7103 - DNA, 20 bp, Saccharomyces cerevisiae
ttcctttcgtggcctctgta

SEQ ID NO: 7104 - DNA, 20 bp, Saccharomyces cerevisiae
ccagggcttgtcactagagc

SEQ ID NO: 7105 - DNA, 20 bp, Saccharomyces cerevisiae
atgtatgtttttccggacgc

SEQ ID NO: 7106 - DNA, 20 bp, Saccharomyces cerevisiae
gatcagctgccattttaggc

SEQ ID NO: 7107 - DNA, 20 bp, Saccharomyces cerevisiae
gcgaaaaggctggtatcaaa

SEQ ID NO: 7108 - DNA, 25 bp, Saccharomyces cerevisiae
atgttggaataaaaaccaactatcg

SEQ ID NO: 7109 - DNA, 20 bp, Saccharomyces cerevisiae
tggagtgcagtattgagcgt

SEQ ID NO: 7110 - DNA, 20 bp, Saccharomyces cerevisiae
aacaatgctttcttatggcg

SEQ ID NO: 7111 - DNA, 20 bp, Saccharomyces cerevisiae
cctcctccctagcttcgtct

SEQ ID NO: 7112 - DNA, 20 bp, Saccharomyces cerevisiae
agtggactactgcgggagaa

SEQ ID NO: 7113 - DNA, 20 bp, Saccharomyces cerevisiae
aaccctagccagaccatcaa

SEQ ID NO: 7114 - DNA, 25 bp, Saccharomyces cerevisiae
agtaggttagctaaggaaggcagag

SEQ ID NO: 7115 - DNA, 20 bp, Saccharomyces cerevisiae
gctagccattgctaccaagc

SEQ ID NO: 7116 - DNA, 20 bp, Saccharomyces cerevisiae
tcaagtgaatgacggttgga

SEQ ID NO: 7117 - DNA, 20 bp, Saccharomyces cerevisiae
gagctagcgtccagctatcg

SEQ ID NO: 7118 - DNA, 20 bp, Saccharomyces cerevisiae
agaaactccagcgcctacaa

SEQ ID NO: 7119 - DNA, 20 bp, Saccharomyces cerevisiae
gccctggagtgtctatggaa

SEQ ID NO: 7120 - DNA, 20 bp, Saccharomyces cerevisiae
taccttcaatcgacttgggc

SEQ ID NO: 7121 - DNA, 20 bp, Saccharomyces cerevisiae
ttcctaggcgagctaggtga

SEQ ID NO: 7122 - DNA, 23 bp, Saccharomyces cerevisiae
caaaattttcatgtcatgctcaa

SEQ ID NO: 7123 - DNA, 20 bp, Saccharomyces cerevisiae
ctttactttgccggttcagc

SEQ ID NO: 7124 - DNA, 20 bp, Saccharomyces cerevisiae
gcccggcttaattgttgtta

SEQ ID NO: 7125 - DNA, 20 bp, Saccharomyces cerevisiae
atgaatcgttggaaggacca

SEQ ID NO: 7126 - DNA, 20 bp, Saccharomyces cerevisiae
gtaagggttgacaggccaga

SEQ ID NO: 7127 - DNA, 20 bp, Saccharomyces cerevisiae
atgcaatggaacgctttttc

SEQ ID NO: 7128 - DNA, 20 bp, Saccharomyces cerevisiae
gtttcatggacgcatagtgg

SEQ ID NO: 7129 - DNA, 20 bp, Saccharomyces cerevisiae
atcaaatgaactcgaacggc

SEQ ID NO: 7130 - DNA, 20 bp, Saccharomyces cerevisiae
gaacaccatgggtctcatcc

SEQ ID NO: 7131 - DNA, 20 bp, Saccharomyces cerevisiae
ttctttgcagcatcgaaatg

SEQ ID NO: 7132 - DNA, 20 bp, Saccharomyces cerevisiae
gagcaagtccggttcttctg

SEQ ID NO: 7133 - DNA, 20 bp, Saccharomyces cerevisiae
caaaaccgaattttgggaaa

SEQ ID NO: 7134 - DNA, 22 bp, Saccharomyces cerevisiae
cggtgttctacaaaacaacgaa

SEQ ID NO: 7135 - DNA, 20 bp, Saccharomyces cerevisiae
tgaacgccttctgcatcata

SEQ ID NO: 7136 - DNA, 20 bp, Saccharomyces cerevisiae
tacacattcctacgaggccc

SEQ ID NO: 7137 - DNA, 20 bp, Saccharomyces cerevisiae
ctggatgggcgtgattgtat

SEQ ID NO: 7138 - DNA, 20 bp, Saccharomyces cerevisiae
actgccaaaaagccttctca

SEQ ID NO: 7139 - DNA, 20 bp, Saccharomyces cerevisiae
gtggcgtttgttcaatgatg

SEQ ID NO: 7140 - DNA, 20 bp, Saccharomyces cerevisiae
gtgtcgggttgactggaagt

SEQ ID NO: 7141 - DNA, 20 bp, Saccharomyces cerevisiae
ggaaatgggggagcattatt

SEQ ID NO: 7142 - DNA, 20 bp, Saccharomyces cerevisiae
tgcgctaactgcgttaatga

SEQ ID NO: 7143 - DNA, 20 bp, Saccharomyces cerevisiae
gctacaagaacttccgccac

SEQ ID NO: 7144 - DNA, 20 bp, Saccharomyces cerevisiae
gcgtatttggtgaagggtgt

SEQ ID NO: 7145 - DNA, 20 bp, Saccharomyces cerevisiae
aatgaccacttccttacggc

SEQ ID NO: 7146 - DNA, 20 bp, Saccharomyces cerevisiae
gcaaacgtcgtaccaatcct

SEQ ID NO: 7147 - DNA, 20 bp, Saccharomyces cerevisiae
caactgacatttcgcacagc

SEQ ID NO: 7148 - DNA, 23 bp, Saccharomyces cerevisiae
gatgagcttatcaaacaggatgg

SEQ ID NO: 7149 - DNA, 20 bp, Saccharomyces cerevisiae
atgaatcacacgcactcagc

SEQ ID NO: 7150 - DNA, 20 bp, Saccharomyces cerevisiae
atgtatgacctttcgctccg

SEQ ID NO: 7151 - DNA, 20 bp, Saccharomyces cerevisiae
gatctcagtcgtcgcaaaaa

SEQ ID NO: 7152 - DNA, 20 bp, Saccharomyces cerevisiae
gtcccaaataacgactgcgt

SEQ ID NO: 7153 - DNA, 20 bp, Saccharomyces cerevisiae
ttacgcccaacaatgcagta

SEQ ID NO: 7154 - DNA, 20 bp, Saccharomyces cerevisiae
accattgctgaaactttggc

SEQ ID NO: 7155 - DNA, 20 bp, Saccharomyces cerevisiae
agcaacattaaggggctggt

SEQ ID NO: 7156 - DNA, 20 bp, Saccharomyces cerevisiae
gaatctgccccgatgaagta

SEQ ID NO: 7157 - DNA, 20 bp, Saccharomyces cerevisiae
tgtgcctagcagttcaggag

SEQ ID NO: 7158 - DNA, 20 bp, Saccharomyces cerevisiae
ttgccaatcggacaacacta

SEQ ID NO: 7159 - DNA, 20 bp, Saccharomyces cerevisiae
ttgacaaagattcgctggaa

SEQ ID NO: 7160 - DNA, 20 bp, Saccharomyces cerevisiae
gctgctgctttagtcggttc

SEQ ID NO: 7161 - DNA, 20 bp, Saccharomyces cerevisiae
ccaaatgcgacatgagtcac

SEQ ID NO: 7162 - DNA, 20 bp, Saccharomyces cerevisiae
agcggacatctgccttttta

SEQ ID NO: 7163 - DNA, 20 bp, Saccharomyces cerevisiae
ttcatttcgtttccggtttc

SEQ ID NO: 7164 - DNA, 20 bp, Saccharomyces cerevisiae
caaggctaacgatgatgtgc

SEQ ID NO: 7165 - DNA, 20 bp, Saccharomyces cerevisiae
aacggatgattgggatgaag

SEQ ID NO: 7166 - DNA, 20 bp, Saccharomyces cerevisiae
gcgcagaaggttttgagaag

SEQ ID NO: 7167 - DNA, 20 bp, Saccharomyces cerevisiae
tgagacctgacattagcgga

SEQ ID NO: 7168 - DNA, 20 bp, Saccharomyces cerevisiae
ttgttggaagcaacttgagc

SEQ ID NO: 7169 - DNA, 20 bp, Saccharomyces cerevisiae
ttctgcaccatcagaacctg

SEQ ID NO: 7170 - DNA, 20 bp, Saccharomyces cerevisiae
agttgcacacaaacactggg

SEQ ID NO: 7171 - DNA, 20 bp, Saccharomyces cerevisiae
atgacaccaatgggggacta

SEQ ID NO: 7172 - DNA, 20 bp, Saccharomyces cerevisiae
tgagaacaaaccgacaccag

SEQ ID NO: 7173 - DNA, 20 bp, Saccharomyces cerevisiae
gctttatatgcgccatggtt

SEQ ID NO: 7174 - DNA, 20 bp, Saccharomyces cerevisiae
gcaacgattctgtccaacaa

SEQ ID NO: 7175 - DNA, 25 bp, Saccharomyces cerevisiae
ttttgtacttcatcctactttcgtg

SEQ ID NO: 7176 - DNA, 20 bp, Saccharomyces cerevisiae
gcatacgtttcatgtttgcc

SEQ ID NO: 7177 - DNA, 20 bp, Saccharomyces cerevisiae
gcctcgtgtatcccgaagta

SEQ ID NO: 7178 - DNA, 20 bp, Saccharomyces cerevisiae
gaggtttagcacttggctcg

SEQ ID NO: 7179 - DNA, 20 bp, Saccharomyces cerevisiae
agggaggcgatggttctatt

SEQ ID NO: 7180 - DNA, 20 bp, Saccharomyces cerevisiae
tatcgttgtagggggttgga

SEQ ID NO: 7181 - DNA, 20 bp, Saccharomyces cerevisiae
tcctagccttgagccgtaaa

SEQ ID NO: 7182 - DNA, 20 bp, Saccharomyces cerevisiae
agcgctagggagcacagata

SEQ ID NO: 7183 - DNA, 20 bp, Saccharomyces cerevisiae
agatttagggaagccatccg

SEQ ID NO: 7184 - DNA, 20 bp, Saccharomyces cerevisiae
cattgtctggttgacgatgc

SEQ ID NO: 7185 - DNA, 20 bp, Saccharomyces cerevisiae
tggcatttgaggactgtgag

SEQ ID NO: 7186 - DNA, 20 bp, Saccharomyces cerevisiae
aaattcccattgcctcacag

SEQ ID NO: 7187 - DNA, 20 bp, Saccharomyces cerevisiae
gaacctcgaattgacttggc

SEQ ID NO: 7188 - DNA, 20 bp, Saccharomyces cerevisiae
gaaagcgaattgaatgccag

SEQ ID NO: 7189 - DNA, 20 bp, Saccharomyces cerevisiae
tgatgatttggcctggtttt

SEQ ID NO: 7190 - DNA, 20 bp, Saccharomyces cerevisiae
gcctgcaaaagtggagtcat

SEQ ID NO: 7191 - DNA, 20 bp, Saccharomyces cerevisiae
tgaaagcaaaaatgggttcc

SEQ ID NO: 7192 - DNA, 20 bp, Saccharomyces cerevisiae
tcagggtgctcatcctcttt

SEQ ID NO: 7193 - DNA, 22 bp, Saccharomyces cerevisiae
tcggttaaagcaattaagcaaa

SEQ ID NO: 7194 - DNA, 20 bp, Saccharomyces cerevisiae
gaaaagaacgaccaagccag

SEQ ID NO: 7195 - DNA, 20 bp, Saccharomyces cerevisiae
ttcaccagcttcaggttttg

SEQ ID NO: 7196 - DNA, 20 bp, Saccharomyces cerevisiae
aggacatttgtacccgcaat

SEQ ID NO: 7197 - DNA, 20 bp, Saccharomyces cerevisiae
ggcgaaattaacccttccat

SEQ ID NO: 7198 - DNA, 20 bp, Saccharomyces cerevisiae
tgcaaaggacctgttcaatg

SEQ ID NO: 7199 - DNA, 20 bp, Saccharomyces cerevisiae
tcggttacacacatccctga

SEQ ID NO: 7200 - DNA, 20 bp, Saccharomyces cerevisiae
ggggaggtggaaaagaaaag

SEQ ID NO: 7201 - DNA, 20 bp, Saccharomyces cerevisiae
ggtgcaacgttaacagcaga

SEQ ID NO: 7202 - DNA, 21 bp, Saccharomyces cerevisiae
agatcgctgaacgaaagatga

SEQ ID NO: 7203 - DNA, 20 bp, Saccharomyces cerevisiae
ttggtgtctctgacggatga

SEQ ID NO: 7204 - DNA, 20 bp, Saccharomyces cerevisiae
taagctcataagggaacccg

SEQ ID NO: 7205 - DNA, 20 bp, Saccharomyces cerevisiae
gcaccacttggtccagtttt

SEQ ID NO: 7206 - DNA, 20 bp, Saccharomyces cerevisiae
caaggaagaaccaaagcctg

SEQ ID NO: 7207 - DNA, 20 bp, Saccharomyces cerevisiae
ctcgaacaaaccaggacgat

SEQ ID NO: 7208 - DNA, 20 bp, Saccharomyces cerevisiae
tgaaacgcaggagactatcg

SEQ ID NO: 7209 - DNA, 20 bp, Saccharomyces cerevisiae
ggtgcaagtggaaagaaagg

SEQ ID NO: 7210 - DNA, 20 bp, Saccharomyces cerevisiae
gaaatgtgcgttcaaaggct

SEQ ID NO: 7211 - DNA, 20 bp, Saccharomyces cerevisiae
tttttcttccactgttgcca

SEQ ID NO: 7212 - DNA, 20 bp, Saccharomyces cerevisiae
cctcatgtcactgcgcttta

SEQ ID NO: 7213 - DNA, 20 bp, Saccharomyces cerevisiae
ccgcccttgatagagttgaa

SEQ ID NO: 7214 - DNA, 20 bp, Saccharomyces cerevisiae
acgtcggaacaactcaggac

SEQ ID NO: 7215 - DNA, 20 bp, Saccharomyces cerevisiae
aatatttcccttggcctgct

SEQ ID NO: 7216 - DNA, 20 bp, Saccharomyces cerevisiae
aagagaatgcgaagcggtaa

SEQ ID NO: 7217 - DNA, 20 bp, Saccharomyces cerevisiae
ggttctgggtttggtcaaga

SEQ ID NO: 7218 - DNA, 20 bp, Saccharomyces cerevisiae
tttcaaagcctgcacctctt

SEQ ID NO: 7219 - DNA, 20 bp, Saccharomyces cerevisiae
tctcgatgcacgtctggata

SEQ ID NO: 7220 - DNA, 20 bp, Saccharomyces cerevisiae
aagtggcagaaagaaagcca

SEQ ID NO: 7221 - DNA, 27 bp, Saccharomyces cerevisiae
tctcttatgagcctagctactttgttt

SEQ ID NO: 7222 - DNA, 20 bp, Saccharomyces cerevisiae
gggtcttcgaaaaagccttc

SEQ ID NO: 7223 - DNA, 20 bp, Saccharomyces cerevisiae
tatcgctgcaaaaatggtga

SEQ ID NO: 7224 - DNA, 20 bp, Saccharomyces cerevisiae
tggtgaaaggtagcgctttt

SEQ ID NO: 7225 - DNA, 20 bp, Saccharomyces cerevisiae
caaccatctcatccccaaac

SEQ ID NO: 7226 - DNA, 20 bp, Saccharomyces cerevisiae
atgggggcattgaattgata

SEQ ID NO: 7227 - DNA, 20 bp, Saccharomyces cerevisiae
acattggctgagagtgggac

SEQ ID NO: 7228 - DNA, 20 bp, Saccharomyces cerevisiae
ccgagcggttaaaaagaaaa

SEQ ID NO: 7229 - DNA, 20 bp, Saccharomyces cerevisiae
ctgcgttgagatttgacgaa

SEQ ID NO: 7230 - DNA, 20 bp, Saccharomyces cerevisiae
cttcgtgtgacatcgttgct

SEQ ID NO: 7231 - DNA, 20 bp, Saccharomyces cerevisiae
gggacccctgttctgttttt

SEQ ID NO: 7232 - DNA, 20 bp, Saccharomyces cerevisiae
accaaccgcttcttatggtc

SEQ ID NO: 7233 - DNA, 21 bp, Saccharomyces cerevisiae
aataggttcgggtaaaacgga

SEQ ID NO: 7234 - DNA, 20 bp, Saccharomyces cerevisiae
tccctaaaagcgaaccagaa

SEQ ID NO: 7235 - DNA, 20 bp, Saccharomyces cerevisiae
gcgcaagaaagaggaaaatg

SEQ ID NO: 7236 - DNA, 20 bp, Saccharomyces cerevisiae
gaaggtgcattggaggacat

SEQ ID NO: 7237 - DNA, 20 bp, Saccharomyces cerevisiae
gtgcctttgccaacttcaat

SEQ ID NO: 7238 - DNA, 20 bp, Saccharomyces cerevisiae
ttagtggttcccggttcttg

SEQ ID NO: 7239 - DNA, 21 bp, Saccharomyces cerevisiae
ggcaatgaccaatatgaaacg

SEQ ID NO: 7240 - DNA, 20 bp, Saccharomyces cerevisiae
aaaagaggctgtaggcgatg

SEQ ID NO: 7241 - DNA, 20 bp, Saccharomyces cerevisiae
ctcttttatacatcgccgca

SEQ ID NO: 7242 - DNA, 23 bp, Saccharomyces cerevisiae
tcgagaccttgacgtataggaaa

SEQ ID NO: 7243 - DNA, 20 bp, Saccharomyces cerevisiae
caaaagaccttggatctggg

SEQ ID NO: 7244 - DNA, 20 bp, Saccharomyces cerevisiae
ggtggtgggctaaatcacag

SEQ ID NO: 7245 - DNA, 20 bp, Saccharomyces cerevisiae
accggtgcaccttctgttac

SEQ ID NO: 7246 - DNA, 23 bp, Saccharomyces cerevisiae
tgaaaacaaccatgaaaaactca

SEQ ID NO: 7247 - DNA, 21 bp, Saccharomyces cerevisiae
gctcgtactgtttcatttggg

SEQ ID NO: 7248 - DNA, 22 bp, Saccharomyces cerevisiae
aacattatgtgcgttctcatcg

SEQ ID NO: 7249 - DNA, 20 bp, Saccharomyces cerevisiae
aagggtcacgagcatagcag

SEQ ID NO: 7250 - DNA, 20 bp, Saccharomyces cerevisiae
tttagcaaacgaggcgttct

SEQ ID NO: 7251 - DNA, 25 bp, Saccharomyces cerevisiae
cgatcataattgactagtaacgcaa

SEQ ID NO: 7252 - DNA, 20 bp, Saccharomyces cerevisiae
cgcccaattacaggacatct

SEQ ID NO: 7253 - DNA, 20 bp, Saccharomyces cerevisiae
aggcgaacaaaatgaagacg

SEQ ID NO: 7254 - DNA, 20 bp, Saccharomyces cerevisiae
atttctggaagggcctatcg

SEQ ID NO: 7255 - DNA, 20 bp, Saccharomyces cerevisiae
ccaaccaatgagaaattggc

SEQ ID NO: 7256 - DNA, 24 bp, Saccharomyces cerevisiae
cgtgggtgtttacctaagattttc

SEQ ID NO: 7257 - DNA, 20 bp, Saccharomyces cerevisiae
cggtttcctggatttttgag

SEQ ID NO: 7258 - DNA, 20 bp, Saccharomyces cerevisiae
cttggcaactctacacgctg

SEQ ID NO: 7259 - DNA, 20 bp, Saccharomyces cerevisiae
ggcgttgttgcaaggactat

SEQ ID NO: 7260 - DNA, 20 bp, Saccharomyces cerevisiae
tgcagactggcccttaagtt

SEQ ID NO: 7261 - DNA, 20 bp, Saccharomyces cerevisiae
agctggtgcatggagcttat

SEQ ID NO: 7262 - DNA, 20 bp, Saccharomyces cerevisiae
cgccctgtaaaatatccgaa

SEQ ID NO: 7263 - DNA, 20 bp, Saccharomyces cerevisiae
cgcaacgacgctacaaataa

SEQ ID NO: 7264 - DNA, 20 bp, Saccharomyces cerevisiae
catgaacttttgcgtttgga

SEQ ID NO: 7265 - DNA, 20 bp, Saccharomyces cerevisiae
cgtacatggcacaaccaatc

SEQ ID NO: 7266 - DNA, 20 bp, Saccharomyces cerevisiae
gaaggacgtcatttgcgaac

SEQ ID NO: 7267 - DNA, 22 bp, Saccharomyces cerevisiae
tccattcgaactagacgagtca

SEQ ID NO: 7268 - DNA, 20 bp, Saccharomyces cerevisiae
aacacagtggagccttgtcc

SEQ ID NO: 7269 - DNA, 20 bp, Saccharomyces cerevisiae
gggctccttaacgtcctttc

SEQ ID NO: 7270 - DNA, 20 bp, Saccharomyces cerevisiae
tctgttcaagacatgctggc

SEQ ID NO: 7271 - DNA, 20 bp, Saccharomyces cerevisiae
cattgtgaggagccgtatga

SEQ ID NO: 7272 - DNA, 20 bp, Saccharomyces cerevisiae
accgattttggagaaagcct

SEQ ID NO: 7273 - DNA, 20 bp, Saccharomyces cerevisiae
tggtaaagaggcgcaagatt

SEQ ID NO: 7274 - DNA, 20 bp, Saccharomyces cerevisiae
aattaccgaggcaacgttct

SEQ ID NO: 7275 - DNA, 20 bp, Saccharomyces cerevisiae
atattctccgcttcgtctgg

SEQ ID NO: 7276 - DNA, 20 bp, Saccharomyces cerevisiae
aagtttgtgccttggagagc

SEQ ID NO: 7277 - DNA, 20 bp, Saccharomyces cerevisiae
tttaaaaatgcggtgaccag

SEQ ID NO: 7278 - DNA, 22 bp, Saccharomyces cerevisiae
gatttccacggttattgaggtc

SEQ ID NO: 7279 - DNA, 20 bp, Saccharomyces cerevisiae
cttgccaggtttcaaaagga

SEQ ID NO: 7280 - DNA, 20 bp, Saccharomyces cerevisiae
ttccacgttagtggggtgat

SEQ ID NO: 7281 - DNA, 20 bp, Saccharomyces cerevisiae
tcccctgggttttgtagaag

SEQ ID NO: 7282 - DNA, 20 bp, Saccharomyces cerevisiae
gcagctctctttgcagcttt

SEQ ID NO: 7283 - DNA, 20 bp, Saccharomyces cerevisiae
gcaccaggacgttgaagaat

SEQ ID NO: 7284 - DNA, 20 bp, Saccharomyces cerevisiae
cgcttttgatctgggttagc

SEQ ID NO: 7285 - DNA, 20 bp, Saccharomyces cerevisiae
gggtgtctctgaattttggc

SEQ ID NO: 7286 - DNA, 20 bp, Saccharomyces cerevisiae
tttcagggtggtgaaccagt

SEQ ID NO: 7287 - DNA, 20 bp, Saccharomyces cerevisiae
atgaattaccgctcccatga

SEQ ID NO: 7288 - DNA, 20 bp, Saccharomyces cerevisiae
tccctgtgccgagaatttac

SEQ ID NO: 7289 - DNA, 20 bp, Saccharomyces cerevisiae
gagcagtaaacgcaacacga

SEQ ID NO: 7290 - DNA, 20 bp, Saccharomyces cerevisiae
caccaaccaaggctttttgt

SEQ ID NO: 7291 - DNA, 20 bp, Saccharomyces cerevisiae
gcacgcttccctcaatctta

SEQ ID NO: 7292 - DNA, 20 bp, Saccharomyces cerevisiae
tcaccattttcagtgctcca

SEQ ID NO: 7293 - DNA, 20 bp, Saccharomyces cerevisiae
tgtctctgatgtcgcaggac

SEQ ID NO: 7294 - DNA, 20 bp, Saccharomyces cerevisiae
tttgccatttgttcgttctg

SEQ ID NO: 7295 - DNA, 20 bp, Saccharomyces cerevisiae
tgatgctggccaataaacaa

SEQ ID NO: 7296 - DNA, 20 bp, Saccharomyces cerevisiae
attctgtccatggtcaacgg

SEQ ID NO: 7297 - DNA, 20 bp, Saccharomyces cerevisiae
ttaacgaggaagcctgaacg

SEQ ID NO: 7298 - DNA, 20 bp, Saccharomyces cerevisiae
accatgcagtttgatgggtt

SEQ ID NO: 7299 - DNA, 20 bp, Saccharomyces cerevisiae
agcaaaaagcatccaggaga

SEQ ID NO: 7300 - DNA, 20 bp, Saccharomyces cerevisiae
ttagacgggaaatgtcgagc

SEQ ID NO: 7301 - DNA, 25 bp, Saccharomyces cerevisiae
acaaaataatgaagcacaagagacc

SEQ ID NO: 7302 - DNA, 20 bp, Saccharomyces cerevisiae
tcgagtccagatgggttagc

SEQ ID NO: 7303 - DNA, 20 bp, Saccharomyces cerevisiae
acattggcgtttgaggtgtt

SEQ ID NO: 7304 - DNA, 20 bp, Saccharomyces cerevisiae
acatgaagtggcggaacagt

SEQ ID NO: 7305 - DNA, 20 bp, Saccharomyces cerevisiae
cgcctattgcttttgctgat

SEQ ID NO: 7306 - DNA, 20 bp, Saccharomyces cerevisiae
cgcttccaagccttaacaaa

SEQ ID NO: 7307 - DNA, 20 bp, Saccharomyces cerevisiae
tccgttccattacgagaagg

SEQ ID NO: 7308 - DNA, 20 bp, Saccharomyces cerevisiae
gaacgtgaaggaaaggctga

SEQ ID NO: 7309 - DNA, 20 bp, Saccharomyces cerevisiae
aatgaacgctggttcaggat

SEQ ID NO: 7310 - DNA, 20 bp, Saccharomyces cerevisiae
aactatccaaaaccctgggc

SEQ ID NO: 7311 - DNA, 20 bp, Saccharomyces cerevisiae
tacttgcatcagaggggctt

SEQ ID NO: 7312 - DNA, 20 bp, Saccharomyces cerevisiae
tcatgcctgaacctgtatgc

SEQ ID NO: 7313 - DNA, 20 bp, Saccharomyces cerevisiae
ggtggggtacctaccatgaa

SEQ ID NO: 7314 - DNA, 20 bp, Saccharomyces cerevisiae
atttggcaaaagccaaacag

SEQ ID NO: 7315 - DNA, 20 bp, Saccharomyces cerevisiae
ccattggcgctattgtcata

SEQ ID NO: 7316 - DNA, 20 bp, Saccharomyces cerevisiae
ttcagcgtcaatggattcaa

SEQ ID NO: 7317 - DNA, 20 bp, Saccharomyces cerevisiae
aaaggggcagaagcaagatt

SEQ ID NO: 7318 - DNA, 20 bp, Saccharomyces cerevisiae
agtcgtgaaccgaagtcacc

SEQ ID NO: 7319 - DNA, 20 bp, Saccharomyces cerevisiae
attcggccaaaacgacagta

SEQ ID NO: 7320 - DNA, 20 bp, Saccharomyces cerevisiae
gagatgtcagcgacgttcaa

SEQ ID NO: 7321 - DNA, 20 bp, Saccharomyces cerevisiae
acaattaaggtccgtttgcg

SEQ ID NO: 7322 - DNA, 22 bp, Saccharomyces cerevisiae
gcaatctgataaaaattgcagc

SEQ ID NO: 7323 - DNA, 26 bp, Saccharomyces cerevisiae
aaagcgttctaaaaattactttcctc

SEQ ID NO: 7324 - DNA, 20 bp, Saccharomyces cerevisiae
ggaggaagcttttgctgttg

SEQ ID NO: 7325 - DNA, 20 bp, Saccharomyces cerevisiae
taaggatatcaggccaccga

SEQ ID NO: 7326 - DNA, 20 bp, Saccharomyces cerevisiae
gattgcgcatttagtgctga

SEQ ID NO: 7327 - DNA, 20 bp, Saccharomyces cerevisiae
tgagcagttttcactggtgc

SEQ ID NO: 7328 - DNA, 20 bp, Saccharomyces cerevisiae
ttaaatgggaacggtggaaa

SEQ ID NO: 7329 - DNA, 20 bp, Saccharomyces cerevisiae
gctgaaatgccaggactgat

SEQ ID NO: 7330 - DNA, 20 bp, Saccharomyces cerevisiae
aagcgctcccattattttca

SEQ ID NO: 7331 - DNA, 20 bp, Saccharomyces cerevisiae
tcaaaagcacaaccaaagca

SEQ ID NO: 7332 - DNA, 20 bp, Saccharomyces cerevisiae
gccttctataccaccagcca

SEQ ID NO: 7333 - DNA, 20 bp, Saccharomyces cerevisiae
ggaaatgcagcgtaaaaacc

SEQ ID NO: 7334 - DNA, 20 bp, Saccharomyces cerevisiae
aatgccaccgctactacagc

SEQ ID NO: 7335 - DNA, 20 bp, Saccharomyces cerevisiae
gcgtgatgaaagcacgatct

SEQ ID NO: 7336 - DNA, 20 bp, Saccharomyces cerevisiae
atggcgtaccaggtgaagag

SEQ ID NO: 7337 - DNA, 20 bp, Saccharomyces cerevisiae
aagatcgccaatttaaggca

SEQ ID NO: 7338 - DNA, 20 bp, Saccharomyces cerevisiae
tgcacgaagaacagttgagg

SEQ ID NO: 7339 - DNA, 20 bp, Saccharomyces cerevisiae
tttggcgcaattgattgata

SEQ ID NO: 7340 - DNA, 20 bp, Saccharomyces cerevisiae
ccattttgggtcaacaaggt

SEQ ID NO: 7341 - DNA, 20 bp, Saccharomyces cerevisiae
atccgctggattctcacatc

SEQ ID NO: 7342 - DNA, 20 bp, Saccharomyces cerevisiae
tctctctcctcccgtcaaaa

SEQ ID NO: 7343 - DNA, 20 bp, Saccharomyces cerevisiae
aaacttgtcgtacgcgatcc

SEQ ID NO: 7344 - DNA, 20 bp, Saccharomyces cerevisiae
cacttgggacttgggtcaat

SEQ ID NO: 7345 - DNA, 20 bp, Saccharomyces cerevisiae
gctatagcttctgccgcttg

SEQ ID NO: 7346 - DNA, 20 bp, Saccharomyces cerevisiae
ttttatgctgttggaagccc

SEQ ID NO: 7347 - DNA, 20 bp, Saccharomyces cerevisiae
caggcagggtgattcaagtt

SEQ ID NO: 7348 - DNA, 21 bp, Saccharomyces cerevisiae
aaggttgcaaagggaacattt

SEQ ID NO: 7349 - DNA, 25 bp, Saccharomyces cerevisiae
ttcttacaagatataggtgcttccg

SEQ ID NO: 7350 - DNA, 20 bp, Saccharomyces cerevisiae
cagggaaggtacggaaatga

SEQ ID NO: 7351 - DNA, 20 bp, Saccharomyces cerevisiae
cttccaaaaggaccctgaca

SEQ ID NO: 7352 - DNA, 20 bp, Saccharomyces cerevisiae
aattgaaactatgggcgcaa

SEQ ID NO: 7353 - DNA, 20 bp, Saccharomyces cerevisiae
acgaaattggtcgattggaa

SEQ ID NO: 7354 - DNA, 20 bp, Saccharomyces cerevisiae
cgacagccatgattaaacga

SEQ ID NO: 7355 - DNA, 20 bp, Saccharomyces cerevisiae
aatagccggcctttgaaaat

SEQ ID NO: 7356 - DNA, 20 bp, Saccharomyces cerevisiae
aattcgttgcagaggcagtt

SEQ ID NO: 7357 - DNA, 20 bp, Saccharomyces cerevisiae
tttccgacattccagaaagg

SEQ ID NO: 7358 - DNA, 20 bp, Saccharomyces cerevisiae
taccgattggcggaagatta

SEQ ID NO: 7359 - DNA, 20 bp, Saccharomyces cerevisiae
tcttatgggcaaagccaaaa

SEQ ID NO: 7360 - DNA, 21 bp, Saccharomyces cerevisiae
tgatagggaacaactggagga

SEQ ID NO: 7361 - DNA, 20 bp, Saccharomyces cerevisiae
ggaggagagaaaggcaacct

SEQ ID NO: 7362 - DNA, 20 bp, Saccharomyces cerevisiae
ttttgatcttcggagatggg

SEQ ID NO: 7363 - DNA, 20 bp, Saccharomyces cerevisiae
caatggccagatctgtttga

SEQ ID NO: 7364 - DNA, 20 bp, Saccharomyces cerevisiae
catttttggggctgatgttt

SEQ ID NO: 7365 - DNA, 20 bp, Saccharomyces cerevisiae
gcgggaaacttacttcatgc

SEQ ID NO: 7366 - DNA, 20 bp, Saccharomyces cerevisiae
aattgcgtacggagatggac

SEQ ID NO: 7367 - DNA, 20 bp, Saccharomyces cerevisiae
ttctttgggccagctctcta

SEQ ID NO: 7368 - DNA, 20 bp, Saccharomyces cerevisiae
ccaatgatgcagtgagcaag

SEQ ID NO: 7369 - DNA, 21 bp, Saccharomyces cerevisiae
tcaaatcactacaccacccaa

SEQ ID NO: 7370 - DNA, 20 bp, Saccharomyces cerevisiae
attgggtggcgtgaatagac

SEQ ID NO: 7371 - DNA, 20 bp, Saccharomyces cerevisiae
ccgtgccagtgtcagaagta

SEQ ID NO: 7372 - DNA, 21 bp, Saccharomyces cerevisiae
ttcatccagaaaatgcaggtc

SEQ ID NO: 7373 - DNA, 20 bp, Saccharomyces cerevisiae
ttcataagaccatccgcaaa

SEQ ID NO: 7374 - DNA, 24 bp, Saccharomyces cerevisiae
cgcttgttacaatattttcattcc

SEQ ID NO: 7375 - DNA, 20 bp, Saccharomyces cerevisiae
ggcgcagctcctgttattta

SEQ ID NO: 7376 - DNA, 20 bp, Saccharomyces cerevisiae
acatccgttgcaccttcttc

SEQ ID NO: 7377 - DNA, 21 bp, Saccharomyces cerevisiae
tcaaaatcttcgccaaagaaa

SEQ ID NO: 7378 - DNA, 20 bp, Saccharomyces cerevisiae
tggttccagtgttgaggaca

SEQ ID NO: 7379 - DNA, 20 bp, Saccharomyces cerevisiae
aaacactattatcggccccc

SEQ ID NO: 7380 - DNA, 20 bp, Saccharomyces cerevisiae
caccagaatgcttcaaccct

SEQ ID NO: 7381 - DNA, 20 bp, Saccharomyces cerevisiae
gaggctcactcttccagtgc

SEQ ID NO: 7382 - DNA, 20 bp, Saccharomyces cerevisiae
ctgacaattgagggaacacg

SEQ ID NO: 7383 - DNA, 20 bp, Saccharomyces cerevisiae
aggagaaagccaacccgtat

SEQ ID NO: 7384 - DNA, 20 bp, Saccharomyces cerevisiae
tgcctgtctgcataggatga

SEQ ID NO: 7385 - DNA, 20 bp, Saccharomyces cerevisiae
ccattggagcgaatatccat

SEQ ID NO: 7386 - DNA, 20 bp, Saccharomyces cerevisiae
tgatgcagtccgttgtaagg

SEQ ID NO: 7387 - DNA, 20 bp, Saccharomyces cerevisiae
gtcgccagccatatttcagt

SEQ ID NO: 7388 - DNA, 20 bp, Saccharomyces cerevisiae
gaaacaacagggcgacctta

SEQ ID NO: 7389 - DNA, 20 bp, Saccharomyces cerevisiae
tgagaaacttgcagcattgg

SEQ ID NO: 7390 - DNA, 20 bp, Saccharomyces cerevisiae
tgaacaatggcgacagctaa

SEQ ID NO: 7391 - DNA, 20 bp, Saccharomyces cerevisiae
agggatcttggagacggact

SEQ ID NO: 7392 - DNA, 20 bp, Saccharomyces cerevisiae
caaagtcgaggaggttctgc

SEQ ID NO: 7393 - DNA, 20 bp, Saccharomyces cerevisiae
ttgggagtcacatttgggat

SEQ ID NO: 7394 - DNA, 22 bp, Saccharomyces cerevisiae
ctgcacacctagttattcctcg

SEQ ID NO: 7395 - DNA, 20 bp, Saccharomyces cerevisiae
acatggacttcggaggtctg

SEQ ID NO: 7396 - DNA, 22 bp, Saccharomyces cerevisiae
tcatcgtacaactgaatcaggg

SEQ ID NO: 7397 - DNA, 20 bp, Saccharomyces cerevisiae
tggtttgcatctgatgttcc

SEQ ID NO: 7398 - DNA, 20 bp, Saccharomyces cerevisiae
aataacgttcaacccggaca

SEQ ID NO: 7399 - DNA, 20 bp, Saccharomyces cerevisiae
acgtaatgaactggaagccg

SEQ ID NO: 7400 - DNA, 20 bp, Saccharomyces cerevisiae
ctcatggctttccttatggg

SEQ ID NO: 7401 - DNA, 20 bp, Saccharomyces cerevisiae
gccaaatgggagaaattgaa

SEQ ID NO: 7402 - DNA, 20 bp, Saccharomyces cerevisiae
ttgtgtgcacgagatatggg

SEQ ID NO: 7403 - DNA, 20 bp, Saccharomyces cerevisiae
cccgggattatacttttggc

SEQ ID NO: 7404 - DNA, 20 bp, Saccharomyces cerevisiae
agcgggagacaagacagaaa

SEQ ID NO: 7405 - DNA, 20 bp, Saccharomyces cerevisiae
tgtcggcctcattgttcata

SEQ ID NO: 7406 - DNA, 20 bp, Saccharomyces cerevisiae
gaccactgagccctatttgc

SEQ ID NO: 7407 - DNA, 20 bp, Saccharomyces cerevisiae
atctatcttgcgcggtatgc

SEQ ID NO: 7408 - DNA, 20 bp, Saccharomyces cerevisiae
atatgcaacgcctcgaagac

SEQ ID NO: 7409 - DNA, 20 bp, Saccharomyces cerevisiae
ttgcggttatcaggtcttcc

SEQ ID NO: 7410 - DNA, 20 bp, Saccharomyces cerevisiae
acgctaacgaggaagaacca

SEQ ID NO: 7411 - DNA, 20 bp, Saccharomyces cerevisiae
tccaacacgcggacatatta

SEQ ID NO: 7412 - DNA, 20 bp, Saccharomyces cerevisiae
cttgctgaacgccaaaatta

SEQ ID NO: 7413 - DNA, 20 bp, Saccharomyces cerevisiae
tggaatttctcgaccaaagg

SEQ ID NO: 7414 - DNA, 20 bp, Saccharomyces cerevisiae
taggctacttgttgggtccg

SEQ ID NO: 7415 - DNA, 20 bp, Saccharomyces cerevisiae
ttcgtcaagcaacaatggaa

SEQ ID NO: 7416 - DNA, 20 bp, Saccharomyces cerevisiae
ggaaacaaggttttccagca

SEQ ID NO: 7417 - DNA, 20 bp, Saccharomyces cerevisiae
tttggaattcccattcaacg

SEQ ID NO: 7418 - DNA, 20 bp, Saccharomyces cerevisiae
agagagagaattgtgccgga

SEQ ID NO: 7419 - DNA, 20 bp, Saccharomyces cerevisiae
ggcgtgtttgaccgtatctt

SEQ ID NO: 7420 - DNA, 20 bp, Saccharomyces cerevisiae
gccaaggcaagcaagattac

SEQ ID NO: 7421 - DNA, 20 bp, Saccharomyces cerevisiae
ttggaacgttgaaccagtga

SEQ ID NO: 7422 - DNA, 20 bp, Saccharomyces cerevisiae
gcagagaccgccaaaaataa

SEQ ID NO: 7423 - DNA, 22 bp, Saccharomyces cerevisiae
gcttcaaaatttgctacgtgaa

SEQ ID NO: 7424 - DNA, 25 bp, Saccharomyces cerevisiae
aactttcggaaatcaaatacactaa

SEQ ID NO: 7425 - DNA, 20 bp, Saccharomyces cerevisiae
gtgggcaatgtggagagatt

SEQ ID NO: 7426 - DNA, 20 bp, Saccharomyces cerevisiae
ctgcgtctttaccgctcttc

SEQ ID NO: 7427 - DNA, 20 bp, Saccharomyces cerevisiae
cggaggtgatccaacagatt

SEQ ID NO: 7428 - DNA, 22 bp, Saccharomyces cerevisiae
ggtaggctttctctacgtggtc

SEQ ID NO: 7429 - DNA, 20 bp, Saccharomyces cerevisiae
ggaaagcacgttaactccca

SEQ ID NO: 7430 - DNA, 20 bp, Saccharomyces cerevisiae
agagcaagaactgggcgata

SEQ ID NO: 7431 - DNA, 20 bp, Saccharomyces cerevisiae
agcggggatttagaagcaat

SEQ ID NO: 7432 - DNA, 20 bp, Saccharomyces cerevisiae
gatgcagttgacgctgaaga

SEQ ID NO: 7433 - DNA, 20 bp, Saccharomyces cerevisiae
cttgctggccttcttacctg

SEQ ID NO: 7434 - DNA, 21 bp, Saccharomyces cerevisiae
ccagatgtgcagatgtaacca

SEQ ID NO: 7435 - DNA, 20 bp, Saccharomyces cerevisiae
tcccatttttcgatccagtc

SEQ ID NO: 7436 - DNA, 20 bp, Saccharomyces cerevisiae
tcgcccgtattttacgaaac

SEQ ID NO: 7437 - DNA, 20 bp, Saccharomyces cerevisiae
gttggacgaattcgacgttt

SEQ ID NO: 7438 - DNA, 20 bp, Saccharomyces cerevisiae
accgatagcgaaccggtaat

SEQ ID NO: 7439 - DNA, 20 bp, Saccharomyces cerevisiae
gccttcttgcaccaaagaac

SEQ ID NO: 7440 - DNA, 20 bp, Saccharomyces cerevisiae
agcaagaatggcaagaaagc

SEQ ID NO: 7441 - DNA, 20 bp, Saccharomyces cerevisiae
gggccatgttggtattgaag

SEQ ID NO: 7442 - DNA, 20 bp, Saccharomyces cerevisiae
cctttgttaggttgcgcatt

SEQ ID NO: 7443 - DNA, 20 bp, Saccharomyces cerevisiae
atcctcctctccttggtggt

SEQ ID NO: 7444 - DNA, 20 bp, Saccharomyces cerevisiae
aaggaacatgcaaaacaccc

SEQ ID NO: 7445 - DNA, 20 bp, Saccharomyces cerevisiae
gctttgcctggataccaaat

SEQ ID NO: 7446 - DNA, 20 bp, Saccharomyces cerevisiae
atatttcatccagttcgccg

SEQ ID NO: 7447 - DNA, 20 bp, Saccharomyces cerevisiae
tcttcggaagtctcagtggg

SEQ ID NO: 7448 - DNA, 20 bp, Saccharomyces cerevisiae
ccatgtagtgacaagcagcg

SEQ ID NO: 7449 - DNA, 21 bp, Saccharomyces cerevisiae
tgttgttggatgaattgaacg

SEQ ID NO: 7450 - DNA, 20 bp, Saccharomyces cerevisiae
cattggtttggatgggactc

SEQ ID NO: 7451 - DNA, 22 bp, Saccharomyces cerevisiae
gaatttaactcactcgtggtgc

SEQ ID NO: 7452 - DNA, 20 bp, Saccharomyces cerevisiae
gcaccctcataaaaacggtc

SEQ ID NO: 7453 - DNA, 20 bp, Saccharomyces cerevisiae
ccagtatctcgggttctgga

SEQ ID NO: 7454 - DNA, 20 bp, Saccharomyces cerevisiae
cttcagctaaagattcggcg

SEQ ID NO: 7455 - DNA, 20 bp, Saccharomyces cerevisiae
atttttgggaacctcccttg

SEQ ID NO: 7456 - DNA, 20 bp, Saccharomyces cerevisiae
acgaaactattggggcctct

SEQ ID NO: 7457 - DNA, 20 bp, Saccharomyces cerevisiae
tcctgcttgaaagcacatga

SEQ ID NO: 7458 - DNA, 20 bp, Saccharomyces cerevisiae
cggtctcatcttctcccaaa

SEQ ID NO: 7459 - DNA, 20 bp, Saccharomyces cerevisiae
ctggactaaaagtggagccg

SEQ ID NO: 7460 - DNA, 21 bp, Saccharomyces cerevisiae
tttgaaaacaaaatcaaggcg

SEQ ID NO: 7461 - DNA, 20 bp, Saccharomyces cerevisiae
tctttgcgctttgttgtgtc

SEQ ID NO: 7462 - DNA, 20 bp, Saccharomyces cerevisiae
tgccagaggttccaaaaagt

SEQ ID NO: 7463 - DNA, 20 bp, Saccharomyces cerevisiae
tgttcgtaaatgaatggggc

SEQ ID NO: 7464 - DNA, 20 bp, Saccharomyces cerevisiae
tggcatcttccaaaggatgt

SEQ ID NO: 7465 - DNA, 20 bp, Saccharomyces cerevisiae
ttttcgacattcctgttcgg

SEQ ID NO: 7466 - DNA, 20 bp, Saccharomyces cerevisiae
tcttcgccccagttattttc

SEQ ID NO: 7467 - DNA, 20 bp, Saccharomyces cerevisiae
cagcaggatcgaactggatt

SEQ ID NO: 7468 - DNA, 21 bp, Saccharomyces cerevisiae
ttgtgatccgacagagacaaa

SEQ ID NO: 7469 - DNA, 20 bp, Saccharomyces cerevisiae
gtaattgcggagcttcctga

SEQ ID NO: 7470 - DNA, 22 bp, Saccharomyces cerevisiae
ggtgcaacacgtgtagtctctg

SEQ ID NO: 7471 - DNA, 20 bp, Saccharomyces cerevisiae
aagttcagggcagcaacaat

SEQ ID NO: 7472 - DNA, 20 bp, Saccharomyces cerevisiae
gccggttccaattctgataa

SEQ ID NO: 7473 - DNA, 20 bp, Saccharomyces cerevisiae
aattaccgacgctccatttg

SEQ ID NO: 7474 - DNA, 20 bp, Saccharomyces cerevisiae
tgcctcatctgccaaactaa

SEQ ID NO: 7475 - DNA, 20 bp, Saccharomyces cerevisiae
gcctcagcatgaattacggt

SEQ ID NO: 7476 - DNA, 20 bp, Saccharomyces cerevisiae
agcacacgctctcctgtctt

SEQ ID NO: 7477 - DNA, 22 bp, Saccharomyces cerevisiae
cctatgtcaccatctaacaccg

SEQ ID NO: 7478 - DNA, 20 bp, Saccharomyces cerevisiae
agggccccactaatttttga

SEQ ID NO: 7479 - DNA, 20 bp, Saccharomyces cerevisiae
gagcaaatccaccttcacct

SEQ ID NO: 7480 - DNA, 20 bp, Saccharomyces cerevisiae
gttcatgggctcgaaagaag

SEQ ID NO: 7481 - DNA, 20 bp, Saccharomyces cerevisiae
tgagcaagaaaaatttggca

SEQ ID NO: 7482 - DNA, 20 bp, Saccharomyces cerevisiae
cggaattctccaggcaattt

SEQ ID NO: 7483 - DNA, 20 bp, Saccharomyces cerevisiae
ttatcatgccaatgcgaatc

SEQ ID NO: 7484 - DNA, 20 bp, Saccharomyces cerevisiae
aggtgcgctcgtttagagaa

SEQ ID NO: 7485 - DNA, 20 bp, Saccharomyces cerevisiae
cggcagttaaccccaatttt

SEQ ID NO: 7486 - DNA, 22 bp, Saccharomyces cerevisiae
ttctgagtcgagcagatttttg

SEQ ID NO: 7487 - DNA, 20 bp, Saccharomyces cerevisiae
acatcgacatacgcctttcc

SEQ ID NO: 7488 - DNA, 20 bp, Saccharomyces cerevisiae
agtcagttggttggcctttg

SEQ ID NO: 7489 - DNA, 20 bp, Saccharomyces cerevisiae
cgctcttcccttttaaagca

SEQ ID NO: 7490 - DNA, 20 bp, Saccharomyces cerevisiae
cgctgcaaatatcccaaagt

SEQ ID NO: 7491 - DNA, 20 bp, Saccharomyces cerevisiae
atgaaggctcggaggaaaat

SEQ ID NO: 7492 - DNA, 20 bp, Saccharomyces cerevisiae
cgcttgacactacaggacga

SEQ ID NO: 7493 - DNA, 20 bp, Saccharomyces cerevisiae
tcagccaaaatgaaggtggt

SEQ ID NO: 7494 - DNA, 20 bp, Saccharomyces cerevisiae
tgaccttccaaaaccctctg

SEQ ID NO: 7495 - DNA, 20 bp, Saccharomyces cerevisiae
attgcaaatgatgcggattt

SEQ ID NO: 7496 - DNA, 21 bp, Saccharomyces cerevisiae
ggtatgccttccatactcacg

SEQ ID NO: 7497 - DNA, 20 bp, Saccharomyces cerevisiae
attccaagtgggctctgatg

SEQ ID NO: 7498 - DNA, 20 bp, Saccharomyces cerevisiae
tgcattaatggaatgcggta

SEQ ID NO: 7499 - DNA, 20 bp, Saccharomyces cerevisiae
gaagacgacgacacctcctc

SEQ ID NO: 7500 - DNA, 20 bp, Saccharomyces cerevisiae
agcaagtagctcgggaacaa

SEQ ID NO: 7501 - DNA, 20 bp, Saccharomyces cerevisiae
aacgctcctgctctctttca

SEQ ID NO: 7502 - DNA, 20 bp, Saccharomyces cerevisiae
acttcgaggacaatgctggt

SEQ ID NO: 7503 - DNA, 20 bp, Saccharomyces cerevisiae
gcacatgtatgcctggagaa

SEQ ID NO: 7504 - DNA, 20 bp, Saccharomyces cerevisiae
tttcaaatctgcaaaaaggg

SEQ ID NO: 7505 - DNA, 20 bp, Saccharomyces cerevisiae
gatgcgttgtaaaggacggt

SEQ ID NO: 7506 - DNA, 20 bp, Saccharomyces cerevisiae
taatttcgcacaagaacccc

SEQ ID NO: 7507 - DNA, 20 bp, Saccharomyces cerevisiae
caaagaaaagaggatgccga

SEQ ID NO: 7508 - DNA, 20 bp, Saccharomyces cerevisiae
ctcttcctccattgaaccca

SEQ ID NO: 7509 - DNA, 19 bp, Saccharomyces cerevisiae
aaacgttgccgaagcaaat

SEQ ID NO: 7510 - DNA, 20 bp, Saccharomyces cerevisiae
ccgcacaagattctttgaca

SEQ ID NO: 7511 - DNA, 20 bp, Saccharomyces cerevisiae
aatcctcccaacactgcaac

SEQ ID NO: 7512 - DNA, 20 bp, Saccharomyces cerevisiae
tttcagcaacagccactgac

SEQ ID NO: 7513 - DNA, 21 bp, Saccharomyces cerevisiae
cttcctttccgtagatgtcca

SEQ ID NO: 7514 - DNA, 20 bp, Saccharomyces cerevisiae
acgcaaacgaaacagaggat

SEQ ID NO: 7515 - DNA, 20 bp, Saccharomyces cerevisiae
ttcttccaagccagtgaagg

SEQ ID NO: 7516 - DNA, 21 bp, Saccharomyces cerevisiae
aagtggttggcatgttgaatc

SEQ ID NO: 7517 - DNA, 20 bp, Saccharomyces cerevisiae
ccctcaagatgggtctacca

SEQ ID NO: 7518 - DNA, 20 bp, Saccharomyces cerevisiae
gcacccctcttgcttttgta

SEQ ID NO: 7519 - DNA, 20 bp, Saccharomyces cerevisiae
cgaaaaacaagaggcttgga

SEQ ID NO: 7520 - DNA, 20 bp, Saccharomyces cerevisiae
caacgtcccggagaactcta

SEQ ID NO: 7521 - DNA, 21 bp, Saccharomyces cerevisiae
gtccctaaaacgtcttcagcc

SEQ ID NO: 7522 - DNA, 20 bp, Saccharomyces cerevisiae
ggatggattggtcattggac

SEQ ID NO: 7523 - DNA, 20 bp, Saccharomyces cerevisiae
tgaatcaccctctggaggtc

SEQ ID NO: 7524 - DNA, 20 bp, Saccharomyces cerevisiae
gccaagaaggatttcaacca

SEQ ID NO: 7525 - DNA, 21 bp, Saccharomyces cerevisiae
ttggtcgaatctaacccagaa

SEQ ID NO: 7526 - DNA, 20 bp, Saccharomyces cerevisiae
agttccccgatagaagccat

SEQ ID NO: 7527 - DNA, 20 bp, Saccharomyces cerevisiae
gccagtgcattgcaactaat

SEQ ID NO: 7528 - DNA, 20 bp, Saccharomyces cerevisiae
gcttttattgcaggctttgg

SEQ ID NO: 7529 - DNA, 20 bp, Saccharomyces cerevisiae
ccaatgcaacagagtcaagc

SEQ ID NO: 7530 - DNA, 20 bp, Saccharomyces cerevisiae
tctggatgttcgtctgcatc

SEQ ID NO: 7531 - DNA, 20 bp, Saccharomyces cerevisiae
catcgacgggatcaagttct

SEQ ID NO: 7532 - DNA, 20 bp, Saccharomyces cerevisiae
cgttaagcaagcatccatca

SEQ ID NO: 7533 - DNA, 20 bp, Saccharomyces cerevisiae
tcaatcttgcctgtaatgcg

SEQ ID NO: 7534 - DNA, 20 bp, Saccharomyces cerevisiae
ggaaaatcgaaaatgagcca

SEQ ID NO: 7535 - DNA, 20 bp, Saccharomyces cerevisiae
tcaaacaatgggggatgaat

SEQ ID NO: 7536 - DNA, 20 bp, Saccharomyces cerevisiae
agtttgccaatacaggtgcc

SEQ ID NO: 7537 - DNA, 20 bp, Saccharomyces cerevisiae
ctgaccacttccagccattt

SEQ ID NO: 7538 - DNA, 20 bp, Saccharomyces cerevisiae
gtgggacggtaacattttcg

SEQ ID NO: 7539 - DNA, 20 bp, Saccharomyces cerevisiae
ttctccctgttgcagagctt

SEQ ID NO: 7540 - DNA, 20 bp, Saccharomyces cerevisiae
gcaaaggaaccgatagttcg

SEQ ID NO: 7541 - DNA, 20 bp, Saccharomyces cerevisiae
gatgaacagtaacgcagcga

SEQ ID NO: 7542 - DNA, 20 bp, Saccharomyces cerevisiae
ccttcgttcttcgttcttcg

SEQ ID NO: 7543 - DNA, 20 bp, Saccharomyces cerevisiae
gtttgcctaccaacgcaagt

SEQ ID NO: 7544 - DNA, 20 bp, Saccharomyces cerevisiae
ttcccacatatcttttcgcc

SEQ ID NO: 7545 - DNA, 23 bp, Saccharomyces cerevisiae
tcgaatccgaaataagagaatca

SEQ ID NO: 7546 - DNA, 20 bp, Saccharomyces cerevisiae
aggggtttgttattttgggg

SEQ ID NO: 7547 - DNA, 22 bp, Saccharomyces cerevisiae
tgctctcttctatcttggaggg

SEQ ID NO: 7548 - DNA, 20 bp, Saccharomyces cerevisiae
agcaagcgaaaggatttcaa

SEQ ID NO: 7549 - DNA, 20 bp, Saccharomyces cerevisiae
atatcgaggatttcccggag

SEQ ID NO: 7550 - DNA, 20 bp, Saccharomyces cerevisiae
atggttcgtgatttgaagcc

SEQ ID NO: 7551 - DNA, 20 bp, Saccharomyces cerevisiae
ttcgtggagtacttcgcctt

SEQ ID NO: 7552 - DNA, 20 bp, Saccharomyces cerevisiae
aattgcaactggagtttggc

SEQ ID NO: 7553 - DNA, 20 bp, Saccharomyces cerevisiae
cctgaaggaaagtccagtgc

SEQ ID NO: 7554 - DNA, 20 bp, Saccharomyces cerevisiae
atattctccatggcacaggc

SEQ ID NO: 7555 - DNA, 20 bp, Saccharomyces cerevisiae
cgtatggactttgcgatcct

SEQ ID NO: 7556 - DNA, 20 bp, Saccharomyces cerevisiae
gggcttcgtaacacttttcg

SEQ ID NO: 7557 - DNA, 21 bp, Saccharomyces cerevisiae
gctgcaatgcttcttagttgg

SEQ ID NO: 7558 - DNA, 20 bp, Saccharomyces cerevisiae
caaactgcttcctttagcgg

SEQ ID NO: 7559 - DNA, 20 bp, Saccharomyces cerevisiae
cccgaaaaggagtttcacaa

SEQ ID NO: 7560 - DNA, 20 bp, Saccharomyces cerevisiae
gcgagcaccaataccaaaat

SEQ ID NO: 7561 - DNA, 20 bp, Saccharomyces cerevisiae
catcgcaatcacttgaaacg

SEQ ID NO: 7562 - DNA, 20 bp, Saccharomyces cerevisiae
ccgtacagcaacaaacagga

SEQ ID NO: 7563 - DNA, 25 bp, Saccharomyces cerevisiae
gttaaggatatctggtagtcaagcg

SEQ ID NO: 7564 - DNA, 20 bp, Saccharomyces cerevisiae
taccatgtggcatgctgttt

SEQ ID NO: 7565 - DNA, 20 bp, Saccharomyces cerevisiae
tcagcattttgcacctgttc

SEQ ID NO: 7566 - DNA, 20 bp, Saccharomyces cerevisiae
gatgtctttttgaggggcac

SEQ ID NO: 7567 - DNA, 20 bp, Saccharomyces cerevisiae
cagagctgctgcatggttta

SEQ ID NO: 7568 - DNA, 20 bp, Saccharomyces cerevisiae
tcagcctcacaattacaccg

SEQ ID NO: 7569 - DNA, 20 bp, Saccharomyces cerevisiae
cactgagcaaagtgaaagcg

SEQ ID NO: 7570 - DNA, 20 bp, Saccharomyces cerevisiae
gtgcgctcgggataaaataa

SEQ ID NO: 7571 - DNA, 21 bp, Saccharomyces cerevisiae
gccctgagggataattcattg

SEQ ID NO: 7572 - DNA, 21 bp, Saccharomyces cerevisiae
tggtatcatcgaaagccattt

SEQ ID NO: 7573 - DNA, 20 bp, Saccharomyces cerevisiae
attgcaaggattggaactcg

SEQ ID NO: 7574 - DNA, 24 bp, Saccharomyces cerevisiae
aacatgtgttgtattggcagattt

SEQ ID NO: 7575 - DNA, 20 bp, Saccharomyces cerevisiae
aacatcccaacccttgatga

SEQ ID NO: 7576 - DNA, 20 bp, Saccharomyces cerevisiae
aattccaaaagatcggtcca

SEQ ID NO: 7577 - DNA, 20 bp, Saccharomyces cerevisiae
tggtcttttgtcctcgcttt

SEQ ID NO: 7578 - DNA, 21 bp, Saccharomyces cerevisiae
ttgcttgttaaactctcccga

SEQ ID NO: 7579 - DNA, 20 bp, Saccharomyces cerevisiae
aatgatccacctgcttggaa

SEQ ID NO: 7580 - DNA, 20 bp, Saccharomyces cerevisiae
gggagaatgcctgaaatgaa

SEQ ID NO: 7581 - DNA, 20 bp, Saccharomyces cerevisiae
gcccgctaagagtcaagaaa

SEQ ID NO: 7582 - DNA, 20 bp, Saccharomyces cerevisiae
gttagccttgatggctggtg

SEQ ID NO: 7583 - DNA, 21 bp, Saccharomyces cerevisiae
ccatcagttacctgcaaaacg

SEQ ID NO: 7584 - DNA, 20 bp, Saccharomyces cerevisiae
tgtgaccccaaagatagcct

SEQ ID NO: 7585 - DNA, 21 bp, Saccharomyces cerevisiae
tcacccttcttgaaatatgcc

SEQ ID NO: 7586 - DNA, 20 bp, Saccharomyces cerevisiae
gggtctgtggggtatgaatg

SEQ ID NO: 7587 - DNA, 20 bp, Saccharomyces cerevisiae
taggcataccttgccctcag

SEQ ID NO: 7588 - DNA, 20 bp, Saccharomyces cerevisiae
cgcgtttggtaatggacttt

SEQ ID NO: 7589 - DNA, 20 bp, Saccharomyces cerevisiae
gcaggacgtcataagctcag

SEQ ID NO: 7590 - DNA, 20 bp, Saccharomyces cerevisiae
ggatcagctgggctagtttg

SEQ ID NO: 7591 - DNA, 20 bp, Saccharomyces cerevisiae
acgagattgagacaaacgcc

SEQ ID NO: 7592 - DNA, 23 bp, Saccharomyces cerevisiae
atcttatccggatttttctcaaa

SEQ ID NO: 7593 - DNA, 20 bp, Saccharomyces cerevisiae
gagggtaccgaacccaaact

SEQ ID NO: 7594 - DNA, 20 bp, Saccharomyces cerevisiae
tagtcaccgccggatgtatt

SEQ ID NO: 7595 - DNA, 20 bp, Saccharomyces cerevisiae
attcctgaccacagccaatc

SEQ ID NO: 7596 - DNA, 20 bp, Saccharomyces cerevisiae
gaacaagtacggggcttcag

SEQ ID NO: 7597 - DNA, 20 bp, Saccharomyces cerevisiae
tcatgcagaatcttcccctc

SEQ ID NO: 7598 - DNA, 20 bp, Saccharomyces cerevisiae
gtggaggatgggcgtagtaa

SEQ ID NO: 7599 - DNA, 25 bp, Saccharomyces cerevisiae
gcgaaaaatacaagaaaagaaactg

SEQ ID NO: 7600 - DNA, 20 bp, Saccharomyces cerevisiae
ttgcctattatgagaccggg

SEQ ID NO: 7601 - DNA, 20 bp, Saccharomyces cerevisiae
tcaacttaagggttgggcac

SEQ ID NO: 7602 - DNA, 20 bp, Saccharomyces cerevisiae
ggggagaggctgagattttc

SEQ ID NO: 7603 - DNA, 20 bp, Saccharomyces cerevisiae
ggtggcgcatttaagaaaga

SEQ ID NO: 7604 - DNA, 20 bp, Saccharomyces cerevisiae
accactgtcaacaacgacca

SEQ ID NO: 7605 - DNA, 20 bp, Saccharomyces cerevisiae
gtaggttcagtcaccccagc

SEQ ID NO: 7606 - DNA, 20 bp, Saccharomyces cerevisiae
gtggagacaaccgagggtta

SEQ ID NO: 7607 - DNA, 20 bp, Saccharomyces cerevisiae
ttggggtttcgttcctgtag

SEQ ID NO: 7608 - DNA, 20 bp, Saccharomyces cerevisiae
tatcgaggcagcgaaactct

SEQ ID NO: 7609 - DNA, 20 bp, Saccharomyces cerevisiae
tccgcgtaagacctgatttc

SEQ ID NO: 7610 - DNA, 22 bp, Saccharomyces cerevisiae
tggacaaccttgaaaggtacag

SEQ ID NO: 7611 - DNA, 20 bp, Saccharomyces cerevisiae
gcacctaaaaggccgaaaac

SEQ ID NO: 7612 - DNA, 20 bp, Saccharomyces cerevisiae
gcgtaggaagttgaaaacgc

SEQ ID NO: 7613 - DNA, 20 bp, Saccharomyces cerevisiae
aaatgttggatttcgttgcc

SEQ ID NO: 7614 - DNA, 20 bp, Saccharomyces cerevisiae
ttttcctggcctgaattttg

SEQ ID NO: 7615 - DNA, 20 bp, Saccharomyces cerevisiae
ccccgagttcaggtctttta

SEQ ID NO: 7616 - DNA, 20 bp, Saccharomyces cerevisiae
aatagatgggttaggaggcg

SEQ ID NO: 7617 - DNA, 20 bp, Saccharomyces cerevisiae
acttgctatgcggctcctaa

SEQ ID NO: 7618 - DNA, 21 bp, Saccharomyces cerevisiae
ccgttcaaaagaaccgtaaca

SEQ ID NO: 7619 - DNA, 20 bp, Saccharomyces cerevisiae
ttcgtcgaggtttaacgctt

SEQ ID NO: 7620 - DNA, 20 bp, Saccharomyces cerevisiae
tttgcaaacgggaacttttc

SEQ ID NO: 7621 - DNA, 20 bp, Saccharomyces cerevisiae
tggtcctcatgctccataca

SEQ ID NO: 7622 - DNA, 20 bp, Saccharomyces cerevisiae
cttcaaacgctttagcaggc

SEQ ID NO: 7623 - DNA, 20 bp, Saccharomyces cerevisiae
atccgtttgtgctcaggttc

SEQ ID NO: 7624 - DNA, 20 bp, Saccharomyces cerevisiae
aagaatacgcagaaggacgc

SEQ ID NO: 7625 - DNA, 20 bp, Saccharomyces cerevisiae
ggatttgcacaacagtccct

SEQ ID NO: 7626 - DNA, 20 bp, Saccharomyces cerevisiae
cgcgattgtcacttcaaaag

SEQ ID NO: 7627 - DNA, 20 bp, Saccharomyces cerevisiae
ggatgtaacggaggtgtgct

SEQ ID NO: 7628 - DNA, 20 bp, Saccharomyces cerevisiae
cggaaaactgggtttttgaa

SEQ ID NO: 7629 - DNA, 20 bp, Saccharomyces cerevisiae
tggtggatgatcgcagtaaa

SEQ ID NO: 7630 - DNA, 21 bp, Saccharomyces cerevisiae
tcacccagtctacgttatggc

SEQ ID NO: 7631 - DNA, 20 bp, Saccharomyces cerevisiae
aactgaaagccgaccaaaaa

SEQ ID NO: 7632 - DNA, 20 bp, Saccharomyces cerevisiae
caatttaccgctgggagaaa

SEQ ID NO: 7633 - DNA, 20 bp, Saccharomyces cerevisiae
tttgcccctcattgaaaatc

SEQ ID NO: 7634 - DNA, 21 bp, Saccharomyces cerevisiae
atgcaagctgatcttgatgtt

SEQ ID NO: 7635 - DNA, 20 bp, Saccharomyces cerevisiae
caacaaggttgctgaacgtg

SEQ ID NO: 7636 - DNA, 22 bp, Saccharomyces cerevisiae
ttcgattgtcagtttttccctt

SEQ ID NO: 7637 - DNA, 20 bp, Saccharomyces cerevisiae
gtctttgggtcaactggagg

SEQ ID NO: 7638 - DNA, 20 bp, Saccharomyces cerevisiae
tgcctgccacgataacaata

SEQ ID NO: 7639 - DNA, 20 bp, Saccharomyces cerevisiae
gggtcatcaccagtcgtttt

SEQ ID NO: 7640 - DNA, 20 bp, Saccharomyces cerevisiae
ccggtgtaaaacaggaggaa

SEQ ID NO: 7641 - DNA, 20 bp, Saccharomyces cerevisiae
gtaccttccagcgctacgtc

SEQ ID NO: 7642 - DNA, 20 bp, Saccharomyces cerevisiae
ccagagtccacgcacctatt

SEQ ID NO: 7643 - DNA, 20 bp, Saccharomyces cerevisiae
agccaaagaaaccaaagggt

SEQ ID NO: 7644 - DNA, 20 bp, Saccharomyces cerevisiae
ccctcttccacaacgtagga

SEQ ID NO: 7645 - DNA, 20 bp, Saccharomyces cerevisiae
gtgccttgtgatccggtaat

SEQ ID NO: 7646 - DNA, 20 bp, Saccharomyces cerevisiae
ataatatcgcgctcaaccga

SEQ ID NO: 7647 - DNA, 20 bp, Saccharomyces cerevisiae
attttgtcgaagctgtcgct

SEQ ID NO: 7648 - DNA, 21 bp, Saccharomyces cerevisiae
tgggctctctacaacaaaaca

SEQ ID NO: 7649 - DNA, 20 bp, Saccharomyces cerevisiae
gaaatggccaaatgcctaga

SEQ ID NO: 7650 - DNA, 20 bp, Saccharomyces cerevisiae
ctctgatttgcgagacctcc

SEQ ID NO: 7651 - DNA, 20 bp, Saccharomyces cerevisiae
gaagctgagatagcccatcg

SEQ ID NO: 7652 - DNA, 20 bp, Saccharomyces cerevisiae
ggctgctgaaaagaaggttg

SEQ ID NO: 7653 - DNA, 20 bp, Saccharomyces cerevisiae
gctgctaaggcaggattttg

SEQ ID NO: 7654 - DNA, 20 bp, Saccharomyces cerevisiae
ggttgccgaaactttaggtg

SEQ ID NO: 7655 - DNA, 20 bp, Saccharomyces cerevisiae
agagatcaactggctgcgat

SEQ ID NO: 7656 - DNA, 20 bp, Saccharomyces cerevisiae
acagataggcgcggaaatta

SEQ ID NO: 7657 - DNA, 20 bp, Saccharomyces cerevisiae
gagatgcgtctgttccctct

SEQ ID NO: 7658 - DNA, 20 bp, Saccharomyces cerevisiae
cattgactgccagcaggata

SEQ ID NO: 7659 - DNA, 22 bp, Saccharomyces cerevisiae
gcacgatcagatacacatacgg

SEQ ID NO: 7660 - DNA, 20 bp, Saccharomyces cerevisiae
tatctggagaagcgaatggg

SEQ ID NO: 7661 - DNA, 20 bp, Saccharomyces cerevisiae
tgggatccaagttcaccttc

SEQ ID NO: 7662 - DNA, 20 bp, Saccharomyces cerevisiae
tgctgcgttttgttcattgt

SEQ ID NO: 7663 - DNA, 21 bp, Saccharomyces cerevisiae
ttagggaatgtgaatccaacg

SEQ ID NO: 7664 - DNA, 20 bp, Saccharomyces cerevisiae
ccctatttctggcaactgct

SEQ ID NO: 7665 - DNA, 20 bp, Saccharomyces cerevisiae
gcaaagcctgcttaaccata

SEQ ID NO: 7666 - DNA, 20 bp, Saccharomyces cerevisiae
cggttcttcccgaattatca

SEQ ID NO: 7667 - DNA, 20 bp, Saccharomyces cerevisiae
tttggtttggcttcccagta

SEQ ID NO: 7668 - DNA, 22 bp, Saccharomyces cerevisiae
catcagagaccttattccctgg

SEQ ID NO: 7669 - DNA, 21 bp, Saccharomyces cerevisiae
tcagagtctttcagcgaggtc

SEQ ID NO: 7670 - DNA, 25 bp, Saccharomyces cerevisiae
acttatgtttcgggatctctttgtt

SEQ ID NO: 7671 - DNA, 20 bp, Saccharomyces cerevisiae
tcatttgtgctgatcttgcc

SEQ ID NO: 7672 - DNA, 20 bp, Saccharomyces cerevisiae
gcgagcctgatgagagaatc

SEQ ID NO: 7673 - DNA, 20 bp, Saccharomyces cerevisiae
tatcagtggaattcgccaca

SEQ ID NO: 7674 - DNA, 22 bp, Saccharomyces cerevisiae
tcctcgagagcacatatgaaaa

SEQ ID NO: 7675 - DNA, 20 bp, Saccharomyces cerevisiae
ccgtgggcaaagaaatcata

SEQ ID NO: 7676 - DNA, 20 bp, Saccharomyces cerevisiae
agatcgagtggaaggggtct

SEQ ID NO: 7677 - DNA, 20 bp, Saccharomyces cerevisiae
atgctccgctggatgattac

SEQ ID NO: 7678 - DNA, 20 bp, Saccharomyces cerevisiae
cggctatggaaaagggaaat

SEQ ID NO: 7679 - DNA, 20 bp, Saccharomyces cerevisiae
gagaaaaggggagccagaac

SEQ ID NO: 7680 - DNA, 20 bp, Saccharomyces cerevisiae
tgacaaagcctctaggggaa

SEQ ID NO: 7681 - DNA, 20 bp, Saccharomyces cerevisiae
tagcggctacatgacacctg

SEQ ID NO: 7682 - DNA, 20 bp, Saccharomyces cerevisiae
gggcgtctgtactcgtttgt

SEQ ID NO: 7683 - DNA, 20 bp, Saccharomyces cerevisiae
atctgcgcatatcacgtgtc

SEQ ID NO: 7684 - DNA, 20 bp, Saccharomyces cerevisiae
gttcgtctggccctatgatg

SEQ ID NO: 7685 - DNA, 20 bp, Saccharomyces cerevisiae
cttagataattcgccggcct

SEQ ID NO: 7686 - DNA, 21 bp, Saccharomyces cerevisiae
gcaacatttattctttccgca

SEQ ID NO: 7687 - DNA, 20 bp, Saccharomyces cerevisiae
cagatgggctttggacaact

SEQ ID NO: 7688 - DNA, 20 bp, Saccharomyces cerevisiae
atgagtttggagatgccacc

SEQ ID NO: 7689 - DNA, 20 bp, Saccharomyces cerevisiae
gcgaaatccgtattaccagc

SEQ ID NO: 7690 - DNA, 20 bp, Saccharomyces cerevisiae
agcttctcttctggctacgc

SEQ ID NO: 7691 - DNA, 20 bp, Saccharomyces cerevisiae
cctggccaaaccttttgata

SEQ ID NO: 7692 - DNA, 20 bp, Saccharomyces cerevisiae
caaaccaaaacccaatgtcc

SEQ ID NO: 7693 - DNA, 20 bp, Saccharomyces cerevisiae
tatcttcgttcggcatttcc

SEQ ID NO: 7694 - DNA, 20 bp, Saccharomyces cerevisiae
caggattgggaagagttcca

SEQ ID NO: 7695 - DNA, 20 bp, Saccharomyces cerevisiae
tgggccagatacacagatga

SEQ ID NO: 7696 - DNA, 20 bp, Saccharomyces cerevisiae
acgcatagccaatctccatc

SEQ ID NO: 7697 - DNA, 20 bp, Saccharomyces cerevisiae
cctgaacccaaacacgaagt

SEQ ID NO: 7698 - DNA, 20 bp, Saccharomyces cerevisiae
ttattgcaatctgcgtgtcc

SEQ ID NO: 7699 - DNA, 20 bp, Saccharomyces cerevisiae
caaggcaaatggatcaaggt

SEQ ID NO: 7700 - DNA, 20 bp, Saccharomyces cerevisiae
agacctttcgttgcctttca

SEQ ID NO: 7701 - DNA, 20 bp, Saccharomyces cerevisiae
cgccaatgaagttgttctga

SEQ ID NO: 7702 - DNA, 20 bp, Saccharomyces cerevisiae
gctaaaatttcagatcgcgg

SEQ ID NO: 7703 - DNA, 20 bp, Saccharomyces cerevisiae
ttcgtcagtgtctgccaaag

SEQ ID NO: 7704 - DNA, 20 bp, Saccharomyces cerevisiae
tttttaggagcaagtccccc

SEQ ID NO: 7705 - DNA, 22 bp, Saccharomyces cerevisiae
tgagcttctcacgactttcttc

SEQ ID NO: 7706 - DNA, 20 bp, Saccharomyces cerevisiae
ccttgggcttgcatgtttat

SEQ ID NO: 7707 - DNA, 20 bp, Saccharomyces cerevisiae
tttgaaacgcctgaattttt

SEQ ID NO: 7708 - DNA, 20 bp, Saccharomyces cerevisiae
agcagtgtgggaattcgaga

SEQ ID NO: 7709 - DNA, 20 bp, Saccharomyces cerevisiae
gcgttagcaatgatccctct

SEQ ID NO: 7710 - DNA, 20 bp, Saccharomyces cerevisiae
aaatacattgccgctccatc

SEQ ID NO: 7711 - DNA, 20 bp, Saccharomyces cerevisiae
cgatctggtcaggatcaaca

SEQ ID NO: 7712 - DNA, 20 bp, Saccharomyces cerevisiae
gtgcctccgcttaaaaatca

SEQ ID NO: 7713 - DNA, 20 bp, Saccharomyces cerevisiae
tttcgggatcatcatcaggt

SEQ ID NO: 7714 - DNA, 20 bp, Saccharomyces cerevisiae
ggttcaacaactgccacctt

SEQ ID NO: 7715 - DNA, 20 bp, Saccharomyces cerevisiae
atggaatgggggttttaagc

SEQ ID NO: 7716 - DNA, 20 bp, Saccharomyces cerevisiae
tggacggtagtgagtcgttt

SEQ ID NO: 7717 - DNA, 20 bp, Saccharomyces cerevisiae
gccataagaagcagttccga

SEQ ID NO: 7718 - DNA, 20 bp, Saccharomyces cerevisiae
ggaagagatggacgaagctg

SEQ ID NO: 7719 - DNA, 20 bp, Saccharomyces cerevisiae
taacaaccgcattgctttga

SEQ ID NO: 7720 - DNA, 21 bp, Saccharomyces cerevisiae
gcaatatgcatgcgtaaagat

SEQ ID NO: 7721 - DNA, 20 bp, Saccharomyces cerevisiae
gactgttgtgcaaatcccaa

SEQ ID NO: 7722 - DNA, 20 bp, Saccharomyces cerevisiae
actgagggagagggtaaggc

SEQ ID NO: 7723 - DNA, 21 bp, Saccharomyces cerevisiae
tgatcaggcaaaggttagagc

SEQ ID NO: 7724 - DNA, 20 bp, Saccharomyces cerevisiae
gcaatactcatggccgtttt

SEQ ID NO: 7725 - DNA, 20 bp, Saccharomyces cerevisiae
accttggaaaacctcggagt

SEQ ID NO: 7726 - DNA, 20 bp, Saccharomyces cerevisiae
tcacgccttcacatgacaat

SEQ ID NO: 7727 - DNA, 22 bp, Saccharomyces cerevisiae
tgcagttattcggttattccaa

SEQ ID NO: 7728 - DNA, 20 bp, Saccharomyces cerevisiae
agtccagacttgctggtcgt

SEQ ID NO: 7729 - DNA, 20 bp, Saccharomyces cerevisiae
tcaaccaatatgcaccagga

SEQ ID NO: 7730 - DNA, 20 bp, Saccharomyces cerevisiae
ggcatcttgattctttccca

SEQ ID NO: 7731 - DNA, 20 bp, Saccharomyces cerevisiae
agccttatcaagtttgccca

SEQ ID NO: 7732 - DNA, 20 bp, Saccharomyces cerevisiae
acattcaagaaatggcgaaa

SEQ ID NO: 7733 - DNA, 20 bp, Saccharomyces cerevisiae
cattacaacccttgaacccg

SEQ ID NO: 7734 - DNA, 24 bp, Saccharomyces cerevisiae
gacaatttccttatttgtatgcga

SEQ ID NO: 7735 - DNA, 20 bp, Saccharomyces cerevisiae
gggagaacgtgaagaaatgg

SEQ ID NO: 7736 - DNA, 20 bp, Saccharomyces cerevisiae
tcgttagcgacttcaatggc

SEQ ID NO: 7737 - DNA, 20 bp, Saccharomyces cerevisiae
gctcccactttgcaactacc

SEQ ID NO: 7738 - DNA, 20 bp, Saccharomyces cerevisiae
atcagctgtgctaaggggaa

SEQ ID NO: 7739 - DNA, 20 bp, Saccharomyces cerevisiae
tcgtaggattggaaattggc

SEQ ID NO: 7740 - DNA, 20 bp, Saccharomyces cerevisiae
aacgaagaaggcaccgttta

SEQ ID NO: 7741 - DNA, 20 bp, Saccharomyces cerevisiae
tacttaacactccctgcgcc

SEQ ID NO: 7742 - DNA, 20 bp, Saccharomyces cerevisiae
agtttgttggtcacggcttc

SEQ ID NO: 7743 - DNA, 20 bp, Saccharomyces cerevisiae
ccttccctgtccagtctttg

SEQ ID NO: 7744 - DNA, 20 bp, Saccharomyces cerevisiae
ggctgccattaagagacagg

SEQ ID NO: 7745 - DNA, 20 bp, Saccharomyces cerevisiae
tcattgtcgtaccccatcct

SEQ ID NO: 7746 - DNA, 20 bp, Saccharomyces cerevisiae
gaccagagttttcccaccaa

SEQ ID NO: 7747 - DNA, 20 bp, Saccharomyces cerevisiae
tgccatgaaaacctctcaaa

SEQ ID NO: 7748 - DNA, 20 bp, Saccharomyces cerevisiae
tgacatcactgcaaagacca

SEQ ID NO: 7749 - DNA, 21 bp, Saccharomyces cerevisiae
ttgaaaatcatcccagtttgg

SEQ ID NO: 7750 - DNA, 23 bp, Saccharomyces cerevisiae
cacagagcacatttattggttga

SEQ ID NO: 7751 - DNA, 21 bp, Saccharomyces cerevisiae
tgtgcctctgttttgttcttg

SEQ ID NO: 7752 - DNA, 20 bp, Saccharomyces cerevisiae
ttccggagtcaatatgagca

SEQ ID NO: 7753 - DNA, 20 bp, Saccharomyces cerevisiae
gaacaacagggtgatcgagg

SEQ ID NO: 7754 - DNA, 20 bp, Saccharomyces cerevisiae
caggcaggtgaatgagatga

SEQ ID NO: 7755 - DNA, 20 bp, Saccharomyces cerevisiae
gaaactgccacaacagcaga

SEQ ID NO: 7756 - DNA, 20 bp, Saccharomyces cerevisiae
atcaattaccaccattcggc

SEQ ID NO: 7757 - DNA, 20 bp, Saccharomyces cerevisiae
cacccttagcttgaagcctg

SEQ ID NO: 7758 - DNA, 20 bp, Saccharomyces cerevisiae
ggagcatgactcagaaaggc

SEQ ID NO: 7759 - DNA, 20 bp, Saccharomyces cerevisiae
ggaaggaacgttactgagcg

SEQ ID NO: 7760 - DNA, 20 bp, Saccharomyces cerevisiae
tggatcagcctcacattcag

SEQ ID NO: 7761 - DNA, 20 bp, Saccharomyces cerevisiae
aacggatgcaggttatttcg

SEQ ID NO: 7762 - DNA, 20 bp, Saccharomyces cerevisiae
ggtgggagattggtgatgag

SEQ ID NO: 7763 - DNA, 20 bp, Saccharomyces cerevisiae
gaaaacggaggttgaggtga

SEQ ID NO: 7764 - DNA, 20 bp, Saccharomyces cerevisiae
gctggagtcaccgaagaaac

SEQ ID NO: 7765 - DNA, 20 bp, Saccharomyces cerevisiae
atcatcttacaggggccaca

SEQ ID NO: 7766 - DNA, 20 bp, Saccharomyces cerevisiae
gaagaaatgggtggctttga

SEQ ID NO: 7767 - DNA, 20 bp, Saccharomyces cerevisiae
taaggcgaggtagagttcgg

SEQ ID NO: 7768 - DNA, 20 bp, Saccharomyces cerevisiae
cacatacacaaatggcggac

SEQ ID NO: 7769 - DNA, 20 bp, Saccharomyces cerevisiae
aacaagatgaaaccgctgct

SEQ ID NO: 7770 - DNA, 20 bp, Saccharomyces cerevisiae
atgtttcttactggacgccg

SEQ ID NO: 7771 - DNA, 20 bp, Saccharomyces cerevisiae
tcttcaaggccatgcttctt

SEQ ID NO: 7772 - DNA, 20 bp, Saccharomyces cerevisiae
atgggacaacttgcaaaagc

SEQ ID NO: 7773 - DNA, 20 bp, Saccharomyces cerevisiae
ttgggatctacttccgttgg

SEQ ID NO: 7774 - DNA, 20 bp, Saccharomyces cerevisiae
gaagctgaaaacgtgggaga

SEQ ID NO: 7775 - DNA, 20 bp, Saccharomyces cerevisiae
gattggaatggggtcttcaa

SEQ ID NO: 7776 - DNA, 20 bp, Saccharomyces cerevisiae
cctccagcactaaaccttcc

SEQ ID NO: 7777 - DNA, 20 bp, Saccharomyces cerevisiae
gcgtaatcgagcaagatggt

SEQ ID NO: 7778 - DNA, 20 bp, Saccharomyces cerevisiae
tggtctgttgggacgtatga

SEQ ID NO: 7779 - DNA, 20 bp, Saccharomyces cerevisiae
gagcagaactggtccaaagg

SEQ ID NO: 7780 - DNA, 20 bp, Saccharomyces cerevisiae
tcctccgctggagaaaatta

SEQ ID NO: 7781 - DNA, 21 bp, Saccharomyces cerevisiae
ggttctcgagcctttcaactc

SEQ ID NO: 7782 - DNA, 20 bp, Saccharomyces cerevisiae
atacaaaaccctacacggcg

SEQ ID NO: 7783 - DNA, 21 bp, Saccharomyces cerevisiae
aagacacttaacttcgcgtgg

SEQ ID NO: 7784 - DNA, 20 bp, Saccharomyces cerevisiae
gaaagaatcgccaaggaaga

SEQ ID NO: 7785 - DNA, 20 bp, Saccharomyces cerevisiae
tagcaatgggagcttatcgc

SEQ ID NO: 7786 - DNA, 21 bp, Saccharomyces cerevisiae
tccggttttctcaagttctga

SEQ ID NO: 7787 - DNA, 20 bp, Saccharomyces cerevisiae
gcaacaaagatcgacacgaa

SEQ ID NO: 7788 - DNA, 20 bp, Saccharomyces cerevisiae
catttttcaaaatccacggg

SEQ ID NO: 7789 - DNA, 20 bp, Saccharomyces cerevisiae
gacatttcggcaggtgactt

SEQ ID NO: 7790 - DNA, 20 bp, Saccharomyces cerevisiae
gatcgtaaacgtgacccctt

SEQ ID NO: 7791 - DNA, 20 bp, Saccharomyces cerevisiae
ccttagataaacccgcacca

SEQ ID NO: 7792 - DNA, 20 bp, Saccharomyces cerevisiae
gagcgatagccgcacataat

SEQ ID NO: 7793 - DNA, 20 bp, Saccharomyces cerevisiae
cgagcgatgtggtagctttt

SEQ ID NO: 7794 - DNA, 20 bp, Saccharomyces cerevisiae
accaaccctcactaaaccca

SEQ ID NO: 7795 - DNA, 20 bp, Saccharomyces cerevisiae
tagtcatgcctaccgcgatt

SEQ ID NO: 7796 - DNA, 22 bp, Saccharomyces cerevisiae
agcacctctaacaaatgcttca

SEQ ID NO: 7797 - DNA, 20 bp, Saccharomyces cerevisiae
gcgcactaggagaaaagctg

SEQ ID NO: 7798 - DNA, 20 bp, Saccharomyces cerevisiae
gagaattgtggcagggatgt

SEQ ID NO: 7799 - DNA, 20 bp, Saccharomyces cerevisiae
caaaatggtggatttggctc

SEQ ID NO: 7800 - DNA, 20 bp, Saccharomyces cerevisiae
gcaaggcgatcgtaaagttc

SEQ ID NO: 7801 - DNA, 23 bp, Saccharomyces cerevisiae
gcagcttctgaatatcaagatcg

SEQ ID NO: 7802 - DNA, 20 bp, Saccharomyces cerevisiae
ttccgtgactgaggatgtca

SEQ ID NO: 7803 - DNA, 21 bp, Saccharomyces cerevisiae
agaaaaatgttgagcattccg

SEQ ID NO: 7804 - DNA, 20 bp, Saccharomyces cerevisiae
tcaacccaaacgtcaatgaa

SEQ ID NO: 7805 - DNA, 20 bp, Saccharomyces cerevisiae
agaaggaaccagccaacctt

SEQ ID NO: 7806 - DNA, 20 bp, Saccharomyces cerevisiae
ctttgacaaaattccagcca

SEQ ID NO: 7807 - DNA, 24 bp, Saccharomyces cerevisiae
tttcattgttcagtatttttccac

SEQ ID NO: 7808 - DNA, 20 bp, Saccharomyces cerevisiae
gcgctcaatgaagttgtgaa

SEQ ID NO: 7809 - DNA, 21 bp, Saccharomyces cerevisiae
cacaacgttagcaaatcgaaa

SEQ ID NO: 7810 - DNA, 25 bp, Saccharomyces cerevisiae
aggaagtcagaggttccaagattag

SEQ ID NO: 7811 - DNA, 20 bp, Saccharomyces cerevisiae
ggaacacctgatgatgacga

SEQ ID NO: 7812 - DNA, 20 bp, Saccharomyces cerevisiae
cttcagggcatcgtgaattt

SEQ ID NO: 7813 - DNA, 20 bp, Saccharomyces cerevisiae
ctacgagccacactgatgga

SEQ ID NO: 7814 - DNA, 20 bp, Saccharomyces cerevisiae
agagaagagacgcagcaagc

SEQ ID NO: 7815 - DNA, 20 bp, Saccharomyces cerevisiae
ccacgcttctgttcaaatca

SEQ ID NO: 7816 - DNA, 20 bp, Saccharomyces cerevisiae
ggcccagaagattttcaaca

SEQ ID NO: 7817 - DNA, 20 bp, Saccharomyces cerevisiae
ccacaatagcggttatggct

SEQ ID NO: 7818 - DNA, 21 bp, Saccharomyces cerevisiae
tcgcatgtttttggagtctct

SEQ ID NO: 7819 - DNA, 20 bp, Saccharomyces cerevisiae
ccgttgatcaagttgtcgtc

SEQ ID NO: 7820 - DNA, 20 bp, Saccharomyces cerevisiae
gaaatgaggtgcgatttcgt

SEQ ID NO: 7821 - DNA, 20 bp, Saccharomyces cerevisiae
gccaatttaaacgaagccaa

SEQ ID NO: 7822 - DNA, 21 bp, Saccharomyces cerevisiae
tgacaatcacccacaaaatga

SEQ ID NO: 7823 - DNA, 20 bp, Saccharomyces cerevisiae
agtgttggtggaattttgcc

SEQ ID NO: 7824 - DNA, 20 bp, Saccharomyces cerevisiae
tgggaagaagacattttggc

SEQ ID NO: 7825 - DNA, 20 bp, Saccharomyces cerevisiae
caaccttcattgtagccggt

SEQ ID NO: 7826 - DNA, 20 bp, Saccharomyces cerevisiae
aataccgatgagttccgtgg

SEQ ID NO: 7827 - DNA, 20 bp, Saccharomyces cerevisiae
taataggagggtctggtgcg

SEQ ID NO: 7828 - DNA, 20 bp, Saccharomyces cerevisiae
tagttcctttggcaatggct

SEQ ID NO: 7829 - DNA, 20 bp, Saccharomyces cerevisiae
gagaaagattagcggaagcg

SEQ ID NO: 7830 - DNA, 20 bp, Saccharomyces cerevisiae
ctaaattgcggagaaggctg

SEQ ID NO: 7831 - DNA, 20 bp, Saccharomyces cerevisiae
gcctgtcttcccttcctttt

SEQ ID NO: 7832 - DNA, 20 bp, Saccharomyces cerevisiae
cggagaaattgtccccaagt

SEQ ID NO: 7833 - DNA, 20 bp, Saccharomyces cerevisiae
agcgatagctgagattgcgt

SEQ ID NO: 7834 - DNA, 20 bp, Saccharomyces cerevisiae
aattgcacccactcttttcg

SEQ ID NO: 7835 - DNA, 20 bp, Saccharomyces cerevisiae
atgctcgatgttcgaggttc

SEQ ID NO: 7836 - DNA, 20 bp, Saccharomyces cerevisiae
cgccaacaaaatcagtcaag

SEQ ID NO: 7837 - DNA, 20 bp, Saccharomyces cerevisiae
tattggcaacatggtgaagc

SEQ ID NO: 7838 - DNA, 20 bp, Saccharomyces cerevisiae
gagtaggctcagttgcctgc

SEQ ID NO: 7839 - DNA, 20 bp, Saccharomyces cerevisiae
acattgccgaattgaaggac

SEQ ID NO: 7840 - DNA, 20 bp, Saccharomyces cerevisiae
gagccaaaagcaatctgacc

SEQ ID NO: 7841 - DNA, 20 bp, Saccharomyces cerevisiae
ctggggtacttgtgcaggtt

SEQ ID NO: 7842 - DNA, 20 bp, Saccharomyces cerevisiae
atacaaccaccaccctgctc

SEQ ID NO: 7843 - DNA, 20 bp, Saccharomyces cerevisiae
attggagtcggcaaatgcta

SEQ ID NO: 7844 - DNA, 20 bp, Saccharomyces cerevisiae
aaccggtattccatgaacct

SEQ ID NO: 7845 - DNA, 20 bp, Saccharomyces cerevisiae
aagattgccggtgaaaagtg

SEQ ID NO: 7846 - DNA, 20 bp, Saccharomyces cerevisiae
tcgcattcttctggagacct

SEQ ID NO: 7847 - DNA, 20 bp, Saccharomyces cerevisiae
aaagggtgcactggttcaat

SEQ ID NO: 7848 - DNA, 23 bp, Saccharomyces cerevisiae
tccagtatggacctcttaggtga

SEQ ID NO: 7849 - DNA, 20 bp, Saccharomyces cerevisiae
gatctgggtcccactgaaga

SEQ ID NO: 7850 - DNA, 20 bp, Saccharomyces cerevisiae
tagcacattccctgtttccc

SEQ ID NO: 7851 - DNA, 20 bp, Saccharomyces cerevisiae
gagaacggatgctcaaaagg

SEQ ID NO: 7852 - DNA, 23 bp, Saccharomyces cerevisiae
tggagaggtattctcaaggatga

SEQ ID NO: 7853 - DNA, 20 bp, Saccharomyces cerevisiae
attcagtgatcaattggggc

SEQ ID NO: 7854 - DNA, 20 bp, Saccharomyces cerevisiae
cccttgcgacgtcttaactc

SEQ ID NO: 7855 - DNA, 20 bp, Saccharomyces cerevisiae
tgaaacgtcagagactcggt

SEQ ID NO: 7856 - DNA, 20 bp, Saccharomyces cerevisiae
aaatgtttcgccaactttca

SEQ ID NO: 7857 - DNA, 22 bp, Saccharomyces cerevisiae
tgcacacttcaatctgttgtga

SEQ ID NO: 7858 - DNA, 20 bp, Saccharomyces cerevisiae
caacacctttcaaaacggct

SEQ ID NO: 7859 - DNA, 20 bp, Saccharomyces cerevisiae
cgtctttcaacgcggtattt

SEQ ID NO: 7860 - DNA, 21 bp, Saccharomyces cerevisiae
ggaaccaaggaactgttaggc

SEQ ID NO: 7861 - DNA, 22 bp, Saccharomyces cerevisiae
tcaaaaacatacgtatcacggc

SEQ ID NO: 7862 - DNA, 23 bp, Saccharomyces cerevisiae
tgtggatgaaacttcctacttgg

SEQ ID NO: 7863 - DNA, 20 bp, Saccharomyces cerevisiae
tggtaacatcaatggcagga

SEQ ID NO: 7864 - DNA, 20 bp, Saccharomyces cerevisiae
tttcaacgattaccaagccc

SEQ ID NO: 7865 - DNA, 20 bp, Saccharomyces cerevisiae
tcacttgaattgcggatttg

SEQ ID NO: 7866 - DNA, 20 bp, Saccharomyces cerevisiae
tttacgtaccggagccaatc

SEQ ID NO: 7867 - DNA, 20 bp, Saccharomyces cerevisiae
gactgcaacgacgaagatga

SEQ ID NO: 7868 - DNA, 20 bp, Saccharomyces cerevisiae
tactgcgaccaagtctgacg

SEQ ID NO: 7869 - DNA, 20 bp, Saccharomyces cerevisiae
aaagtcattccaatcgcagc

SEQ ID NO: 7870 - DNA, 23 bp, Saccharomyces cerevisiae
gagcacaattagtttatttggca

SEQ ID NO: 7871 - DNA, 20 bp, Saccharomyces cerevisiae
ttttgtactttcgggccaag

SEQ ID NO: 7872 - DNA, 20 bp, Saccharomyces cerevisiae
cggcaccaaaatagacgaat

SEQ ID NO: 7873 - DNA, 20 bp, Saccharomyces cerevisiae
tttgaacgttcgtcaggaca

SEQ ID NO: 7874 - DNA, 22 bp, Saccharomyces cerevisiae
aaattaacatgcccttttctgg

SEQ ID NO: 7875 - DNA, 20 bp, Saccharomyces cerevisiae
ataatcatctgccacctcgc

SEQ ID NO: 7876 - DNA, 20 bp, Saccharomyces cerevisiae
tgccagatcatcaaacgaga

SEQ ID NO: 7877 - DNA, 20 bp, Saccharomyces cerevisiae
tcgaaatcagccttccattc

SEQ ID NO: 7878 - DNA, 20 bp, Saccharomyces cerevisiae
cttccaaagcgaaacgagtc

SEQ ID NO: 7879 - DNA, 20 bp, Saccharomyces cerevisiae
agcgttctccgaaggaagtc

SEQ ID NO: 7880 - DNA, 25 bp, Saccharomyces cerevisiae
aaaaggacaagatgttaaaaatcca

SEQ ID NO: 7881 - DNA, 20 bp, Saccharomyces cerevisiae
tgccggcttagctctgtaaa

SEQ ID NO: 7882 - DNA, 20 bp, Saccharomyces cerevisiae
aatcgaagacccatctgctg

SEQ ID NO: 7883 - DNA, 20 bp, Saccharomyces cerevisiae
cgtgggctgaattgatctct

SEQ ID NO: 7884 - DNA, 20 bp, Saccharomyces cerevisiae
caggcttggaggaaaaagtg

SEQ ID NO: 7885 - DNA, 20 bp, Saccharomyces cerevisiae
acagcattgctttcacatcg

SEQ ID NO: 7886 - DNA, 20 bp, Saccharomyces cerevisiae
gacgcattggcaaagaattt

SEQ ID NO: 7887 - DNA, 20 bp, Saccharomyces cerevisiae
ttcgccaaaagacaaacctt

SEQ ID NO: 7888 - DNA, 20 bp, Saccharomyces cerevisiae
aaagaacgatggcgatgaag

SEQ ID NO: 7889 - DNA, 20 bp, Saccharomyces cerevisiae
tttgctgtggcaccaaaata

SEQ ID NO: 7890 - DNA, 22 bp, Saccharomyces cerevisiae
ccgttctattgacctagccttg

SEQ ID NO: 7891 - DNA, 20 bp, Saccharomyces cerevisiae
tttccaacgaaaaggaccac

SEQ ID NO: 7892 - DNA, 20 bp, Saccharomyces cerevisiae
tgtcacgcacggtgttttat

SEQ ID NO: 7893 - DNA, 20 bp, Saccharomyces cerevisiae
ggtaaagtttgccttccgct

SEQ ID NO: 7894 - DNA, 20 bp, Saccharomyces cerevisiae
gaattgagggtcccaatcag

SEQ ID NO: 7895 - DNA, 20 bp, Saccharomyces cerevisiae
atggcaggtgtcattgttga

SEQ ID NO: 7896 - DNA, 20 bp, Saccharomyces cerevisiae
tcgaacgagtgactctggaa

SEQ ID NO: 7897 - DNA, 20 bp, Saccharomyces cerevisiae
ggaacctctgcaaaatccaa

SEQ ID NO: 7898 - DNA, 19 bp, Saccharomyces cerevisiae
ctattgccaagaggcccat

SEQ ID NO: 7899 - DNA, 22 bp, Saccharomyces cerevisiae
gtggatggtgaaaagtttcctt

SEQ ID NO: 7900 - DNA, 20 bp, Saccharomyces cerevisiae
cacatttgaacatgggaacg

SEQ ID NO: 7901 - DNA, 20 bp, Saccharomyces cerevisiae
ccgagcaaacagtctccatt

SEQ ID NO: 7902 - DNA, 20 bp, Saccharomyces cerevisiae
ggatgccactgacctttctc

SEQ ID NO: 7903 - DNA, 20 bp, Saccharomyces cerevisiae
agtggacggaaaacaaatgg

SEQ ID NO: 7904 - DNA, 19 bp, Saccharomyces cerevisiae
gcgtttacgcattccattg

SEQ ID NO: 7905 - DNA, 20 bp, Saccharomyces cerevisiae
acaccaaagaaaccaccagg

SEQ ID NO: 7906 - DNA, 20 bp, Saccharomyces cerevisiae
ggaaaacactgcacctccat

SEQ ID NO: 7907 - DNA, 20 bp, Saccharomyces cerevisiae
accaaatttcccaagccttt

SEQ ID NO: 7908 - DNA, 21 bp, Saccharomyces cerevisiae
aatcttagtggacaatggggg

SEQ ID NO: 7909 - DNA, 20 bp, Saccharomyces cerevisiae
tccaaccatccctcactagg

SEQ ID NO: 7910 - DNA, 21 bp, Saccharomyces cerevisiae
ttgattgtcttgacgttgcat

SEQ ID NO: 7911 - DNA, 20 bp, Saccharomyces cerevisiae
tcgatgtatgtgacacccgt

SEQ ID NO: 7912 - DNA, 20 bp, Saccharomyces cerevisiae
tgggagtgctaatgctcctt

SEQ ID NO: 7913 - DNA, 20 bp, Saccharomyces cerevisiae
tggcctgtgttgaagtatgg

SEQ ID NO: 7914 - DNA, 20 bp, Saccharomyces cerevisiae
aaaaccatcaactctccccc

SEQ ID NO: 7915 - DNA, 20 bp, Saccharomyces cerevisiae
ttcacctcgaggacttgaaa

SEQ ID NO: 7916 - DNA, 20 bp, Saccharomyces cerevisiae
attgcgatgtctttgacgtg

SEQ ID NO: 7917 - DNA, 22 bp, Saccharomyces cerevisiae
aaagctggatttagcttcctca

SEQ ID NO: 7918 - DNA, 20 bp, Saccharomyces cerevisiae
gcgagctatgagctgtgatg

SEQ ID NO: 7919 - DNA, 21 bp, Saccharomyces cerevisiae
caggaacaaatctcgagaacg

SEQ ID NO: 7920 - DNA, 20 bp, Saccharomyces cerevisiae
cttctgctgacgacattcca

SEQ ID NO: 7921 - DNA, 20 bp, Saccharomyces cerevisiae
aaaatgccaaacagcgtacc

SEQ ID NO: 7922 - DNA, 20 bp, Saccharomyces cerevisiae
ctgggtagctctttcatcgc

SEQ ID NO: 7923 - DNA, 20 bp, Saccharomyces cerevisiae
gattgaacgggtagagcctg

SEQ ID NO: 7924 - DNA, 20 bp, Saccharomyces cerevisiae
cggatgcctacgttttgttt

SEQ ID NO: 7925 - DNA, 20 bp, Saccharomyces cerevisiae
gcacccgaatctgtcaatct

SEQ ID NO: 7926 - DNA, 20 bp, Saccharomyces cerevisiae
agatgggacttctgccaatg

SEQ ID NO: 7927 - DNA, 20 bp, Saccharomyces cerevisiae
tgtaggaaggcagggttacg

SEQ ID NO: 7928 - DNA, 20 bp, Saccharomyces cerevisiae
ttggcgacatatcaatgagc

SEQ ID NO: 7929 - DNA, 20 bp, Saccharomyces cerevisiae
tgcctctgttttctggcttt

SEQ ID NO: 7930 - DNA, 20 bp, Saccharomyces cerevisiae
tgtaacggcttgtgaacctg

SEQ ID NO: 7931 - DNA, 20 bp, Saccharomyces cerevisiae
agccctcagcttctcaagtg

SEQ ID NO: 7932 - DNA, 20 bp, Saccharomyces cerevisiae
cgttatgccacacaagtgct

SEQ ID NO: 7933 - DNA, 21 bp, Saccharomyces cerevisiae
cggtgtagccacgtgttaaat

SEQ ID NO: 7934 - DNA, 20 bp, Saccharomyces cerevisiae
acatgcagctcaatgtctgg

SEQ ID NO: 7935 - DNA, 20 bp, Saccharomyces cerevisiae
ggctttttcacttgccacat

SEQ ID NO: 7936 - DNA, 21 bp, Saccharomyces cerevisiae
aaaaggaaccaacaaatcggt

SEQ ID NO: 7937 - DNA, 20 bp, Saccharomyces cerevisiae
tacgaattgcaaggcaaatg

SEQ ID NO: 7938 - DNA, 20 bp, Saccharomyces cerevisiae
gctcacatatattgggcggt

SEQ ID NO: 7939 - DNA, 20 bp, Saccharomyces cerevisiae
taacgccattgctgatgaaa

SEQ ID NO: 7940 - DNA, 20 bp, Saccharomyces cerevisiae
attcgatttgaatgcccttg

SEQ ID NO: 7941 - DNA, 20 bp, Saccharomyces cerevisiae
tcccactgttcaccaaatca

SEQ ID NO: 7942 - DNA, 20 bp, Saccharomyces cerevisiae
gaggtagtacccggtagccc

SEQ ID NO: 7943 - DNA, 20 bp, Saccharomyces cerevisiae
gtgcgacggttatacgttca

SEQ ID NO: 7944 - DNA, 20 bp, Saccharomyces cerevisiae
tgcgtgtaccagctgttgat

SEQ ID NO: 7945 - DNA, 21 bp, Saccharomyces cerevisiae
tgggagactcttcatgcattt

SEQ ID NO: 7946 - DNA, 20 bp, Saccharomyces cerevisiae
ctccgcataagtaggttgcc

SEQ ID NO: 7947 - DNA, 20 bp, Saccharomyces cerevisiae
tcttgtccctaacaatcgcc

SEQ ID NO: 7948 - DNA, 20 bp, Saccharomyces cerevisiae
ttcccttgcaaacagtaggc

SEQ ID NO: 7949 - DNA, 20 bp, Saccharomyces cerevisiae
gatagtcccaccccgatctt

SEQ ID NO: 7950 - DNA, 20 bp, Saccharomyces cerevisiae
gtaccagggcctgctctatg

SEQ ID NO: 7951 - DNA, 20 bp, Saccharomyces cerevisiae
ttgacaccacaaagcagcat

SEQ ID NO: 7952 - DNA, 20 bp, Saccharomyces cerevisiae
gttatggttgatgggctgct

SEQ ID NO: 7953 - DNA, 20 bp, Saccharomyces cerevisiae
attgaagaaccgaaccatcg

SEQ ID NO: 7954 - DNA, 20 bp, Saccharomyces cerevisiae
ataatgatgctgggccgata

SEQ ID NO: 7955 - DNA, 21 bp, Saccharomyces cerevisiae
tctgaaaaggttggattggaa

SEQ ID NO: 7956 - DNA, 20 bp, Saccharomyces cerevisiae
taatctccgtgtctccctgg

SEQ ID NO: 7957 - DNA, 20 bp, Saccharomyces cerevisiae
ttgaacaacttgaaatggcg

SEQ ID NO: 7958 - DNA, 22 bp, Saccharomyces cerevisiae
tcgtaactttgtctcacctgga

SEQ ID NO: 7959 - DNA, 20 bp, Saccharomyces cerevisiae
ccctcagctggtgtggtact

SEQ ID NO: 7960 - DNA, 20 bp, Saccharomyces cerevisiae
ttctccacttctctgtgcca

SEQ ID NO: 7961 - DNA, 20 bp, Saccharomyces cerevisiae
gtctttatcggcatgttcgg

SEQ ID NO: 7962 - DNA, 20 bp, Saccharomyces cerevisiae
attggcaccttggacaattt

SEQ ID NO: 7963 - DNA, 20 bp, Saccharomyces cerevisiae
tggagaatggtaaaatcgcc

SEQ ID NO: 7964 - DNA, 20 bp, Saccharomyces cerevisiae
caatgacaatcttcaggccc

SEQ ID NO: 7965 - DNA, 20 bp, Saccharomyces cerevisiae
gggagccacattatcctttg

SEQ ID NO: 7966 - DNA, 20 bp, Saccharomyces cerevisiae
aatggtctccgtcactttgg

SEQ ID NO: 7967 - DNA, 20 bp, Saccharomyces cerevisiae
acgagacggatgaaaggaga

SEQ ID NO: 7968 - DNA, 22 bp, Saccharomyces cerevisiae
tccagttccatacgaaaccttc

SEQ ID NO: 7969 - DNA, 20 bp, Saccharomyces cerevisiae
cacaaaagctctccaaaggg

SEQ ID NO: 7970 - DNA, 23 bp, Saccharomyces cerevisiae
catctgatgaagaggatacagca

SEQ ID NO: 7971 - DNA, 20 bp, Saccharomyces cerevisiae
gctctcttcagggacagggt

SEQ ID NO: 7972 - DNA, 20 bp, Saccharomyces cerevisiae
ggggtcgtctgaattagcaa

SEQ ID NO: 7973 - DNA, 20 bp, Saccharomyces cerevisiae
aacgtttgaatgtgggaagc

SEQ ID NO: 7974 - DNA, 20 bp, Saccharomyces cerevisiae
gggttgatgtgatgattgcc

SEQ ID NO: 7975 - DNA, 20 bp, Saccharomyces cerevisiae
tttgcgatcccttatatcgc

SEQ ID NO: 7976 - DNA, 20 bp, Saccharomyces cerevisiae
ccataaaataatcgggcgtg

SEQ ID NO: 7977 - DNA, 20 bp, Saccharomyces cerevisiae
gacatctttttgggcgaaag

SEQ ID NO: 7978 - DNA, 20 bp, Saccharomyces cerevisiae
cagagtaacaggccacccat

SEQ ID NO: 7979 - DNA, 20 bp, Saccharomyces cerevisiae
ggtgtggtgtccttcaccat

SEQ ID NO: 7980 - DNA, 20 bp, Saccharomyces cerevisiae
ccagttgaccctattgggaa

SEQ ID NO: 7981 - DNA, 20 bp, Saccharomyces cerevisiae
cgattaacagcagggaagga

SEQ ID NO: 7982 - DNA, 20 bp, Saccharomyces cerevisiae
ttccattgagcctcgagaac

SEQ ID NO: 7983 - DNA, 20 bp, Saccharomyces cerevisiae
agaaggaggggcaaagaaag

SEQ ID NO: 7984 - DNA, 20 bp, Saccharomyces cerevisiae
tgtcaaaacaaccaacggaa

SEQ ID NO: 7985 - DNA, 20 bp, Saccharomyces cerevisiae
atcgacaatggaatcccaac

SEQ ID NO: 7986 - DNA, 20 bp, Saccharomyces cerevisiae
atggccaattaacggagaca

SEQ ID NO: 7987 - DNA, 20 bp, Saccharomyces cerevisiae
cgaaggctagcgaggtactg

SEQ ID NO: 7988 - DNA, 20 bp, Saccharomyces cerevisiae
caaagccaccaatggaactt

SEQ ID NO: 7989 - DNA, 20 bp, Saccharomyces cerevisiae
ttgataccgttcacccaaca

SEQ ID NO: 7990 - DNA, 20 bp, Saccharomyces cerevisiae
atggccgctattttgtcaac

SEQ ID NO: 7991 - DNA, 20 bp, Saccharomyces cerevisiae
cgtttgatgttgccaaatgt

SEQ ID NO: 7992 - DNA, 20 bp, Saccharomyces cerevisiae
cacaaacagtgaaaccgtgg

SEQ ID NO: 7993 - DNA, 20 bp, Saccharomyces cerevisiae
tcatgtcgactcctgtgagc

SEQ ID NO: 7994 - DNA, 20 bp, Saccharomyces cerevisiae
taatgaccagcgctatcgaa

SEQ ID NO: 7995 - DNA, 20 bp, Saccharomyces cerevisiae
gtgccatcctcggaagagta

SEQ ID NO: 7996 - DNA, 20 bp, Saccharomyces cerevisiae
tgaccgaatttttggacaga

SEQ ID NO: 7997 - DNA, 20 bp, Saccharomyces cerevisiae
aaggagagggaaagtccgtg

SEQ ID NO: 7998 - DNA, 20 bp, Saccharomyces cerevisiae
cttgcccaatgaattccaac

SEQ ID NO: 7999 - DNA, 20 bp, Saccharomyces cerevisiae
tcgttggtccatcctatggt

SEQ ID NO: 8000 - DNA, 25 bp, Saccharomyces cerevisiae
tctatagtttgtgttgtgtccctca

SEQ ID NO: 8001 - DNA, 20 bp, Saccharomyces cerevisiae
tttgagtggcaactactgcg

SEQ ID NO: 8002 - DNA, 20 bp, Saccharomyces cerevisiae
gggatcccaacaattatcca

SEQ ID NO: 8003 - DNA, 20 bp, Saccharomyces cerevisiae
ctcgcggatttgatagcatt

SEQ ID NO: 8004 - DNA, 20 bp, Saccharomyces cerevisiae
ttccaattccacgaaggaaa

SEQ ID NO: 8005 - DNA, 20 bp, Saccharomyces cerevisiae
ctactgggagcgttaggacg

SEQ ID NO: 8006 - DNA, 20 bp, Saccharomyces cerevisiae
cgagtgtccagagacgatga

SEQ ID NO: 8007 - DNA, 20 bp, Saccharomyces cerevisiae
agacgtgatggccctgtaac

SEQ ID NO: 8008 - DNA, 20 bp, Saccharomyces cerevisiae
agctgcctgtgaaatcctgt

SEQ ID NO: 8009 - DNA, 20 bp, Saccharomyces cerevisiae
caagccaaacgccttaaaga

SEQ ID NO: 8010 - DNA, 20 bp, Saccharomyces cerevisiae
ttttctcctgcaatgggaac

SEQ ID NO: 8011 - DNA, 20 bp, Saccharomyces cerevisiae
gcaactgggatgaaggaaga

SEQ ID NO: 8012 - DNA, 20 bp, Saccharomyces cerevisiae
gggacctgcattcattcaac

SEQ ID NO: 8013 - DNA, 20 bp, Saccharomyces cerevisiae
tgtctaccgccagttgaatg

SEQ ID NO: 8014 - DNA, 20 bp, Saccharomyces cerevisiae
tgagtaagctggcgattgaa

SEQ ID NO: 8015 - DNA, 20 bp, Saccharomyces cerevisiae
aatgtagcgatgtggggaag

SEQ ID NO: 8016 - DNA, 20 bp, Saccharomyces cerevisiae
aaagaggtggcgattgtgtc

SEQ ID NO: 8017 - DNA, 21 bp, Saccharomyces cerevisiae
ttctcggaacaagagacctca

SEQ ID NO: 8018 - DNA, 20 bp, Saccharomyces cerevisiae
gttaccgagggcaaatcctt

SEQ ID NO: 8019 - DNA, 20 bp, Saccharomyces cerevisiae
ggtttgcaataacattgggc

SEQ ID NO: 8020 - DNA, 20 bp, Saccharomyces cerevisiae
tcttgtgaatcctgtgtcgg

SEQ ID NO: 8021 - DNA, 20 bp, Saccharomyces cerevisiae
ttattttccaagcggaagga

SEQ ID NO: 8022 - DNA, 21 bp, Saccharomyces cerevisiae
agctctaagtcgaagttgcca

SEQ ID NO: 8023 - DNA, 20 bp, Saccharomyces cerevisiae
atccatgaacatagccccaa

SEQ ID NO: 8024 - DNA, 20 bp, Saccharomyces cerevisiae
cttccaaggtgtccacgact

SEQ ID NO: 8025 - DNA, 20 bp, Saccharomyces cerevisiae
cgagcgctagttctaaggga

SEQ ID NO: 8026 - DNA, 20 bp, Saccharomyces cerevisiae
tctttcaccggagatggttc

SEQ ID NO: 8027 - DNA, 20 bp, Saccharomyces cerevisiae
tggtttcgatttggttcaca

SEQ ID NO: 8028 - DNA, 20 bp, Saccharomyces cerevisiae
aggttgccaatacaaatcgg

SEQ ID NO: 8029 - DNA, 20 bp, Saccharomyces cerevisiae
gttccatcgatatcgcaacc

SEQ ID NO: 8030 - DNA, 20 bp, Saccharomyces cerevisiae
gtgccgtctagaaaatggga

SEQ ID NO: 8031 - DNA, 20 bp, Saccharomyces cerevisiae
aactacaggggtagtgcgat

SEQ ID NO: 8032 - DNA, 20 bp, Saccharomyces cerevisiae
ccaaaggaagacgtgaccat

SEQ ID NO: 8033 - DNA, 20 bp, Saccharomyces cerevisiae
ccgctacctcagtctcacct

SEQ ID NO: 8034 - DNA, 20 bp, Saccharomyces cerevisiae
cacccttccgactctttttg

SEQ ID NO: 8035 - DNA, 20 bp, Saccharomyces cerevisiae
ccgaggaaaaagcacagaac

SEQ ID NO: 8036 - DNA, 21 bp, Saccharomyces cerevisiae
tcggttaatttcccctttctt

SEQ ID NO: 8037 - DNA, 20 bp, Saccharomyces cerevisiae
ttttcgaagcttcttttgcc

SEQ ID NO: 8038 - DNA, 20 bp, Saccharomyces cerevisiae
ttgatggagttgttgaccca

SEQ ID NO: 8039 - DNA, 20 bp, Saccharomyces cerevisiae
cgacttgtaacggtctgctg

SEQ ID NO: 8040 - DNA, 21 bp, Saccharomyces cerevisiae
cagaattcggaaagaagatgg

SEQ ID NO: 8041 - DNA, 20 bp, Saccharomyces cerevisiae
cgatgaacatgacttcccaa

SEQ ID NO: 8042 - DNA, 20 bp, Saccharomyces cerevisiae
tgttggtagactcaatggcg

SEQ ID NO: 8043 - DNA, 20 bp, Saccharomyces cerevisiae
tagcggctggaattgtttct

SEQ ID NO: 8044 - DNA, 20 bp, Saccharomyces cerevisiae
aaaactcctctcctcctggg

SEQ ID NO: 8045 - DNA, 20 bp, Saccharomyces cerevisiae
ggccactttgttgaattcgt

SEQ ID NO: 8046 - DNA, 20 bp, Saccharomyces cerevisiae
ggcggtacaagtttttggaa

SEQ ID NO: 8047 - DNA, 20 bp, Saccharomyces cerevisiae
ttatatacaatggccgtgcg

SEQ ID NO: 8048 - DNA, 20 bp, Saccharomyces cerevisiae
gcaaggcttcaaggcattag

SEQ ID NO: 8049 - DNA, 20 bp, Saccharomyces cerevisiae
agtgggttcgctaacattcg

SEQ ID NO: 8050 - DNA, 21 bp, Saccharomyces cerevisiae
tctgagcctcaatggtgtaga

SEQ ID NO: 8051 - DNA, 20 bp, Saccharomyces cerevisiae
cctcccactttctttgatgc

SEQ ID NO: 8052 - DNA, 20 bp, Saccharomyces cerevisiae
aaaatcgatgtctcctgcaa

SEQ ID NO: 8053 - DNA, 20 bp, Saccharomyces cerevisiae
gacgggcaaatcgaacatac

SEQ ID NO: 8054 - DNA, 20 bp, Saccharomyces cerevisiae
cctgcgtctcagtccaattt

SEQ ID NO: 8055 - DNA, 20 bp, Saccharomyces cerevisiae
tgtttcaattcgatgccaaa

SEQ ID NO: 8056 - DNA, 20 bp, Saccharomyces cerevisiae
acgacagcgttttccttgat

SEQ ID NO: 8057 - DNA, 22 bp, Saccharomyces cerevisiae
cctcttttggagatgacacaca

SEQ ID NO: 8058 - DNA, 20 bp, Saccharomyces cerevisiae
gatgttaggagaaggagcgg

SEQ ID NO: 8059 - DNA, 20 bp, Saccharomyces cerevisiae
ggtcatagttcatggcctcg

SEQ ID NO: 8060 - DNA, 20 bp, Saccharomyces cerevisiae
caattccatctcctcccaga

SEQ ID NO: 8061 - DNA, 20 bp, Saccharomyces cerevisiae
acaaagtgcggaaggaaaaa

SEQ ID NO: 8062 - DNA, 20 bp, Saccharomyces cerevisiae
ctaccgaggagaccgaagtg

SEQ ID NO: 8063 - DNA, 20 bp, Saccharomyces cerevisiae
ccaaagacagctcaatgcaa

SEQ ID NO: 8064 - DNA, 20 bp, Saccharomyces cerevisiae
catggtacggtgaccagaca

SEQ ID NO: 8065 - DNA, 20 bp, Saccharomyces cerevisiae
ccacaccggagttctcaaat

SEQ ID NO: 8066 - DNA, 21 bp, Saccharomyces cerevisiae
cgtggatatcaggagagagca

SEQ ID NO: 8067 - DNA, 20 bp, Saccharomyces cerevisiae
tctatcagcattctgctgcg

SEQ ID NO: 8068 - DNA, 20 bp, Saccharomyces cerevisiae
taccgacgcagtctggtaca

SEQ ID NO: 8069 - DNA, 20 bp, Saccharomyces cerevisiae
cccacccaactgaaaaagag

SEQ ID NO: 8070 - DNA, 20 bp, Saccharomyces cerevisiae
gcagccagtgtttcaacaaa

SEQ ID NO: 8071 - DNA, 21 bp, Saccharomyces cerevisiae
cgtaaagcaacgacttgaaca

SEQ ID NO: 8072 - DNA, 20 bp, Saccharomyces cerevisiae
aatttctggcgtcagtttgg

SEQ ID NO: 8073 - DNA, 20 bp, Saccharomyces cerevisiae
tacacgagatagcggtgctg

SEQ ID NO: 8074 - DNA, 20 bp, Saccharomyces cerevisiae
gacacaaaatggagggcaat

SEQ ID NO: 8075 - DNA, 18 bp, Saccharomyces cerevisiae
ggccgcaaaatttacgaa

SEQ ID NO: 8076 - DNA, 20 bp, Saccharomyces cerevisiae
agtctttccttgattcgggc

SEQ ID NO: 8077 - DNA, 20 bp, Saccharomyces cerevisiae
atgcatcggaagacaggttc

SEQ ID NO: 8078 - DNA, 20 bp, Saccharomyces cerevisiae
cacgaacgcaattcattgat

SEQ ID NO: 8079 - DNA, 19 bp, Saccharomyces cerevisiae
aggggccgaaatattcgat

SEQ ID NO: 8080 - DNA, 20 bp, Saccharomyces cerevisiae
gggaggcgtagagttttgtg

SEQ ID NO: 8081 - DNA, 20 bp, Saccharomyces cerevisiae
tccaagagagccgatgattt

SEQ ID NO: 8082 - DNA, 20 bp, Saccharomyces cerevisiae
aatagcttggcagcaacagg

SEQ ID NO: 8083 - DNA, 19 bp, Saccharomyces cerevisiae
gttttgcatccatggtggg

SEQ ID NO: 8084 - DNA, 20 bp, Saccharomyces cerevisiae
caccactttcggtgaccttt

SEQ ID NO: 8085 - DNA, 20 bp, Saccharomyces cerevisiae
tgagggagaaagaaggagca

SEQ ID NO: 8086 - DNA, 20 bp, Saccharomyces cerevisiae
acgagcgaagtgccaactat

SEQ ID NO: 8087 - DNA, 20 bp, Saccharomyces cerevisiae
ccactttggaaaactgtggg

SEQ ID NO: 8088 - DNA, 20 bp, Saccharomyces cerevisiae
tgctgcggagttcctatttt

SEQ ID NO: 8089 - DNA, 19 bp, Saccharomyces cerevisiae
ctggacactcactgggtcg

SEQ ID NO: 8090 - DNA, 20 bp, Saccharomyces cerevisiae
ttatcgtctacgggaaacgc

SEQ ID NO: 8091 - DNA, 20 bp, Saccharomyces cerevisiae
acatcgggcataaacctttg

SEQ ID NO: 8092 - DNA, 20 bp, Saccharomyces cerevisiae
aaattctgcacccaatggtc

SEQ ID NO: 8093 - DNA, 20 bp, Saccharomyces cerevisiae
gtggcatcagatgggaactt

SEQ ID NO: 8094 - DNA, 20 bp, Saccharomyces cerevisiae
tgatgacgattgggagacaa

SEQ ID NO: 8095 - DNA, 20 bp, Saccharomyces cerevisiae
aatgtaatttgagtcgccgc

SEQ ID NO: 8096 - DNA, 20 bp, Saccharomyces cerevisiae
caatgtaacatcggtgtcgg

SEQ ID NO: 8097 - DNA, 21 bp, Saccharomyces cerevisiae
gaacaataaaggacgttgcga

SEQ ID NO: 8098 - DNA, 20 bp, Saccharomyces cerevisiae
attagtccagcaaaggcagg

SEQ ID NO: 8099 - DNA, 20 bp, Saccharomyces cerevisiae
actgcttggcgcttatgatt

SEQ ID NO: 8100 - DNA, 20 bp, Saccharomyces cerevisiae
gtgattgggaaaggcacact

SEQ ID NO: 8101 - DNA, 20 bp, Saccharomyces cerevisiae
ggcagcaatatttttgcgat

SEQ ID NO: 8102 - DNA, 25 bp, Saccharomyces cerevisiae
aaacttgaagggctacctaattctg

SEQ ID NO: 8103 - DNA, 20 bp, Saccharomyces cerevisiae
gggttttgccttctgtgatt

SEQ ID NO: 8104 - DNA, 20 bp, Saccharomyces cerevisiae
tagacgaggaacggtgactg

SEQ ID NO: 8105 - DNA, 20 bp, Saccharomyces cerevisiae
aattgccatttccaattcca

SEQ ID NO: 8106 - DNA, 20 bp, Saccharomyces cerevisiae
aggactgggacagtcattgg

SEQ ID NO: 8107 - DNA, 20 bp, Saccharomyces cerevisiae
attgcctgggtttgtgaaag

SEQ ID NO: 8108 - DNA, 22 bp, Saccharomyces cerevisiae
gcgttcaagaatccataacaca

SEQ ID NO: 8109 - DNA, 20 bp, Saccharomyces cerevisiae
tagccatgcatagccatcaa

SEQ ID NO: 8110 - DNA, 22 bp, Saccharomyces cerevisiae
ggaaataccctctaacctgcaa

SEQ ID NO: 8111 - DNA, 20 bp, Saccharomyces cerevisiae
tgccgtcagcgcttatacta

SEQ ID NO: 8112 - DNA, 20 bp, Saccharomyces cerevisiae
cggagttagggggagatgtt

SEQ ID NO: 8113 - DNA, 20 bp, Saccharomyces cerevisiae
agaaccaggccttccacttt

SEQ ID NO: 8114 - DNA, 20 bp, Saccharomyces cerevisiae
gagagcggatttgtggaaga

SEQ ID NO: 8115 - DNA, 21 bp, Saccharomyces cerevisiae
tctcctctattagcattgcct

SEQ ID NO: 8116 - DNA, 20 bp, Saccharomyces cerevisiae
gccgtatgggtctctcttca

SEQ ID NO: 8117 - DNA, 20 bp, Saccharomyces cerevisiae
tcttgctgaagaaggcatca

SEQ ID NO: 8118 - DNA, 20 bp, Saccharomyces cerevisiae
aggataaccgatgatcgcaa

SEQ ID NO: 8119 - DNA, 20 bp, Saccharomyces cerevisiae
gatcaggtgcgtggattcat

SEQ ID NO: 8120 - DNA, 20 bp, Saccharomyces cerevisiae
gtcgtcaacagggatgtcct

SEQ ID NO: 8121 - DNA, 20 bp, Saccharomyces cerevisiae
tatctgcagtagcagccgtg

SEQ ID NO: 8122 - DNA, 21 bp, Saccharomyces cerevisiae
tggttaatggaatatggtggg

SEQ ID NO: 8123 - DNA, 20 bp, Saccharomyces cerevisiae
acgtttgttcttttcccacg

SEQ ID NO: 8124 - DNA, 20 bp, Saccharomyces cerevisiae
tatcccacgaaccaatctcc

SEQ ID NO: 8125 - DNA, 20 bp, Saccharomyces cerevisiae
gcggcaaaactttaagtgga

SEQ ID NO: 8126 - DNA, 20 bp, Saccharomyces cerevisiae
ccagttccaacggtgaattt

SEQ ID NO: 8127 - DNA, 20 bp, Saccharomyces cerevisiae
acagggtgccaccatagaaa

SEQ ID NO: 8128 - DNA, 20 bp, Saccharomyces cerevisiae
ttcaccccagaataaatcgc

SEQ ID NO: 8129 - DNA, 20 bp, Saccharomyces cerevisiae
tcaaactgtatgcctctgcg

SEQ ID NO: 8130 - DNA, 20 bp, Saccharomyces cerevisiae
tgcgtatgggatttcgtgta

SEQ ID NO: 8131 - DNA, 20 bp, Saccharomyces cerevisiae
aagcgcccttgtcgtattta

SEQ ID NO: 8132 - DNA, 20 bp, Saccharomyces cerevisiae
actgccatttttggttggac

SEQ ID NO: 8133 - DNA, 20 bp, Saccharomyces cerevisiae
cgtcggttctgaattatggg

SEQ ID NO: 8134 - DNA, 20 bp, Saccharomyces cerevisiae
cactaaaccaaagggccaaa

SEQ ID NO: 8135 - DNA, 20 bp, Saccharomyces cerevisiae
ttctacggcaattctggcat

SEQ ID NO: 8136 - DNA, 20 bp, Saccharomyces cerevisiae
gtttgcgccacagaaagatt

SEQ ID NO: 8137 - DNA, 20 bp, Saccharomyces cerevisiae
aggaaagggacacaaagggt

SEQ ID NO: 8138 - DNA, 21 bp, Saccharomyces cerevisiae
ggtacgtgaatcatcgaagga

SEQ ID NO: 8139 - DNA, 20 bp, Saccharomyces cerevisiae
tccatcgagcatgatttcag

SEQ ID NO: 8140 - DNA, 20 bp, Saccharomyces cerevisiae
cactctaggtctcgcttggg

SEQ ID NO: 8141 - DNA, 20 bp, Saccharomyces cerevisiae
atgcgttgttggtcactttg

SEQ ID NO: 8142 - DNA, 20 bp, Saccharomyces cerevisiae
tgcttttggaagctggagat

SEQ ID NO: 8143 - DNA, 22 bp, Saccharomyces cerevisiae
gaagtttcgtaagtattggggg

SEQ ID NO: 8144 - DNA, 20 bp, Saccharomyces cerevisiae
atacctcaagttcggacgga

SEQ ID NO: 8145 - DNA, 20 bp, Saccharomyces cerevisiae
aagggcgcacagagttagaa

SEQ ID NO: 8146 - DNA, 20 bp, Saccharomyces cerevisiae
aaaggtcaactgccaaaacg

SEQ ID NO: 8147 - DNA, 21 bp, Saccharomyces cerevisiae
gaaaagagtccaaagttgggg

SEQ ID NO: 8148 - DNA, 20 bp, Saccharomyces cerevisiae
agcaaggttcaaggtttgga

SEQ ID NO: 8149 - DNA, 20 bp, Saccharomyces cerevisiae
tctttgtcgctctttgcctt

SEQ ID NO: 8150 - DNA, 20 bp, Saccharomyces cerevisiae
gcaccaagtggcgtagaaat

SEQ ID NO: 8151 - DNA, 20 bp, Saccharomyces cerevisiae
tcgatcgataccagcacatt

SEQ ID NO: 8152 - DNA, 20 bp, Saccharomyces cerevisiae
agctgttcgaaccaaggcta

SEQ ID NO: 8153 - DNA, 20 bp, Saccharomyces cerevisiae
gcatgtacaatggtgccaag

SEQ ID NO: 8154 - DNA, 20 bp, Saccharomyces cerevisiae
atcgactctcccccgtatct

SEQ ID NO: 8155 - DNA, 20 bp, Saccharomyces cerevisiae
cgtttcaccacaggatcgta

SEQ ID NO: 8156 - DNA, 20 bp, Saccharomyces cerevisiae
ttaccgaaactggaagaccg

SEQ ID NO: 8157 - DNA, 21 bp, Saccharomyces cerevisiae
caaaaggatcctaagttgggc

SEQ ID NO: 8158 - DNA, 20 bp, Saccharomyces cerevisiae
cgtatggaagaggccaaaga

SEQ ID NO: 8159 - DNA, 20 bp, Saccharomyces cerevisiae
ttgaccaccgtcaagaacaa

SEQ ID NO: 8160 - DNA, 20 bp, Saccharomyces cerevisiae
gttggatagtaacccgagcg

SEQ ID NO: 8161 - DNA, 20 bp, Saccharomyces cerevisiae
accgctctgaaatccatcac

SEQ ID NO: 8162 - DNA, 20 bp, Saccharomyces cerevisiae
agctttcccaactgatccct

SEQ ID NO: 8163 - DNA, 20 bp, Saccharomyces cerevisiae
cccgaccgctttatatagga

SEQ ID NO: 8164 - DNA, 20 bp, Saccharomyces cerevisiae
ggaatgtaacgctccctgaa

SEQ ID NO: 8165 - DNA, 20 bp, Saccharomyces cerevisiae
aaattgttacgcacgttccc

SEQ ID NO: 8166 - DNA, 20 bp, Saccharomyces cerevisiae
tcagaatgcccttttccatc

SEQ ID NO: 8167 - DNA, 20 bp, Saccharomyces cerevisiae
aaacctccgcaaaatctgtg

SEQ ID NO: 8168 - DNA, 20 bp, Saccharomyces cerevisiae
atcaacgatgctggtaaggc

SEQ ID NO: 8169 - DNA, 20 bp, Saccharomyces cerevisiae
gcgcctgccaaaataaataa

SEQ ID NO: 8170 - DNA, 20 bp, Saccharomyces cerevisiae
aaaatggggatcatacgctg

SEQ ID NO: 8171 - DNA, 20 bp, Saccharomyces cerevisiae
gaccatccaggattctttgc

SEQ ID NO: 8172 - DNA, 20 bp, Saccharomyces cerevisiae
ctcataaaggtttgcccgaa

SEQ ID NO: 8173 - DNA, 20 bp, Saccharomyces cerevisiae
gtggtttcgtccactacggt

SEQ ID NO: 8174 - DNA, 20 bp, Saccharomyces cerevisiae
tcatcggctgaatgttttga

SEQ ID NO: 8175 - DNA, 20 bp, Saccharomyces cerevisiae
ccagcatcaagacagatgga

SEQ ID NO: 8176 - DNA, 20 bp, Saccharomyces cerevisiae
aactccttgcacgacaggat

SEQ ID NO: 8177 - DNA, 21 bp, Saccharomyces cerevisiae
catccgtttctgaccttgttc

SEQ ID NO: 8178 - DNA, 20 bp, Saccharomyces cerevisiae
agtcgcaggaatcagatgct

SEQ ID NO: 8179 - DNA, 23 bp, Saccharomyces cerevisiae
ccatatacgaaaatgttggtgac

SEQ ID NO: 8180 - DNA, 21 bp, Saccharomyces cerevisiae
gctgaacaagaactgactccc

SEQ ID NO: 8181 - DNA, 20 bp, Saccharomyces cerevisiae
tccgctccaaagaaaaacac

SEQ ID NO: 8182 - DNA, 20 bp, Saccharomyces cerevisiae
tttagcaccgaagaagcgat

SEQ ID NO: 8183 - DNA, 19 bp, Saccharomyces cerevisiae
ttgctgttgtaccgtccgt

SEQ ID NO: 8184 - DNA, 20 bp, Saccharomyces cerevisiae
tggccattgtgttattgctc

SEQ ID NO: 8185 - DNA, 20 bp, Saccharomyces cerevisiae
atcgcgttacaacatggtca

SEQ ID NO: 8186 - DNA, 20 bp, Saccharomyces cerevisiae
tttgtgttgatatgtggggc

SEQ ID NO: 8187 - DNA, 20 bp, Saccharomyces cerevisiae
attcacagttgcaaagcacg

SEQ ID NO: 8188 - DNA, 20 bp, Saccharomyces cerevisiae
taacaagccgttcaggctct

SEQ ID NO: 8189 - DNA, 20 bp, Saccharomyces cerevisiae
tcacaggctatggatagggc

SEQ ID NO: 8190 - DNA, 20 bp, Saccharomyces cerevisiae
ttctttgccgttacagggtc

SEQ ID NO: 8191 - DNA, 20 bp, Saccharomyces cerevisiae
tgggctcagaaacttccagt

SEQ ID NO: 8192 - DNA, 22 bp, Saccharomyces cerevisiae
ccttgatctccaagtaacgtcc

SEQ ID NO: 8193 - DNA, 20 bp, Saccharomyces cerevisiae
tgtcatcaaggacctcctcc

SEQ ID NO: 8194 - DNA, 20 bp, Saccharomyces cerevisiae
aataacggtgttttcggtgc

SEQ ID NO: 8195 - DNA, 20 bp, Saccharomyces cerevisiae
cggaagaacaaaaggtctgc

SEQ ID NO: 8196 - DNA, 20 bp, Saccharomyces cerevisiae
ggtatgatgtaacgaccgcc

SEQ ID NO: 8197 - DNA, 21 bp, Saccharomyces cerevisiae
ttggctttggggaacttactt

SEQ ID NO: 8198 - DNA, 20 bp, Saccharomyces cerevisiae
cctttcgccattttacctca

SEQ ID NO: 8199 - DNA, 20 bp, Saccharomyces cerevisiae
tctcggtggaagagcaaact

SEQ ID NO: 8200 - DNA, 20 bp, Saccharomyces cerevisiae
tgagtgggttagtgcacctg

SEQ ID NO: 8201 - DNA, 20 bp, Saccharomyces cerevisiae
caaaggtaaattggtgccgt

SEQ ID NO: 8202 - DNA, 20 bp, Saccharomyces cerevisiae
cgtcgcaaaattagcacaga

SEQ ID NO: 8203 - DNA, 20 bp, Saccharomyces cerevisiae
tgacgtctgtcattacccca

SEQ ID NO: 8204 - DNA, 20 bp, Saccharomyces cerevisiae
cgcccgtcaatagatctcac

SEQ ID NO: 8205 - DNA, 20 bp, Saccharomyces cerevisiae
ccctctgcgacaaagttagc

SEQ ID NO: 8206 - DNA, 20 bp, Saccharomyces cerevisiae
accggaacctaccatgatga

SEQ ID NO: 8207 - DNA, 20 bp, Saccharomyces cerevisiae
attattccgcagacacgagg

SEQ ID NO: 8208 - DNA, 20 bp, Saccharomyces cerevisiae
ttgccagatcctgtgaaaca

SEQ ID NO: 8209 - DNA, 20 bp, Saccharomyces cerevisiae
gcggtgctacaggagaggta

SEQ ID NO: 8210 - DNA, 20 bp, Saccharomyces cerevisiae
ccagcaggttccaacgttat

SEQ ID NO: 8211 - DNA, 20 bp, Saccharomyces cerevisiae
ttcacatggtggtagggaga

SEQ ID NO: 8212 - DNA, 20 bp, Saccharomyces cerevisiae
aacgccccggataactagag

SEQ ID NO: 8213 - DNA, 20 bp, Saccharomyces cerevisiae
cccgttacaagccgtctcta

SEQ ID NO: 8214 - DNA, 20 bp, Saccharomyces cerevisiae
gttattgctgcaagggaagg

SEQ ID NO: 8215 - DNA, 20 bp, Saccharomyces cerevisiae
ccttcgcaaatgactgatga

SEQ ID NO: 8216 - DNA, 20 bp, Saccharomyces cerevisiae
gcccagtctagtgacgacaa

SEQ ID NO: 8217 - DNA, 20 bp, Saccharomyces cerevisiae
atttacgaaggagacccgga

SEQ ID NO: 8218 - DNA, 20 bp, Saccharomyces cerevisiae
ctgaatcgctgcttcctctt

SEQ ID NO: 8219 - DNA, 20 bp, Saccharomyces cerevisiae
gtggaaattggccctaggtt

SEQ ID NO: 8220 - DNA, 20 bp, Saccharomyces cerevisiae
aacaacagcagcaagagcaa

SEQ ID NO: 8221 - DNA, 20 bp, Saccharomyces cerevisiae
aaatgaaaatgaccgccaac

SEQ ID NO: 8222 - DNA, 20 bp, Saccharomyces cerevisiae
ctgtgaatgctgttgcctgt

SEQ ID NO: 8223 - DNA, 20 bp, Saccharomyces cerevisiae
agtaggccgttgaagggaat

SEQ ID NO: 8224 - DNA, 20 bp, Saccharomyces cerevisiae
cctggacttctctcaaagcg

SEQ ID NO: 8225 - DNA, 20 bp, Saccharomyces cerevisiae
gctgcctgtgacattatgga

SEQ ID NO: 8226 - DNA, 22 bp, Saccharomyces cerevisiae
tttacatctccgttcttcgtga

SEQ ID NO: 8227 - DNA, 21 bp, Saccharomyces cerevisiae
ttcgcactggttttcaaaata

SEQ ID NO: 8228 - DNA, 20 bp, Saccharomyces cerevisiae
tctgctccaaaccaaatcct

SEQ ID NO: 8229 - DNA, 20 bp, Saccharomyces cerevisiae
tttccaggacggaagttagc

SEQ ID NO: 8230 - DNA, 20 bp, Saccharomyces cerevisiae
ggagggcgagtactatgacg

SEQ ID NO: 8231 - DNA, 20 bp, Saccharomyces cerevisiae
taaatccgtttgccaggaag

SEQ ID NO: 8232 - DNA, 20 bp, Saccharomyces cerevisiae
caccgcactgtaaacacagg

SEQ ID NO: 8233 - DNA, 21 bp, Saccharomyces cerevisiae
cagcccaatattcgttatcca

SEQ ID NO: 8234 - DNA, 20 bp, Saccharomyces cerevisiae
tcagctgtgtcagcagtcaa

SEQ ID NO: 8235 - DNA, 20 bp, Saccharomyces cerevisiae
tattggtcgctattgggctc

SEQ ID NO: 8236 - DNA, 20 bp, Saccharomyces cerevisiae
aagcacaaagacgcaccata

SEQ ID NO: 8237 - DNA, 20 bp, Saccharomyces cerevisiae
ggccacttttgtctcccata

SEQ ID NO: 8238 - DNA, 20 bp, Saccharomyces cerevisiae
ttgtcccaggagcgtaaatc

SEQ ID NO: 8239 - DNA, 20 bp, Saccharomyces cerevisiae
cctaaaacaagccgtgtcgt

SEQ ID NO: 8240 - DNA, 20 bp, Saccharomyces cerevisiae
taatgatgaatggtttgccg

SEQ ID NO: 8241 - DNA, 20 bp, Saccharomyces cerevisiae
tgtcgttccaaatccaactg

SEQ ID NO: 8242 - DNA, 20 bp, Saccharomyces cerevisiae
gatcgctgcactccaataca

SEQ ID NO: 8243 - DNA, 20 bp, Saccharomyces cerevisiae
agaaaaagaagcggcatgaa

SEQ ID NO: 8244 - DNA, 22 bp, Saccharomyces cerevisiae
gccaacaacaaaataagtgcaa

SEQ ID NO: 8245 - DNA, 20 bp, Saccharomyces cerevisiae
tcttgggacgtcatcaaaca

SEQ ID NO: 8246 - DNA, 20 bp, Saccharomyces cerevisiae
acgctttcaaagtggcttgt

SEQ ID NO: 8247 - DNA, 20 bp, Saccharomyces cerevisiae
attggagacattggaaccca

SEQ ID NO: 8248 - DNA, 20 bp, Saccharomyces cerevisiae
gaaacccttctatctggggc

SEQ ID NO: 8249 - DNA, 20 bp, Saccharomyces cerevisiae
ggaatggtgtgagtggttca

SEQ ID NO: 8250 - DNA, 20 bp, Saccharomyces cerevisiae
gttgcctgagattgttgggt

SEQ ID NO: 8251 - DNA, 20 bp, Saccharomyces cerevisiae
cagaggagctttggatttga

SEQ ID NO: 8252 - DNA, 20 bp, Saccharomyces cerevisiae
atggtactcaggctgctgct

SEQ ID NO: 8253 - DNA, 20 bp, Saccharomyces cerevisiae
tccaaaaatggtatcccagg

SEQ ID NO: 8254 - DNA, 20 bp, Saccharomyces cerevisiae
agcaacaatggaatcccaac

SEQ ID NO: 8255 - DNA, 22 bp, Saccharomyces cerevisiae
cgatccaaaatatgtttcagca

SEQ ID NO: 8256 - DNA, 20 bp, Saccharomyces cerevisiae
gcctccgtttccaatatgtc

SEQ ID NO: 8257 - DNA, 20 bp, Saccharomyces cerevisiae
ttctgctggtttgttcacca

SEQ ID NO: 8258 - DNA, 20 bp, Saccharomyces cerevisiae
agaaaatttgacaatcggcg

SEQ ID NO: 8259 - DNA, 20 bp, Saccharomyces cerevisiae
tgaccatcaaagtcatccca

SEQ ID NO: 8260 - DNA, 20 bp, Saccharomyces cerevisiae
atacggcctgggatcatgta

SEQ ID NO: 8261 - DNA, 20 bp, Saccharomyces cerevisiae
gaaaaggatttacggggcat

SEQ ID NO: 8262 - DNA, 20 bp, Saccharomyces cerevisiae
aaaatgggggaaaagcaaac

SEQ ID NO: 8263 - DNA, 20 bp, Saccharomyces cerevisiae
gatatctcacgtgttgccga

SEQ ID NO: 8264 - DNA, 20 bp, Saccharomyces cerevisiae
gttggctgctcaaagaaagg

SEQ ID NO: 8265 - DNA, 20 bp, Saccharomyces cerevisiae
ataccgaagggcctatggag

SEQ ID NO: 8266 - DNA, 20 bp, Saccharomyces cerevisiae
tgatggcaatcgcgtagtaa

SEQ ID NO: 8267 - DNA, 20 bp, Saccharomyces cerevisiae
tgcgaactcatgctatggtc

SEQ ID NO: 8268 - DNA, 19 bp, Saccharomyces cerevisiae
agaaggcctttcccgactt

SEQ ID NO: 8269 - DNA, 20 bp, Saccharomyces cerevisiae
gccccacaattataaggggt

SEQ ID NO: 8270 - DNA, 20 bp, Saccharomyces cerevisiae
cgctttgtttctgtttgctg

SEQ ID NO: 8271 - DNA, 22 bp, Saccharomyces cerevisiae
gaaaggacaagaaggaggaaga

SEQ ID NO: 8272 - DNA, 20 bp, Saccharomyces cerevisiae
attagcaaagtgcaacggct

SEQ ID NO: 8273 - DNA, 20 bp, Saccharomyces cerevisiae
tgaaaacggaaaagtggtga

SEQ ID NO: 8274 - DNA, 20 bp, Saccharomyces cerevisiae
cgccaaagttaccgaaagag

SEQ ID NO: 8275 - DNA, 20 bp, Saccharomyces cerevisiae
catgaccgtaccgaagaggt

SEQ ID NO: 8276 - DNA, 21 bp, Saccharomyces cerevisiae
ttgtgaaataaaggcgaatcc

SEQ ID NO: 8277 - DNA, 20 bp, Saccharomyces cerevisiae
ttcgccatctttattttccg

SEQ ID NO: 8278 - DNA, 20 bp, Saccharomyces cerevisiae
attctgccgatgaagattgg

SEQ ID NO: 8279 - DNA, 20 bp, Saccharomyces cerevisiae
ctttcaagctcaggcgaaat

SEQ ID NO: 8280 - DNA, 20 bp, Saccharomyces cerevisiae
atgggcctgaaaaatacacg

SEQ ID NO: 8281 - DNA, 20 bp, Saccharomyces cerevisiae
gtgcctcaattcctgatggt

SEQ ID NO: 8282 - DNA, 20 bp, Saccharomyces cerevisiae
tcacatcgccttatggtcaa

SEQ ID NO: 8283 - DNA, 20 bp, Saccharomyces cerevisiae
aaccaaacaaaaccagacgc

SEQ ID NO: 8284 - DNA, 20 bp, Saccharomyces cerevisiae
ttaaattctgatgaccccgc

SEQ ID NO: 8285 - DNA, 20 bp, Saccharomyces cerevisiae
gactgccagcaacatcttca

SEQ ID NO: 8286 - DNA, 20 bp, Saccharomyces cerevisiae
gctctgccctccctttagat

SEQ ID NO: 8287 - DNA, 20 bp, Saccharomyces cerevisiae
ggcaaattggtttttcctca

SEQ ID NO: 8288 - DNA, 23 bp, Saccharomyces cerevisiae
gcaaagctacagttttatccctg

SEQ ID NO: 8289 - DNA, 20 bp, Saccharomyces cerevisiae
ccacacacatacaagcctcc

SEQ ID NO: 8290 - DNA, 20 bp, Saccharomyces cerevisiae
gccaccaggcaacaaaaata

SEQ ID NO: 8291 - DNA, 20 bp, Saccharomyces cerevisiae
tccgatttcaaaaacccact

SEQ ID NO: 8292 - DNA, 22 bp, Saccharomyces cerevisiae
gggaccactactactcagtccg

SEQ ID NO: 8293 - DNA, 20 bp, Saccharomyces cerevisiae
agggtatggcagctctagca

SEQ ID NO: 8294 - DNA, 19 bp, Saccharomyces cerevisiae
taccgtgcatgcctgagat

SEQ ID NO: 8295 - DNA, 20 bp, Saccharomyces cerevisiae
ttaatttgcaaaggccatcc

SEQ ID NO: 8296 - DNA, 20 bp, Saccharomyces cerevisiae
ttcgattttcttgaggaccg

SEQ ID NO: 8297 - DNA, 20 bp, Saccharomyces cerevisiae
tgtgtggataggggaacgtc

SEQ ID NO: 8298 - DNA, 20 bp, Saccharomyces cerevisiae
caatgagctttccaaggcag

SEQ ID NO: 8299 - DNA, 20 bp, Saccharomyces cerevisiae
caactgggttgacgatgatg

SEQ ID NO: 8300 - DNA, 20 bp, Saccharomyces cerevisiae
caaaattgttcaagtccgca

SEQ ID NO: 8301 - DNA, 20 bp, Saccharomyces cerevisiae
ctaaaacacatgcacgccac

SEQ ID NO: 8302 - DNA, 20 bp, Saccharomyces cerevisiae
tctggcgcagatgataaaga

SEQ ID NO: 8303 - DNA, 20 bp, Saccharomyces cerevisiae
cgttgaaggtttgtgtggtg

SEQ ID NO: 8304 - DNA, 20 bp, Saccharomyces cerevisiae
cctcgggaagctcacaatag

SEQ ID NO: 8305 - DNA, 20 bp, Saccharomyces cerevisiae
tgtctatgggtttcgtgggt

SEQ ID NO: 8306 - DNA, 25 bp, Saccharomyces cerevisiae
cattgtctacatataatccgagagg

SEQ ID NO: 8307 - DNA, 20 bp, Saccharomyces cerevisiae
ttctccaaattttccaccga

SEQ ID NO: 8308 - DNA, 20 bp, Saccharomyces cerevisiae
gacgagacaaccaaccacct

SEQ ID NO: 8309 - DNA, 20 bp, Saccharomyces cerevisiae
taaaaggtatggccgcattc

SEQ ID NO: 8310 - DNA, 20 bp, Saccharomyces cerevisiae
acggttcgtctcgttttcag

SEQ ID NO: 8311 - DNA, 20 bp, Saccharomyces cerevisiae
acctgaacaccgacgaagac

SEQ ID NO: 8312 - DNA, 20 bp, Saccharomyces cerevisiae
caaaacgataaatttccccg

SEQ ID NO: 8313 - DNA, 25 bp, Saccharomyces cerevisiae
taaattatgtgtcaagtactgcgga

SEQ ID NO: 8314 - DNA, 20 bp, Saccharomyces cerevisiae
catcatcgccatcaatttca

SEQ ID NO: 8315 - DNA, 20 bp, Saccharomyces cerevisiae
tcagcttttgttgcgatgac

SEQ ID NO: 8316 - DNA, 20 bp, Saccharomyces cerevisiae
ctcgttaacaatggtgtggc

SEQ ID NO: 8317 - DNA, 20 bp, Saccharomyces cerevisiae
gccccatccatagtttttcc

SEQ ID NO: 8318 - DNA, 20 bp, Saccharomyces cerevisiae
gcaacggaaatcgaagtgat

SEQ ID NO: 8319 - DNA, 21 bp, Saccharomyces cerevisiae
gggtttacccaatgaaaacca

SEQ ID NO: 8320 - DNA, 21 bp, Saccharomyces cerevisiae
ggagtcttctgtaatggctgc

SEQ ID NO: 8321 - DNA, 20 bp, Saccharomyces cerevisiae
cgcatctcattccaacttga

SEQ ID NO: 8322 - DNA, 20 bp, Saccharomyces cerevisiae
ggtgaaaacgccaaagaaga

SEQ ID NO: 8323 - DNA, 20 bp, Saccharomyces cerevisiae
ttactccaggcaggttgcat

SEQ ID NO: 8324 - DNA, 20 bp, Saccharomyces cerevisiae
tctactcgggccattggtag

SEQ ID NO: 8325 - DNA, 22 bp, Saccharomyces cerevisiae
tggatgatgacattgatatgga

SEQ ID NO: 8326 - DNA, 20 bp, Saccharomyces cerevisiae
tatcggaaaagctccaccac

SEQ ID NO: 8327 - DNA, 20 bp, Saccharomyces cerevisiae
gaaccgtgactgaggacgat

SEQ ID NO: 8328 - DNA, 20 bp, Saccharomyces cerevisiae
aagctccgacgagaaaactg

SEQ ID NO: 8329 - DNA, 20 bp, Saccharomyces cerevisiae
aggatccggtgatagcaatg

SEQ ID NO: 8330 - DNA, 20 bp, Saccharomyces cerevisiae
tttttcaattttgcccttgg

SEQ ID NO: 8331 - DNA, 20 bp, Saccharomyces cerevisiae
cgttccctctgctgttctct

SEQ ID NO: 8332 - DNA, 20 bp, Saccharomyces cerevisiae
ccctttggagagcttttgtg

SEQ ID NO: 8333 - DNA, 20 bp, Saccharomyces cerevisiae
ttctgaaaagatggcgttga

SEQ ID NO: 8334 - DNA, 20 bp, Saccharomyces cerevisiae
ccattacaaagccctccaga

SEQ ID NO: 8335 - DNA, 20 bp, Saccharomyces cerevisiae
gccttgtttgctttctacgg

SEQ ID NO: 8336 - DNA, 21 bp, Saccharomyces cerevisiae
cagcgtttatctttctcagcc

SEQ ID NO: 8337 - DNA, 20 bp, Saccharomyces cerevisiae
cttggcccttaggttcagtg

SEQ ID NO: 8338 - DNA, 22 bp, Saccharomyces cerevisiae
tccagtttcatcaacttttgct

SEQ ID NO: 8339 - DNA, 20 bp, Saccharomyces cerevisiae
cagaagagaaggaggggagg

SEQ ID NO: 8340 - DNA, 20 bp, Saccharomyces cerevisiae
caagccaaactgaacgacaa

SEQ ID NO: 8341 - DNA, 20 bp, Saccharomyces cerevisiae
atgatgcagttgaatcgcaa

SEQ ID NO: 8342 - DNA, 20 bp, Saccharomyces cerevisiae
caatctcttcatcatccgca

SEQ ID NO: 8343 - DNA, 20 bp, Saccharomyces cerevisiae
ccgtctttcggaagaaacaa

SEQ ID NO: 8344 - DNA, 20 bp, Saccharomyces cerevisiae
tcgtttcgataaaggcaaca

SEQ ID NO: 8345 - DNA, 20 bp, Saccharomyces cerevisiae
aatgcaaaaggaaatcaccg

SEQ ID NO: 8346 - DNA, 20 bp, Saccharomyces cerevisiae
gtgcattttccacgtgttca

SEQ ID NO: 8347 - DNA, 20 bp, Saccharomyces cerevisiae
gtcgccaacggagtttctaa

SEQ ID NO: 8348 - DNA, 20 bp, Saccharomyces cerevisiae
agctcaaactcaggctccag

SEQ ID NO: 8349 - DNA, 20 bp, Saccharomyces cerevisiae
gcatgacccaccaagtaagg

SEQ ID NO: 8350 - DNA, 20 bp, Saccharomyces cerevisiae
caaagaaggtggcagagagg

SEQ ID NO: 8351 - DNA, 20 bp, Saccharomyces cerevisiae
ccagacgcctttatcgacat

SEQ ID NO: 8352 - DNA, 20 bp, Saccharomyces cerevisiae
tgacaaaagaaccgggagat

SEQ ID NO: 8353 - DNA, 20 bp, Saccharomyces cerevisiae
ttttagcgatgttccccttg

SEQ ID NO: 8354 - DNA, 20 bp, Saccharomyces cerevisiae
tttacccaccttttgacggt

SEQ ID NO: 8355 - DNA, 20 bp, Saccharomyces cerevisiae
tcagggaaagcttctgcaat

SEQ ID NO: 8356 - DNA, 20 bp, Saccharomyces cerevisiae
acatgctaccgcgagaaaac

SEQ ID NO: 8357 - DNA, 20 bp, Saccharomyces cerevisiae
gcctcagcactcttaccagg

SEQ ID NO: 8358 - DNA, 20 bp, Saccharomyces cerevisiae
tatcctgcctgtctcatcgg

SEQ ID NO: 8359 - DNA, 20 bp, Saccharomyces cerevisiae
acgccaaattaaaggcacac

SEQ ID NO: 8360 - DNA, 20 bp, Saccharomyces cerevisiae
ctttgaacgctgattgcttg

SEQ ID NO: 8361 - DNA, 20 bp, Saccharomyces cerevisiae
aagggcgttttgttttgttg

SEQ ID NO: 8362 - DNA, 20 bp, Saccharomyces cerevisiae
caaacaatggaatcccaaca

SEQ ID NO: 8363 - DNA, 20 bp, Saccharomyces cerevisiae
catgagatttccaagtgcca

SEQ ID NO: 8364 - DNA, 20 bp, Saccharomyces cerevisiae
gcatgtgaccttttgcaagc

SEQ ID NO: 8365 - DNA, 20 bp, Saccharomyces cerevisiae
tgttcagttgcaatgcttca

SEQ ID NO: 8366 - DNA, 20 bp, Saccharomyces cerevisiae
tggacagaaacaggagggtc

SEQ ID NO: 8367 - DNA, 20 bp, Saccharomyces cerevisiae
tgaaggtgttgatggtccaa

SEQ ID NO: 8368 - DNA, 20 bp, Saccharomyces cerevisiae
cgagagggaataaacacgga

SEQ ID NO: 8369 - DNA, 25 bp, Saccharomyces cerevisiae
tattgctaaaaggttggaagaagtg

SEQ ID NO: 8370 - DNA, 21 bp, Saccharomyces cerevisiae
tcgtgacaatcacaaaaagga

SEQ ID NO: 8371 - DNA, 20 bp, Saccharomyces cerevisiae
gaaacaaaattgagggcgaa

SEQ ID NO: 8372 - DNA, 20 bp, Saccharomyces cerevisiae
aacccaagtctgcggataca

SEQ ID NO: 8373 - DNA, 20 bp, Saccharomyces cerevisiae
tcgcgctgttatcttgactg

SEQ ID NO: 8374 - DNA, 20 bp, Saccharomyces cerevisiae
tgctccgtgaagagttttga

SEQ ID NO: 8375 - DNA, 20 bp, Saccharomyces cerevisiae
ttcggagttattgtgggagg

SEQ ID NO: 8376 - DNA, 20 bp, Saccharomyces cerevisiae
ttggtcccagagtgttgtca

SEQ ID NO: 8377 - DNA, 20 bp, Saccharomyces cerevisiae
actgggacaaggtgaaggtg

SEQ ID NO: 8378 - DNA, 20 bp, Saccharomyces cerevisiae
caaccgtatcgcttcttgtg

SEQ ID NO: 8379 - DNA, 20 bp, Saccharomyces cerevisiae
ttcttccttggtgagggatg

SEQ ID NO: 8380 - DNA, 20 bp, Saccharomyces cerevisiae
tggcagactgtggtgtcaat

SEQ ID NO: 8381 - DNA, 20 bp, Saccharomyces cerevisiae
ctggccccacaagagttaag

SEQ ID NO: 8382 - DNA, 20 bp, Saccharomyces cerevisiae
tattgcaccttccaaccctc

SEQ ID NO: 8383 - DNA, 25 bp, Saccharomyces cerevisiae
gaaagtaaaaatatgagcggtacga

SEQ ID NO: 8384 - DNA, 20 bp, Saccharomyces cerevisiae
taaacccaggttgcttctgg

SEQ ID NO: 8385 - DNA, 21 bp, Saccharomyces cerevisiae
ctggtgtcaaaagcaagaagg

SEQ ID NO: 8386 - DNA, 20 bp, Saccharomyces cerevisiae
aactgccatgaaaggtttgg

SEQ ID NO: 8387 - DNA, 20 bp, Saccharomyces cerevisiae
gcacgcgaagggagttatta

SEQ ID NO: 8388 - DNA, 20 bp, Saccharomyces cerevisiae
ggacatttggatacgcccta

SEQ ID NO: 8389 - DNA, 20 bp, Saccharomyces cerevisiae
atgtggtgggtgaaccattt

SEQ ID NO: 8390 - DNA, 20 bp, Saccharomyces cerevisiae
cattcaatggccatgctaaa

SEQ ID NO: 8391 - DNA, 20 bp, Saccharomyces cerevisiae
caatgcgaggttttcttggt

SEQ ID NO: 8392 - DNA, 20 bp, Saccharomyces cerevisiae
ctttgcagttttcgtggcta

SEQ ID NO: 8393 - DNA, 20 bp, Saccharomyces cerevisiae
ggctgatggtgtttatgcaa

SEQ ID NO: 8394 - DNA, 20 bp, Saccharomyces cerevisiae
tgaaaaacccagtgtagcca

SEQ ID NO: 8395 - DNA, 22 bp, Saccharomyces cerevisiae
ttccttttgtacgctgtgattc

SEQ ID NO: 8396 - DNA, 21 bp, Saccharomyces cerevisiae
tggtttccgaaatttcatctg

SEQ ID NO: 8397 - DNA, 20 bp, Saccharomyces cerevisiae
gtaccatcgaaacattgcca

SEQ ID NO: 8398 - DNA, 22 bp, Saccharomyces cerevisiae
ggcaggcacattactaaaaagg

SEQ ID NO: 8399 - DNA, 20 bp, Saccharomyces cerevisiae
cgacctcaaatgtttacgca

SEQ ID NO: 8400 - DNA, 20 bp, Saccharomyces cerevisiae
gcaaacgtgcacctacaaaa

SEQ ID NO: 8401 - DNA, 20 bp, Saccharomyces cerevisiae
tttctgtcatgcttttggga

SEQ ID NO: 8402 - DNA, 21 bp, Saccharomyces cerevisiae
ttcctagacgttaagtgccca

SEQ ID NO: 8403 - DNA, 20 bp, Saccharomyces cerevisiae
gcagcaacaaggtcggtaat

SEQ ID NO: 8404 - DNA, 21 bp, Saccharomyces cerevisiae
agaaagcgcaattgatcagac

SEQ ID NO: 8405 - DNA, 20 bp, Saccharomyces cerevisiae
tttccatgccctttgaaaaa

SEQ ID NO: 8406 - DNA, 20 bp, Saccharomyces cerevisiae
tgaattcagatgggaaaccc

SEQ ID NO: 8407 - DNA, 20 bp, Saccharomyces cerevisiae
ttcatgaaaggaagcccatc

SEQ ID NO: 8408 - DNA, 22 bp, Saccharomyces cerevisiae
gggagagattcaattatcggaa

SEQ ID NO: 8409 - DNA, 20 bp, Saccharomyces cerevisiae
catcggtggtccagaaagtt

SEQ ID NO: 8410 - DNA, 25 bp, Saccharomyces cerevisiae
ttccttttctaatttttctttttca

SEQ ID NO: 8411 - DNA, 20 bp, Saccharomyces cerevisiae
aacggcaagaatgaaaatgc

SEQ ID NO: 8412 - DNA, 22 bp, Saccharomyces cerevisiae
tttagcgagcactaccaagaca

SEQ ID NO: 8413 - DNA, 20 bp, Saccharomyces cerevisiae
aaggctttgcatcagaatca

SEQ ID NO: 8414 - DNA, 20 bp, Saccharomyces cerevisiae
ttgggttgattggcatgata

SEQ ID NO: 8415 - DNA, 20 bp, Saccharomyces cerevisiae
tcgggaatgaaaagttgagg

SEQ ID NO: 8416 - DNA, 20 bp, Saccharomyces cerevisiae
ggtagcaaacacttgtgcca

SEQ ID NO: 8417 - DNA, 20 bp, Saccharomyces cerevisiae
cttgaaccccattttctcca

SEQ ID NO: 8418 - DNA, 20 bp, Saccharomyces cerevisiae
gcggttaaattcgtattggc

SEQ ID NO: 8419 - DNA, 20 bp, Saccharomyces cerevisiae
ggcacctgcttgacgatatt

SEQ ID NO: 8420 - DNA, 20 bp, Saccharomyces cerevisiae
ctttagtactgcttgccccg

SEQ ID NO: 8421 - DNA, 20 bp, Saccharomyces cerevisiae
actggggtgattcttttcca

SEQ ID NO: 8422 - DNA, 20 bp, Saccharomyces cerevisiae
tttagttatcggagtggcgg

SEQ ID NO: 8423 - DNA, 20 bp, Saccharomyces cerevisiae
tgtccaccagcttcaacaag

SEQ ID NO: 8424 - DNA, 20 bp, Saccharomyces cerevisiae
ggcttaatcccaagacatgc

SEQ ID NO: 8425 - DNA, 21 bp, Saccharomyces cerevisiae
tcgtcgcctttacttgacatt

SEQ ID NO: 8426 - DNA, 20 bp, Saccharomyces cerevisiae
gcagaagcttaacacgcgat

SEQ ID NO: 8427 - DNA, 20 bp, Saccharomyces cerevisiae
cggcaatcgttgcttttact

SEQ ID NO: 8428 - DNA, 20 bp, Saccharomyces cerevisiae
aactccgcacggtgtactct

SEQ ID NO: 8429 - DNA, 20 bp, Saccharomyces cerevisiae
tggggcttatcggtaacaag

SEQ ID NO: 8430 - DNA, 20 bp, Saccharomyces cerevisiae
gcggtgcttaatgttcgttt

SEQ ID NO: 8431 - DNA, 21 bp, Saccharomyces cerevisiae
cagccattcgtaacacgtaca

SEQ ID NO: 8432 - DNA, 20 bp, Saccharomyces cerevisiae
tcctgaccaagaaacgttca

SEQ ID NO: 8433 - DNA, 20 bp, Saccharomyces cerevisiae
gtgcgcaagaagataggagc

SEQ ID NO: 8434 - DNA, 20 bp, Saccharomyces cerevisiae
ttaatggtgccttctccgtc

SEQ ID NO: 8435 - DNA, 21 bp, Saccharomyces cerevisiae
ttcgggaaaactagtccatgt

SEQ ID NO: 8436 - DNA, 21 bp, Saccharomyces cerevisiae
agcatgttccatttatgggtg

SEQ ID NO: 8437 - DNA, 20 bp, Saccharomyces cerevisiae
aatttgtcgagccaccaaag

SEQ ID NO: 8438 - DNA, 21 bp, Saccharomyces cerevisiae
tttacttcatgctgtgctgga

SEQ ID NO: 8439 - DNA, 20 bp, Saccharomyces cerevisiae
accacaactttggaagtgcc

SEQ ID NO: 8440 - DNA, 20 bp, Saccharomyces cerevisiae
tagaccccgaatgccaatta

SEQ ID NO: 8441 - DNA, 20 bp, Saccharomyces cerevisiae
tagcagggtgttcttgcctt

SEQ ID NO: 8442 - DNA, 20 bp, Saccharomyces cerevisiae
tttcgggttcttcgctattg

SEQ ID NO: 8443 - DNA, 20 bp, Saccharomyces cerevisiae
gcattggaagcactattccg

SEQ ID NO: 8444 - DNA, 20 bp, Saccharomyces cerevisiae
tctagggagagcccaggagt

SEQ ID NO: 8445 - DNA, 20 bp, Saccharomyces cerevisiae
aggaggacgaagaggaagga

SEQ ID NO: 8446 - DNA, 20 bp, Saccharomyces cerevisiae
gtggaaaggtaagcccatga

SEQ ID NO: 8447 - DNA, 20 bp, Saccharomyces cerevisiae
gggccctggagcaatagata

SEQ ID NO: 8448 - DNA, 23 bp, Saccharomyces cerevisiae
cacattaatcgataacaaacgca

SEQ ID NO: 8449 - DNA, 21 bp, Saccharomyces cerevisiae
gcgttttgaggttcttacacc

SEQ ID NO: 8450 - DNA, 20 bp, Saccharomyces cerevisiae
ggcattaagccagaaatcca

SEQ ID NO: 8451 - DNA, 20 bp, Saccharomyces cerevisiae
acagaaggcaattgaacgct

SEQ ID NO: 8452 - DNA, 20 bp, Saccharomyces cerevisiae
tgcgcaattacttgcttttg

SEQ ID NO: 8453 - DNA, 20 bp, Saccharomyces cerevisiae
gcagaatccaccaggagtgt

SEQ ID NO: 8454 - DNA, 23 bp, Saccharomyces cerevisiae
aagtgtataggcgtgactttgac

SEQ ID NO: 8455 - DNA, 21 bp, Saccharomyces cerevisiae
gctcgaaaaactatgttggga

SEQ ID NO: 8456 - DNA, 20 bp, Saccharomyces cerevisiae
tacaaggggttcccatacca

SEQ ID NO: 8457 - DNA, 20 bp, Saccharomyces cerevisiae
ccatttctaacagcgcatca

SEQ ID NO: 8458 - DNA, 20 bp, Saccharomyces cerevisiae
gaaatccaggaactgccaga

SEQ ID NO: 8459 - DNA, 20 bp, Saccharomyces cerevisiae
catcaacaaatagggcccag

SEQ ID NO: 8460 - DNA, 21 bp, Saccharomyces cerevisiae
aagaaggcgtgatgaagatga

SEQ ID NO: 8461 - DNA, 20 bp, Saccharomyces cerevisiae
ggcattttgtcagcttgtga

SEQ ID NO: 8462 - DNA, 20 bp, Saccharomyces cerevisiae
gattgaaagtagggccacca

SEQ ID NO: 8463 - DNA, 25 bp, Saccharomyces cerevisiae
agaacggtaagaaggttactgcttt

SEQ ID NO: 8464 - DNA, 20 bp, Saccharomyces cerevisiae
cgatttgacgcaagaacaga

SEQ ID NO: 8465 - DNA, 20 bp, Saccharomyces cerevisiae
ccctttctcattgtgcgttt

SEQ ID NO: 8466 - DNA, 20 bp, Saccharomyces cerevisiae
gctccagcaggatttttgag

SEQ ID NO: 8467 - DNA, 20 bp, Saccharomyces cerevisiae
cgttgaatctgggcgactat

SEQ ID NO: 8468 - DNA, 20 bp, Saccharomyces cerevisiae
gagttctgctttccttccca

SEQ ID NO: 8469 - DNA, 20 bp, Saccharomyces cerevisiae
cccagcagtgtcccatattt

SEQ ID NO: 8470 - DNA, 20 bp, Saccharomyces cerevisiae
tcaaattgtagcgatgccaa

SEQ ID NO: 8471 - DNA, 20 bp, Saccharomyces cerevisiae
aaagcaacccagttcaatgc

SEQ ID NO: 8472 - DNA, 21 bp, Saccharomyces cerevisiae
tttgagcgtttccttttagca

SEQ ID NO: 8473 - DNA, 20 bp, Saccharomyces cerevisiae
gatgatgatttcgaccctcg

SEQ ID NO: 8474 - DNA, 20 bp, Saccharomyces cerevisiae
cagcttcaattggcttcaca

SEQ ID NO: 8475 - DNA, 22 bp, Saccharomyces cerevisiae
tggaaaaagaattaatgcgtga

SEQ ID NO: 8476 - DNA, 20 bp, Saccharomyces cerevisiae
cctcatgaagagcaacgtca

SEQ ID NO: 8477 - DNA, 20 bp, Saccharomyces cerevisiae
caaagggggaacaacttcaa

SEQ ID NO: 8478 - DNA, 20 bp, Saccharomyces cerevisiae
atcaatgcttttcggtacgc

SEQ ID NO: 8479 - DNA, 20 bp, Saccharomyces cerevisiae
gcaggaccaagaaactgagg

SEQ ID NO: 8480 - DNA, 20 bp, Saccharomyces cerevisiae
ttggcctaaataccagtcca

SEQ ID NO: 8481 - DNA, 20 bp, Saccharomyces cerevisiae
tttaacaatggggtcttggg

SEQ ID NO: 8482 - DNA, 20 bp, Saccharomyces cerevisiae
gtaccgcaaccgacgtctaa

SEQ ID NO: 8483 - DNA, 20 bp, Saccharomyces cerevisiae
ttgatagcgacttccaagca

SEQ ID NO: 8484 - DNA, 20 bp, Saccharomyces cerevisiae
attagtgacgctggtttccg

SEQ ID NO: 8485 - DNA, 20 bp, Saccharomyces cerevisiae
caagatggcggtattatggg

SEQ ID NO: 8486 - DNA, 20 bp, Saccharomyces cerevisiae
aatgtctattccgccaccag

SEQ ID NO: 8487 - DNA, 20 bp, Saccharomyces cerevisiae
atctgaagcggttgctgtct

SEQ ID NO: 8488 - DNA, 20 bp, Saccharomyces cerevisiae
tcataggtaatgcaccgcaa

SEQ ID NO: 8489 - DNA, 20 bp, Saccharomyces cerevisiae
gccctacgttaacgcaaatg

SEQ ID NO: 8490 - DNA, 20 bp, Saccharomyces cerevisiae
cctagccattgtcggaccta

SEQ ID NO: 8491 - DNA, 20 bp, Saccharomyces cerevisiae
acatggaaaaacaacgagcc

SEQ ID NO: 8492 - DNA, 20 bp, Saccharomyces cerevisiae
cccaaccagttcttctttgc

SEQ ID NO: 8493 - DNA, 20 bp, Saccharomyces cerevisiae
tgtacgcagaggcgtgtaag

SEQ ID NO: 8494 - DNA, 20 bp, Saccharomyces cerevisiae
agcagctaaatcggaggaca

SEQ ID NO: 8495 - DNA, 23 bp, Saccharomyces cerevisiae
cacaaagtttcatgtgatcctca

SEQ ID NO: 8496 - DNA, 20 bp, Saccharomyces cerevisiae
ccacttcaatggtgatgacg

SEQ ID NO: 8497 - DNA, 20 bp, Saccharomyces cerevisiae
aatcaagtgccgatgcaagt

SEQ ID NO: 8498 - DNA, 25 bp, Saccharomyces cerevisiae
tcaccatgtacgattgttatgtttc

SEQ ID NO: 8499 - DNA, 20 bp, Saccharomyces cerevisiae
ttttgcacgtcaagtatcgc

SEQ ID NO: 8500 - DNA, 20 bp, Saccharomyces cerevisiae
agaggcttgacatttcgcac

SEQ ID NO: 8501 - DNA, 20 bp, Saccharomyces cerevisiae
atacgacatttcgaggcgtt

SEQ ID NO: 8502 - DNA, 22 bp, Saccharomyces cerevisiae
tgttttaaaaaggccaacatca

SEQ ID NO: 8503 - DNA, 20 bp, Saccharomyces cerevisiae
ggcaaagaagcaaagtccag

SEQ ID NO: 8504 - DNA, 20 bp, Saccharomyces cerevisiae
cgacgagctccagttcatta

SEQ ID NO: 8505 - DNA, 20 bp, Saccharomyces cerevisiae
ctgccattttcttcctccac

SEQ ID NO: 8506 - DNA, 20 bp, Saccharomyces cerevisiae
accttgcgtcatcgtaggag

SEQ ID NO: 8507 - DNA, 20 bp, Saccharomyces cerevisiae
catcaaaatcacctgtgcaa

SEQ ID NO: 8508 - DNA, 20 bp, Saccharomyces cerevisiae
acaaagttttgccaggttgg

SEQ ID NO: 8509 - DNA, 20 bp, Saccharomyces cerevisiae
tgcagatccattacagcagc

SEQ ID NO: 8510 - DNA, 23 bp, Saccharomyces cerevisiae
gatgatcgttttctcttactcgc

SEQ ID NO: 8511 - DNA, 20 bp, Saccharomyces cerevisiae
cggggtacagggtcatacac

SEQ ID NO: 8512 - DNA, 20 bp, Saccharomyces cerevisiae
tttggtcaatgccactgaaa

SEQ ID NO: 8513 - DNA, 20 bp, Saccharomyces cerevisiae
gacacaaaagaagggggtga

SEQ ID NO: 8514 - DNA, 20 bp, Saccharomyces cerevisiae
cggagcttttggatgagttc

SEQ ID NO: 8515 - DNA, 20 bp, Saccharomyces cerevisiae
tgcacgtagcttggaaacag

SEQ ID NO: 8516 - DNA, 20 bp, Saccharomyces cerevisiae
agccatggccataagtgaac

SEQ ID NO: 8517 - DNA, 20 bp, Saccharomyces cerevisiae
agaagatcctgagccagcaa

SEQ ID NO: 8518 - DNA, 20 bp, Saccharomyces cerevisiae
gtgctgcaccacgagattta

SEQ ID NO: 8519 - DNA, 20 bp, Saccharomyces cerevisiae
cgtaacaccagggtggtcat

SEQ ID NO: 8520 - DNA, 20 bp, Saccharomyces cerevisiae
aacaacggtaaggttgcagg

SEQ ID NO: 8521 - DNA, 20 bp, Saccharomyces cerevisiae
tgaggccaaccaagagacat

SEQ ID NO: 8522 - DNA, 20 bp, Saccharomyces cerevisiae
tagaatttagccatgcagcg

SEQ ID NO: 8523 - DNA, 20 bp, Saccharomyces cerevisiae
ctgcgattgataacgaggct

SEQ ID NO: 8524 - DNA, 20 bp, Saccharomyces cerevisiae
gagggattctgactggtgga

SEQ ID NO: 8525 - DNA, 21 bp, Saccharomyces cerevisiae
tttcatatacggcgattttgc

SEQ ID NO: 8526 - DNA, 20 bp, Saccharomyces cerevisiae
gcctctgtaagcgtccactc

SEQ ID NO: 8527 - DNA, 23 bp, Saccharomyces cerevisiae
tcaatcctttcatttcactttca

SEQ ID NO: 8528 - DNA, 20 bp, Saccharomyces cerevisiae
ttttgttgcaagtgggatga

SEQ ID NO: 8529 - DNA, 20 bp, Saccharomyces cerevisiae
gatgtttgtgcggaacaatg

SEQ ID NO: 8530 - DNA, 20 bp, Saccharomyces cerevisiae
ttatagggggtgctgtagcg

SEQ ID NO: 8531 - DNA, 20 bp, Saccharomyces cerevisiae
agttatccatgcctcaaccg

SEQ ID NO: 8532 - DNA, 20 bp, Saccharomyces cerevisiae
atgtccaccgtatcctccag

SEQ ID NO: 8533 - DNA, 20 bp, Saccharomyces cerevisiae
aatggacaaattagcgccac

SEQ ID NO: 8534 - DNA, 20 bp, Saccharomyces cerevisiae
atgttcggtatctccccctt

SEQ ID NO: 8535 - DNA, 20 bp, Saccharomyces cerevisiae
atcggacggattcttcacac

SEQ ID NO: 8536 - DNA, 20 bp, Saccharomyces cerevisiae
tgagcgtgctaatgctgaac

SEQ ID NO: 8537 - DNA, 20 bp, Saccharomyces cerevisiae
tttgtacacaacggagccaa

SEQ ID NO: 8538 - DNA, 20 bp, Saccharomyces cerevisiae
ttggttgccgttgttattca

SEQ ID NO: 8539 - DNA, 20 bp, Saccharomyces cerevisiae
atggcaaacgaattacagcc

SEQ ID NO: 8540 - DNA, 20 bp, Saccharomyces cerevisiae
gcccgaaacaaaagttcaaa

SEQ ID NO: 8541 - DNA, 20 bp, Saccharomyces cerevisiae
cctctttctgtaactgccgc

SEQ ID NO: 8542 - DNA, 20 bp, Saccharomyces cerevisiae
cccatgggatggagaatatg

SEQ ID NO: 8543 - DNA, 20 bp, Saccharomyces cerevisiae
agcgatgtattcaaacgctg

SEQ ID NO: 8544 - DNA, 19 bp, Saccharomyces cerevisiae
ccttgctgcaacatccaat

SEQ ID NO: 8545 - DNA, 20 bp, Saccharomyces cerevisiae
actggagcataacgtgaggg

SEQ ID NO: 8546 - DNA, 20 bp, Saccharomyces cerevisiae
tcttattcaattgggccctg

SEQ ID NO: 8547 - DNA, 21 bp, Saccharomyces cerevisiae
tcgcttagaggaggtgcataa

SEQ ID NO: 8548 - DNA, 20 bp, Saccharomyces cerevisiae
actacagggaacacggcaag

SEQ ID NO: 8549 - DNA, 20 bp, Saccharomyces cerevisiae
ttccacttccgtccacattt

SEQ ID NO: 8550 - DNA, 20 bp, Saccharomyces cerevisiae
cttgtttcctgcccatcaat

SEQ ID NO: 8551 - DNA, 20 bp, Saccharomyces cerevisiae
cgtgatgccaacttcaacag

SEQ ID NO: 8552 - DNA, 20 bp, Saccharomyces cerevisiae
aatttgaagctcaaccccaa

SEQ ID NO: 8553 - DNA, 20 bp, Saccharomyces cerevisiae
gccagtacaaccaccaacaa

SEQ ID NO: 8554 - DNA, 20 bp, Saccharomyces cerevisiae
aattgctcatattgcctgcc

SEQ ID NO: 8555 - DNA, 20 bp, Saccharomyces cerevisiae
catggaagaaacgagcttga

SEQ ID NO: 8556 - DNA, 20 bp, Saccharomyces cerevisiae
gacgaatcgtgactctgggt

SEQ ID NO: 8557 - DNA, 20 bp, Saccharomyces cerevisiae
gcgcttttgctgtgaagatt

SEQ ID NO: 8558 - DNA, 20 bp, Saccharomyces cerevisiae
cggggacaatagcaacactt

SEQ ID NO: 8559 - DNA, 20 bp, Saccharomyces cerevisiae
atccaacgtggctaggtgac

SEQ ID NO: 8560 - DNA, 20 bp, Saccharomyces cerevisiae
acataacttcggggacgttg

SEQ ID NO: 8561 - DNA, 20 bp, Saccharomyces cerevisiae
attcctaaccaaggccacct

SEQ ID NO: 8562 - DNA, 20 bp, Saccharomyces cerevisiae
tcctaacggataatgctgcc

SEQ ID NO: 8563 - DNA, 20 bp, Saccharomyces cerevisiae
agattgggttacgtcgcatc

SEQ ID NO: 8564 - DNA, 20 bp, Saccharomyces cerevisiae
ctccctcatcatttgcccta

SEQ ID NO: 8565 - DNA, 20 bp, Saccharomyces cerevisiae
tcatggtaatccccaccagt

SEQ ID NO: 8566 - DNA, 20 bp, Saccharomyces cerevisiae
actattgttatcggtgcggc

SEQ ID NO: 8567 - DNA, 21 bp, Saccharomyces cerevisiae
tgttgccataagcgtagtgaa

SEQ ID NO: 8568 - DNA, 22 bp, Saccharomyces cerevisiae
tcttcaaagggaaacaacaaca

SEQ ID NO: 8569 - DNA, 20 bp, Saccharomyces cerevisiae
ttcttcttcttcgctcgcat

SEQ ID NO: 8570 - DNA, 20 bp, Saccharomyces cerevisiae
tgaacaaaaaccgtttgcat

SEQ ID NO: 8571 - DNA, 20 bp, Saccharomyces cerevisiae
aaaagccgctgaattgagaa

SEQ ID NO: 8572 - DNA, 20 bp, Saccharomyces cerevisiae
ggagctgcaccgtatgattt

SEQ ID NO: 8573 - DNA, 20 bp, Saccharomyces cerevisiae
gtcagtgcacaccagggtaa

SEQ ID NO: 8574 - DNA, 20 bp, Saccharomyces cerevisiae
gatactgccgcaatgaacct

SEQ ID NO: 8575 - DNA, 20 bp, Saccharomyces cerevisiae
ctggagatgaggataaggcg

SEQ ID NO: 8576 - DNA, 20 bp, Saccharomyces cerevisiae
aggtatgattccaaaggggc

SEQ ID NO: 8577 - DNA, 20 bp, Saccharomyces cerevisiae
gaccgcaagagagattttcg

SEQ ID NO: 8578 - DNA, 20 bp, Saccharomyces cerevisiae
ccagaggtcaaattccctca

SEQ ID NO: 8579 - DNA, 20 bp, Saccharomyces cerevisiae
agagttgtagcctgcgatgc

SEQ ID NO: 8580 - DNA, 20 bp, Saccharomyces cerevisiae
atatcaaccacgatgtccgc

SEQ ID NO: 8581 - DNA, 20 bp, Saccharomyces cerevisiae
ctttacgtcggcatttcaca

SEQ ID NO: 8582 - DNA, 20 bp, Saccharomyces cerevisiae
gtgctcagaagaacatggca

SEQ ID NO: 8583 - DNA, 20 bp, Saccharomyces cerevisiae
tggtactcaatcgaaagccc

SEQ ID NO: 8584 - DNA, 20 bp, Saccharomyces cerevisiae
aagcctcaagatacaagccg

SEQ ID NO: 8585 - DNA, 20 bp, Saccharomyces cerevisiae
ttttgcagcacattccattc

SEQ ID NO: 8586 - DNA, 20 bp, Saccharomyces cerevisiae
tacggctgaaatcagtgcaa

SEQ ID NO: 8587 - DNA, 20 bp, Saccharomyces cerevisiae
tgtgcgaatgtcgacaaaat

SEQ ID NO: 8588 - DNA, 20 bp, Saccharomyces cerevisiae
tgtctccaaacaccacaacg

SEQ ID NO: 8589 - DNA, 20 bp, Saccharomyces cerevisiae
aagcagttgctgcatttgtg

SEQ ID NO: 8590 - DNA, 20 bp, Saccharomyces cerevisiae
gaaaagtcgcctcagaaacg

SEQ ID NO: 8591 - DNA, 23 bp, Saccharomyces cerevisiae
tgggtttaaatcaatggtagctg

SEQ ID NO: 8592 - DNA, 20 bp, Saccharomyces cerevisiae
agtctcccaaccacgtcaag

SEQ ID NO: 8593 - DNA, 20 bp, Saccharomyces cerevisiae
agctttccgaattgacgttg

SEQ ID NO: 8594 - DNA, 20 bp, Saccharomyces cerevisiae
aggtccactgtgttcggaag

SEQ ID NO: 8595 - DNA, 20 bp, Saccharomyces cerevisiae
atgaattagccgccaatgac

SEQ ID NO: 8596 - DNA, 20 bp, Saccharomyces cerevisiae
tcttgctagcaggtttcggt

SEQ ID NO: 8597 - DNA, 19 bp, Saccharomyces cerevisiae
aatgcatatttgcctgcga

SEQ ID NO: 8598 - DNA, 20 bp, Saccharomyces cerevisiae
cttcgcgtttgcttttgttt

SEQ ID NO: 8599 - DNA, 20 bp, Saccharomyces cerevisiae
agagcttctctccgcagcta

SEQ ID NO: 8600 - DNA, 20 bp, Saccharomyces cerevisiae
ggggtattccaagaaccagc

SEQ ID NO: 8601 - DNA, 20 bp, Saccharomyces cerevisiae
tgagggtggtgcacaagata

SEQ ID NO: 8602 - DNA, 20 bp, Saccharomyces cerevisiae
tctgccgtggcagttacttt

SEQ ID NO: 8603 - DNA, 25 bp, Saccharomyces cerevisiae
acttcgattgttaagagtccttttg

SEQ ID NO: 8604 - DNA, 20 bp, Saccharomyces cerevisiae
agctcctcgagcgtaaaggt

SEQ ID NO: 8605 - DNA, 21 bp, Saccharomyces cerevisiae
ccggaaacccttcataatgtt

SEQ ID NO: 8606 - DNA, 20 bp, Saccharomyces cerevisiae
cagctttttcgcaaatcaca

SEQ ID NO: 8607 - DNA, 20 bp, Saccharomyces cerevisiae
ggctcaattgacctccaaat

SEQ ID NO: 8608 - DNA, 20 bp, Saccharomyces cerevisiae
tccgaaattccagaaggttg

SEQ ID NO: 8609 - DNA, 20 bp, Saccharomyces cerevisiae
ggcaccggtgaagaatctaa

SEQ ID NO: 8610 - DNA, 21 bp, Saccharomyces cerevisiae
gcttccaacagaggttcttga

SEQ ID NO: 8611 - DNA, 20 bp, Saccharomyces cerevisiae
ctttttgtgcttgcctttcc

SEQ ID NO: 8612 - DNA, 20 bp, Saccharomyces cerevisiae
agcgatataaacaccggcag

SEQ ID NO: 8613 - DNA, 20 bp, Saccharomyces cerevisiae
gtcccattcaagtcagtggc

SEQ ID NO: 8614 - DNA, 20 bp, Saccharomyces cerevisiae
acatgccatgacgaaattca

SEQ ID NO: 8615 - DNA, 20 bp, Saccharomyces cerevisiae
ttgggtccgcgtaaacttag

SEQ ID NO: 8616 - DNA, 20 bp, Saccharomyces cerevisiae
aagtcgctggaggagttgaa

SEQ ID NO: 8617 - DNA, 20 bp, Saccharomyces cerevisiae
taatgcttggtgttcgtgga

SEQ ID NO: 8618 - DNA, 20 bp, Saccharomyces cerevisiae
gatgcaaagacgaggaggag

SEQ ID NO: 8619 - DNA, 22 bp, Saccharomyces cerevisiae
tgaagacgtttgttttgtaccg

SEQ ID NO: 8620 - DNA, 20 bp, Saccharomyces cerevisiae
acgggcatttggaattcttt

SEQ ID NO: 8621 - DNA, 20 bp, Saccharomyces cerevisiae
tatggctggatcccatttgt

SEQ ID NO: 8622 - DNA, 20 bp, Saccharomyces cerevisiae
atgatcgcccaaagtaccag

SEQ ID NO: 8623 - DNA, 20 bp, Saccharomyces cerevisiae
tttctatgcccttggtgctt

SEQ ID NO: 8624 - DNA, 20 bp, Saccharomyces cerevisiae
ctctgttcgttttcacgcaa

SEQ ID NO: 8625 - DNA, 20 bp, Saccharomyces cerevisiae
ggctgctggtattcacacct

SEQ ID NO: 8626 - DNA, 20 bp, Saccharomyces cerevisiae
tctttcgtttggtgggaaac

SEQ ID NO: 8627 - DNA, 20 bp, Saccharomyces cerevisiae
tcgttaaccgccaagttagg

SEQ ID NO: 8628 - DNA, 20 bp, Saccharomyces cerevisiae
tgttgaaggatgttatgcgg

SEQ ID NO: 8629 - DNA, 20 bp, Saccharomyces cerevisiae
acggaatcaccgtggtctta

SEQ ID NO: 8630 - DNA, 20 bp, Saccharomyces cerevisiae
atcgactaccccttttgggt

SEQ ID NO: 8631 - DNA, 20 bp, Saccharomyces cerevisiae
ggcgtatgaaccttgcactt

SEQ ID NO: 8632 - DNA, 20 bp, Saccharomyces cerevisiae
tttttgtgcagcatccactc

SEQ ID NO: 8633 - DNA, 20 bp, Saccharomyces cerevisiae
ttttggaaagcgtgacgagt

SEQ ID NO: 8634 - DNA, 20 bp, Saccharomyces cerevisiae
ctgcgcagaaaatactggct

SEQ ID NO: 8635 - DNA, 20 bp, Saccharomyces cerevisiae
gccttatcctgtggagacca

SEQ ID NO: 8636 - DNA, 20 bp, Saccharomyces cerevisiae
ccaaagcgctaaatgtgtca

SEQ ID NO: 8637 - DNA, 20 bp, Saccharomyces cerevisiae
tccctcaacaactagggctc

SEQ ID NO: 8638 - DNA, 22 bp, Saccharomyces cerevisiae
cgaaagaaaagaggaattgtgg

SEQ ID NO: 8639 - DNA, 20 bp, Saccharomyces cerevisiae
ctttggaccgtcagagtcgt

SEQ ID NO: 8640 - DNA, 20 bp, Saccharomyces cerevisiae
cagggacatgatttgctgtg

SEQ ID NO: 8641 - DNA, 20 bp, Saccharomyces cerevisiae
aaaaagcatggaaagggaaa

SEQ ID NO: 8642 - DNA, 20 bp, Saccharomyces cerevisiae
tccgttgcaagtggtgacta

SEQ ID NO: 8643 - DNA, 20 bp, Saccharomyces cerevisiae
aagctcctgggggtagacat

SEQ ID NO: 8644 - DNA, 20 bp, Saccharomyces cerevisiae
cggcaagacaccagtttaca

SEQ ID NO: 8645 - DNA, 20 bp, Saccharomyces cerevisiae
tttccctggaacattaccca

SEQ ID NO: 8646 - DNA, 20 bp, Saccharomyces cerevisiae
aagaagcagccgcttttgta

SEQ ID NO: 8647 - DNA, 20 bp, Saccharomyces cerevisiae
tgaaaagagtggcttggtcc

SEQ ID NO: 8648 - DNA, 20 bp, Saccharomyces cerevisiae
acgcgaataataccccagtg

SEQ ID NO: 8649 - DNA, 20 bp, Saccharomyces cerevisiae
gggcctttcaagcaatgtag

SEQ ID NO: 8650 - DNA, 20 bp, Saccharomyces cerevisiae
tttgcagcagaacacgaaac

SEQ ID NO: 8651 - DNA, 20 bp, Saccharomyces cerevisiae
attcaatgcgtttttagcgg

SEQ ID NO: 8652 - DNA, 20 bp, Saccharomyces cerevisiae
cgtcgcgtactcccagtaat

SEQ ID NO: 8653 - DNA, 20 bp, Saccharomyces cerevisiae
ggcctgagacttcccttttt

SEQ ID NO: 8654 - DNA, 20 bp, Saccharomyces cerevisiae
tgagctggtacatcaagcca

SEQ ID NO: 8655 - DNA, 21 bp, Saccharomyces cerevisiae
tgtcttcaaacaatcggaaaa

SEQ ID NO: 8656 - DNA, 20 bp, Saccharomyces cerevisiae
gtgcccaagaagaataccga

SEQ ID NO: 8657 - DNA, 20 bp, Saccharomyces cerevisiae
ttgacaataaagcgatcccc

SEQ ID NO: 8658 - DNA, 20 bp, Saccharomyces cerevisiae
agctttgcatcttcttcgga

SEQ ID NO: 8659 - DNA, 20 bp, Saccharomyces cerevisiae
aatatttgccacttcgtccg

SEQ ID NO: 8660 - DNA, 20 bp, Saccharomyces cerevisiae
attggtaacaggctcgatgg

SEQ ID NO: 8661 - DNA, 20 bp, Saccharomyces cerevisiae
tatgatggttgtttgtgcgg

SEQ ID NO: 8662 - DNA, 20 bp, Saccharomyces cerevisiae
tgctaaagtggaagaagcga

SEQ ID NO: 8663 - DNA, 20 bp, Saccharomyces cerevisiae
gatctcccaccatcagagga

SEQ ID NO: 8664 - DNA, 20 bp, Saccharomyces cerevisiae
gaagaagacagcgcttcgat

SEQ ID NO: 8665 - DNA, 20 bp, Saccharomyces cerevisiae
cctatgcactagaccacgca

SEQ ID NO: 8666 - DNA, 20 bp, Saccharomyces cerevisiae
tgaaaaatgagcccgctaac

SEQ ID NO: 8667 - DNA, 20 bp, Saccharomyces cerevisiae
tttgcgtcattaacattgcg

SEQ ID NO: 8668 - DNA, 20 bp, Saccharomyces cerevisiae
ttggtccaatcacgtttcaa

SEQ ID NO: 8669 - DNA, 20 bp, Saccharomyces cerevisiae
aagagaaaagcagaccacgg

SEQ ID NO: 8670 - DNA, 20 bp, Saccharomyces cerevisiae
accttcccagaaaagacggt

SEQ ID NO: 8671 - DNA, 20 bp, Saccharomyces cerevisiae
cacgttgtgaccgtaagtgc

SEQ ID NO: 8672 - DNA, 20 bp, Saccharomyces cerevisiae
cgaagcatcattccgttctt

SEQ ID NO: 8673 - DNA, 20 bp, Saccharomyces cerevisiae
gcgagtccgataacgaatgt

SEQ ID NO: 8674 - DNA, 20 bp, Saccharomyces cerevisiae
tctacgacgcagacaccatt

SEQ ID NO: 8675 - DNA, 20 bp, Saccharomyces cerevisiae
cctgggaattgtcctcaaga

SEQ ID NO: 8676 - DNA, 20 bp, Saccharomyces cerevisiae
gggactaatcgttcctgacg

SEQ ID NO: 8677 - DNA, 20 bp, Saccharomyces cerevisiae
atcaagtcttgcatttcggc

SEQ ID NO: 8678 - DNA, 20 bp, Saccharomyces cerevisiae
atggaagctgctctcacgat

SEQ ID NO: 8679 - DNA, 20 bp, Saccharomyces cerevisiae
cgtcatcgtcgtcatcgtat

SEQ ID NO: 8680 - DNA, 21 bp, Saccharomyces cerevisiae
tgactgtttcccaatcacctt

SEQ ID NO: 8681 - DNA, 20 bp, Saccharomyces cerevisiae
gcgttatgagatcatccggt

SEQ ID NO: 8682 - DNA, 20 bp, Saccharomyces cerevisiae
agcctctgaaggctggaaat

SEQ ID NO: 8683 - DNA, 20 bp, Saccharomyces cerevisiae
ttctttttcaagtgctgcca

SEQ ID NO: 8684 - DNA, 20 bp, Saccharomyces cerevisiae
tggcctcactggtttttacc

SEQ ID NO: 8685 - DNA, 20 bp, Saccharomyces cerevisiae
gtggccgatgtggtattttt

SEQ ID NO: 8686 - DNA, 21 bp, Saccharomyces cerevisiae
ggcgcgtacatttaattttca

SEQ ID NO: 8687 - DNA, 20 bp, Saccharomyces cerevisiae
aggtcggtgctaaggctaca

SEQ ID NO: 8688 - DNA, 20 bp, Saccharomyces cerevisiae
ataaaattacgaaccggggg

SEQ ID NO: 8689 - DNA, 20 bp, Saccharomyces cerevisiae
ctggccaatatgcctcattt

SEQ ID NO: 8690 - DNA, 20 bp, Saccharomyces cerevisiae
ggttggcaatgacatcaaca

SEQ ID NO: 8691 - DNA, 20 bp, Saccharomyces cerevisiae
gaagcgacccaattcaaaga

SEQ ID NO: 8692 - DNA, 20 bp, Saccharomyces cerevisiae
aagttagtggaagccgcaaa

SEQ ID NO: 8693 - DNA, 20 bp, Saccharomyces cerevisiae
ccacgcttacaacaacctca

SEQ ID NO: 8694 - DNA, 25 bp, Saccharomyces cerevisiae
atttattacgatctccacaaatcca

SEQ ID NO: 8695 - DNA, 20 bp, Saccharomyces cerevisiae
gggttccagttcccattttt

SEQ ID NO: 8696 - DNA, 20 bp, Saccharomyces cerevisiae
tttcaatttcggcagattcc

SEQ ID NO: 8697 - DNA, 20 bp, Saccharomyces cerevisiae
tttcgatgttctttttcgcc

SEQ ID NO: 8698 - DNA, 20 bp, Saccharomyces cerevisiae
caatccttacaccgagccat

SEQ ID NO: 8699 - DNA, 20 bp, Saccharomyces cerevisiae
taatctgaggtgcggagctt

SEQ ID NO: 8700 - DNA, 20 bp, Saccharomyces cerevisiae
cttatacgcgtgggcatttt

SEQ ID NO: 8701 - DNA, 21 bp, Saccharomyces cerevisiae
acccggataaaaccgataaga

SEQ ID NO: 8702 - DNA, 20 bp, Saccharomyces cerevisiae
gtccaaccggagtcaactgt

SEQ ID NO: 8703 - DNA, 20 bp, Saccharomyces cerevisiae
tacatgggatgcatggagaa

SEQ ID NO: 8704 - DNA, 20 bp, Saccharomyces cerevisiae
attgacacctcccagcaaat

SEQ ID NO: 8705 - DNA, 20 bp, Saccharomyces cerevisiae
ctcctcagtttgtccacggt

SEQ ID NO: 8706 - DNA, 20 bp, Saccharomyces cerevisiae
gctcaggagaagtccgtttg

SEQ ID NO: 8707 - DNA, 21 bp, Saccharomyces cerevisiae
ggaaaccacaatccaagatga

SEQ ID NO: 8708 - DNA, 20 bp, Saccharomyces cerevisiae
agcaaatgctggtttgcttt

SEQ ID NO: 8709 - DNA, 20 bp, Saccharomyces cerevisiae
tttggaagcagcagtccttt

SEQ ID NO: 8710 - DNA, 20 bp, Saccharomyces cerevisiae
tacgtatgctcagtccagcc

SEQ ID NO: 8711 - DNA, 20 bp, Saccharomyces cerevisiae
aacctattcaaccccaacga

SEQ ID NO: 8712 - DNA, 20 bp, Saccharomyces cerevisiae
gcccgttccatctttctctt

SEQ ID NO: 8713 - DNA, 20 bp, Saccharomyces cerevisiae
agacttgaaagacggttggc

SEQ ID NO: 8714 - DNA, 20 bp, Saccharomyces cerevisiae
tttcactctttggtggcaca

SEQ ID NO: 8715 - DNA, 20 bp, Saccharomyces cerevisiae
tgggagagttgttttcagcc

SEQ ID NO: 8716 - DNA, 20 bp, Saccharomyces cerevisiae
gcatcattcaatgcgtcact

SEQ ID NO: 8717 - DNA, 20 bp, Saccharomyces cerevisiae
tcgaatgaaatcgggaagac

SEQ ID NO: 8718 - DNA, 20 bp, Saccharomyces cerevisiae
aaggaattgcgatcctttga

SEQ ID NO: 8719 - DNA, 20 bp, Saccharomyces cerevisiae
tcgccctatctgttttggtt

SEQ ID NO: 8720 - DNA, 20 bp, Saccharomyces cerevisiae
gcaacgattgacaaatccct

SEQ ID NO: 8721 - DNA, 20 bp, Saccharomyces cerevisiae
ttacattttgccgccataca

SEQ ID NO: 8722 - DNA, 20 bp, Saccharomyces cerevisiae
cgcatccgggtatggtaaat

SEQ ID NO: 8723 - DNA, 20 bp, Saccharomyces cerevisiae
attcttggagcaaaggcaga

SEQ ID NO: 8724 - DNA, 20 bp, Saccharomyces cerevisiae
catgccttcactgctacagg

SEQ ID NO: 8725 - DNA, 20 bp, Saccharomyces cerevisiae
atttgcagcccataccaatc

SEQ ID NO: 8726 - DNA, 20 bp, Saccharomyces cerevisiae
catcaacaaaaatcgggcat

SEQ ID NO: 8727 - DNA, 19 bp, Saccharomyces cerevisiae
cgtagagtccccggaaaaa

SEQ ID NO: 8728 - DNA, 20 bp, Saccharomyces cerevisiae
acagtggggagttcaaaagc

SEQ ID NO: 8729 - DNA, 20 bp, Saccharomyces cerevisiae
ggacccttggaacagcaata

SEQ ID NO: 8730 - DNA, 20 bp, Saccharomyces cerevisiae
aggcgacacttcgaaaatct

SEQ ID NO: 8731 - DNA, 20 bp, Saccharomyces cerevisiae
gatggagacgacgatgatga

SEQ ID NO: 8732 - DNA, 24 bp, Saccharomyces cerevisiae
ataaaatgcagacaatgatgatga

SEQ ID NO: 8733 - DNA, 20 bp, Saccharomyces cerevisiae
ccgaatcctttaccaaacca

SEQ ID NO: 8734 - DNA, 20 bp, Saccharomyces cerevisiae
tgcaagctaaaatgaacgca

SEQ ID NO: 8735 - DNA, 20 bp, Saccharomyces cerevisiae
attttcgtcagcgaacttgg

SEQ ID NO: 8736 - DNA, 20 bp, Saccharomyces cerevisiae
taggcaacgatcctatccgt

SEQ ID NO: 8737 - DNA, 21 bp, Saccharomyces cerevisiae
aagagactctggcttgctttg

SEQ ID NO: 8738 - DNA, 20 bp, Saccharomyces cerevisiae
gagattatctgcggcctacg

SEQ ID NO: 8739 - DNA, 20 bp, Saccharomyces cerevisiae
tacggcttactgacgggttc

SEQ ID NO: 8740 - DNA, 20 bp, Saccharomyces cerevisiae
tagaccaggaagtgaaggca

SEQ ID NO: 8741 - DNA, 20 bp, Saccharomyces cerevisiae
ggttaagcctgacttgctgg

SEQ ID NO: 8742 - DNA, 20 bp, Saccharomyces cerevisiae
tggaagccttgctctgattt

SEQ ID NO: 8743 - DNA, 20 bp, Saccharomyces cerevisiae
atattaaggcatgcccacca

SEQ ID NO: 8744 - DNA, 20 bp, Saccharomyces cerevisiae
cgggttggctgttgtaaaaa

SEQ ID NO: 8745 - DNA, 19 bp, Saccharomyces cerevisiae
ataaccagcccagtggacc

SEQ ID NO: 8746 - DNA, 20 bp, Saccharomyces cerevisiae
taagggctccgtgctaagaa

SEQ ID NO: 8747 - DNA, 20 bp, Saccharomyces cerevisiae
tgttggttgtagcgctggta

SEQ ID NO: 8748 - DNA, 20 bp, Saccharomyces cerevisiae
ggcggtagctcattttctga

SEQ ID NO: 8749 - DNA, 20 bp, Saccharomyces cerevisiae
tggaagaaatcattggaggc

SEQ ID NO: 8750 - DNA, 20 bp, Saccharomyces cerevisiae
cagaggattcccgatttcaa

SEQ ID NO: 8751 - DNA, 20 bp, Saccharomyces cerevisiae
tgtcgatggagattcgtcaa

SEQ ID NO: 8752 - DNA, 20 bp, Saccharomyces cerevisiae
ccatctaacggtgctccttc

SEQ ID NO: 8753 - DNA, 20 bp, Saccharomyces cerevisiae
acaagatctcgccaaggaaa

SEQ ID NO: 8754 - DNA, 20 bp, Saccharomyces cerevisiae
gggttctcgttgtacggatg

SEQ ID NO: 8755 - DNA, 20 bp, Saccharomyces cerevisiae
caacttgaactcgtttcgca

SEQ ID NO: 8756 - DNA, 20 bp, Saccharomyces cerevisiae
gacaaccgactcccttttga

SEQ ID NO: 8757 - DNA, 20 bp, Saccharomyces cerevisiae
gacgaaaaaggaatggcaaa

SEQ ID NO: 8758 - DNA, 20 bp, Saccharomyces cerevisiae
ttttcttcctcgatgtggct

SEQ ID NO: 8759 - DNA, 20 bp, Saccharomyces cerevisiae
gcttggtatccatttccctc

SEQ ID NO: 8760 - DNA, 20 bp, Saccharomyces cerevisiae
aggaatcgctctcaattggt

SEQ ID NO: 8761 - DNA, 20 bp, Saccharomyces cerevisiae
ttgggacttttgcagatcgt

SEQ ID NO: 8762 - DNA, 20 bp, Saccharomyces cerevisiae
aaatttgaatttcacgcgct

SEQ ID NO: 8763 - DNA, 20 bp, Saccharomyces cerevisiae
accacgaggacactttccaa

SEQ ID NO: 8764 - DNA, 20 bp, Saccharomyces cerevisiae
gctgcttgacgttcatgtct

SEQ ID NO: 8765 - DNA, 20 bp, Saccharomyces cerevisiae
cctcacagtcctctgcacaa

SEQ ID NO: 8766 - DNA, 20 bp, Saccharomyces cerevisiae
ttctgatgcaggtgcaagac

SEQ ID NO: 8767 - DNA, 20 bp, Saccharomyces cerevisiae
ccagagggcaaatacgaaga

SEQ ID NO: 8768 - DNA, 20 bp, Saccharomyces cerevisiae
gtgccaaggcaatatcaggt

SEQ ID NO: 8769 - DNA, 20 bp, Saccharomyces cerevisiae
ccaattgggcaggttcttta

SEQ ID NO: 8770 - DNA, 20 bp, Saccharomyces cerevisiae
ccgttttcagggtcaggtaa

SEQ ID NO: 8771 - DNA, 22 bp, Saccharomyces cerevisiae
tccgtagttggttttctcaaca

SEQ ID NO: 8772 - DNA, 20 bp, Saccharomyces cerevisiae
tttcataagggattccacgg

SEQ ID NO: 8773 - DNA, 20 bp, Saccharomyces cerevisiae
tccttgccgcgtataatttc

SEQ ID NO: 8774 - DNA, 20 bp, Saccharomyces cerevisiae
tgtgcctgtatccagctttg

SEQ ID NO: 8775 - DNA, 20 bp, Saccharomyces cerevisiae
aacccgaaccctcttctgat

SEQ ID NO: 8776 - DNA, 20 bp, Saccharomyces cerevisiae
tggaggcaccaaaggagata

SEQ ID NO: 8777 - DNA, 20 bp, Saccharomyces cerevisiae
ggccaagaaccatcaggaat

SEQ ID NO: 8778 - DNA, 20 bp, Saccharomyces cerevisiae
tgaaagaatttcctcgaccg

SEQ ID NO: 8779 - DNA, 20 bp, Saccharomyces cerevisiae
aggttgggatcaaggtgttg

SEQ ID NO: 8780 - DNA, 20 bp, Saccharomyces cerevisiae
aaaggatggtgccaaattca

SEQ ID NO: 8781 - DNA, 21 bp, Saccharomyces cerevisiae
cagggtagcataaacctgctg

SEQ ID NO: 8782 - DNA, 20 bp, Saccharomyces cerevisiae
aagcaaaacagaccattgcc

SEQ ID NO: 8783 - DNA, 20 bp, Saccharomyces cerevisiae
ccattccgccaaaaatagaa

SEQ ID NO: 8784 - DNA, 20 bp, Saccharomyces cerevisiae
ggaggtttctcgtatgccaa

SEQ ID NO: 8785 - DNA, 21 bp, Saccharomyces cerevisiae
accccaacgttgaacttactt

SEQ ID NO: 8786 - DNA, 20 bp, Saccharomyces cerevisiae
atgcgatgaggtcagtttcc

SEQ ID NO: 8787 - DNA, 20 bp, Saccharomyces cerevisiae
ataccatgacacgcattccc

SEQ ID NO: 8788 - DNA, 22 bp, Saccharomyces cerevisiae
acacgtttgttcttggaaaaat

SEQ ID NO: 8789 - DNA, 20 bp, Saccharomyces cerevisiae
attgtggcttccctttgttg

SEQ ID NO: 8790 - DNA, 20 bp, Saccharomyces cerevisiae
gctgtttacccagtccctga

SEQ ID NO: 8791 - DNA, 20 bp, Saccharomyces cerevisiae
ctgaaaacactacgtgcgga

SEQ ID NO: 8792 - DNA, 20 bp, Saccharomyces cerevisiae
taggtatgcgctcgacgatt

SEQ ID NO: 8793 - DNA, 20 bp, Saccharomyces cerevisiae
cacatttggctgcacaactc

SEQ ID NO: 8794 - DNA, 20 bp, Saccharomyces cerevisiae
ccgatcctttcctcagaatg

SEQ ID NO: 8795 - DNA, 20 bp, Saccharomyces cerevisiae
tcatggaatctgggttggtt

SEQ ID NO: 8796 - DNA, 21 bp, Saccharomyces cerevisiae
acccagtacagagcaagcaaa

SEQ ID NO: 8797 - DNA, 20 bp, Saccharomyces cerevisiae
caggccacatcatcactcag

SEQ ID NO: 8798 - DNA, 21 bp, Saccharomyces cerevisiae
ttcattcacaattgtttgcca

SEQ ID NO: 8799 - DNA, 20 bp, Saccharomyces cerevisiae
agacacaccactaaacccgc

SEQ ID NO: 8800 - DNA, 20 bp, Saccharomyces cerevisiae
aggcgttcgcactaaaacac

SEQ ID NO: 8801 - DNA, 20 bp, Saccharomyces cerevisiae
catagcagccggtttttcat

SEQ ID NO: 8802 - DNA, 20 bp, Saccharomyces cerevisiae
caaccaaagatcggttacgg

SEQ ID NO: 8803 - DNA, 20 bp, Saccharomyces cerevisiae
catcagacatgctcggactc

SEQ ID NO: 8804 - DNA, 25 bp, Saccharomyces cerevisiae
aggaggtcttctattgaatgctttt

SEQ ID NO: 8805 - DNA, 20 bp, Saccharomyces cerevisiae
tcgcaatgattctcacgaac

SEQ ID NO: 8806 - DNA, 22 bp, Saccharomyces cerevisiae
caaatacttcatcgagcagagg

SEQ ID NO: 8807 - DNA, 20 bp, Saccharomyces cerevisiae
atgaaagttgtccccgtcac

SEQ ID NO: 8808 - DNA, 20 bp, Saccharomyces cerevisiae
cggtgcccacagtaaagatt

SEQ ID NO: 8809 - DNA, 20 bp, Saccharomyces cerevisiae
aggtacgggttcatcagacg

SEQ ID NO: 8810 - DNA, 20 bp, Saccharomyces cerevisiae
gttgggggtcctccattact

SEQ ID NO: 8811 - DNA, 20 bp, Saccharomyces cerevisiae
tctggtcttcctgcgtctct

SEQ ID NO: 8812 - DNA, 20 bp, Saccharomyces cerevisiae
ctcaacatgtgggtaatgcg

SEQ ID NO: 8813 - DNA, 20 bp, Saccharomyces cerevisiae
aagcggaaacgattctgaaa

SEQ ID NO: 8814 - DNA, 20 bp, Saccharomyces cerevisiae
ggacgttatcaagagcccaa

SEQ ID NO: 8815 - DNA, 20 bp, Saccharomyces cerevisiae
catgaccattgaaatgctgg

SEQ ID NO: 8816 - DNA, 20 bp, Saccharomyces cerevisiae
caagcactcagagcgaatca

SEQ ID NO: 8817 - DNA, 22 bp, Saccharomyces cerevisiae
aaaaatgggaacttcatcaaag

SEQ ID NO: 8818 - DNA, 20 bp, Saccharomyces cerevisiae
atggccgcacttatgagaac

SEQ ID NO: 8819 - DNA, 20 bp, Saccharomyces cerevisiae
tggttttgttttccgaaatg

SEQ ID NO: 8820 - DNA, 23 bp, Saccharomyces cerevisiae
gacgttttcaaaatatcctgacg

SEQ ID NO: 8821 - DNA, 20 bp, Saccharomyces cerevisiae
taggtccctctgaacgttgg

SEQ ID NO: 8822 - DNA, 20 bp, Saccharomyces cerevisiae
gatcactgtcggatgctgaa

SEQ ID NO: 8823 - DNA, 22 bp, Saccharomyces cerevisiae
cgatgctttgtgaatgagaaaa

SEQ ID NO: 8824 - DNA, 20 bp, Saccharomyces cerevisiae
tcttcggtgacgttgaaaca

SEQ ID NO: 8825 - DNA, 20 bp, Saccharomyces cerevisiae
ctctttggcttgctggactc

SEQ ID NO: 8826 - DNA, 20 bp, Saccharomyces cerevisiae
acgtggacgaatcaccagat

SEQ ID NO: 8827 - DNA, 20 bp, Saccharomyces cerevisiae
gcattggtgattcgtcaaga

SEQ ID NO: 8828 - DNA, 20 bp, Saccharomyces cerevisiae
tggcgagaatgatacaagca

SEQ ID NO: 8829 - DNA, 20 bp, Saccharomyces cerevisiae
gaagttgcttggaggaggtg

SEQ ID NO: 8830 - DNA, 20 bp, Saccharomyces cerevisiae
ccttcccaaaaagacagcac

SEQ ID NO: 8831 - DNA, 20 bp, Saccharomyces cerevisiae
aacgaccgttgtttccaatc

SEQ ID NO: 8832 - DNA, 20 bp, Saccharomyces cerevisiae
cggatttatctcaagcgagg

SEQ ID NO: 8833 - DNA, 20 bp, Saccharomyces cerevisiae
cttcaggcttcctggctatg

SEQ ID NO: 8834 - DNA, 25 bp, Saccharomyces cerevisiae
actctagcatagtcaccatctttcg

SEQ ID NO: 8835 - DNA, 21 bp, Saccharomyces cerevisiae
tcagttgaatcagttgccaga

SEQ ID NO: 8836 - DNA, 20 bp, Saccharomyces cerevisiae
aatatacggcaacagtgccc

SEQ ID NO: 8837 - DNA, 20 bp, Saccharomyces cerevisiae
cttgctccatgggaaacact

SEQ ID NO: 8838 - DNA, 22 bp, Saccharomyces cerevisiae
ttggtatgaaacgaacacatga

SEQ ID NO: 8839 - DNA, 20 bp, Saccharomyces cerevisiae
acgtcatttcaaggattcgg

SEQ ID NO: 8840 - DNA, 20 bp, Saccharomyces cerevisiae
ctatcgtgcaccatgtcagc

SEQ ID NO: 8841 - DNA, 20 bp, Saccharomyces cerevisiae
gaatgggaaacccagctttt

SEQ ID NO: 8842 - DNA, 20 bp, Saccharomyces cerevisiae
ggtgctgctggtatttggac

SEQ ID NO: 8843 - DNA, 20 bp, Saccharomyces cerevisiae
atggtagtgagggcacaagg

SEQ ID NO: 8844 - DNA, 20 bp, Saccharomyces cerevisiae
cgaatcccacagtttgaagt

SEQ ID NO: 8845 - DNA, 20 bp, Saccharomyces cerevisiae
tcgaatctaaatgggttgcc

SEQ ID NO: 8846 - DNA, 20 bp, Saccharomyces cerevisiae
ttgggtcgaatgctcaatta

SEQ ID NO: 8847 - DNA, 20 bp, Saccharomyces cerevisiae
ttgataagggccaagacctg

SEQ ID NO: 8848 - DNA, 21 bp, Saccharomyces cerevisiae
agaagttcctgtggtgcaaga

SEQ ID NO: 8849 - DNA, 20 bp, Saccharomyces cerevisiae
catctgcttcatcccaaagc

SEQ ID NO: 8850 - DNA, 20 bp, Saccharomyces cerevisiae
tgcgagttttccgtcttctt

SEQ ID NO: 8851 - DNA, 20 bp, Saccharomyces cerevisiae
atccctcatcctcctggtct

SEQ ID NO: 8852 - DNA, 20 bp, Saccharomyces cerevisiae
atgaacgtaccaaaggcgag

SEQ ID NO: 8853 - DNA, 20 bp, Saccharomyces cerevisiae
gttcaatcagacccaggtgc

SEQ ID NO: 8854 - DNA, 20 bp, Saccharomyces cerevisiae
gtgaagccgaagctgaaaag

SEQ ID NO: 8855 - DNA, 20 bp, Saccharomyces cerevisiae
cgcaattagtggattgctca

SEQ ID NO: 8856 - DNA, 20 bp, Saccharomyces cerevisiae
aagtacaacggacagacccg

SEQ ID NO: 8857 - DNA, 20 bp, Saccharomyces cerevisiae
gatgagatgagatgcgatgc

SEQ ID NO: 8858 - DNA, 21 bp, Saccharomyces cerevisiae
ccgagccaaaggtatataggc

SEQ ID NO: 8859 - DNA, 20 bp, Saccharomyces cerevisiae
aaggaaaacagcctggtcct

SEQ ID NO: 8860 - DNA, 20 bp, Saccharomyces cerevisiae
caatgtttcatcgctatccg

SEQ ID NO: 8861 - DNA, 20 bp, Saccharomyces cerevisiae
cattcacgaggccctacatt

SEQ ID NO: 8862 - DNA, 20 bp, Saccharomyces cerevisiae
acagcttaacatcgttgggg

SEQ ID NO: 8863 - DNA, 20 bp, Saccharomyces cerevisiae
cggggtgcaaagaaataaaa

SEQ ID NO: 8864 - DNA, 20 bp, Saccharomyces cerevisiae
gatggtacacttgcgacagc

SEQ ID NO: 8865 - DNA, 20 bp, Saccharomyces cerevisiae
caaggcacaagcaaagacag

SEQ ID NO: 8866 - DNA, 20 bp, Saccharomyces cerevisiae
gcagaaccatctgggacatt

SEQ ID NO: 8867 - DNA, 20 bp, Saccharomyces cerevisiae
caagaaagctagggagggtg

SEQ ID NO: 8868 - DNA, 20 bp, Saccharomyces cerevisiae
gaaacctttttccgcgtttt

SEQ ID NO: 8869 - DNA, 20 bp, Saccharomyces cerevisiae
cgtacgcttcccactctttg

SEQ ID NO: 8870 - DNA, 22 bp, Saccharomyces cerevisiae
cgagctcaaagaaatctgtcat

SEQ ID NO: 8871 - DNA, 20 bp, Saccharomyces cerevisiae
tacaacgctgaaaccgatga

SEQ ID NO: 8872 - DNA, 20 bp, Saccharomyces cerevisiae
aagcacccatttcagcaatc

SEQ ID NO: 8873 - DNA, 20 bp, Saccharomyces cerevisiae
ctgatccgtcgaagatggtt

SEQ ID NO: 8874 - DNA, 22 bp, Saccharomyces cerevisiae
tcaggtaaaaaccagtaccagg

SEQ ID NO: 8875 - DNA, 20 bp, Saccharomyces cerevisiae
caagagcgtttcgatgtcaa

SEQ ID NO: 8876 - DNA, 20 bp, Saccharomyces cerevisiae
tgttcaaaaggttgggcttc

SEQ ID NO: 8877 - DNA, 20 bp, Saccharomyces cerevisiae
cgttggtcttttgttcatcg

SEQ ID NO: 8878 - DNA, 20 bp, Saccharomyces cerevisiae
acccatgggatgtcattttg

SEQ ID NO: 8879 - DNA, 20 bp, Saccharomyces cerevisiae
aagacatcgagaacgtggga

SEQ ID NO: 8880 - DNA, 20 bp, Saccharomyces cerevisiae
gacccgatatattcgcctca

SEQ ID NO: 8881 - DNA, 20 bp, Saccharomyces cerevisiae
gctttgggaaaagagggaga

SEQ ID NO: 8882 - DNA, 20 bp, Saccharomyces cerevisiae
tccagaaaatttccagcaga

SEQ ID NO: 8883 - DNA, 20 bp, Saccharomyces cerevisiae
ccttgtggataggcgttgtt

SEQ ID NO: 8884 - DNA, 20 bp, Saccharomyces cerevisiae
ggccatagctccgtaacaaa

SEQ ID NO: 8885 - DNA, 20 bp, Saccharomyces cerevisiae
catcgtgcagaacttctcgt

SEQ ID NO: 8886 - DNA, 20 bp, Saccharomyces cerevisiae
cgaaggtgtctctgtcttcg

SEQ ID NO: 8887 - DNA, 27 bp, Saccharomyces cerevisiae
tcaatgtaaattattgtcttgattcat

SEQ ID NO: 8888 - DNA, 21 bp, Saccharomyces cerevisiae
ttgctgcaggcttcatataca

SEQ ID NO: 8889 - DNA, 20 bp, Saccharomyces cerevisiae
cgacactgacaagcctttga

SEQ ID NO: 8890 - DNA, 20 bp, Saccharomyces cerevisiae
aaatgcaccgaaccaacatt

SEQ ID NO: 8891 - DNA, 20 bp, Saccharomyces cerevisiae
atgaatgccggtgtcttacc

SEQ ID NO: 8892 - DNA, 20 bp, Saccharomyces cerevisiae
cgagataaccatggcggtat

SEQ ID NO: 8893 - DNA, 20 bp, Saccharomyces cerevisiae
cgctctactgcctctggaac

SEQ ID NO: 8894 - DNA, 20 bp, Saccharomyces cerevisiae
ggctctgtgtgggttcattt

SEQ ID NO: 8895 - DNA, 20 bp, Saccharomyces cerevisiae
acctaaggattgggaatggg

SEQ ID NO: 8896 - DNA, 20 bp, Saccharomyces cerevisiae
gcacaaaccgacagttgaga

SEQ ID NO: 8897 - DNA, 20 bp, Saccharomyces cerevisiae
ccacagccttgtagcctcat

SEQ ID NO: 8898 - DNA, 20 bp, Saccharomyces cerevisiae
tccggatcgattatggaaga

SEQ ID NO: 8899 - DNA, 20 bp, Saccharomyces cerevisiae
aactcccctatgccaattcc

SEQ ID NO: 8900 - DNA, 20 bp, Saccharomyces cerevisiae
ccttagccttttggatttcg

SEQ ID NO: 8901 - DNA, 20 bp, Saccharomyces cerevisiae
gttccatttggttcctcagc

SEQ ID NO: 8902 - DNA, 21 bp, Saccharomyces cerevisiae
gagtcgagatgaaatgcttcg

SEQ ID NO: 8903 - DNA, 20 bp, Saccharomyces cerevisiae
gaacaaaagcccaatcgcta

SEQ ID NO: 8904 - DNA, 20 bp, Saccharomyces cerevisiae
tggtcttggaaaattcaggc

SEQ ID NO: 8905 - DNA, 20 bp, Saccharomyces cerevisiae
ctgcgaaccacgcatataaa

SEQ ID NO: 8906 - DNA, 21 bp, Saccharomyces cerevisiae
tcgacgagtggttaaacttgc

SEQ ID NO: 8907 - DNA, 27 bp, Saccharomyces cerevisiae
caaccagataagagaaatacaagttca

SEQ ID NO: 8908 - DNA, 22 bp, Saccharomyces cerevisiae
ggttgtgactgtaactccgaca

SEQ ID NO: 8909 - DNA, 20 bp, Saccharomyces cerevisiae
agagtctttttgagcagcgg

SEQ ID NO: 8910 - DNA, 20 bp, Saccharomyces cerevisiae
tcggcaaacacttcattcag

SEQ ID NO: 8911 - DNA, 20 bp, Saccharomyces cerevisiae
taacgtgctgagtcttccca

SEQ ID NO: 8912 - DNA, 20 bp, Saccharomyces cerevisiae
ttcccttgccatggtacact

SEQ ID NO: 8913 - DNA, 20 bp, Saccharomyces cerevisiae
tatatgggaccagctccacc

SEQ ID NO: 8914 - DNA, 20 bp, Saccharomyces cerevisiae
ctttggagaccatgaccgat

SEQ ID NO: 8915 - DNA, 25 bp, Saccharomyces cerevisiae
ccaacaattatctcaaatttcatcc

SEQ ID NO: 8916 - DNA, 20 bp, Saccharomyces cerevisiae
attcaggatgaaatggtcgg

SEQ ID NO: 8917 - DNA, 21 bp, Saccharomyces cerevisiae
tgatgcattgtctctgctgaa

SEQ ID NO: 8918 - DNA, 20 bp, Saccharomyces cerevisiae
caagcaacaccaaaaccaaa

SEQ ID NO: 8919 - DNA, 20 bp, Saccharomyces cerevisiae
taatcaactgtcaaaggcgg

SEQ ID NO: 8920 - DNA, 20 bp, Saccharomyces cerevisiae
accatgaggagttgtttgcc

SEQ ID NO: 8921 - DNA, 20 bp, Saccharomyces cerevisiae
ataattcgtttgcgccaagt

SEQ ID NO: 8922 - DNA, 20 bp, Saccharomyces cerevisiae
gccgtcgttacaccacttct

SEQ ID NO: 8923 - DNA, 20 bp, Saccharomyces cerevisiae
ctcacgttcaatagcgtcca

SEQ ID NO: 8924 - DNA, 20 bp, Saccharomyces cerevisiae
gctttggttcacgatggtct

SEQ ID NO: 8925 - DNA, 20 bp, Saccharomyces cerevisiae
ggaccgtggaaaagatacga

SEQ ID NO: 8926 - DNA, 20 bp, Saccharomyces cerevisiae
gacaagttttctccgcgaac

SEQ ID NO: 8927 - DNA, 20 bp, Saccharomyces cerevisiae
aacgaaggcctttcttctcc

SEQ ID NO: 8928 - DNA, 20 bp, Saccharomyces cerevisiae
caatcccatgatcctccatc

SEQ ID NO: 8929 - DNA, 20 bp, Saccharomyces cerevisiae
cgggtgtaccatattttggc

SEQ ID NO: 8930 - DNA, 21 bp, Saccharomyces cerevisiae
gcacctaagaagcattaacgg

SEQ ID NO: 8931 - DNA, 20 bp, Saccharomyces cerevisiae
ctgacttgtcgctcgcatag

SEQ ID NO: 8932 - DNA, 20 bp, Saccharomyces cerevisiae
tgatcgaatgggcacaataa

SEQ ID NO: 8933 - DNA, 20 bp, Saccharomyces cerevisiae
ttgtctggcactgccttatg

SEQ ID NO: 8934 - DNA, 20 bp, Saccharomyces cerevisiae
tttctacttagcctgcgcgt

SEQ ID NO: 8935 - DNA, 20 bp, Saccharomyces cerevisiae
tcagtgcaggtggtgctatc

SEQ ID NO: 8936 - DNA, 20 bp, Saccharomyces cerevisiae
tcagaagcaatgggagcttt

SEQ ID NO: 8937 - DNA, 20 bp, Saccharomyces cerevisiae
attcggattcaagatcgtcg

SEQ ID NO: 8938 - DNA, 20 bp, Saccharomyces cerevisiae
ggacatctttttccctggct

SEQ ID NO: 8939 - DNA, 20 bp, Saccharomyces cerevisiae
cagaagctaaggcctccaga

SEQ ID NO: 8940 - DNA, 20 bp, Saccharomyces cerevisiae
taacaatgctggccatgaaa

SEQ ID NO: 8941 - DNA, 20 bp, Saccharomyces cerevisiae
aattgggcgtgtttggttac

SEQ ID NO: 8942 - DNA, 21 bp, Saccharomyces cerevisiae
aggtatgttcggatcttcgat

SEQ ID NO: 8943 - DNA, 21 bp, Saccharomyces cerevisiae
aaatcagcccagattaccctc

SEQ ID NO: 8944 - DNA, 20 bp, Saccharomyces cerevisiae
agctttatttgctccgctca

SEQ ID NO: 8945 - DNA, 20 bp, Saccharomyces cerevisiae
tccgagttaaccagcaaagc

SEQ ID NO: 8946 - DNA, 20 bp, Saccharomyces cerevisiae
tacacctcgtgctcaactgc

SEQ ID NO: 8947 - DNA, 20 bp, Saccharomyces cerevisiae
ccgcgaatttgtaaacaggt

SEQ ID NO: 8948 - DNA, 20 bp, Saccharomyces cerevisiae
aataaagggctcaagcaggc

SEQ ID NO: 8949 - DNA, 20 bp, Saccharomyces cerevisiae
gctgtcgtcctcaacagaca

SEQ ID NO: 8950 - DNA, 20 bp, Saccharomyces cerevisiae
tttgacaatggtggaactcg

SEQ ID NO: 8951 - DNA, 20 bp, Saccharomyces cerevisiae
agtggtggatgtcacggttt

SEQ ID NO: 8952 - DNA, 20 bp, Saccharomyces cerevisiae
tccccgcatcttttatatcg

SEQ ID NO: 8953 - DNA, 20 bp, Saccharomyces cerevisiae
caatcctggtaaaaccgcac

SEQ ID NO: 8954 - DNA, 20 bp, Saccharomyces cerevisiae
gtttagggcatgccacattt

SEQ ID NO: 8955 - DNA, 20 bp, Saccharomyces cerevisiae
gagacccagaccggatgtta

SEQ ID NO: 8956 - DNA, 20 bp, Saccharomyces cerevisiae
atatacaagggcgcaactgg

SEQ ID NO: 8957 - DNA, 20 bp, Saccharomyces cerevisiae
gcaagaaatgggcataaagg

SEQ ID NO: 8958 - DNA, 20 bp, Saccharomyces cerevisiae
aggatgaggcccagtctttt

SEQ ID NO: 8959 - DNA, 22 bp, Saccharomyces cerevisiae
tatggaaagtagcatccaacca

SEQ ID NO: 8960 - DNA, 20 bp, Saccharomyces cerevisiae
ttgttcgctcattcagatgc

SEQ ID NO: 8961 - DNA, 20 bp, Saccharomyces cerevisiae
atgagctggtgatgaaagcc

SEQ ID NO: 8962 - DNA, 20 bp, Saccharomyces cerevisiae
aaatgtgtggctgggcttac

SEQ ID NO: 8963 - DNA, 20 bp, Saccharomyces cerevisiae
tgcgctttatgccagctagt

SEQ ID NO: 8964 - DNA, 20 bp, Saccharomyces cerevisiae
agatcaaatagcctacgccg

SEQ ID NO: 8965 - DNA, 20 bp, Saccharomyces cerevisiae
gcaactttttatcggtcgga

SEQ ID NO: 8966 - DNA, 20 bp, Saccharomyces cerevisiae
ttgggaaggaaaggatcaaa

SEQ ID NO: 8967 - DNA, 20 bp, Saccharomyces cerevisiae
tgacttgtttcgaagacgga

SEQ ID NO: 8968 - DNA, 20 bp, Saccharomyces cerevisiae
tcagcttctaatccaggcgt

SEQ ID NO: 8969 - DNA, 20 bp, Saccharomyces cerevisiae
ttctaaaaggcggaaggtca

SEQ ID NO: 8970 - DNA, 21 bp, Saccharomyces cerevisiae
aaaaaggacgagacaccagaa

SEQ ID NO: 8971 - DNA, 20 bp, Saccharomyces cerevisiae
ttgggcgttctatgaggaag

SEQ ID NO: 8972 - DNA, 20 bp, Saccharomyces cerevisiae
tgacgagtttccttaggcgt

SEQ ID NO: 8973 - DNA, 20 bp, Saccharomyces cerevisiae
tcataactgcgagcttggaa

SEQ ID NO: 8974 - DNA, 22 bp, Saccharomyces cerevisiae
tgcgttattgtcttttcaaacc

SEQ ID NO: 8975 - DNA, 20 bp, Saccharomyces cerevisiae
cgaaaatccattcgtggtct

SEQ ID NO: 8976 - DNA, 20 bp, Saccharomyces cerevisiae
tatggttgtgcaaggcactc

SEQ ID NO: 8977 - DNA, 25 bp, Saccharomyces cerevisiae
gagagtatccatctttacgtcggta

SEQ ID NO: 8978 - DNA, 20 bp, Saccharomyces cerevisiae
caatgcaacgacagccatag

SEQ ID NO: 8979 - DNA, 20 bp, Saccharomyces cerevisiae
cagatactggttggctgctg

SEQ ID NO: 8980 - DNA, 20 bp, Saccharomyces cerevisiae
aatcccggatgagtttggtt

SEQ ID NO: 8981 - DNA, 20 bp, Saccharomyces cerevisiae
cgacccggttcaacagtagt

SEQ ID NO: 8982 - DNA, 20 bp, Saccharomyces cerevisiae
cgtgaaaatgccatggtaaa

SEQ ID NO: 8983 - DNA, 20 bp, Saccharomyces cerevisiae
attgacaaggtcaagcagca

SEQ ID NO: 8984 - DNA, 20 bp, Saccharomyces cerevisiae
tgctgctgtctttggactga

SEQ ID NO: 8985 - DNA, 20 bp, Saccharomyces cerevisiae
atttggaatggccctttctt

SEQ ID NO: 8986 - DNA, 23 bp, Saccharomyces cerevisiae
aagatctgagtgagctgagaagg

SEQ ID NO: 8987 - DNA, 20 bp, Saccharomyces cerevisiae
tggagttgggagaggttttg

SEQ ID NO: 8988 - DNA, 20 bp, Saccharomyces cerevisiae
cttcagcatctttttcccca

SEQ ID NO: 8989 - DNA, 20 bp, Saccharomyces cerevisiae
tttgatcgaccctgaaggac

SEQ ID NO: 8990 - DNA, 20 bp, Saccharomyces cerevisiae
aatgcgtacggttgaagtcc

SEQ ID NO: 8991 - DNA, 20 bp, Saccharomyces cerevisiae
tggactgcttgtctcaatcg

SEQ ID NO: 8992 - DNA, 20 bp, Saccharomyces cerevisiae
ccggtttttggaacaacatt

SEQ ID NO: 8993 - DNA, 20 bp, Saccharomyces cerevisiae
accccttcctttggacaagt

SEQ ID NO: 8994 - DNA, 20 bp, Saccharomyces cerevisiae
gagaaagaggggttccttcg

SEQ ID NO: 8995 - DNA, 20 bp, Saccharomyces cerevisiae
tggaatgtttgatgaggtgg

SEQ ID NO: 8996 - DNA, 20 bp, Saccharomyces cerevisiae
ggcaattacaggcagttggt

SEQ ID NO: 8997 - DNA, 20 bp, Saccharomyces cerevisiae
tctcgatttcgctgcttttt

SEQ ID NO: 8998 - DNA, 20 bp, Saccharomyces cerevisiae
gcaagcgtgggtgattttat

SEQ ID NO: 8999 - DNA, 20 bp, Saccharomyces cerevisiae
taaactaaagcgaaggcgga

SEQ ID NO: 9000 - DNA, 20 bp, Saccharomyces cerevisiae
atgaaaggggtgcacagaag

SEQ ID NO: 9001 - DNA, 24 bp, Saccharomyces cerevisiae
aagtttgttaccaagttttgcttt

SEQ ID NO: 9002 - DNA, 23 bp, Saccharomyces cerevisiae
tgtaaaactctggacgaacaaga

SEQ ID NO: 9003 - DNA, 21 bp, Saccharomyces cerevisiae
cgttactttctggccatacca

SEQ ID NO: 9004 - DNA, 20 bp, Saccharomyces cerevisiae
ttttggggagctctcctttt

SEQ ID NO: 9005 - DNA, 21 bp, Saccharomyces cerevisiae
gccaatcaatcttacaatcgc

SEQ ID NO: 9006 - DNA, 20 bp, Saccharomyces cerevisiae
tgagaagaaattccggatgc

SEQ ID NO: 9007 - DNA, 20 bp, Saccharomyces cerevisiae
tttccatttcctgatcctcg

SEQ ID NO: 9008 - DNA, 20 bp, Saccharomyces cerevisiae
tgtgagtacttcgtttgcgg

SEQ ID NO: 9009 - DNA, 22 bp, Saccharomyces cerevisiae
cccttaccaacaatggaatctc

SEQ ID NO: 9010 - DNA, 20 bp, Saccharomyces cerevisiae
aaggacgtttccaacgaatg

SEQ ID NO: 9011 - DNA, 20 bp, Saccharomyces cerevisiae
attttgcctcgaacgatcac

SEQ ID NO: 9012 - DNA, 21 bp, Saccharomyces cerevisiae
ttcattacccgcagatgaaat

SEQ ID NO: 9013 - DNA, 20 bp, Saccharomyces cerevisiae
tcttgcggaacagcagtaga

SEQ ID NO: 9014 - DNA, 20 bp, Saccharomyces cerevisiae
ctcggcgtccactttgtaat

SEQ ID NO: 9015 - DNA, 20 bp, Saccharomyces cerevisiae
ctccccggcaagaatttatc

SEQ ID NO: 9016 - DNA, 20 bp, Saccharomyces cerevisiae
ctaaggaagcgatgggacac

SEQ ID NO: 9017 - DNA, 20 bp, Saccharomyces cerevisiae
tatggaacccggtgagaaag

SEQ ID NO: 9018 - DNA, 20 bp, Saccharomyces cerevisiae
tatcatacgtttggggccat

SEQ ID NO: 9019 - DNA, 20 bp, Saccharomyces cerevisiae
ccccaacaacaacaacaaca

SEQ ID NO: 9020 - DNA, 20 bp, Saccharomyces cerevisiae
aagacgagcacacacgacac

SEQ ID NO: 9021 - DNA, 20 bp, Saccharomyces cerevisiae
attctccaagggtggtcctt

SEQ ID NO: 9022 - DNA, 20 bp, Saccharomyces cerevisiae
atcaatgatacgccaaagcc

SEQ ID NO: 9023 - DNA, 20 bp, Saccharomyces cerevisiae
cgacaacatgcaaaatggat

SEQ ID NO: 9024 - DNA, 19 bp, Saccharomyces cerevisiae
aaccatggccttgagatgc

SEQ ID NO: 9025 - DNA, 20 bp, Saccharomyces cerevisiae
ttttgtggattccaagaccc

SEQ ID NO: 9026 - DNA, 20 bp, Saccharomyces cerevisiae
acttctacctccggccaact

SEQ ID NO: 9027 - DNA, 20 bp, Saccharomyces cerevisiae
tgtttcggaaggattttgct

SEQ ID NO: 9028 - DNA, 20 bp, Saccharomyces cerevisiae
ctgctgatagatggatgccc

SEQ ID NO: 9029 - DNA, 20 bp, Saccharomyces cerevisiae
gaagggatggatgcttttga

SEQ ID NO: 9030 - DNA, 20 bp, Saccharomyces cerevisiae
tccagtgacttttcccgttt

SEQ ID NO: 9031 - DNA, 20 bp, Saccharomyces cerevisiae
caacggttggttttcctgtt

SEQ ID NO: 9032 - DNA, 20 bp, Saccharomyces cerevisiae
aaattccagcttttggaacg

SEQ ID NO: 9033 - DNA, 20 bp, Saccharomyces cerevisiae
ttcaccgccctttctatacg

SEQ ID NO: 9034 - DNA, 20 bp, Saccharomyces cerevisiae
gtgaaatcgccaccttgaat

SEQ ID NO: 9035 - DNA, 21 bp, Saccharomyces cerevisiae
caaatggttaactttggaggg

SEQ ID NO: 9036 - DNA, 20 bp, Saccharomyces cerevisiae
acaataatagcagtgccgcc

SEQ ID NO: 9037 - DNA, 20 bp, Saccharomyces cerevisiae
caatagcgaagaacccgaaa

SEQ ID NO: 9038 - DNA, 20 bp, Saccharomyces cerevisiae
gaatctgtccggaagaaacg

SEQ ID NO: 9039 - DNA, 20 bp, Saccharomyces cerevisiae
ttcatctcgacaatgccaac

SEQ ID NO: 9040 - DNA, 20 bp, Saccharomyces cerevisiae
ggaggcgtcgttacgaatta

SEQ ID NO: 9041 - DNA, 20 bp, Saccharomyces cerevisiae
tatgtgatggagctgccttg

SEQ ID NO: 9042 - DNA, 20 bp, Saccharomyces cerevisiae
caaccaacagcagaaagcaa

SEQ ID NO: 9043 - DNA, 21 bp, Saccharomyces cerevisiae
tcgtcattggcttttatttcg

SEQ ID NO: 9044 - DNA, 20 bp, Saccharomyces cerevisiae
gttctggcagcatgatttga

SEQ ID NO: 9045 - DNA, 20 bp, Saccharomyces cerevisiae
gtttctggggctgtcgtaga

SEQ ID NO: 9046 - DNA, 20 bp, Saccharomyces cerevisiae
tggtcaaatttttgttgcca

SEQ ID NO: 9047 - DNA, 20 bp, Saccharomyces cerevisiae
caatgaaggattctgtcggg

SEQ ID NO: 9048 - DNA, 21 bp, Saccharomyces cerevisiae
tgctctaaccgttggtgattt

SEQ ID NO: 9049 - DNA, 20 bp, Saccharomyces cerevisiae
ttccaattcatcagcatcca

SEQ ID NO: 9050 - DNA, 20 bp, Saccharomyces cerevisiae
acattgccttgcctcaaact

SEQ ID NO: 9051 - DNA, 20 bp, Saccharomyces cerevisiae
acgttacgatagagccagcg

SEQ ID NO: 9052 - DNA, 20 bp, Saccharomyces cerevisiae
ctcaaccgaatgaccgattt

SEQ ID NO: 9053 - DNA, 20 bp, Saccharomyces cerevisiae
ctgccctcacttatggcatc

SEQ ID NO: 9054 - DNA, 20 bp, Saccharomyces cerevisiae
ggcaccatgataaacgaggt

SEQ ID NO: 9055 - DNA, 20 bp, Saccharomyces cerevisiae
aaaaggctttgctgaggaca

SEQ ID NO: 9056 - DNA, 20 bp, Saccharomyces cerevisiae
ttttaggcgtggctgaaaat

SEQ ID NO: 9057 - DNA, 20 bp, Saccharomyces cerevisiae
cgaagcaacccctttcctat

SEQ ID NO: 9058 - DNA, 20 bp, Saccharomyces cerevisiae
aaaaaggcaggacttcgaca

SEQ ID NO: 9059 - DNA, 20 bp, Saccharomyces cerevisiae
tttttccattgttccccaaa

SEQ ID NO: 9060 - DNA, 20 bp, Saccharomyces cerevisiae
ccgtggagtcttcgtcaagt

SEQ ID NO: 9061 - DNA, 20 bp, Saccharomyces cerevisiae
cgcagtttgtttttcccatt

SEQ ID NO: 9062 - DNA, 21 bp, Saccharomyces cerevisiae
ggatcctttatgtctctggca

SEQ ID NO: 9063 - DNA, 20 bp, Saccharomyces cerevisiae
taaaatcagtccaggcaggg

SEQ ID NO: 9064 - DNA, 20 bp, Saccharomyces cerevisiae
aaagcataggcgtgcaagat

SEQ ID NO: 9065 - DNA, 20 bp, Saccharomyces cerevisiae
tgggacggtaaatgaatggt

SEQ ID NO: 9066 - DNA, 20 bp, Saccharomyces cerevisiae
cggttttatcctcctcacga

SEQ ID NO: 9067 - DNA, 20 bp, Saccharomyces cerevisiae
agacccctccacagacttca

SEQ ID NO: 9068 - DNA, 20 bp, Saccharomyces cerevisiae
tttggcagggactatgctgt

SEQ ID NO: 9069 - DNA, 23 bp, Saccharomyces cerevisiae
aaagttcaaaccctcacttgttg

SEQ ID NO: 9070 - DNA, 20 bp, Saccharomyces cerevisiae
aaaaatatggttgggccctc

SEQ ID NO: 9071 - DNA, 20 bp, Saccharomyces cerevisiae
ctggcgtattgcaacaattt

SEQ ID NO: 9072 - DNA, 23 bp, Saccharomyces cerevisiae
ccaaaagtgaatatggaaacgag

SEQ ID NO: 9073 - DNA, 20 bp, Saccharomyces cerevisiae
tgtcgatcgtcatttcttcg

SEQ ID NO: 9074 - DNA, 20 bp, Saccharomyces cerevisiae
atcttgggtcgttgcttgtc

SEQ ID NO: 9075 - DNA, 20 bp, Saccharomyces cerevisiae
cggtgtgaagatagggctgt

SEQ ID NO: 9076 - DNA, 20 bp, Saccharomyces cerevisiae
gctctttcacgtttgtgctg

SEQ ID NO: 9077 - DNA, 20 bp, Saccharomyces cerevisiae
ggcaaccacggtacaaaaac

SEQ ID NO: 9078 - DNA, 21 bp, Saccharomyces cerevisiae
ttctgcctctattcctggatg

SEQ ID NO: 9079 - DNA, 20 bp, Saccharomyces cerevisiae
tcgaaccatcacgaaatcaa

SEQ ID NO: 9080 - DNA, 20 bp, Saccharomyces cerevisiae
tgctacttgttttgccctga

SEQ ID NO: 9081 - DNA, 20 bp, Saccharomyces cerevisiae
gctagaaaccggggaagaaa

SEQ ID NO: 9082 - DNA, 20 bp, Saccharomyces cerevisiae
ttgggtacgcaaatctacga

SEQ ID NO: 9083 - DNA, 21 bp, Saccharomyces cerevisiae
gaccgtgttcaaagaatctcg

SEQ ID NO: 9084 - DNA, 20 bp, Saccharomyces cerevisiae
cgcagaatttgaactgggtt

SEQ ID NO: 9085 - DNA, 20 bp, Saccharomyces cerevisiae
gggaaggattgtttgtgcat

SEQ ID NO: 9086 - DNA, 22 bp, Saccharomyces cerevisiae
ttccaacactgtggattgagtt

SEQ ID NO: 9087 - DNA, 20 bp, Saccharomyces cerevisiae
ctggagaatcggatggtgtt

SEQ ID NO: 9088 - DNA, 20 bp, Saccharomyces cerevisiae
ccaaaaatcgaagatgagca

SEQ ID NO: 9089 - DNA, 20 bp, Saccharomyces cerevisiae
ttcatgttccgaccgttgta

SEQ ID NO: 9090 - DNA, 20 bp, Saccharomyces cerevisiae
gaaaaggcagcagtttgcat

SEQ ID NO: 9091 - DNA, 20 bp, Saccharomyces cerevisiae
gaaaagcgattcggaaactg

SEQ ID NO: 9092 - DNA, 20 bp, Saccharomyces cerevisiae
gaacgcattttagctctcgc

SEQ ID NO: 9093 - DNA, 22 bp, Saccharomyces cerevisiae
tgctctttggaaaaggaatctt

SEQ ID NO: 9094 - DNA, 20 bp, Saccharomyces cerevisiae
cgtatccagcctccttcttg

SEQ ID NO: 9095 - DNA, 20 bp, Saccharomyces cerevisiae
gaggcgcagtcaatacacaa

SEQ ID NO: 9096 - DNA, 20 bp, Saccharomyces cerevisiae
ggatgttcagttcgttggct

SEQ ID NO: 9097 - DNA, 20 bp, Saccharomyces cerevisiae
cgacaacagaggtgttcagg

SEQ ID NO: 9098 - DNA, 20 bp, Saccharomyces cerevisiae
atttacggcagatgccaaga

SEQ ID NO: 9099 - DNA, 20 bp, Saccharomyces cerevisiae
ttgtcgctctaaccgctttt

SEQ ID NO: 9100 - DNA, 20 bp, Saccharomyces cerevisiae
ctctctgaacaggcctggaa

SEQ ID NO: 9101 - DNA, 21 bp, Saccharomyces cerevisiae
aaaccgtgacgttctagctca

SEQ ID NO: 9102 - DNA, 20 bp, Saccharomyces cerevisiae
ctgtacaccggatgagcaga

SEQ ID NO: 9103 - DNA, 20 bp, Saccharomyces cerevisiae
atcaacaatggaaccccaac

SEQ ID NO: 9104 - DNA, 20 bp, Saccharomyces cerevisiae
gatgcggagaaattgttcgt

SEQ ID NO: 9105 - DNA, 20 bp, Saccharomyces cerevisiae
atagacgcaaggaaaagcga

SEQ ID NO: 9106 - DNA, 20 bp, Saccharomyces cerevisiae
cgccgtggaggaaatagata

SEQ ID NO: 9107 - DNA, 26 bp, Saccharomyces cerevisiae
tcatagtgtagtgatatcatttgcga

SEQ ID NO: 9108 - DNA, 20 bp, Saccharomyces cerevisiae
tggatccaaaatggcagaat

SEQ ID NO: 9109 - DNA, 20 bp, Saccharomyces cerevisiae
taaagttccagcagggaagc

SEQ ID NO: 9110 - DNA, 20 bp, Saccharomyces cerevisiae
gcttggacaggtgttgcttt

SEQ ID NO: 9111 - DNA, 20 bp, Saccharomyces cerevisiae
gaaaaggcgcagattaatgg

SEQ ID NO: 9112 - DNA, 20 bp, Saccharomyces cerevisiae
taaggaaaccgttactggcg

SEQ ID NO: 9113 - DNA, 20 bp, Saccharomyces cerevisiae
cgcttaccgtccacaataca

SEQ ID NO: 9114 - DNA, 20 bp, Saccharomyces cerevisiae
aaagggtgttgatggtgctc

SEQ ID NO: 9115 - DNA, 20 bp, Saccharomyces cerevisiae
cgatatcatgtcccgtggta

SEQ ID NO: 9116 - DNA, 20 bp, Saccharomyces cerevisiae
taggtgatgttgtgccctca

SEQ ID NO: 9117 - DNA, 20 bp, Saccharomyces cerevisiae
agtcaaggacgtggatctgg

SEQ ID NO: 9118 - DNA, 20 bp, Saccharomyces cerevisiae
aggatgccgttgatggaata

SEQ ID NO: 9119 - DNA, 20 bp, Saccharomyces cerevisiae
ttttcacaaaaggcaaaggg

SEQ ID NO: 9120 - DNA, 22 bp, Saccharomyces cerevisiae
tcctttttgctttttcataggc

SEQ ID NO: 9121 - DNA, 20 bp, Saccharomyces cerevisiae
ccctacacgttcgctatgct

SEQ ID NO: 9122 - DNA, 20 bp, Saccharomyces cerevisiae
tctggcacccacaacaataa

SEQ ID NO: 9123 - DNA, 20 bp, Saccharomyces cerevisiae
ccgcaggtatggactcgtat

SEQ ID NO: 9124 - DNA, 20 bp, Saccharomyces cerevisiae
attcccaaactgactggacg

SEQ ID NO: 9125 - DNA, 20 bp, Saccharomyces cerevisiae
ttgaaatggtcacacgcagt

SEQ ID NO: 9126 - DNA, 20 bp, Saccharomyces cerevisiae
ctggcaagaagccgagtagt

SEQ ID NO: 9127 - DNA, 20 bp, Saccharomyces cerevisiae
agttcatgcaattgggaagc

SEQ ID NO: 9128 - DNA, 20 bp, Saccharomyces cerevisiae
aagagtggggcgatgtaatg

SEQ ID NO: 9129 - DNA, 20 bp, Saccharomyces cerevisiae
gctggtgggtgaagatttgt

SEQ ID NO: 9130 - DNA, 20 bp, Saccharomyces cerevisiae
acaagccttcccttccagat

SEQ ID NO: 9131 - DNA, 20 bp, Saccharomyces cerevisiae
tggtgtgctgcttctgtctt

SEQ ID NO: 9132 - DNA, 20 bp, Saccharomyces cerevisiae
tatgcgagaaggctccaagt

SEQ ID NO: 9133 - DNA, 20 bp, Saccharomyces cerevisiae
aatcattatccagggtgcca

SEQ ID NO: 9134 - DNA, 20 bp, Saccharomyces cerevisiae
aagcaggttctggtacaccg

SEQ ID NO: 9135 - DNA, 20 bp, Saccharomyces cerevisiae
gtctcgtgctcacgtttgaa

SEQ ID NO: 9136 - DNA, 20 bp, Saccharomyces cerevisiae
ttgtgttaccgaaccaacga

SEQ ID NO: 9137 - DNA, 20 bp, Saccharomyces cerevisiae
aggccattgaagatgcagtt

SEQ ID NO: 9138 - DNA, 20 bp, Saccharomyces cerevisiae
tgctagtcttcggggtagga

SEQ ID NO: 9139 - DNA, 21 bp, Saccharomyces cerevisiae
ttttccttaacaatgcgatgg

SEQ ID NO: 9140 - DNA, 20 bp, Saccharomyces cerevisiae
cagctcctgtggtgctgata

SEQ ID NO: 9141 - DNA, 22 bp, Saccharomyces cerevisiae
ttggacgtaccttaaaccacaa

SEQ ID NO: 9142 - DNA, 19 bp, Saccharomyces cerevisiae
tgcagatcatcgaggaagg

SEQ ID NO: 9143 - DNA, 22 bp, Saccharomyces cerevisiae
cacgctgtacttcttgacttgg

SEQ ID NO: 9144 - DNA, 20 bp, Saccharomyces cerevisiae
ggttcagcttaagcgttgct

SEQ ID NO: 9145 - DNA, 25 bp, Saccharomyces cerevisiae
gacaaccaaacttctgacttggtta

SEQ ID NO: 9146 - DNA, 20 bp, Saccharomyces cerevisiae
cgttgacgggagttttctgt

SEQ ID NO: 9147 - DNA, 21 bp, Saccharomyces cerevisiae
tccagaccttttcgttagtca

SEQ ID NO: 9148 - DNA, 20 bp, Saccharomyces cerevisiae
tgctactgcatcaaatccgt

SEQ ID NO: 9149 - DNA, 20 bp, Saccharomyces cerevisiae
tggtgatgcttgttgacctc

SEQ ID NO: 9150 - DNA, 20 bp, Saccharomyces cerevisiae
tttgaagacatccccgtagc

SEQ ID NO: 9151 - DNA, 23 bp, Saccharomyces cerevisiae
tgtgctgtcagaaatattggttt

SEQ ID NO: 9152 - DNA, 20 bp, Saccharomyces cerevisiae
ccaagggagaagcacctgta

SEQ ID NO: 9153 - DNA, 20 bp, Saccharomyces cerevisiae
gctctaaccactttggtgcc

SEQ ID NO: 9154 - DNA, 21 bp, Saccharomyces cerevisiae
cgttggaggaagaaaatttga

SEQ ID NO: 9155 - DNA, 20 bp, Saccharomyces cerevisiae
ttagaaggctggcgattcat

SEQ ID NO: 9156 - DNA, 20 bp, Saccharomyces cerevisiae
tggatcgcacgttcgtaata

SEQ ID NO: 9157 - DNA, 20 bp, Saccharomyces cerevisiae
cgtcgctatcggtattggtt

SEQ ID NO: 9158 - DNA, 20 bp, Saccharomyces cerevisiae
tcaaacccagcaattcttcc

SEQ ID NO: 9159 - DNA, 20 bp, Saccharomyces cerevisiae
aagagaaaaaggaatcccgc

SEQ ID NO: 9160 - DNA, 21 bp, Saccharomyces cerevisiae
cccaccagacttcaatttttg

SEQ ID NO: 9161 - DNA, 20 bp, Saccharomyces cerevisiae
ggaatcaagagttcccacga

SEQ ID NO: 9162 - DNA, 20 bp, Saccharomyces cerevisiae
atccgaggataagacgcagt

SEQ ID NO: 9163 - DNA, 20 bp, Saccharomyces cerevisiae
ggcgtaccgagatggttaat

SEQ ID NO: 9164 - DNA, 25 bp, Saccharomyces cerevisiae
gcacaatcaattggattatagtttc

SEQ ID NO: 9165 - DNA, 20 bp, Saccharomyces cerevisiae
gcagcaagccatgaaagatt

SEQ ID NO: 9166 - DNA, 20 bp, Saccharomyces cerevisiae
aacactgcaaaaaggttggg

SEQ ID NO: 9167 - DNA, 22 bp, Saccharomyces cerevisiae
cgaaatcgtaagtccacatgaa

SEQ ID NO: 9168 - DNA, 20 bp, Saccharomyces cerevisiae
tgaggaagacgaagtggctt

SEQ ID NO: 9169 - DNA, 20 bp, Saccharomyces cerevisiae
cctcccctgttagacaatcg

SEQ ID NO: 9170 - DNA, 20 bp, Saccharomyces cerevisiae
aagtcagcggctacaccaag

SEQ ID NO: 9171 - DNA, 20 bp, Saccharomyces cerevisiae
agtccgtctccaagatccct

SEQ ID NO: 9172 - DNA, 20 bp, Saccharomyces cerevisiae
caccttgcccattttgaagt

SEQ ID NO: 9173 - DNA, 20 bp, Saccharomyces cerevisiae
tgcaaaaacactgtatgggg

SEQ ID NO: 9174 - DNA, 20 bp, Saccharomyces cerevisiae
cgccaatgcaagaaaaatgt

SEQ ID NO: 9175 - DNA, 20 bp, Saccharomyces cerevisiae
agctgaagcgtgagaatgag

SEQ ID NO: 9176 - DNA, 20 bp, Saccharomyces cerevisiae
ctgcggctcttcagcttact

SEQ ID NO: 9177 - DNA, 20 bp, Saccharomyces cerevisiae
accggaaagtgaagcaccta

SEQ ID NO: 9178 - DNA, 20 bp, Saccharomyces cerevisiae
ggcacagccagtcgtaaagt

SEQ ID NO: 9179 - DNA, 20 bp, Saccharomyces cerevisiae
actcgagtgctgctttccat

SEQ ID NO: 9180 - DNA, 20 bp, Saccharomyces cerevisiae
gcgctgctgaaagagctaag

SEQ ID NO: 9181 - DNA, 21 bp, Saccharomyces cerevisiae
ggcgtagtgaactcttcgtca

SEQ ID NO: 9182 - DNA, 21 bp, Saccharomyces cerevisiae
cgactcgaagacttaaaggca

SEQ ID NO: 9183 - DNA, 20 bp, Saccharomyces cerevisiae
tgtgagcaacgcgatatgat

SEQ ID NO: 9184 - DNA, 20 bp, Saccharomyces cerevisiae
gcaattttcacagtgcatgg

SEQ ID NO: 9185 - DNA, 20 bp, Saccharomyces cerevisiae
cttccggattacctggatga

SEQ ID NO: 9186 - DNA, 20 bp, Saccharomyces cerevisiae
tttcaccgcagaacatcaaa

SEQ ID NO: 9187 - DNA, 20 bp, Saccharomyces cerevisiae
tcgggtctatgtcgtcttcc

SEQ ID NO: 9188 - DNA, 20 bp, Saccharomyces cerevisiae
aattgcaaggtgcaaaggac

SEQ ID NO: 9189 - DNA, 20 bp, Saccharomyces cerevisiae
tagggacgttgaggaactgg

SEQ ID NO: 9190 - DNA, 20 bp, Saccharomyces cerevisiae
ggtgtgatgctggacgacta

SEQ ID NO: 9191 - DNA, 21 bp, Saccharomyces cerevisiae
catccggatagattgagatcg

SEQ ID NO: 9192 - DNA, 20 bp, Saccharomyces cerevisiae
caggcaagagaatgaacgct

SEQ ID NO: 9193 - DNA, 20 bp, Saccharomyces cerevisiae
aatagccaccaatgctggaa

SEQ ID NO: 9194 - DNA, 20 bp, Saccharomyces cerevisiae
atgaggatactccccaggct

SEQ ID NO: 9195 - DNA, 20 bp, Saccharomyces cerevisiae
gcaagaggaacgataaccga

SEQ ID NO: 9196 - DNA, 20 bp, Saccharomyces cerevisiae
tggtatgaagtggagggagg

SEQ ID NO: 9197 - DNA, 22 bp, Saccharomyces cerevisiae
cagtccccagattgagaaagtt

SEQ ID NO: 9198 - DNA, 21 bp, Saccharomyces cerevisiae
tgttgccgatggtacaaatta

SEQ ID NO: 9199 - DNA, 20 bp, Saccharomyces cerevisiae
cgtgcattaattgaacctga

SEQ ID NO: 9200 - DNA, 20 bp, Saccharomyces cerevisiae
atgtgacgagggatgaaagg

SEQ ID NO: 9201 - DNA, 20 bp, Saccharomyces cerevisiae
ttcccccaattctcagacag

SEQ ID NO: 9202 - DNA, 20 bp, Saccharomyces cerevisiae
gcccgaaacagcatacagat

SEQ ID NO: 9203 - DNA, 20 bp, Saccharomyces cerevisiae
tgagctgaagcttgtcgcta

SEQ ID NO: 9204 - DNA, 20 bp, Saccharomyces cerevisiae
gactagcgatcgccttatcg

SEQ ID NO: 9205 - DNA, 20 bp, Saccharomyces cerevisiae
tgcacatcctgaaatccaag

SEQ ID NO: 9206 - DNA, 20 bp, Saccharomyces cerevisiae
aacagaatcatgcccactca

SEQ ID NO: 9207 - DNA, 20 bp, Saccharomyces cerevisiae
atgacgattgaaggagacgc

SEQ ID NO: 9208 - DNA, 20 bp, Saccharomyces cerevisiae
tcgtgctcgttatcatcgtc

SEQ ID NO: 9209 - DNA, 22 bp, Saccharomyces cerevisiae
ttctgacctaggaatttttggc

SEQ ID NO: 9210 - DNA, 20 bp, Saccharomyces cerevisiae
gtttcgacaaaccgatggat

SEQ ID NO: 9211 - DNA, 20 bp, Saccharomyces cerevisiae
ttcaacttctcgcagtgtgg

SEQ ID NO: 9212 - DNA, 20 bp, Saccharomyces cerevisiae
aaaaccaacagcgacattcc

SEQ ID NO: 9213 - DNA, 20 bp, Saccharomyces cerevisiae
taatgtcgggagaggaatgc

SEQ ID NO: 9214 - DNA, 20 bp, Saccharomyces cerevisiae
aaagggttcttagatccgcc

SEQ ID NO: 9215 - DNA, 20 bp, Saccharomyces cerevisiae
gcccattggttaacttcctg

SEQ ID NO: 9216 - DNA, 20 bp, Saccharomyces cerevisiae
atggttggagagtgtggcta

SEQ ID NO: 9217 - DNA, 20 bp, Saccharomyces cerevisiae
actccttcagtctgcaagcc

SEQ ID NO: 9218 - DNA, 20 bp, Saccharomyces cerevisiae
ggattgaccagctccaaaga

SEQ ID NO: 9219 - DNA, 20 bp, Saccharomyces cerevisiae
aattcacttgagagcgggac

SEQ ID NO: 9220 - DNA, 20 bp, Saccharomyces cerevisiae
gaaagtgcgtcttttcagcc

SEQ ID NO: 9221 - DNA, 20 bp, Saccharomyces cerevisiae
ccgtggtatcgtgaggttct

SEQ ID NO: 9222 - DNA, 20 bp, Saccharomyces cerevisiae
gcgaattctgtttctgcttg

SEQ ID NO: 9223 - DNA, 20 bp, Saccharomyces cerevisiae
catctggatgaggtcgttcc

SEQ ID NO: 9224 - DNA, 22 bp, Saccharomyces cerevisiae
ggagggtctaatctccttcaga

SEQ ID NO: 9225 - DNA, 20 bp, Saccharomyces cerevisiae
agaaattcctctgcttggca

SEQ ID NO: 9226 - DNA, 20 bp, Saccharomyces cerevisiae
ccaattgagatgccagacaa

SEQ ID NO: 9227 - DNA, 20 bp, Saccharomyces cerevisiae
gtgagccaaccatggaaact

SEQ ID NO: 9228 - DNA, 20 bp, Saccharomyces cerevisiae
gcaacggtgaagcacagaat

SEQ ID NO: 9229 - DNA, 20 bp, Saccharomyces cerevisiae
cttttcagcccttcaccaag

SEQ ID NO: 9230 - DNA, 23 bp, Saccharomyces cerevisiae
ggaggagaccttgtgtaccaaat

SEQ ID NO: 9231 - DNA, 20 bp, Saccharomyces cerevisiae
attcgacattggaggagtgg

SEQ ID NO: 9232 - DNA, 20 bp, Saccharomyces cerevisiae
ccctgccaacttcttcttca

SEQ ID NO: 9233 - DNA, 20 bp, Saccharomyces cerevisiae
tggcggtaagaaaggatctg

SEQ ID NO: 9234 - DNA, 20 bp, Saccharomyces cerevisiae
ggttgtaaaaagcagggcac

SEQ ID NO: 9235 - DNA, 20 bp, Saccharomyces cerevisiae
gcaccgttaccggacattat

SEQ ID NO: 9236 - DNA, 22 bp, Saccharomyces cerevisiae
cacattattgctttcggacttg

SEQ ID NO: 9237 - DNA, 20 bp, Saccharomyces cerevisiae
gatacggtttccagggaggt

SEQ ID NO: 9238 - DNA, 20 bp, Saccharomyces cerevisiae
caacgaaagatggggtgact

SEQ ID NO: 9239 - DNA, 23 bp, Saccharomyces cerevisiae
tggttgatttttactccaacagg

SEQ ID NO: 9240 - DNA, 20 bp, Saccharomyces cerevisiae
ggttacgcctagtcagcagc

SEQ ID NO: 9241 - DNA, 20 bp, Saccharomyces cerevisiae
tctcagcggctaatccaatc

SEQ ID NO: 9242 - DNA, 21 bp, Saccharomyces cerevisiae
caagtgatgctgctttgacag

SEQ ID NO: 9243 - DNA, 20 bp, Saccharomyces cerevisiae
aagagccggcaaagaaactt

SEQ ID NO: 9244 - DNA, 20 bp, Saccharomyces cerevisiae
acaggatgattgggatccag

SEQ ID NO: 9245 - DNA, 20 bp, Saccharomyces cerevisiae
aaacgcatgtatcatcgcaa

SEQ ID NO: 9246 - DNA, 20 bp, Saccharomyces cerevisiae
tcgctgttgttcatgagtcc

SEQ ID NO: 9247 - DNA, 21 bp, Saccharomyces cerevisiae
aacatggtgttccaaagcact

SEQ ID NO: 9248 - DNA, 20 bp, Saccharomyces cerevisiae
gcgatatcgttgcagattga

SEQ ID NO: 9249 - DNA, 20 bp, Saccharomyces cerevisiae
tctttgcttttgttgggacc

SEQ ID NO: 9250 - DNA, 20 bp, Saccharomyces cerevisiae
ggccatcgttagtcaacaca

SEQ ID NO: 9251 - DNA, 20 bp, Saccharomyces cerevisiae
gaatttccgagagcaaatcg

SEQ ID NO: 9252 - DNA, 20 bp, Saccharomyces cerevisiae
ggtttgctaaaggggaggag

SEQ ID NO: 9253 - DNA, 20 bp, Saccharomyces cerevisiae
accggaaatttgacaaggtg

SEQ ID NO: 9254 - DNA, 20 bp, Saccharomyces cerevisiae
acatgggaataggaccctcc

SEQ ID NO: 9255 - DNA, 20 bp, Saccharomyces cerevisiae
caacgccattgctaatgcta

SEQ ID NO: 9256 - DNA, 20 bp, Saccharomyces cerevisiae
ggggcgttgttaaatgaaat

SEQ ID NO: 9257 - DNA, 20 bp, Saccharomyces cerevisiae
agaaagtgcatggatttggc

SEQ ID NO: 9258 - DNA, 20 bp, Saccharomyces cerevisiae
agcaaccaatacaacagggg

SEQ ID NO: 9259 - DNA, 20 bp, Saccharomyces cerevisiae
tgaagcatgcaactgaggtc

SEQ ID NO: 9260 - DNA, 20 bp, Saccharomyces cerevisiae
tcatgtcaaaggaaggagca

SEQ ID NO: 9261 - DNA, 25 bp, Saccharomyces cerevisiae
gagaaacaagattgctggttacact

SEQ ID NO: 9262 - DNA, 20 bp, Saccharomyces cerevisiae
cagtatcgtggccgttcttt

SEQ ID NO: 9263 - DNA, 20 bp, Saccharomyces cerevisiae
tctttgggcactatcgttgg

SEQ ID NO: 9264 - DNA, 20 bp, Saccharomyces cerevisiae
tttgtttatcgtttggctgg

SEQ ID NO: 9265 - DNA, 20 bp, Saccharomyces cerevisiae
agtccagcgtctcctttcaa

SEQ ID NO: 9266 - DNA, 20 bp, Saccharomyces cerevisiae
ggtgtctgatctcctgagcc

SEQ ID NO: 9267 - DNA, 20 bp, Saccharomyces cerevisiae
cgttgaaatgacgaggtgaa

SEQ ID NO: 9268 - DNA, 20 bp, Saccharomyces cerevisiae
cggctgtggttcttgttctc

SEQ ID NO: 9269 - DNA, 20 bp, Saccharomyces cerevisiae
tcccagtgatatggcacaag

SEQ ID NO: 9270 - DNA, 20 bp, Saccharomyces cerevisiae
acataccaaaatcggggtca

SEQ ID NO: 9271 - DNA, 20 bp, Saccharomyces cerevisiae
tgctgctccaactcactctg

SEQ ID NO: 9272 - DNA, 20 bp, Saccharomyces cerevisiae
ggggtttactttgggtttgc

SEQ ID NO: 9273 - DNA, 20 bp, Saccharomyces cerevisiae
cttggctgctttagtcaggg

SEQ ID NO: 9274 - DNA, 20 bp, Saccharomyces cerevisiae
ccccatggaatatctggaac

SEQ ID NO: 9275 - DNA, 20 bp, Saccharomyces cerevisiae
aaaaaggaatcacaaccccc

SEQ ID NO: 9276 - DNA, 20 bp, Saccharomyces cerevisiae
cgtcggtgaatttatcccat

SEQ ID NO: 9277 - DNA, 20 bp, Saccharomyces cerevisiae
ccaccccatcaaaaccacta

SEQ ID NO: 9278 - DNA, 20 bp, Saccharomyces cerevisiae
actgccgagcaattgaagat

SEQ ID NO: 9279 - DNA, 20 bp, Saccharomyces cerevisiae
gcgtcgaagatgatgagaca

SEQ ID NO: 9280 - DNA, 20 bp, Saccharomyces cerevisiae
cctcaattctggaggcaaac

SEQ ID NO: 9281 - DNA, 20 bp, Saccharomyces cerevisiae
tagaggccgcacctaaattg

SEQ ID NO: 9282 - DNA, 20 bp, Saccharomyces cerevisiae
ttaattcgggagccaaagtg

SEQ ID NO: 9283 - DNA, 20 bp, Saccharomyces cerevisiae
ttcagagccttctttggagc

SEQ ID NO: 9284 - DNA, 20 bp, Saccharomyces cerevisiae
gttcttggcgttggacaagt

SEQ ID NO: 9285 - DNA, 20 bp, Saccharomyces cerevisiae
tcatgatggttcgttagcca

SEQ ID NO: 9286 - DNA, 20 bp, Saccharomyces cerevisiae
ttgattaaaatcattgggcg

SEQ ID NO: 9287 - DNA, 20 bp, Saccharomyces cerevisiae
tgttgcccgggaagtataag

SEQ ID NO: 9288 - DNA, 20 bp, Saccharomyces cerevisiae
agaagggaaaacgcactcaa

SEQ ID NO: 9289 - DNA, 20 bp, Saccharomyces cerevisiae
tgggatagctggtcagtggt

SEQ ID NO: 9290 - DNA, 20 bp, Saccharomyces cerevisiae
atgtcggatccatgtccagt

SEQ ID NO: 9291 - DNA, 20 bp, Saccharomyces cerevisiae
agacttcccaacaggcagaa

SEQ ID NO: 9292 - DNA, 20 bp, Saccharomyces cerevisiae
catttgttctctccatcgca

SEQ ID NO: 9293 - DNA, 20 bp, Saccharomyces cerevisiae
tcagcgaaaagaccaatcct

SEQ ID NO: 9294 - DNA, 20 bp, Saccharomyces cerevisiae
agtatagagacagccggcca

SEQ ID NO: 9295 - DNA, 20 bp, Saccharomyces cerevisiae
gatgaaggcgatgagttcgt

SEQ ID NO: 9296 - DNA, 20 bp, Saccharomyces cerevisiae
atgagccttcgctcaacagt

SEQ ID NO: 9297 - DNA, 22 bp, Saccharomyces cerevisiae
cggatgtaggttgttgaatgtt

SEQ ID NO: 9298 - DNA, 20 bp, Saccharomyces cerevisiae
agcggagaccttttggtttt

SEQ ID NO: 9299 - DNA, 20 bp, Saccharomyces cerevisiae
gctgtccttgctactttggc

SEQ ID NO: 9300 - DNA, 20 bp, Saccharomyces cerevisiae
taccagaaccaagaccccag

SEQ ID NO: 9301 - DNA, 20 bp, Saccharomyces cerevisiae
atcgatgagtggggattttg

SEQ ID NO: 9302 - DNA, 20 bp, Saccharomyces cerevisiae
tgcaaaagcaaggactgaaa

SEQ ID NO: 9303 - DNA, 20 bp, Saccharomyces cerevisiae
tagaaagggcttggctttga

SEQ ID NO: 9304 - DNA, 20 bp, Saccharomyces cerevisiae
tcgtcaagtttttgaagggc

SEQ ID NO: 9305 - DNA, 20 bp, Saccharomyces cerevisiae
gaaagccttccttgcttcct

SEQ ID NO: 9306 - DNA, 20 bp, Saccharomyces cerevisiae
cgctggtaatgtcattggtg

SEQ ID NO: 9307 - DNA, 20 bp, Saccharomyces cerevisiae
cagtgcttttaagcttgccc

SEQ ID NO: 9308 - DNA, 20 bp, Saccharomyces cerevisiae
agctcatttaatcgcgtgct

SEQ ID NO: 9309 - DNA, 22 bp, Saccharomyces cerevisiae
ttgtggccagacaaaaattaga

SEQ ID NO: 9310 - DNA, 20 bp, Saccharomyces cerevisiae
tcacgaaactggtacgatgc

SEQ ID NO: 9311 - DNA, 20 bp, Saccharomyces cerevisiae
gctttaaacaagaaacgccg

SEQ ID NO: 9312 - DNA, 20 bp, Saccharomyces cerevisiae
cggccttctgatatgtttga

SEQ ID NO: 9313 - DNA, 20 bp, Saccharomyces cerevisiae
ttatttttggcagcactgga

SEQ ID NO: 9314 - DNA, 20 bp, Saccharomyces cerevisiae
cagagctctaacgcaacgaa

SEQ ID NO: 9315 - DNA, 20 bp, Saccharomyces cerevisiae
aataacaagcggagggttcc

SEQ ID NO: 9316 - DNA, 20 bp, Saccharomyces cerevisiae
atctactgccaactcggtgc

SEQ ID NO: 9317 - DNA, 20 bp, Saccharomyces cerevisiae
atggaggcagagtgcttgat

SEQ ID NO: 9318 - DNA, 19 bp, Saccharomyces cerevisiae
ttttggagaaaacccagcc

SEQ ID NO: 9319 - DNA, 20 bp, Saccharomyces cerevisiae
gcattgatgttatcccaccc

SEQ ID NO: 9320 - DNA, 20 bp, Saccharomyces cerevisiae
acaggttcgttctcccaatg

SEQ ID NO: 9321 - DNA, 20 bp, Saccharomyces cerevisiae
gattgccgaagttggtccta

SEQ ID NO: 9322 - DNA, 20 bp, Saccharomyces cerevisiae
tgcaggaaggtcttgcctat

SEQ ID NO: 9323 - DNA, 20 bp, Saccharomyces cerevisiae
gcgaagatgacattgcaaaa

SEQ ID NO: 9324 - DNA, 20 bp, Saccharomyces cerevisiae
aaattgaatcagaagggggc

SEQ ID NO: 9325 - DNA, 20 bp, Saccharomyces cerevisiae
cggaacggtaggatgaaaaa

SEQ ID NO: 9326 - DNA, 20 bp, Saccharomyces cerevisiae
tggctacaaagctactgcga

SEQ ID NO: 9327 - DNA, 20 bp, Saccharomyces cerevisiae
tctctcttctcattcggcgt

SEQ ID NO: 9328 - DNA, 20 bp, Saccharomyces cerevisiae
tcagatgactttgccaacca

SEQ ID NO: 9329 - DNA, 20 bp, Saccharomyces cerevisiae
attcgcatttgttgtcgtga

SEQ ID NO: 9330 - DNA, 20 bp, Saccharomyces cerevisiae
tgtagcccaacggattcttc

SEQ ID NO: 9331 - DNA, 18 bp, Saccharomyces cerevisiae
aacagccagccccttttc

SEQ ID NO: 9332 - DNA, 20 bp, Saccharomyces cerevisiae
gggttggcgttgtatagcat

SEQ ID NO: 9333 - DNA, 20 bp, Saccharomyces cerevisiae
tttgagcaacatccgaatca

SEQ ID NO: 9334 - DNA, 20 bp, Saccharomyces cerevisiae
cggtgcgagactgacagtta

SEQ ID NO: 9335 - DNA, 20 bp, Saccharomyces cerevisiae
ttagcgggctttacatggtc

SEQ ID NO: 9336 - DNA, 20 bp, Saccharomyces cerevisiae
ggggcccgctaattagtaac

SEQ ID NO: 9337 - DNA, 20 bp, Saccharomyces cerevisiae
aatgcctgataccgttctgc

SEQ ID NO: 9338 - DNA, 20 bp, Saccharomyces cerevisiae
gaggtggtgccaagatgttt

SEQ ID NO: 9339 - DNA, 20 bp, Saccharomyces cerevisiae
tacatggggtccttcctgag

SEQ ID NO: 9340 - DNA, 20 bp, Saccharomyces cerevisiae
cttatatgcaatccaccggg

SEQ ID NO: 9341 - DNA, 20 bp, Saccharomyces cerevisiae
gaccaccaccaccgaataac

SEQ ID NO: 9342 - DNA, 20 bp, Saccharomyces cerevisiae
cgtcaagtgtcaggatgtcg

SEQ ID NO: 9343 - DNA, 21 bp, Saccharomyces cerevisiae
ggcctagtgttcttgaagagg

SEQ ID NO: 9344 - DNA, 20 bp, Saccharomyces cerevisiae
gcgcttagaggagcaattca

SEQ ID NO: 9345 - DNA, 20 bp, Saccharomyces cerevisiae
gagcagcttggcgtaggtag

SEQ ID NO: 9346 - DNA, 25 bp, Saccharomyces cerevisiae
cactgagaagtttagtgaggaggag

SEQ ID NO: 9347 - DNA, 20 bp, Saccharomyces cerevisiae
gccgctaagcatctgaaaaa

SEQ ID NO: 9348 - DNA, 20 bp, Saccharomyces cerevisiae
aaggatgagggagaggtggt

SEQ ID NO: 9349 - DNA, 20 bp, Saccharomyces cerevisiae
aacagagtctcgaagctcgc

SEQ ID NO: 9350 - DNA, 20 bp, Saccharomyces cerevisiae
acgtcgcacgacctacttct

SEQ ID NO: 9351 - DNA, 20 bp, Saccharomyces cerevisiae
cgggaataaatcaggaggct

SEQ ID NO: 9352 - DNA, 20 bp, Saccharomyces cerevisiae
gaagagcgaaaacaaatcgc

SEQ ID NO: 9353 - DNA, 20 bp, Saccharomyces cerevisiae
tgccgaaagacaatatgtgc

SEQ ID NO: 9354 - DNA, 20 bp, Saccharomyces cerevisiae
ccacgacgtcttcccaatac

SEQ ID NO: 9355 - DNA, 20 bp, Saccharomyces cerevisiae
tgggaggcttacaaagatgc

SEQ ID NO: 9356 - DNA, 20 bp, Saccharomyces cerevisiae
cggtgatatcggatcaggtt

SEQ ID NO: 9357 - DNA, 20 bp, Saccharomyces cerevisiae
cgctgcagtctcctctacct

SEQ ID NO: 9358 - DNA, 21 bp, Saccharomyces cerevisiae
caccattttcacgagcctatg

SEQ ID NO: 9359 - DNA, 20 bp, Saccharomyces cerevisiae
aacatcgacaggactacccg

SEQ ID NO: 9360 - DNA, 26 bp, Saccharomyces cerevisiae
tgtttattatacatacgcaacggttt

SEQ ID NO: 9361 - DNA, 20 bp, Saccharomyces cerevisiae
cgtgaaaagaaggaacaggc

SEQ ID NO: 9362 - DNA, 20 bp, Saccharomyces cerevisiae
tcgcatcgtgtatcaatggt

SEQ ID NO: 9363 - DNA, 20 bp, Saccharomyces cerevisiae
cgctattgaggacggttttt

SEQ ID NO: 9364 - DNA, 20 bp, Saccharomyces cerevisiae
actttagggagcggatcatt

SEQ ID NO: 9365 - DNA, 20 bp, Saccharomyces cerevisiae
agacaggaggtgcttgagga

SEQ ID NO: 9366 - DNA, 20 bp, Saccharomyces cerevisiae
gcggcaatgactttgaattt

SEQ ID NO: 9367 - DNA, 20 bp, Saccharomyces cerevisiae
ccaaagagatgagccaaagc

SEQ ID NO: 9368 - DNA, 20 bp, Saccharomyces cerevisiae
tagcagcaaacgaaagtgga

SEQ ID NO: 9369 - DNA, 20 bp, Saccharomyces cerevisiae
cgataaagaatggtaccggc

SEQ ID NO: 9370 - DNA, 20 bp, Saccharomyces cerevisiae
tgaaagggtcccaaataacg

SEQ ID NO: 9371 - DNA, 20 bp, Saccharomyces cerevisiae
actgcctcgagtctgacgat

SEQ ID NO: 9372 - DNA, 20 bp, Saccharomyces cerevisiae
ctgctgtgggtatggatgaa

SEQ ID NO: 9373 - DNA, 20 bp, Saccharomyces cerevisiae
tgcgctgcatttattggata

SEQ ID NO: 9374 - DNA, 23 bp, Saccharomyces cerevisiae
tgagaagtacaggattttggagg

SEQ ID NO: 9375 - DNA, 20 bp, Saccharomyces cerevisiae
aaagctaccggccaagaaat

SEQ ID NO: 9376 - DNA, 20 bp, Saccharomyces cerevisiae
tgaaggttattccgggagtg

SEQ ID NO: 9377 - DNA, 20 bp, Saccharomyces cerevisiae
cttccaatctgttgtgccag

SEQ ID NO: 9378 - DNA, 20 bp, Saccharomyces cerevisiae
tcaaactcatccttgcctcc

SEQ ID NO: 9379 - DNA, 20 bp, Saccharomyces cerevisiae
atgcctggtcatatgggaaa

SEQ ID NO: 9380 - DNA, 20 bp, Saccharomyces cerevisiae
gcagctaacgtacccgagac

SEQ ID NO: 9381 - DNA, 20 bp, Saccharomyces cerevisiae
gccatcggtgcatctagttt

SEQ ID NO: 9382 - DNA, 20 bp, Saccharomyces cerevisiae
cccatgcgaataggaaggta

SEQ ID NO: 9383 - DNA, 22 bp, Saccharomyces cerevisiae
gggactacatgttaaggaggca

SEQ ID NO: 9384 - DNA, 21 bp, Saccharomyces cerevisiae
tcaaatgaagctgattccacc

SEQ ID NO: 9385 - DNA, 20 bp, Saccharomyces cerevisiae
ctttcccaaaagccaatcat

SEQ ID NO: 9386 - DNA, 20 bp, Saccharomyces cerevisiae
tacaaggaagggcaaagcat

SEQ ID NO: 9387 - DNA, 20 bp, Saccharomyces cerevisiae
tcagccatctcccagaattg

SEQ ID NO: 9388 - DNA, 23 bp, Saccharomyces cerevisiae
gaagcgtaaattcatcaaaaagg

SEQ ID NO: 9389 - DNA, 20 bp, Saccharomyces cerevisiae
caccatgggtgaagagaggt

SEQ ID NO: 9390 - DNA, 20 bp, Saccharomyces cerevisiae
gaagttgctcatctcctggc

SEQ ID NO: 9391 - DNA, 20 bp, Saccharomyces cerevisiae
acggttgacatcaaaggaca

SEQ ID NO: 9392 - DNA, 20 bp, Saccharomyces cerevisiae
tcagaagcaccgaggagagt

SEQ ID NO: 9393 - DNA, 20 bp, Saccharomyces cerevisiae
cggcctcaaccattctctaa

SEQ ID NO: 9394 - DNA, 20 bp, Saccharomyces cerevisiae
cgccctcgagttactcaata

SEQ ID NO: 9395 - DNA, 20 bp, Saccharomyces cerevisiae
ttgcaacaccaacaacgaat

SEQ ID NO: 9396 - DNA, 20 bp, Saccharomyces cerevisiae
agcagcggtggtagtgaagt

SEQ ID NO: 9397 - DNA, 20 bp, Saccharomyces cerevisiae
gaaaattggatgagggggat

SEQ ID NO: 9398 - DNA, 20 bp, Saccharomyces cerevisiae
cacggtccaagagtgacaga

SEQ ID NO: 9399 - DNA, 20 bp, Saccharomyces cerevisiae
ccgccttcattatgggaata

SEQ ID NO: 9400 - DNA, 20 bp, Saccharomyces cerevisiae
cgagatcgacaaggaacaca

SEQ ID NO: 9401 - DNA, 20 bp, Saccharomyces cerevisiae
ccaaactcggtccatgctat

SEQ ID NO: 9402 - DNA, 22 bp, Saccharomyces cerevisiae
tccaacatgtgtactacgagca

SEQ ID NO: 9403 - DNA, 20 bp, Saccharomyces cerevisiae
taacgctatggaatcggacc

SEQ ID NO: 9404 - DNA, 20 bp, Saccharomyces cerevisiae
taaagtcatttgcagcggag

SEQ ID NO: 9405 - DNA, 20 bp, Saccharomyces cerevisiae
tcgtcctcatctcccaagag

SEQ ID NO: 9406 - DNA, 20 bp, Saccharomyces cerevisiae
cgaagcaccttcctctcaac

SEQ ID NO: 9407 - DNA, 20 bp, Saccharomyces cerevisiae
aggggttcgccaaattattc

SEQ ID NO: 9408 - DNA, 20 bp, Saccharomyces cerevisiae
ccatccggtcatacaggttc

SEQ ID NO: 9409 - DNA, 21 bp, Saccharomyces cerevisiae
tgatttggttcatccttttgg

SEQ ID NO: 9410 - DNA, 20 bp, Saccharomyces cerevisiae
tgtttacatggtcatcggga

SEQ ID NO: 9411 - DNA, 20 bp, Saccharomyces cerevisiae
tcatcagctgcggtacagtc

SEQ ID NO: 9412 - DNA, 20 bp, Saccharomyces cerevisiae
atcttccatgagagaggccc

SEQ ID NO: 9413 - DNA, 20 bp, Saccharomyces cerevisiae
taggggaatggagcttttca

SEQ ID NO: 9414 - DNA, 20 bp, Saccharomyces cerevisiae
tgttcgtggtaagctcgttg

SEQ ID NO: 9415 - DNA, 20 bp, Saccharomyces cerevisiae
aacgaaaagttggctgctgt

SEQ ID NO: 9416 - DNA, 20 bp, Saccharomyces cerevisiae
tctcgaactcaacctcctgg

SEQ ID NO: 9417 - DNA, 20 bp, Saccharomyces cerevisiae
cttcttaggcacttccggtg

SEQ ID NO: 9418 - DNA, 20 bp, Saccharomyces cerevisiae
acaaactgggtttcttccga

SEQ ID NO: 9419 - DNA, 20 bp, Saccharomyces cerevisiae
tggccgaagttaggtttctg

SEQ ID NO: 9420 - DNA, 20 bp, Saccharomyces cerevisiae
aaaaggccgcagtaatttga

SEQ ID NO: 9421 - DNA, 20 bp, Saccharomyces cerevisiae
cgggaaaaattcagacggta

SEQ ID NO: 9422 - DNA, 25 bp, Saccharomyces cerevisiae
cgacaaagcgttaaatatagaaaca

SEQ ID NO: 9423 - DNA, 20 bp, Saccharomyces cerevisiae
caaggaagattggcttagcg

SEQ ID NO: 9424 - DNA, 20 bp, Saccharomyces cerevisiae
ccaatggtgagaaatgttcg

SEQ ID NO: 9425 - DNA, 20 bp, Saccharomyces cerevisiae
gctgggaactgcttatttgc

SEQ ID NO: 9426 - DNA, 20 bp, Saccharomyces cerevisiae
ctgtataccctcagccagcc

SEQ ID NO: 9427 - DNA, 20 bp, Saccharomyces cerevisiae
tggaagatgtcaaaagggct

SEQ ID NO: 9428 - DNA, 20 bp, Saccharomyces cerevisiae
agtgatcaaggtgcaagcct

SEQ ID NO: 9429 - DNA, 21 bp, Saccharomyces cerevisiae
tctgcgtacacctggagattt

SEQ ID NO: 9430 - DNA, 20 bp, Saccharomyces cerevisiae
tggggtagcttgataccgtc

SEQ ID NO: 9431 - DNA, 20 bp, Saccharomyces cerevisiae
ggcagaattgattgagggaa

SEQ ID NO: 9432 - DNA, 20 bp, Saccharomyces cerevisiae
gcaaccaaatagggctacca

SEQ ID NO: 9433 - DNA, 20 bp, Saccharomyces cerevisiae
cccctaaccaaaaatcagca

SEQ ID NO: 9434 - DNA, 20 bp, Saccharomyces cerevisiae
tgactcgcaaaattcacagc

SEQ ID NO: 9435 - DNA, 20 bp, Saccharomyces cerevisiae
catgtgataatttgacgcgg

SEQ ID NO: 9436 - DNA, 20 bp, Saccharomyces cerevisiae
tacgcttgtctgggtgagac

SEQ ID NO: 9437 - DNA, 20 bp, Saccharomyces cerevisiae
ttggagaatcgttttcggtt

SEQ ID NO: 9438 - DNA, 22 bp, Saccharomyces cerevisiae
agaaaaacaatacggaaaggca

SEQ ID NO: 9439 - DNA, 20 bp, Saccharomyces cerevisiae
cctcatgatgattggtgctg

SEQ ID NO: 9440 - DNA, 20 bp, Saccharomyces cerevisiae
gcaccaactttagtgacccc

SEQ ID NO: 9441 - DNA, 20 bp, Saccharomyces cerevisiae
atgcttctttggtgtccagc

SEQ ID NO: 9442 - DNA, 20 bp, Saccharomyces cerevisiae
cgttccagggctacgaaata

SEQ ID NO: 9443 - DNA, 21 bp, Saccharomyces cerevisiae
ccaaaaggcttcttttgtgag

SEQ ID NO: 9444 - DNA, 20 bp, Saccharomyces cerevisiae
gggtggagatatcgtctgga

SEQ ID NO: 9445 - DNA, 20 bp, Saccharomyces cerevisiae
ccggacgatcacggtagtat

SEQ ID NO: 9446 - DNA, 20 bp, Saccharomyces cerevisiae
gcagttttgttgatcccgtt

SEQ ID NO: 9447 - DNA, 20 bp, Saccharomyces cerevisiae
caaaggtgcaaattccaggt

SEQ ID NO: 9448 - DNA, 20 bp, Saccharomyces cerevisiae
tcaaatggatcccaaaatgg

SEQ ID NO: 9449 - DNA, 20 bp, Saccharomyces cerevisiae
tacgaaccccgaagtgctac

SEQ ID NO: 9450 - DNA, 20 bp, Saccharomyces cerevisiae
cgaccgtcccagaatttaag

SEQ ID NO: 9451 - DNA, 20 bp, Saccharomyces cerevisiae
tgaaaagggccagctttcta

SEQ ID NO: 9452 - DNA, 20 bp, Saccharomyces cerevisiae
cggacattaatgggcactct

SEQ ID NO: 9453 - DNA, 20 bp, Saccharomyces cerevisiae
ggactttttcaacagcctcg

SEQ ID NO: 9454 - DNA, 20 bp, Saccharomyces cerevisiae
gttatcaggagcgggtacga

SEQ ID NO: 9455 - DNA, 20 bp, Saccharomyces cerevisiae
gagacattgcaggcattgaa

SEQ ID NO: 9456 - DNA, 25 bp, Saccharomyces cerevisiae
aaagttacctttccaaagattggtc

SEQ ID NO: 9457 - DNA, 20 bp, Saccharomyces cerevisiae
tttgaaaacgactgtgtcgg

SEQ ID NO: 9458 - DNA, 20 bp, Saccharomyces cerevisiae
accaagatcgaacagacgaa

SEQ ID NO: 9459 - DNA, 20 bp, Saccharomyces cerevisiae
gggctagctgtagcgatttg

SEQ ID NO: 9460 - DNA, 20 bp, Saccharomyces cerevisiae
ggagccatcctgtgagttgt

SEQ ID NO: 9461 - DNA, 20 bp, Saccharomyces cerevisiae
gaagacatccaggcggataa

SEQ ID NO: 9462 - DNA, 21 bp, Saccharomyces cerevisiae
caggacatttccagaagcaag

SEQ ID NO: 9463 - DNA, 20 bp, Saccharomyces cerevisiae
tcttttggaaggcctcattg

SEQ ID NO: 9464 - DNA, 20 bp, Saccharomyces cerevisiae
gagcaacaaattacgtcgca

SEQ ID NO: 9465 - DNA, 20 bp, Saccharomyces cerevisiae
cagattcaacagcaaaggca

SEQ ID NO: 9466 - DNA, 20 bp, Saccharomyces cerevisiae
aggtaggcgaagcatcaaga

SEQ ID NO: 9467 - DNA, 20 bp, Saccharomyces cerevisiae
gagtaacgctgctcctgctt

SEQ ID NO: 9468 - DNA, 20 bp, Saccharomyces cerevisiae
ttagcggtagactggaaggc

SEQ ID NO: 9469 - DNA, 20 bp, Saccharomyces cerevisiae
ctcttcagctgccttacgct

SEQ ID NO: 9470 - DNA, 22 bp, Saccharomyces cerevisiae
cgagatcgagaaagaagaaagg

SEQ ID NO: 9471 - DNA, 20 bp, Saccharomyces cerevisiae
tgcagtggcttcttctagcc

SEQ ID NO: 9472 - DNA, 20 bp, Saccharomyces cerevisiae
ttaacggaggtgattggagc

SEQ ID NO: 9473 - DNA, 20 bp, Saccharomyces cerevisiae
gaaattggggcagcagaata

SEQ ID NO: 9474 - DNA, 20 bp, Saccharomyces cerevisiae
tacgcaataggtcacagccc

SEQ ID NO: 9475 - DNA, 20 bp, Saccharomyces cerevisiae
tttcttccccttcatcatcg

SEQ ID NO: 9476 - DNA, 20 bp, Saccharomyces cerevisiae
taagctaagccacccgacat

SEQ ID NO: 9477 - DNA, 21 bp, Saccharomyces cerevisiae
tgtcatcttgctgagtcgaaa

SEQ ID NO: 9478 - DNA, 20 bp, Saccharomyces cerevisiae
agccttaaccggaaggaaaa

SEQ ID NO: 9479 - DNA, 20 bp, Saccharomyces cerevisiae
ccaaattaacccaggagcaa

SEQ ID NO: 9480 - DNA, 19 bp, Saccharomyces cerevisiae
caatggcgctgtcattttt

SEQ ID NO: 9481 - DNA, 20 bp, Saccharomyces cerevisiae
ttaggcgtaaaggttggtga

SEQ ID NO: 9482 - DNA, 20 bp, Saccharomyces cerevisiae
tgaggagtcgtgtcgatgtc

SEQ ID NO: 9483 - DNA, 20 bp, Saccharomyces cerevisiae
cagcacgttaaaactcacgc

SEQ ID NO: 9484 - DNA, 20 bp, Saccharomyces cerevisiae
cgcgcattgaaataaacgag

SEQ ID NO: 9485 - DNA, 22 bp, Saccharomyces cerevisiae
tgcttggtcaaagagtattcca

SEQ ID NO: 9486 - DNA, 20 bp, Saccharomyces cerevisiae
gcgctttgcggtaatttcta

SEQ ID NO: 9487 - DNA, 20 bp, Saccharomyces cerevisiae
aatccgcttgaatcgacaga

SEQ ID NO: 9488 - DNA, 20 bp, Saccharomyces cerevisiae
gggtgccctgaagactattg

SEQ ID NO: 9489 - DNA, 20 bp, Saccharomyces cerevisiae
ggaaagccctgatcatcgta

SEQ ID NO: 9490 - DNA, 19 bp, Saccharomyces cerevisiae
tcataggcagtctccacgc

SEQ ID NO: 9491 - DNA, 20 bp, Saccharomyces cerevisiae
cctacggatcaagaggtcca

SEQ ID NO: 9492 - DNA, 20 bp, Saccharomyces cerevisiae
aggcacaaaccattctgtcc

SEQ ID NO: 9493 - DNA, 20 bp, Saccharomyces cerevisiae
ccccggagcacaagatataa

SEQ ID NO: 9494 - DNA, 20 bp, Saccharomyces cerevisiae
acgcagatggagaatatggc

SEQ ID NO: 9495 - DNA, 20 bp, Saccharomyces cerevisiae
gtcatcgggtttaacggaag

SEQ ID NO: 9496 - DNA, 20 bp, Saccharomyces cerevisiae
tatgcggtttaccccaaaac

SEQ ID NO: 9497 - DNA, 20 bp, Saccharomyces cerevisiae
agcgagtcaactcctttgga

SEQ ID NO: 9498 - DNA, 20 bp, Saccharomyces cerevisiae
ttatgggccttatcattggc

SEQ ID NO: 9499 - DNA, 20 bp, Saccharomyces cerevisiae
cccaagcgttagacaccatt

SEQ ID NO: 9500 - DNA, 20 bp, Saccharomyces cerevisiae
gcagtcattttcccgagttg

SEQ ID NO: 9501 - DNA, 20 bp, Saccharomyces cerevisiae
ttctcacctatgagggccac

SEQ ID NO: 9502 - DNA, 20 bp, Saccharomyces cerevisiae
gccttcaccaagattaccca

SEQ ID NO: 9503 - DNA, 20 bp, Saccharomyces cerevisiae
gtcggtgttggactcttcgt

SEQ ID NO: 9504 - DNA, 20 bp, Saccharomyces cerevisiae
gttcaaggcttcgacaatcc

SEQ ID NO: 9505 - DNA, 20 bp, Saccharomyces cerevisiae
tcgttcctacacgcatgaaa

SEQ ID NO: 9506 - DNA, 20 bp, Saccharomyces cerevisiae
gggtcccagaagacaccttt

SEQ ID NO: 9507 - DNA, 20 bp, Saccharomyces cerevisiae
tcccacccctatgaacgtaa

SEQ ID NO: 9508 - DNA, 20 bp, Saccharomyces cerevisiae
ctaccgggtggagtcacaat

SEQ ID NO: 9509 - DNA, 20 bp, Saccharomyces cerevisiae
gaaaacgagatcttcgtcgc

SEQ ID NO: 9510 - DNA, 20 bp, Saccharomyces cerevisiae
gattggcaatttttggttgg

SEQ ID NO: 9511 - DNA, 20 bp, Saccharomyces cerevisiae
tgatgaagaagatggggagg

SEQ ID NO: 9512 - DNA, 20 bp, Saccharomyces cerevisiae
ccaagctggtcagtttaccg

SEQ ID NO: 9513 - DNA, 20 bp, Saccharomyces cerevisiae
cacgatctgagactgggaca

SEQ ID NO: 9514 - DNA, 20 bp, Saccharomyces cerevisiae
ttaccgacttggtcgattca

SEQ ID NO: 9515 - DNA, 20 bp, Saccharomyces cerevisiae
tcagcatggttggatttgaa

SEQ ID NO: 9516 - DNA, 20 bp, Saccharomyces cerevisiae
ggaagtctccaccacatcgt

SEQ ID NO: 9517 - DNA, 20 bp, Saccharomyces cerevisiae
catccaagacgagatgacga

SEQ ID NO: 9518 - DNA, 20 bp, Saccharomyces cerevisiae
atcgaaaatgggtccacaaa

SEQ ID NO: 9519 - DNA, 20 bp, Saccharomyces cerevisiae
aaacaactgtgcgtgagcag

SEQ ID NO: 9520 - DNA, 20 bp, Saccharomyces cerevisiae
catcagaacacaatggctgg

SEQ ID NO: 9521 - DNA, 24 bp, Saccharomyces cerevisiae
ttgtttgccttagttatcgttcaa

SEQ ID NO: 9522 - DNA, 20 bp, Saccharomyces cerevisiae
ctcgaaaatggttggtggtt

SEQ ID NO: 9523 - DNA, 20 bp, Saccharomyces cerevisiae
attccaaccgtaaagcttgc

SEQ ID NO: 9524 - DNA, 21 bp, Saccharomyces cerevisiae
cagcaaaaagaaggagcaaaa

SEQ ID NO: 9525 - DNA, 21 bp, Saccharomyces cerevisiae
tggaaagtgatgatgacaacg

SEQ ID NO: 9526 - DNA, 20 bp, Saccharomyces cerevisiae
ccccaagcaagactctcaca

SEQ ID NO: 9527 - DNA, 22 bp, Saccharomyces cerevisiae
tgacacatcatatgttttcccg

SEQ ID NO: 9528 - DNA, 20 bp, Saccharomyces cerevisiae
tggaaggcttcacctctacg

SEQ ID NO: 9529 - DNA, 20 bp, Saccharomyces cerevisiae
cctctcgtggttcttcggta

SEQ ID NO: 9530 - DNA, 20 bp, Saccharomyces cerevisiae
cgtatgaaccaaacacgacg

SEQ ID NO: 9531 - DNA, 20 bp, Saccharomyces cerevisiae
gcttacaaaattgccctgga

SEQ ID NO: 9532 - DNA, 20 bp, Saccharomyces cerevisiae
gcatgcaacattgaagatgg

SEQ ID NO: 9533 - DNA, 20 bp, Saccharomyces cerevisiae
tgtttgtgcctggtcgataa

SEQ ID NO: 9534 - DNA, 20 bp, Saccharomyces cerevisiae
gcttgacatcgaagtgagca

SEQ ID NO: 9535 - DNA, 20 bp, Saccharomyces cerevisiae
catggttcagggtagcgaat

SEQ ID NO: 9536 - DNA, 20 bp, Saccharomyces cerevisiae
tacgccaagtaatgctgacg

SEQ ID NO: 9537 - DNA, 20 bp, Saccharomyces cerevisiae
atgcggaacaacttggaatc

SEQ ID NO: 9538 - DNA, 20 bp, Saccharomyces cerevisiae
ttgcaaaaggcttgtcacac

SEQ ID NO: 9539 - DNA, 20 bp, Saccharomyces cerevisiae
ttccaaatcctctacacggc

SEQ ID NO: 9540 - DNA, 20 bp, Saccharomyces cerevisiae
ttgtgaaactccttttcggg

SEQ ID NO: 9541 - DNA, 20 bp, Saccharomyces cerevisiae
ccaaactcgcaaggtaaagg

SEQ ID NO: 9542 - DNA, 20 bp, Saccharomyces cerevisiae
ggttggagagcgaaagttga

SEQ ID NO: 9543 - DNA, 20 bp, Saccharomyces cerevisiae
tttaatacggatcaacgggg

SEQ ID NO: 9544 - DNA, 20 bp, Saccharomyces cerevisiae
taccagtgggtggtttggtt

SEQ ID NO: 9545 - DNA, 20 bp, Saccharomyces cerevisiae
aatacgggcagtccaaacaa

SEQ ID NO: 9546 - DNA, 20 bp, Saccharomyces cerevisiae
aaactcgggcaaagacttca

SEQ ID NO: 9547 - DNA, 20 bp, Saccharomyces cerevisiae
tccaagctgtccaacatctg

SEQ ID NO: 9548 - DNA, 20 bp, Saccharomyces cerevisiae
agtctgcgattgaatggagc

SEQ ID NO: 9549 - DNA, 20 bp, Saccharomyces cerevisiae
gctctctgatactgggctcg

SEQ ID NO: 9550 - DNA, 20 bp, Saccharomyces cerevisiae
gttagaaagcgatcctcccc

SEQ ID NO: 9551 - DNA, 20 bp, Saccharomyces cerevisiae
tagcacgatatgaaccacgg

SEQ ID NO: 9552 - DNA, 21 bp, Saccharomyces cerevisiae
gcaatacataaggacgagcca

SEQ ID NO: 9553 - DNA, 20 bp, Saccharomyces cerevisiae
acttgccatcgtgctctttt

SEQ ID NO: 9554 - DNA, 22 bp, Saccharomyces cerevisiae
ttctcctaatccctctccttca

SEQ ID NO: 9555 - DNA, 23 bp, Saccharomyces cerevisiae
caactatgcaaattgaaagaggg

SEQ ID NO: 9556 - DNA, 20 bp, Saccharomyces cerevisiae
gcaagcatggatgtttctca

SEQ ID NO: 9557 - DNA, 20 bp, Saccharomyces cerevisiae
ttggatgattgccagacctt

SEQ ID NO: 9558 - DNA, 20 bp, Saccharomyces cerevisiae
tgggatccaaagactggaac

SEQ ID NO: 9559 - DNA, 20 bp, Saccharomyces cerevisiae
cgcacaaaataaaaagggga

SEQ ID NO: 9560 - DNA, 20 bp, Saccharomyces cerevisiae
gatatccgaggcattcagga

SEQ ID NO: 9561 - DNA, 20 bp, Saccharomyces cerevisiae
gaaggacatttacggctgga

SEQ ID NO: 9562 - DNA, 20 bp, Saccharomyces cerevisiae
tccttcttgggaatgcgata

SEQ ID NO: 9563 - DNA, 20 bp, Saccharomyces cerevisiae
tggcagacactctggtcaag

SEQ ID NO: 9564 - DNA, 20 bp, Saccharomyces cerevisiae
attccgtcgttatcgtctcg

SEQ ID NO: 9565 - DNA, 20 bp, Saccharomyces cerevisiae
tgtggaaccctgaatgttga

SEQ ID NO: 9566 - DNA, 25 bp, Saccharomyces cerevisiae
ttagttaaggatctattgacgtgcg

SEQ ID NO: 9567 - DNA, 20 bp, Saccharomyces cerevisiae
taggaaaaggtggtgccaag

SEQ ID NO: 9568 - DNA, 20 bp, Saccharomyces cerevisiae
agaagcgccaatttacaacg

SEQ ID NO: 9569 - DNA, 20 bp, Saccharomyces cerevisiae
gtaatgccttcggagtcagc

SEQ ID NO: 9570 - DNA, 20 bp, Saccharomyces cerevisiae
cgactttcatttggatgcac

SEQ ID NO: 9571 - DNA, 20 bp, Saccharomyces cerevisiae
tccactgatggcgatattga

SEQ ID NO: 9572 - DNA, 20 bp, Saccharomyces cerevisiae
tgcaaaatttgaacgatgga

SEQ ID NO: 9573 - DNA, 20 bp, Saccharomyces cerevisiae
gcgcataaaggaaatgcaag

SEQ ID NO: 9574 - DNA, 20 bp, Saccharomyces cerevisiae
tcaagcttcaaacagggtcc

SEQ ID NO: 9575 - DNA, 20 bp, Saccharomyces cerevisiae
cgtctcggttattcaacggt

SEQ ID NO: 9576 - DNA, 20 bp, Saccharomyces cerevisiae
ttcgtggcaacgttaaaaca

SEQ ID NO: 9577 - DNA, 20 bp, Saccharomyces cerevisiae
caaggtgatgacgaagctca

SEQ ID NO: 9578 - DNA, 20 bp, Saccharomyces cerevisiae
gcaagttattgatcggctcc

SEQ ID NO: 9579 - DNA, 20 bp, Saccharomyces cerevisiae
attgcgcataacgaatccat

SEQ ID NO: 9580 - DNA, 20 bp, Saccharomyces cerevisiae
gtttgacctgccaccaaact

SEQ ID NO: 9581 - DNA, 21 bp, Saccharomyces cerevisiae
tgcttactgctccaactgtca

SEQ ID NO: 9582 - DNA, 20 bp, Saccharomyces cerevisiae
cctcggaagcatatcggtaa

SEQ ID NO: 9583 - DNA, 20 bp, Saccharomyces cerevisiae
acttttgttacggctggtgg

SEQ ID NO: 9584 - DNA, 20 bp, Saccharomyces cerevisiae
caaaggaggctcttccctct

SEQ ID NO: 9585 - DNA, 20 bp, Saccharomyces cerevisiae
aacccgctacttcgcctact

SEQ ID NO: 9586 - DNA, 20 bp, Saccharomyces cerevisiae
tgcttggatccttcttggtc

SEQ ID NO: 9587 - DNA, 20 bp, Saccharomyces cerevisiae
ctctgggaaaacccagatga

SEQ ID NO: 9588 - DNA, 20 bp, Saccharomyces cerevisiae
gcttatctggtccgttcgag

SEQ ID NO: 9589 - DNA, 20 bp, Saccharomyces cerevisiae
cgtgcccgactaaaactctc

SEQ ID NO: 9590 - DNA, 20 bp, Saccharomyces cerevisiae
cccctagcaatgtttggtga

SEQ ID NO: 9591 - DNA, 20 bp, Saccharomyces cerevisiae
ttttgccctccaattcaaag

SEQ ID NO: 9592 - DNA, 22 bp, Saccharomyces cerevisiae
tgtgatgagatgctgtctctga

SEQ ID NO: 9593 - DNA, 20 bp, Saccharomyces cerevisiae
gtcgcatggggatggtatag

SEQ ID NO: 9594 - DNA, 20 bp, Saccharomyces cerevisiae
aaaagttcagtgggcaaagg

SEQ ID NO: 9595 - DNA, 20 bp, Saccharomyces cerevisiae
aacacgcgtaattgaaaggg

SEQ ID NO: 9596 - DNA, 20 bp, Saccharomyces cerevisiae
tggtgttgaaatgctcgaag

SEQ ID NO: 9597 - DNA, 20 bp, Saccharomyces cerevisiae
tgtggtataatgcgttgcct

SEQ ID NO: 9598 - DNA, 20 bp, Saccharomyces cerevisiae
caaccaactataaggggcga

SEQ ID NO: 9599 - DNA, 20 bp, Saccharomyces cerevisiae
gctacggtggactcaccaat

SEQ ID NO: 9600 - DNA, 20 bp, Saccharomyces cerevisiae
accgccatctcaaagtgaag

SEQ ID NO: 9601 - DNA, 20 bp, Saccharomyces cerevisiae
tcacagacctcgaagaaacg

SEQ ID NO: 9602 - DNA, 22 bp, Saccharomyces cerevisiae
tggaataaatgagtttcgatga

SEQ ID NO: 9603 - DNA, 20 bp, Saccharomyces cerevisiae
gaggggctcctttgacttgt

SEQ ID NO: 9604 - DNA, 20 bp, Saccharomyces cerevisiae
cgaatggaactccagcagat

SEQ ID NO: 9605 - DNA, 20 bp, Saccharomyces cerevisiae
gtggcttctgcgtgtactga

SEQ ID NO: 9606 - DNA, 20 bp, Saccharomyces cerevisiae
tatcaaacaagaggccctgc

SEQ ID NO: 9607 - DNA, 20 bp, Saccharomyces cerevisiae
aagcagaagggaattacgca

SEQ ID NO: 9608 - DNA, 20 bp, Saccharomyces cerevisiae
aaccactttgttacgcaggg

SEQ ID NO: 9609 - DNA, 20 bp, Saccharomyces cerevisiae
agtcgatctgctcccgtaaa

SEQ ID NO: 9610 - DNA, 20 bp, Saccharomyces cerevisiae
tctcggaatgttaagcacga

SEQ ID NO: 9611 - DNA, 20 bp, Saccharomyces cerevisiae
aacgtcgttttccagtggtc

SEQ ID NO: 9612 - DNA, 20 bp, Saccharomyces cerevisiae
aagaccattgtctggaacgg

SEQ ID NO: 9613 - DNA, 20 bp, Saccharomyces cerevisiae
ccattgccggagaaattaga

SEQ ID NO: 9614 - DNA, 20 bp, Saccharomyces cerevisiae
tgagagtacaggcgacgaaa

SEQ ID NO: 9615 - DNA, 20 bp, Saccharomyces cerevisiae
atgtttgaaggcacatcggt

SEQ ID NO: 9616 - DNA, 22 bp, Saccharomyces cerevisiae
ttgggaagagagaagattagcg

SEQ ID NO: 9617 - DNA, 20 bp, Saccharomyces cerevisiae
gctacctttgaagccgattg

SEQ ID NO: 9618 - DNA, 20 bp, Saccharomyces cerevisiae
ttcctggttattccgcagac

SEQ ID NO: 9619 - DNA, 20 bp, Saccharomyces cerevisiae
catcagaagcccacaaacct

SEQ ID NO: 9620 - DNA, 20 bp, Saccharomyces cerevisiae
cgagtgaaattgcgacctct

SEQ ID NO: 9621 - DNA, 20 bp, Saccharomyces cerevisiae
ggaggtgacaatttggaagc

SEQ ID NO: 9622 - DNA, 20 bp, Saccharomyces cerevisiae
gtaggtggcttctccgatga

SEQ ID NO: 9623 - DNA, 20 bp, Saccharomyces cerevisiae
agactaaggaccgtggtgga

SEQ ID NO: 9624 - DNA, 20 bp, Saccharomyces cerevisiae
tgcgtctgcttcatcatctc

SEQ ID NO: 9625 - DNA, 20 bp, Saccharomyces cerevisiae
acctttgccgaatatcctcc

SEQ ID NO: 9626 - DNA, 20 bp, Saccharomyces cerevisiae
cgcccataaaggcatatttc

SEQ ID NO: 9627 - DNA, 20 bp, Saccharomyces cerevisiae
ggaaaaccgcctaaagttca

SEQ ID NO: 9628 - DNA, 20 bp, Saccharomyces cerevisiae
tgcagaaccgaaattgaaaa

SEQ ID NO: 9629 - DNA, 20 bp, Saccharomyces cerevisiae
ttcttccgctaatttgagcc

SEQ ID NO: 9630 - DNA, 20 bp, Saccharomyces cerevisiae
gtgttagccctcaaaccgag

SEQ ID NO: 9631 - DNA, 20 bp, Saccharomyces cerevisiae
gggtgaattatggatcgcag

SEQ ID NO: 9632 - DNA, 20 bp, Saccharomyces cerevisiae
gttcattagtgcggttcgct

SEQ ID NO: 9633 - DNA, 21 bp, Saccharomyces cerevisiae
tgtgaagtttactggaagggc

SEQ ID NO: 9634 - DNA, 20 bp, Saccharomyces cerevisiae
gggttcgtaccattggattg

SEQ ID NO: 9635 - DNA, 20 bp, Saccharomyces cerevisiae
taatttggggttgagaacgc

SEQ ID NO: 9636 - DNA, 20 bp, Saccharomyces cerevisiae
cgttcaacccacaggatttt

SEQ ID NO: 9637 - DNA, 20 bp, Saccharomyces cerevisiae
ttaatccgtcctggttccac

SEQ ID NO: 9638 - DNA, 20 bp, Saccharomyces cerevisiae
actgggtttcaccagcaaga

SEQ ID NO: 9639 - DNA, 20 bp, Saccharomyces cerevisiae
gtgagaaaccccattcttgc

SEQ ID NO: 9640 - DNA, 20 bp, Saccharomyces cerevisiae
taacgaagggcggataattg

SEQ ID NO: 9641 - DNA, 22 bp, Saccharomyces cerevisiae
tggaagatattttcgctcttga

SEQ ID NO: 9642 - DNA, 21 bp, Saccharomyces cerevisiae
ttcgttctactttgctttcgc

SEQ ID NO: 9643 - DNA, 20 bp, Saccharomyces cerevisiae
ttgttcgttatcgcttgctg

SEQ ID NO: 9644 - DNA, 21 bp, Saccharomyces cerevisiae
ggattgcaggttgcaaagtaa

SEQ ID NO: 9645 - DNA, 20 bp, Saccharomyces cerevisiae
gccaatatttccaaagctgg

SEQ ID NO: 9646 - DNA, 20 bp, Saccharomyces cerevisiae
aacgaggctttccaacaatg

SEQ ID NO: 9647 - DNA, 20 bp, Saccharomyces cerevisiae
gagggagctgcataaaaacg

SEQ ID NO: 9648 - DNA, 22 bp, Saccharomyces cerevisiae
gccatggtgtcattaacatgaa

SEQ ID NO: 9649 - DNA, 20 bp, Saccharomyces cerevisiae
ccagagagtagcatgagggc

SEQ ID NO: 9650 - DNA, 20 bp, Saccharomyces cerevisiae
tttcacgattggatcacagc

SEQ ID NO: 9651 - DNA, 20 bp, Saccharomyces cerevisiae
aatgtggacaatagcgaggg

SEQ ID NO: 9652 - DNA, 20 bp, Saccharomyces cerevisiae
cggatttggctcaaaagatt

SEQ ID NO: 9653 - DNA, 20 bp, Saccharomyces cerevisiae
tggttccattgtaccccaat

SEQ ID NO: 9654 - DNA, 20 bp, Saccharomyces cerevisiae
ccaccgagtaagcgatgaat

SEQ ID NO: 9655 - DNA, 20 bp, Saccharomyces cerevisiae
tctacctttgggtcattgcc

SEQ ID NO: 9656 - DNA, 20 bp, Saccharomyces cerevisiae
tttctctggctgggtttgat

SEQ ID NO: 9657 - DNA, 21 bp, Saccharomyces cerevisiae
ccagtcttgacagccattttg

SEQ ID NO: 9658 - DNA, 20 bp, Saccharomyces cerevisiae
tggcaagaaacactatccca

SEQ ID NO: 9659 - DNA, 20 bp, Saccharomyces cerevisiae
ctgagcacacaggagcaaac

SEQ ID NO: 9660 - DNA, 24 bp, Saccharomyces cerevisiae
gctagtaaatttgacgtgagaagc

SEQ ID NO: 9661 - DNA, 20 bp, Saccharomyces cerevisiae
aatccaatcgatgcttccac

SEQ ID NO: 9662 - DNA, 20 bp, Saccharomyces cerevisiae
cttgaagctcaggtaagggg

SEQ ID NO: 9663 - DNA, 22 bp, Saccharomyces cerevisiae
gagaggtttttggtttagacgg

SEQ ID NO: 9664 - DNA, 20 bp, Saccharomyces cerevisiae
gacttcttgcagatcagccc

SEQ ID NO: 9665 - DNA, 20 bp, Saccharomyces cerevisiae
tggctgttttcttcgctttt

SEQ ID NO: 9666 - DNA, 20 bp, Saccharomyces cerevisiae
cgtttggagtaatgagcggt

SEQ ID NO: 9667 - DNA, 20 bp, Saccharomyces cerevisiae
cgatgaatttgacgggatct

SEQ ID NO: 9668 - DNA, 20 bp, Saccharomyces cerevisiae
ggtatgggtgctggtgtcat

SEQ ID NO: 9669 - DNA, 21 bp, Saccharomyces cerevisiae
ttttgggatcattattcggtg

SEQ ID NO: 9670 - DNA, 20 bp, Saccharomyces cerevisiae
gcgaaagtaccactgcacaa

SEQ ID NO: 9671 - DNA, 20 bp, Saccharomyces cerevisiae
ttgcttgttcagtggggaat

SEQ ID NO: 9672 - DNA, 20 bp, Saccharomyces cerevisiae
ttgcaggcctctatttaccc

SEQ ID NO: 9673 - DNA, 20 bp, Saccharomyces cerevisiae
acactcgttgggttcgtttc

SEQ ID NO: 9674 - DNA, 20 bp, Saccharomyces cerevisiae
cccagatgaacctggaccta

SEQ ID NO: 9675 - DNA, 20 bp, Saccharomyces cerevisiae
aaaattcctccacatcgtcg

SEQ ID NO: 9676 - DNA, 20 bp, Saccharomyces cerevisiae
catttttcccggcttacctt

SEQ ID NO: 9677 - DNA, 20 bp, Saccharomyces cerevisiae
cttgacgacgttagccacag

SEQ ID NO: 9678 - DNA, 20 bp, Saccharomyces cerevisiae
cacctaagccaccgactagg

SEQ ID NO: 9679 - DNA, 20 bp, Saccharomyces cerevisiae
attttgtaaggaacgcggtg

SEQ ID NO: 9680 - DNA, 20 bp, Saccharomyces cerevisiae
ccgtgctatgtccacaaatg

SEQ ID NO: 9681 - DNA, 20 bp, Saccharomyces cerevisiae
ttgcattccataaattcgca

SEQ ID NO: 9682 - DNA, 20 bp, Saccharomyces cerevisiae
caaatttgggagaaaggtgg

SEQ ID NO: 9683 - DNA, 20 bp, Saccharomyces cerevisiae
ggtttcggtaaatcaggcaa

SEQ ID NO: 9684 - DNA, 20 bp, Saccharomyces cerevisiae
ccaatctgctcgggttttta

SEQ ID NO: 9685 - DNA, 20 bp, Saccharomyces cerevisiae
cggaaaagaaaagcagtgga

SEQ ID NO: 9686 - DNA, 20 bp, Saccharomyces cerevisiae
gcaaagtgcaaaccgtatca

SEQ ID NO: 9687 - DNA, 20 bp, Saccharomyces cerevisiae
cgatgacgttagtgcttcca

SEQ ID NO: 9688 - DNA, 20 bp, Saccharomyces cerevisiae
gctggaatcgttactttcgc

SEQ ID NO: 9689 - DNA, 21 bp, Saccharomyces cerevisiae
tcgtcggatcctaataaccaa

SEQ ID NO: 9690 - DNA, 20 bp, Saccharomyces cerevisiae
tgagcaccaaagtgcttgtt

SEQ ID NO: 9691 - DNA, 20 bp, Saccharomyces cerevisiae
gaaccgcctacacatttggt

SEQ ID NO: 9692 - DNA, 20 bp, Saccharomyces cerevisiae
cttcttcgaacgccattctc

SEQ ID NO: 9693 - DNA, 20 bp, Saccharomyces cerevisiae
caagccgtccaaactctttc

SEQ ID NO: 9694 - DNA, 20 bp, Saccharomyces cerevisiae
acacattgggaggacgactc

SEQ ID NO: 9695 - DNA, 19 bp, Saccharomyces cerevisiae
tctgcgtagtatggggcaa

SEQ ID NO: 9696 - DNA, 20 bp, Saccharomyces cerevisiae
aagctgctgatagggcacat

SEQ ID NO: 9697 - DNA, 21 bp, Saccharomyces cerevisiae
ttgccactatggaatttcgac

SEQ ID NO: 9698 - DNA, 21 bp, Saccharomyces cerevisiae
catcaggcagatcttgtgtca

SEQ ID NO: 9699 - DNA, 20 bp, Saccharomyces cerevisiae
aagtaacaaccaacggcgag

SEQ ID NO: 9700 - DNA, 20 bp, Saccharomyces cerevisiae
cccaattctgacgtgtttga

SEQ ID NO: 9701 - DNA, 23 bp, Saccharomyces cerevisiae
tcatttatcgacagatgttccaa

SEQ ID NO: 9702 - DNA, 19 bp, Saccharomyces cerevisiae
cgggcataatgttgcagtt

SEQ ID NO: 9703 - DNA, 20 bp, Saccharomyces cerevisiae
gaacagggcgaagtaatcca

SEQ ID NO: 9704 - DNA, 20 bp, Saccharomyces cerevisiae
aggacgtattcagcgcagtt

SEQ ID NO: 9705 - DNA, 20 bp, Saccharomyces cerevisiae
tatgcccgttttattgggtc

SEQ ID NO: 9706 - DNA, 20 bp, Saccharomyces cerevisiae
ctggagtaaagatggccgag

SEQ ID NO: 9707 - DNA, 20 bp, Saccharomyces cerevisiae
tgttcttgagcaccaagacg

SEQ ID NO: 9708 - DNA, 20 bp, Saccharomyces cerevisiae
tttatctggaacagcctggg

SEQ ID NO: 9709 - DNA, 25 bp, Saccharomyces cerevisiae
aaggtttatttgctatacccctttg

SEQ ID NO: 9710 - DNA, 20 bp, Saccharomyces cerevisiae
gccgattttgctcttggata

SEQ ID NO: 9711 - DNA, 20 bp, Saccharomyces cerevisiae
ggcacaaatgtggtttcctt

SEQ ID NO: 9712 - DNA, 20 bp, Saccharomyces cerevisiae
ttacaggtccgcctcatttc

SEQ ID NO: 9713 - DNA, 20 bp, Saccharomyces cerevisiae
tggcaagtttgttgctgaag

SEQ ID NO: 9714 - DNA, 20 bp, Saccharomyces cerevisiae
atggcaattctggggtaaca

SEQ ID NO: 9715 - DNA, 20 bp, Saccharomyces cerevisiae
aggggtgagtggagaaaagg

SEQ ID NO: 9716 - DNA, 21 bp, Saccharomyces cerevisiae
ggaatgccgttagagcattta

SEQ ID NO: 9717 - DNA, 20 bp, Saccharomyces cerevisiae
aagtttgcaaaggcatggat

SEQ ID NO: 9718 - DNA, 20 bp, Saccharomyces cerevisiae
ttaagctcgaaccacaaggc

SEQ ID NO: 9719 - DNA, 21 bp, Saccharomyces cerevisiae
cgaactctcatacgtgatggc

SEQ ID NO: 9720 - DNA, 20 bp, Saccharomyces cerevisiae
gccaatgtttcgaaggaagt

SEQ ID NO: 9721 - DNA, 20 bp, Saccharomyces cerevisiae
tagatccgccctcttacgaa

SEQ ID NO: 9722 - DNA, 20 bp, Saccharomyces cerevisiae
acaggttccagccatactgc

SEQ ID NO: 9723 - DNA, 20 bp, Saccharomyces cerevisiae
ggtgggaaatcatatggtgg

SEQ ID NO: 9724 - DNA, 20 bp, Saccharomyces cerevisiae
atggatgcgttaaggaggtg

SEQ ID NO: 9725 - DNA, 20 bp, Saccharomyces cerevisiae
aggagtgaattccgccatag

SEQ ID NO: 9726 - DNA, 24 bp, Saccharomyces cerevisiae
tttgttcttttcaggaacacagtt

SEQ ID NO: 9727 - DNA, 20 bp, Saccharomyces cerevisiae
tattggaagcgcatgtttga

SEQ ID NO: 9728 - DNA, 20 bp, Saccharomyces cerevisiae
cgaacggtatgttcgttgtg

SEQ ID NO: 9729 - DNA, 20 bp, Saccharomyces cerevisiae
ttggaccttttagccacgat

SEQ ID NO: 9730 - DNA, 20 bp, Saccharomyces cerevisiae
cgacgagcagcaactttgta

SEQ ID NO: 9731 - DNA, 20 bp, Saccharomyces cerevisiae
gctgcagctcaagaaggaaa

SEQ ID NO: 9732 - DNA, 20 bp, Saccharomyces cerevisiae
gttctcgccacagtcgaatc

SEQ ID NO: 9733 - DNA, 20 bp, Saccharomyces cerevisiae
ggcttatcccactgttcagg

SEQ ID NO: 9734 - DNA, 20 bp, Saccharomyces cerevisiae
actgacgaaaatggcaaacc

SEQ ID NO: 9735 - DNA, 20 bp, Saccharomyces cerevisiae
cgtgatcgcaatacacaagc

SEQ ID NO: 9736 - DNA, 22 bp, Saccharomyces cerevisiae
ggtaggacagttctcctgcttt

SEQ ID NO: 9737 - DNA, 20 bp, Saccharomyces cerevisiae
tggatgctaatagtgctgcg

SEQ ID NO: 9738 - DNA, 20 bp, Saccharomyces cerevisiae
tgtggcattggcaaataaaa

SEQ ID NO: 9739 - DNA, 20 bp, Saccharomyces cerevisiae
ctggtgctgcacacaaatct

SEQ ID NO: 9740 - DNA, 20 bp, Saccharomyces cerevisiae
aaggggaagtgtcaatgtgc

SEQ ID NO: 9741 - DNA, 20 bp, Saccharomyces cerevisiae
gcacatgtcgagcaacagat

SEQ ID NO: 9742 - DNA, 20 bp, Saccharomyces cerevisiae
accgctaaataccacgcatc

SEQ ID NO: 9743 - DNA, 20 bp, Saccharomyces cerevisiae
ccggaaacgtccacattagt

SEQ ID NO: 9744 - DNA, 20 bp, Saccharomyces cerevisiae
tgcatgatttaatcggacca

SEQ ID NO: 9745 - DNA, 20 bp, Saccharomyces cerevisiae
tggattcaatatgcggagtg

SEQ ID NO: 9746 - DNA, 20 bp, Saccharomyces cerevisiae
ccaggttttggaacaatgct

SEQ ID NO: 9747 - DNA, 20 bp, Saccharomyces cerevisiae
acttcccagaagtggcattg

SEQ ID NO: 9748 - DNA, 20 bp, Saccharomyces cerevisiae
atcaaatgcaaaaagacccg

SEQ ID NO: 9749 - DNA, 20 bp, Saccharomyces cerevisiae
tgcgatgagctttattgctg

SEQ ID NO: 9750 - DNA, 20 bp, Saccharomyces cerevisiae
tcctgattgaatgtgtcccc

SEQ ID NO: 9751 - DNA, 20 bp, Saccharomyces cerevisiae
tttaccggttgggttgttgt

SEQ ID NO: 9752 - DNA, 21 bp, Saccharomyces cerevisiae
ggatacagattatttgggccg

SEQ ID NO: 9753 - DNA, 20 bp, Saccharomyces cerevisiae
ttcatcgtccccagtttttc

SEQ ID NO: 9754 - DNA, 20 bp, Saccharomyces cerevisiae
tgaggcaatgcaaagtgcta

SEQ ID NO: 9755 - DNA, 20 bp, Saccharomyces cerevisiae
tgcgtcagtctgttcctttg

SEQ ID NO: 9756 - DNA, 20 bp, Saccharomyces cerevisiae
caacccaacaaaacaacgaa

SEQ ID NO: 9757 - DNA, 20 bp, Saccharomyces cerevisiae
aagtgtcaatttcccgctgt

SEQ ID NO: 9758 - DNA, 20 bp, Saccharomyces cerevisiae
tcggaaatctcaaccgagaa

SEQ ID NO: 9759 - DNA, 20 bp, Saccharomyces cerevisiae
ttccgaatttaggatgtgcc

SEQ ID NO: 9760 - DNA, 20 bp, Saccharomyces cerevisiae
tgtggccaatactgcttcag

SEQ ID NO: 9761 - DNA, 21 bp, Saccharomyces cerevisiae
tgctgttttctttctgtgtgg

SEQ ID NO: 9762 - DNA, 20 bp, Saccharomyces cerevisiae
tgttgccacctgcagaaata

SEQ ID NO: 9763 - DNA, 20 bp, Saccharomyces cerevisiae
aagtgcccattcaactccac

SEQ ID NO: 9764 - DNA, 20 bp, Saccharomyces cerevisiae
aacgggtgtcttcttagcca

SEQ ID NO: 9765 - DNA, 20 bp, Saccharomyces cerevisiae
atcccgttgttgaagcaaac

SEQ ID NO: 9766 - DNA, 20 bp, Saccharomyces cerevisiae
tcggaaatgctgttcctacc

SEQ ID NO: 9767 - DNA, 21 bp, Saccharomyces cerevisiae
cagacgtctttaagcagagcg

SEQ ID NO: 9768 - DNA, 20 bp, Saccharomyces cerevisiae
taagaataatgggggcgttg

SEQ ID NO: 9769 - DNA, 20 bp, Saccharomyces cerevisiae
ttgcagcttctcacttacgg

SEQ ID NO: 9770 - DNA, 20 bp, Saccharomyces cerevisiae
tacacttcctatcccggcag

SEQ ID NO: 9771 - DNA, 21 bp, Saccharomyces cerevisiae
tgaaacctgaaggaaatctgc

SEQ ID NO: 9772 - DNA, 20 bp, Saccharomyces cerevisiae
aagaacttctgtccacccca

SEQ ID NO: 9773 - DNA, 20 bp, Saccharomyces cerevisiae
ttcagcgttgaactccacat

SEQ ID NO: 9774 - DNA, 20 bp, Saccharomyces cerevisiae
acgagccgttggagatcttt

SEQ ID NO: 9775 - DNA, 20 bp, Saccharomyces cerevisiae
tcgggtttgctgctaaattc

SEQ ID NO: 9776 - DNA, 20 bp, Saccharomyces cerevisiae
tggctaaggaagattccacg

SEQ ID NO: 9777 - DNA, 20 bp, Saccharomyces cerevisiae
cattcactccctcattggct

SEQ ID NO: 9778 - DNA, 22 bp, Saccharomyces cerevisiae
gacccttctgaaatcaaactgc

SEQ ID NO: 9779 - DNA, 20 bp, Saccharomyces cerevisiae
gccaaatcattgttgtccct

SEQ ID NO: 9780 - DNA, 21 bp, Saccharomyces cerevisiae
tctttggaggaagatgcaaaa

SEQ ID NO: 9781 - DNA, 20 bp, Saccharomyces cerevisiae
gcacagggagaagaaactgc

SEQ ID NO: 9782 - DNA, 20 bp, Saccharomyces cerevisiae
ccaattcggaagcctttctt

SEQ ID NO: 9783 - DNA, 20 bp, Saccharomyces cerevisiae
caggccttgttattgccaac

SEQ ID NO: 9784 - DNA, 20 bp, Saccharomyces cerevisiae
aatgcgcgaatcctgtctac

SEQ ID NO: 9785 - DNA, 20 bp, Saccharomyces cerevisiae
cctgccccaactaagaatga

SEQ ID NO: 9786 - DNA, 20 bp, Saccharomyces cerevisiae
cgtcttcttcctcgtcttcg

SEQ ID NO: 9787 - DNA, 20 bp, Saccharomyces cerevisiae
caaacacttgcacaatggct

SEQ ID NO: 9788 - DNA, 20 bp, Saccharomyces cerevisiae
ttctgggttgtggactgaca

SEQ ID NO: 9789 - DNA, 20 bp, Saccharomyces cerevisiae
ccaaaagagctgctggaact

SEQ ID NO: 9790 - DNA, 20 bp, Saccharomyces cerevisiae
catggtcggagttgtagcct

SEQ ID NO: 9791 - DNA, 20 bp, Saccharomyces cerevisiae
cggtgcttccaatttgattt

SEQ ID NO: 9792 - DNA, 20 bp, Saccharomyces cerevisiae
gctggttattgatcccgaaa

SEQ ID NO: 9793 - DNA, 20 bp, Saccharomyces cerevisiae
atccttcagaatcggtggtg

SEQ ID NO: 9794 - DNA, 20 bp, Saccharomyces cerevisiae
ggaaatgatgtcttaggccc

SEQ ID NO: 9795 - DNA, 22 bp, Saccharomyces cerevisiae
tctcgccatttaccttgacttt

SEQ ID NO: 9796 - DNA, 20 bp, Saccharomyces cerevisiae
tccccacacaatcagtgaaa

SEQ ID NO: 9797 - DNA, 20 bp, Saccharomyces cerevisiae
cgatcaagatgtggacgatg

SEQ ID NO: 9798 - DNA, 20 bp, Saccharomyces cerevisiae
tactccttgcaagacggaca

SEQ ID NO: 9799 - DNA, 21 bp, Saccharomyces cerevisiae
tcactgaacctttttccgaag

SEQ ID NO: 9800 - DNA, 20 bp, Saccharomyces cerevisiae
aggcaggaaggaaaaagaca

SEQ ID NO: 9801 - DNA, 21 bp, Saccharomyces cerevisiae
aactcgtttccgatcttctga

SEQ ID NO: 9802 - DNA, 20 bp, Saccharomyces cerevisiae
aaccacaaggtccatgcaat

SEQ ID NO: 9803 - DNA, 20 bp, Saccharomyces cerevisiae
ctgcctcttctaacgcttcg

SEQ ID NO: 9804 - DNA, 20 bp, Saccharomyces cerevisiae
actacgccgttggactgtct

SEQ ID NO: 9805 - DNA, 20 bp, Saccharomyces cerevisiae
gcccaattttcaaggtccta

SEQ ID NO: 9806 - DNA, 21 bp, Saccharomyces cerevisiae
gcctacgctaatgaaagcaaa

SEQ ID NO: 9807 - DNA, 20 bp, Saccharomyces cerevisiae
tctaacgcaatcacaccgaa

SEQ ID NO: 9808 - DNA, 20 bp, Saccharomyces cerevisiae
aatgctgcggctatttccta

SEQ ID NO: 9809 - DNA, 20 bp, Saccharomyces cerevisiae
ccaacgcttcatcagagttc

SEQ ID NO: 9810 - DNA, 20 bp, Saccharomyces cerevisiae
tggtttgcttccttttcgtt

SEQ ID NO: 9811 - DNA, 20 bp, Saccharomyces cerevisiae
cgttacgtgttcgaagggat

SEQ ID NO: 9812 - DNA, 20 bp, Saccharomyces cerevisiae
aacttacatgggatggtggg

SEQ ID NO: 9813 - DNA, 21 bp, Saccharomyces cerevisiae
gggctctatcacgatactcca

SEQ ID NO: 9814 - DNA, 20 bp, Saccharomyces cerevisiae
gagcttattttgcaacccca

SEQ ID NO: 9815 - DNA, 20 bp, Saccharomyces cerevisiae
cgaaatttggacaagccatt

SEQ ID NO: 9816 - DNA, 20 bp, Saccharomyces cerevisiae
caacaaagcagagatgccaa

SEQ ID NO: 9817 - DNA, 20 bp, Saccharomyces cerevisiae
atgaacccgatttttcttcg

SEQ ID NO: 9818 - DNA, 20 bp, Saccharomyces cerevisiae
ttgttggaaacgacagcaga

SEQ ID NO: 9819 - DNA, 20 bp, Saccharomyces cerevisiae
tcaccaaactgcctttccat

SEQ ID NO: 9820 - DNA, 20 bp, Saccharomyces cerevisiae
aggcgtgcttgctagtgaat

SEQ ID NO: 9821 - DNA, 27 bp, Saccharomyces cerevisiae
ttctagtgcaaagaatagtgctagaat

SEQ ID NO: 9822 - DNA, 20 bp, Saccharomyces cerevisiae
tgttggagccacaatttgaa

SEQ ID NO: 9823 - DNA, 20 bp, Saccharomyces cerevisiae
ttcttgcatgctcattacgg

SEQ ID NO: 9824 - DNA, 20 bp, Saccharomyces cerevisiae
tgcagtccatgcagtgagat

SEQ ID NO: 9825 - DNA, 20 bp, Saccharomyces cerevisiae
tgagaaaagaaccgtttcgg

SEQ ID NO: 9826 - DNA, 21 bp, Saccharomyces cerevisiae
ttgcaataatcccaaacttgc

SEQ ID NO: 9827 - DNA, 20 bp, Saccharomyces cerevisiae
aaagggccgcgtttaatagt

SEQ ID NO: 9828 - DNA, 20 bp, Saccharomyces cerevisiae
tggatttttcgattgctgtg

SEQ ID NO: 9829 - DNA, 21 bp, Saccharomyces cerevisiae
tctaacttagccctttcccga

SEQ ID NO: 9830 - DNA, 20 bp, Saccharomyces cerevisiae
aattggtgttgctgtagccc

SEQ ID NO: 9831 - DNA, 20 bp, Saccharomyces cerevisiae
tattaaccatgggagaggcg

SEQ ID NO: 9832 - DNA, 20 bp, Saccharomyces cerevisiae
gccttggattctgtcagctc

SEQ ID NO: 9833 - DNA, 20 bp, Saccharomyces cerevisiae
tgatcaacaatccggttcaa

SEQ ID NO: 9834 - DNA, 20 bp, Saccharomyces cerevisiae
aggaaataacggtgtggtgg

SEQ ID NO: 9835 - DNA, 20 bp, Saccharomyces cerevisiae
ttacggtgggtaggttttgg

SEQ ID NO: 9836 - DNA, 20 bp, Saccharomyces cerevisiae
gtcgctatggattgggctaa

SEQ ID NO: 9837 - DNA, 20 bp, Saccharomyces cerevisiae
atgttctcaacccagcatcc

SEQ ID NO: 9838 - DNA, 21 bp, Saccharomyces cerevisiae
cgcaaaatagtcggtaactcg

SEQ ID NO: 9839 - DNA, 21 bp, Saccharomyces cerevisiae
caacgtcaacaccaacttgaa

SEQ ID NO: 9840 - DNA, 20 bp, Saccharomyces cerevisiae
acggccatcttgcacttcta

SEQ ID NO: 9841 - DNA, 20 bp, Saccharomyces cerevisiae
tggatttttcgaccatttga

SEQ ID NO: 9842 - DNA, 20 bp, Saccharomyces cerevisiae
gaacgtgaactggaattggg

SEQ ID NO: 9843 - DNA, 20 bp, Saccharomyces cerevisiae
tttcattgctgacttggtcg

SEQ ID NO: 9844 - DNA, 22 bp, Saccharomyces cerevisiae
tcctgacgtttcaatattttcg

SEQ ID NO: 9845 - DNA, 20 bp, Saccharomyces cerevisiae
gtagcttcgttgctgaaccc

SEQ ID NO: 9846 - DNA, 21 bp, Saccharomyces cerevisiae
aaatcaaagtcgcaaagcaga

SEQ ID NO: 9847 - DNA, 20 bp, Saccharomyces cerevisiae
tgacaatggtacgggaagtg

SEQ ID NO: 9848 - DNA, 20 bp, Saccharomyces cerevisiae
tcagttgcgtcgttacaacc

SEQ ID NO: 9849 - DNA, 20 bp, Saccharomyces cerevisiae
tggggagaataaaggggagt

SEQ ID NO: 9850 - DNA, 20 bp, Saccharomyces cerevisiae
taggactctgggtcacgctt

SEQ ID NO: 9851 - DNA, 20 bp, Saccharomyces cerevisiae
cagaaggcatgttcctctca

SEQ ID NO: 9852 - DNA, 20 bp, Saccharomyces cerevisiae
ggttgggcttttgaagatga

SEQ ID NO: 9853 - DNA, 20 bp, Saccharomyces cerevisiae
aggctcgtccaataatccct

SEQ ID NO: 9854 - DNA, 24 bp, Saccharomyces cerevisiae
tcttacagaggtggatccattaca

SEQ ID NO: 9855 - DNA, 22 bp, Saccharomyces cerevisiae
ttttccatatacgatgccttga

SEQ ID NO: 9856 - DNA, 20 bp, Saccharomyces cerevisiae
gatgaagtgtcgtctgctgg

SEQ ID NO: 9857 - DNA, 20 bp, Saccharomyces cerevisiae
catacgcacaagtggctgtt

SEQ ID NO: 9858 - DNA, 20 bp, Saccharomyces cerevisiae
tctgtgagaaggaaatgggg

SEQ ID NO: 9859 - DNA, 20 bp, Saccharomyces cerevisiae
ctccatgacttcgatgacca

SEQ ID NO: 9860 - DNA, 20 bp, Saccharomyces cerevisiae
ctgaaaccattcaaggaggg

SEQ ID NO: 9861 - DNA, 21 bp, Saccharomyces cerevisiae
ccttgctagctttgttcttgc

SEQ ID NO: 9862 - DNA, 20 bp, Saccharomyces cerevisiae
cgcttgctcttatgcaaggt

SEQ ID NO: 9863 - DNA, 20 bp, Saccharomyces cerevisiae
gcgcatataaaggcgagaac

SEQ ID NO: 9864 - DNA, 20 bp, Saccharomyces cerevisiae
attcggttgacagttgaggc

SEQ ID NO: 9865 - DNA, 20 bp, Saccharomyces cerevisiae
acaaaggctgttgcgctaat

SEQ ID NO: 9866 - DNA, 20 bp, Saccharomyces cerevisiae
ttcttaaggttgcctttgcc

SEQ ID NO: 9867 - DNA, 20 bp, Saccharomyces cerevisiae
ggttggtgagatggttcgat

SEQ ID NO: 9868 - DNA, 20 bp, Saccharomyces cerevisiae
tttgcagttcagcaatctgg

SEQ ID NO: 9869 - DNA, 20 bp, Saccharomyces cerevisiae
ttcttcaatgcgttcggttt

SEQ ID NO: 9870 - DNA, 20 bp, Saccharomyces cerevisiae
taggcttcaccccagaaatg

SEQ ID NO: 9871 - DNA, 21 bp, Saccharomyces cerevisiae
tccatcggtcatagcatcttc

SEQ ID NO: 9872 - DNA, 20 bp, Saccharomyces cerevisiae
ttggttcccagaaacaaagg

SEQ ID NO: 9873 - DNA, 20 bp, Saccharomyces cerevisiae
ccacagctgcaattgtgaaa

SEQ ID NO: 9874 - DNA, 20 bp, Saccharomyces cerevisiae
aggaaacatatgcgcagctt

SEQ ID NO: 9875 - DNA, 20 bp, Saccharomyces cerevisiae
gaggaggaaaatgatggcaa

SEQ ID NO: 9876 - DNA, 20 bp, Saccharomyces cerevisiae
aatttagacggtgtggagcg

SEQ ID NO: 9877 - DNA, 20 bp, Saccharomyces cerevisiae
tgaaacatcatttgcggaag

SEQ ID NO: 9878 - DNA, 20 bp, Saccharomyces cerevisiae
gtgggcacttttgtctcaca

SEQ ID NO: 9879 - DNA, 20 bp, Saccharomyces cerevisiae
aaacaccaccaagaccgaag

SEQ ID NO: 9880 - DNA, 20 bp, Saccharomyces cerevisiae
attttcaagcgttgtggagg

SEQ ID NO: 9881 - DNA, 20 bp, Saccharomyces cerevisiae
cttcggttattcttttggcg

SEQ ID NO: 9882 - DNA, 20 bp, Saccharomyces cerevisiae
ggaaacgaggcattagggat

SEQ ID NO: 9883 - DNA, 20 bp, Saccharomyces cerevisiae
aaaatcgaaggttggtgtcg

SEQ ID NO: 9884 - DNA, 20 bp, Saccharomyces cerevisiae
tacgggcatcccaaagtaag

SEQ ID NO: 9885 - DNA, 20 bp, Saccharomyces cerevisiae
ccggtgactccaacgtatct

SEQ ID NO: 9886 - DNA, 20 bp, Saccharomyces cerevisiae
ggcaaacccactgttaagga

SEQ ID NO: 9887 - DNA, 20 bp, Saccharomyces cerevisiae
aattagcagatggctggtgc

SEQ ID NO: 9888 - DNA, 20 bp, Saccharomyces cerevisiae
aacgaagagttgggacatcg

SEQ ID NO: 9889 - DNA, 20 bp, Saccharomyces cerevisiae
accccctcttcccagactaa

SEQ ID NO: 9890 - DNA, 21 bp, Saccharomyces cerevisiae
cgcaaaacccttgtatattcg

SEQ ID NO: 9891 - DNA, 20 bp, Saccharomyces cerevisiae
gtcacaactggcacaaccac

SEQ ID NO: 9892 - DNA, 20 bp, Saccharomyces cerevisiae
acgttttggtctggatgctc

SEQ ID NO: 9893 - DNA, 20 bp, Saccharomyces cerevisiae
aacctgatgcggtgagaaat

SEQ ID NO: 9894 - DNA, 20 bp, Saccharomyces cerevisiae
ttcggaaatcatggaattga

SEQ ID NO: 9895 - DNA, 20 bp, Saccharomyces cerevisiae
ccaacttgtaaaaagcagcg

SEQ ID NO: 9896 - DNA, 20 bp, Saccharomyces cerevisiae
tctgaaaggaagtggctgct

SEQ ID NO: 9897 - DNA, 21 bp, Saccharomyces cerevisiae
gagcagaattttccttttgga

SEQ ID NO: 9898 - DNA, 20 bp, Saccharomyces cerevisiae
ggcagaggattgttgacagg

SEQ ID NO: 9899 - DNA, 20 bp, Saccharomyces cerevisiae
tccttctcaaggcattctgc

SEQ ID NO: 9900 - DNA, 21 bp, Saccharomyces cerevisiae
catcaggggaactatcttcca

SEQ ID NO: 9901 - DNA, 20 bp, Saccharomyces cerevisiae
cagtgaccaatcctagcggt

SEQ ID NO: 9902 - DNA, 20 bp, Saccharomyces cerevisiae
gggcctggatgatagggtat

SEQ ID NO: 9903 - DNA, 20 bp, Saccharomyces cerevisiae
cctagggcaccgagtgtaaa

SEQ ID NO: 9904 - DNA, 20 bp, Saccharomyces cerevisiae
ccaagcgtgtcactatccaa

SEQ ID NO: 9905 - DNA, 20 bp, Saccharomyces cerevisiae
tagccaaaatcttcgctgct

SEQ ID NO: 9906 - DNA, 20 bp, Saccharomyces cerevisiae
gagaaatgggacccgacata

SEQ ID NO: 9907 - DNA, 21 bp, Saccharomyces cerevisiae
gcgaaagactaatttcgatgg

SEQ ID NO: 9908 - DNA, 20 bp, Saccharomyces cerevisiae
ccgtgatggatggagagact

SEQ ID NO: 9909 - DNA, 20 bp, Saccharomyces cerevisiae
aaagtttatcggggtgcgta

SEQ ID NO: 9910 - DNA, 20 bp, Saccharomyces cerevisiae
catacccccaaatggttcag

SEQ ID NO: 9911 - DNA, 20 bp, Saccharomyces cerevisiae
gctacgtttgcgagtgcata

SEQ ID NO: 9912 - DNA, 20 bp, Saccharomyces cerevisiae
gcagaaatcaattgacaccg

SEQ ID NO: 9913 - DNA, 20 bp, Saccharomyces cerevisiae
aaaaccctcgagacaagcaa

SEQ ID NO: 9914 - DNA, 20 bp, Saccharomyces cerevisiae
taccgctgggttcataggag

SEQ ID NO: 9915 - DNA, 20 bp, Saccharomyces cerevisiae
ggtttactgaatgccctgga

SEQ ID NO: 9916 - DNA, 20 bp, Saccharomyces cerevisiae
atcggcattcaacctggata

SEQ ID NO: 9917 - DNA, 20 bp, Saccharomyces cerevisiae
gggattaaagaagggatggc

SEQ ID NO: 9918 - DNA, 20 bp, Saccharomyces cerevisiae
acgctcaaaaaggaacgaaa

SEQ ID NO: 9919 - DNA, 20 bp, Saccharomyces cerevisiae
gaggaggtttcagaggaggc

SEQ ID NO: 9920 - DNA, 20 bp, Saccharomyces cerevisiae
cgcatgaaatgacaacatcc

SEQ ID NO: 9921 - DNA, 20 bp, Saccharomyces cerevisiae
gcttaagaaacgccaggaca

SEQ ID NO: 9922 - DNA, 20 bp, Saccharomyces cerevisiae
tgtgccttttgctgaatctg

SEQ ID NO: 9923 - DNA, 21 bp, Saccharomyces cerevisiae
cctcaagctacctttgcattg

SEQ ID NO: 9924 - DNA, 20 bp, Saccharomyces cerevisiae
cgtacatgtggcaaccaaac

SEQ ID NO: 9925 - DNA, 20 bp, Saccharomyces cerevisiae
gccgcttaagcttcaaaaca

SEQ ID NO: 9926 - DNA, 20 bp, Saccharomyces cerevisiae
acgaccggcattctcttttt

SEQ ID NO: 9927 - DNA, 20 bp, Saccharomyces cerevisiae
aaaacgtgcggtagttgtcc

SEQ ID NO: 9928 - DNA, 20 bp, Saccharomyces cerevisiae
tgtagttttcagaagcgggc

SEQ ID NO: 9929 - DNA, 20 bp, Saccharomyces cerevisiae
agaaatgacacgcaatgcag

SEQ ID NO: 9930 - DNA, 20 bp, Saccharomyces cerevisiae
gaaagcgaaaaaggcttcct

SEQ ID NO: 9931 - DNA, 20 bp, Saccharomyces cerevisiae
cttcttttaagtgacgggcg

SEQ ID NO: 9932 - DNA, 20 bp, Saccharomyces cerevisiae
cattccgatcatctgagcaa

SEQ ID NO: 9933 - DNA, 20 bp, Saccharomyces cerevisiae
gatgggattttcctctgcaa

SEQ ID NO: 9934 - DNA, 20 bp, Saccharomyces cerevisiae
tcaccctttggatattggga

SEQ ID NO: 9935 - DNA, 20 bp, Saccharomyces cerevisiae
aattaccaaaacaaacgccg

SEQ ID NO: 9936 - DNA, 20 bp, Saccharomyces cerevisiae
tcgcattttgagcagttttg

SEQ ID NO: 9937 - DNA, 21 bp, Saccharomyces cerevisiae
tttttcttttgaagcacccaa

SEQ ID NO: 9938 - DNA, 20 bp, Saccharomyces cerevisiae
ggcttcggtaatcttcccat

SEQ ID NO: 9939 - DNA, 20 bp, Saccharomyces cerevisiae
tgttgtgctcgaggatgaag

SEQ ID NO: 9940 - DNA, 20 bp, Saccharomyces cerevisiae
atcttggatgaagctgtcgc

SEQ ID NO: 9941 - DNA, 20 bp, Saccharomyces cerevisiae
catcttaaggagggcctggt

SEQ ID NO: 9942 - DNA, 20 bp, Saccharomyces cerevisiae
cggatcaggctgtacctctc

SEQ ID NO: 9943 - DNA, 20 bp, Saccharomyces cerevisiae
ctgcttcgaacgcaataaca

SEQ ID NO: 9944 - DNA, 20 bp, Saccharomyces cerevisiae
ctgtcgaagatgggcaaaat

SEQ ID NO: 9945 - DNA, 20 bp, Saccharomyces cerevisiae
gaacgaaaaggcggtattga

SEQ ID NO: 9946 - DNA, 20 bp, Saccharomyces cerevisiae
tggcattggttgcagttaaa

SEQ ID NO: 9947 - DNA, 20 bp, Saccharomyces cerevisiae
tggactgggattccacatct

SEQ ID NO: 9948 - DNA, 20 bp, Saccharomyces cerevisiae
ttcaacaaacaccgttctca

SEQ ID NO: 9949 - DNA, 20 bp, Saccharomyces cerevisiae
tgttgattgcctattgctcg

SEQ ID NO: 9950 - DNA, 20 bp, Saccharomyces cerevisiae
ctcgcctttggtacgttcat

SEQ ID NO: 9951 - DNA, 20 bp, Saccharomyces cerevisiae
tagctgccccaaagtaatgg

SEQ ID NO: 9952 - DNA, 20 bp, Saccharomyces cerevisiae
ttgcctgcaattcttcttga

SEQ ID NO: 9953 - DNA, 20 bp, Saccharomyces cerevisiae
gacgttcgtcccaatttgat

SEQ ID NO: 9954 - DNA, 20 bp, Saccharomyces cerevisiae
cctaccgtttgttgcgtttt

SEQ ID NO: 9955 - DNA, 20 bp, Saccharomyces cerevisiae
tttgcccttctcgtattcgt

SEQ ID NO: 9956 - DNA, 20 bp, Saccharomyces cerevisiae
tctgaacgtaccaacgacca

SEQ ID NO: 9957 - DNA, 20 bp, Saccharomyces cerevisiae
ggatttatcttccggccaat

SEQ ID NO: 9958 - DNA, 20 bp, Saccharomyces cerevisiae
ttattgacccactgacccgt

SEQ ID NO: 9959 - DNA, 20 bp, Saccharomyces cerevisiae
agctacgaaggttggcagaa

SEQ ID NO: 9960 - DNA, 20 bp, Saccharomyces cerevisiae
gcacaggtttcaagtgaggg

SEQ ID NO: 9961 - DNA, 20 bp, Saccharomyces cerevisiae
aggccaaagaaaagggaaaa

SEQ ID NO: 9962 - DNA, 20 bp, Saccharomyces cerevisiae
acgtatccagaaaacgcagc

SEQ ID NO: 9963 - DNA, 20 bp, Saccharomyces cerevisiae
ttctctgccctttttggcta

SEQ ID NO: 9964 - DNA, 20 bp, Saccharomyces cerevisiae
gttttgtgggattggctctc

SEQ ID NO: 9965 - DNA, 20 bp, Saccharomyces cerevisiae
tgcagaagtggaagaaacca

SEQ ID NO: 9966 - DNA, 20 bp, Saccharomyces cerevisiae
aggcggtcaacaagtctagg

SEQ ID NO: 9967 - DNA, 20 bp, Saccharomyces cerevisiae
acctcttcaaattcctcggg

SEQ ID NO: 9968 - DNA, 20 bp, Saccharomyces cerevisiae
tacactgccgattggactca

SEQ ID NO: 9969 - DNA, 20 bp, Saccharomyces cerevisiae
aaggaattgcaggatgaagc

SEQ ID NO: 9970 - DNA, 20 bp, Saccharomyces cerevisiae
tgataccaatggactaggcg

SEQ ID NO: 9971 - DNA, 20 bp, Saccharomyces cerevisiae
ccccctctttgcattacatt

SEQ ID NO: 9972 - DNA, 20 bp, Saccharomyces cerevisiae
gtcaattggggcaatctacg

SEQ ID NO: 9973 - DNA, 20 bp, Saccharomyces cerevisiae
gacattccaattggcaaaca

SEQ ID NO: 9974 - DNA, 20 bp, Saccharomyces cerevisiae
gcatttggccgctaaaataa

SEQ ID NO: 9975 - DNA, 21 bp, Saccharomyces cerevisiae
tcctatgttgccgaaaacaac

SEQ ID NO: 9976 - DNA, 20 bp, Saccharomyces cerevisiae
agcgtgtgatggattatggg

SEQ ID NO: 9977 - DNA, 20 bp, Saccharomyces cerevisiae
cgacgacgcaaatgtaacaa

SEQ ID NO: 9978 - DNA, 20 bp, Saccharomyces cerevisiae
gggtcatcagatcccacaat

SEQ ID NO: 9979 - DNA, 20 bp, Saccharomyces cerevisiae
atttcttccccgcaagttct

SEQ ID NO: 9980 - DNA, 23 bp, Saccharomyces cerevisiae
cttgattctttgtcacctcaaca

SEQ ID NO: 9981 - DNA, 21 bp, Saccharomyces cerevisiae
tgcatacgccaataagaaagc

SEQ ID NO: 9982 - DNA, 20 bp, Saccharomyces cerevisiae
gcatcactctcatccagcaa

SEQ ID NO: 9983 - DNA, 20 bp, Saccharomyces cerevisiae
cggacaacgaggctaagaaa

SEQ ID NO: 9984 - DNA, 20 bp, Saccharomyces cerevisiae
tccaggtgctttaggtttgg

SEQ ID NO: 9985 - DNA, 20 bp, Saccharomyces cerevisiae
gcttttggtggtggtaagga

SEQ ID NO: 9986 - DNA, 20 bp, Saccharomyces cerevisiae
agacgccgtagccagactaa

SEQ ID NO: 9987 - DNA, 20 bp, Saccharomyces cerevisiae
aagggaaatcaattgcctga

SEQ ID NO: 9988 - DNA, 23 bp, Saccharomyces cerevisiae
cgttttcagatttattattgccg

SEQ ID NO: 9989 - DNA, 20 bp, Saccharomyces cerevisiae
acgagggttgcttgttgttt

SEQ ID NO: 9990 - DNA, 20 bp, Saccharomyces cerevisiae
atgttcgccctgaaattttg

SEQ ID NO: 9991 - DNA, 24 bp, Saccharomyces cerevisiae
tcccaataaagcattgaattatga

SEQ ID NO: 9992 - DNA, 21 bp, Saccharomyces cerevisiae
ttcctgctttgttagagccaa

SEQ ID NO: 9993 - DNA, 20 bp, Saccharomyces cerevisiae
aaacaattcggtatcgctgc

SEQ ID NO: 9994 - DNA, 20 bp, Saccharomyces cerevisiae
aagatttgtgggcagtcgtt

SEQ ID NO: 9995 - DNA, 20 bp, Saccharomyces cerevisiae
ggtcagatgttggcaggttt

SEQ ID NO: 9996 - DNA, 25 bp, Saccharomyces cerevisiae
gtacaatgtcacaggaaatgacttg

SEQ ID NO: 9997 - DNA, 20 bp, Saccharomyces cerevisiae
catgctggaaactcagcaaa

SEQ ID NO: 9998 - DNA, 20 bp, Saccharomyces cerevisiae
accggactttaaaccatccc

SEQ ID NO: 9999 - DNA, 20 bp, Saccharomyces cerevisiae
taaagaagccttgagccgaa

SEQ ID NO: 10000 - DNA, 20 bp, Saccharomyces cerevisiae
ccttttgaaacgctttacgc

SEQ ID NO: 10001 - DNA, 20 bp, Saccharomyces cerevisiae
taaagggctccggtttgtaa

SEQ ID NO: 10002 - DNA, 20 bp, Saccharomyces cerevisiae
atgcgaattgcctaacgtct

SEQ ID NO: 10003 - DNA, 21 bp, Saccharomyces cerevisiae
agtggatgaggatggattcac

SEQ ID NO: 10004 - DNA, 20 bp, Saccharomyces cerevisiae
gattgctgtttgagctgctg

SEQ ID NO: 10005 - DNA, 20 bp, Saccharomyces cerevisiae
gtagccgccgttgttgttat

SEQ ID NO: 10006 - DNA, 20 bp, Saccharomyces cerevisiae
aaatgacttggcgacgctat

SEQ ID NO: 10007 - DNA, 20 bp, Saccharomyces cerevisiae
aactggacaaatccggtgag

SEQ ID NO: 10008 - DNA, 20 bp, Saccharomyces cerevisiae
gatacggcgttgactccact

SEQ ID NO: 10009 - DNA, 20 bp, Saccharomyces cerevisiae
tgccatttgactttgagtcg

SEQ ID NO: 10010 - DNA, 22 bp, Saccharomyces cerevisiae
caaaactggtcgagttcatagg

SEQ ID NO: 10011 - DNA, 21 bp, Saccharomyces cerevisiae
tccagaagaatgaatgcaaca

SEQ ID NO: 10012 - DNA, 20 bp, Saccharomyces cerevisiae
gactcatatggtcgaagccg

SEQ ID NO: 10013 - DNA, 20 bp, Saccharomyces cerevisiae
ggtgctgttgccttaacgat

SEQ ID NO: 10014 - DNA, 20 bp, Saccharomyces cerevisiae
gcggggtataaaccaaacaa

SEQ ID NO: 10015 - DNA, 20 bp, Saccharomyces cerevisiae
aagaggctcgttgaccgata

SEQ ID NO: 10016 - DNA, 20 bp, Saccharomyces cerevisiae
caggcacaacaaaagctgaa

SEQ ID NO: 10017 - DNA, 20 bp, Saccharomyces cerevisiae
acgaaaaggcgtagacatgg

SEQ ID NO: 10018 - DNA, 20 bp, Saccharomyces cerevisiae
gaatgccctgaaccaaagaa

SEQ ID NO: 10019 - DNA, 20 bp, Saccharomyces cerevisiae
tgcgtaatagcccaaaatcc

SEQ ID NO: 10020 - DNA, 20 bp, Saccharomyces cerevisiae
gatcggagcaaaattggaaa

SEQ ID NO: 10021 - DNA, 22 bp, Saccharomyces cerevisiae
aaaggtggagttagatgccttt

SEQ ID NO: 10022 - DNA, 24 bp, Saccharomyces cerevisiae
tgatttttattccaacagtcctga

SEQ ID NO: 10023 - DNA, 20 bp, Saccharomyces cerevisiae
ctggtggtctggatggactt

SEQ ID NO: 10024 - DNA, 20 bp, Saccharomyces cerevisiae
tttttccgttgcggatttac

SEQ ID NO: 10025 - DNA, 20 bp, Saccharomyces cerevisiae
tctaccaccaaacctacggc

SEQ ID NO: 10026 - DNA, 20 bp, Saccharomyces cerevisiae
gcgttggttcacttagaggc

SEQ ID NO: 10027 - DNA, 20 bp, Saccharomyces cerevisiae
ggatgcgttgaaggaaaagt

SEQ ID NO: 10028 - DNA, 20 bp, Saccharomyces cerevisiae
atacgatccaaccaaggtgc

SEQ ID NO: 10029 - DNA, 20 bp, Saccharomyces cerevisiae
tgggcaagatcccagtagac

SEQ ID NO: 10030 - DNA, 20 bp, Saccharomyces cerevisiae
cgtaggctggaactctaccg

SEQ ID NO: 10031 - DNA, 20 bp, Saccharomyces cerevisiae
tcttaaaccagcagtgccaa

SEQ ID NO: 10032 - DNA, 22 bp, Saccharomyces cerevisiae
tgtctttactgggtgtaagcct

SEQ ID NO: 10033 - DNA, 20 bp, Saccharomyces cerevisiae
gcacacattttggtagcagc

SEQ ID NO: 10034 - DNA, 20 bp, Saccharomyces cerevisiae
tatcaattgcacacaggcgt

SEQ ID NO: 10035 - DNA, 20 bp, Saccharomyces cerevisiae
ttgttgagcaaccatgcaat

SEQ ID NO: 10036 - DNA, 20 bp, Saccharomyces cerevisiae
cgaagagcaaagaaaggctg

SEQ ID NO: 10037 - DNA, 20 bp, Saccharomyces cerevisiae
gttcattgcgggtgaaaaat

SEQ ID NO: 10038 - DNA, 20 bp, Saccharomyces cerevisiae
ctgggtggtacgtactcgtg

SEQ ID NO: 10039 - DNA, 25 bp, Saccharomyces cerevisiae
ttgacaagaacttagcatgtaacca

SEQ ID NO: 10040 - DNA, 22 bp, Saccharomyces cerevisiae
ttgtctgttacctttgtcgagc

SEQ ID NO: 10041 - DNA, 20 bp, Saccharomyces cerevisiae
cttgatttgctcgcgtctaa

SEQ ID NO: 10042 - DNA, 20 bp, Saccharomyces cerevisiae
aggcgccaattaaaaatgtg

SEQ ID NO: 10043 - DNA, 20 bp, Saccharomyces cerevisiae
ggattcaacggcgttaagaa

SEQ ID NO: 10044 - DNA, 20 bp, Saccharomyces cerevisiae
tgatctttcgtggcactttg

SEQ ID NO: 10045 - DNA, 20 bp, Saccharomyces cerevisiae
gccctatcatcggagatcaa

SEQ ID NO: 10046 - DNA, 20 bp, Saccharomyces cerevisiae
aacgcttgatcgtagccagt

SEQ ID NO: 10047 - DNA, 20 bp, Saccharomyces cerevisiae
gattcggtgcactctgttga

SEQ ID NO: 10048 - DNA, 20 bp, Saccharomyces cerevisiae
ctgtttctggaactttggca

SEQ ID NO: 10049 - DNA, 20 bp, Saccharomyces cerevisiae
tctaacggagacatctgggc

SEQ ID NO: 10050 - DNA, 20 bp, Saccharomyces cerevisiae
ttcccagatccccttattcc

SEQ ID NO: 10051 - DNA, 20 bp, Saccharomyces cerevisiae
aggactgcggaactacaagc

SEQ ID NO: 10052 - DNA, 21 bp, Saccharomyces cerevisiae
tgctattatccttgttccccc

SEQ ID NO: 10053 - DNA, 20 bp, Saccharomyces cerevisiae
gcccaacggtgaaacaatac

SEQ ID NO: 10054 - DNA, 20 bp, Saccharomyces cerevisiae
tctaactgtgattgcgcgtc

SEQ ID NO: 10055 - DNA, 20 bp, Saccharomyces cerevisiae
aaaatgattggtggacaggc

SEQ ID NO: 10056 - DNA, 20 bp, Saccharomyces cerevisiae
cagtgagtcctgttccgtga

SEQ ID NO: 10057 - DNA, 20 bp, Saccharomyces cerevisiae
ctaatgtttgcgggatgctt

SEQ ID NO: 10058 - DNA, 20 bp, Saccharomyces cerevisiae
cttaactcttgtggggccag

SEQ ID NO: 10059 - DNA, 20 bp, Saccharomyces cerevisiae
cataaactgggcaaagtcgc

SEQ ID NO: 10060 - DNA, 20 bp, Saccharomyces cerevisiae
aattgcaagctcgctgtttt

SEQ ID NO: 10061 - DNA, 21 bp, Saccharomyces cerevisiae
catgaaaagggaaagacagca

SEQ ID NO: 10062 - DNA, 20 bp, Saccharomyces cerevisiae
caggagaggacgccaataaa

SEQ ID NO: 10063 - DNA, 20 bp, Saccharomyces cerevisiae
acttgtccgtcaactgcctc

SEQ ID NO: 10064 - DNA, 20 bp, Saccharomyces cerevisiae
tctaaggacgcaaactgggt

SEQ ID NO: 10065 - DNA, 20 bp, Saccharomyces cerevisiae
ctttcgcttaggttccatgc

SEQ ID NO: 10066 - DNA, 20 bp, Saccharomyces cerevisiae
ccagtttgtcttccagagcc

SEQ ID NO: 10067 - DNA, 20 bp, Saccharomyces cerevisiae
ttgtcaaaggtacgcccttc

SEQ ID NO: 10068 - DNA, 20 bp, Saccharomyces cerevisiae
ttagacgtgtagcgggtctg

SEQ ID NO: 10069 - DNA, 20 bp, Saccharomyces cerevisiae
cccaccatcccatgtaagtt

SEQ ID NO: 10070 - DNA, 20 bp, Saccharomyces cerevisiae
tagggcttttgcaaacaagg

SEQ ID NO: 10071 - DNA, 25 bp, Saccharomyces cerevisiae
gtatggttctaacaacgatgattcc

SEQ ID NO: 10072 - DNA, 20 bp, Saccharomyces cerevisiae
ccacttcactgtcgagttgc

SEQ ID NO: 10073 - DNA, 23 bp, Saccharomyces cerevisiae
catgttggcttatttcaaaaaca

SEQ ID NO: 10074 - DNA, 20 bp, Saccharomyces cerevisiae
aaatccttgtgcctcgactg

SEQ ID NO: 10075 - DNA, 21 bp, Saccharomyces cerevisiae
ccgccagaaatgaattaatga

SEQ ID NO: 10076 - DNA, 20 bp, Saccharomyces cerevisiae
tcgaggaaacagtggaaagg

SEQ ID NO: 10077 - DNA, 20 bp, Saccharomyces cerevisiae
ggcagaaggctcacgaaata

SEQ ID NO: 10078 - DNA, 20 bp, Saccharomyces cerevisiae
tttccattaccggatgaagc

SEQ ID NO: 10079 - DNA, 20 bp, Saccharomyces cerevisiae
caaaagcacacgttaaccga

SEQ ID NO: 10080 - DNA, 20 bp, Saccharomyces cerevisiae
attggcagcgacgagatatt

SEQ ID NO: 10081 - DNA, 20 bp, Saccharomyces cerevisiae
gacattgttgcgaatggttg

SEQ ID NO: 10082 - DNA, 21 bp, Saccharomyces cerevisiae
ccccatatcaatgtgttgagc

SEQ ID NO: 10083 - DNA, 20 bp, Saccharomyces cerevisiae
gctacgacatggcatttgaa

SEQ ID NO: 10084 - DNA, 20 bp, Saccharomyces cerevisiae
gaaccttaatcgagccatcg

SEQ ID NO: 10085 - DNA, 24 bp, Saccharomyces cerevisiae
tgcaactaaatgaggaagtagcaa

SEQ ID NO: 10086 - DNA, 20 bp, Saccharomyces cerevisiae
tttgttttcggtgcagcata

SEQ ID NO: 10087 - DNA, 20 bp, Saccharomyces cerevisiae
taaaactgcagcactgggtg

SEQ ID NO: 10088 - DNA, 20 bp, Saccharomyces cerevisiae
aagcccacacagaagcagat

SEQ ID NO: 10089 - DNA, 20 bp, Saccharomyces cerevisiae
tcaatggtcattggatgcag

SEQ ID NO: 10090 - DNA, 20 bp, Saccharomyces cerevisiae
cttggttccttttgaatcgc

SEQ ID NO: 10091 - DNA, 21 bp, Saccharomyces cerevisiae
tggtgctgatgatgatgaaga

SEQ ID NO: 10092 - DNA, 23 bp, Saccharomyces cerevisiae
gaagaatactcagttgcagcaca

SEQ ID NO: 10093 - DNA, 22 bp, Saccharomyces cerevisiae
gaaagactttgttgtgtcggaa

SEQ ID NO: 10094 - DNA, 20 bp, Saccharomyces cerevisiae
acagaaaagagaccagcgga

SEQ ID NO: 10095 - DNA, 20 bp, Saccharomyces cerevisiae
caaacattttcaggcaccct

SEQ ID NO: 10096 - DNA, 20 bp, Saccharomyces cerevisiae
tgactaaccgccagtcacag

SEQ ID NO: 10097 - DNA, 20 bp, Saccharomyces cerevisiae
tgaacgttgacacctttgga

SEQ ID NO: 10098 - DNA, 22 bp, Saccharomyces cerevisiae
cacgctagaacctctcattgaa

SEQ ID NO: 10099 - DNA, 22 bp, Saccharomyces cerevisiae
ttttcaccaaagaagatgttgc

SEQ ID NO: 10100 - DNA, 20 bp, Saccharomyces cerevisiae
tctgcgcgtacttaacatcg

SEQ ID NO: 10101 - DNA, 20 bp, Saccharomyces cerevisiae
gcaacaacaccaacgacatc

SEQ ID NO: 10102 - DNA, 20 bp, Saccharomyces cerevisiae
tgtatcttcgagggtggctt

SEQ ID NO: 10103 - DNA, 20 bp, Saccharomyces cerevisiae
aaggccatcaacaaccagtc

SEQ ID NO: 10104 - DNA, 20 bp, Saccharomyces cerevisiae
tgtataagggaccagaggcg

SEQ ID NO: 10105 - DNA, 21 bp, Saccharomyces cerevisiae
gaagcttggaaacaaacgaca

SEQ ID NO: 10106 - DNA, 20 bp, Saccharomyces cerevisiae
ttccttaggggacgctacct

SEQ ID NO: 10107 - DNA, 20 bp, Saccharomyces cerevisiae
tacccatacgacgctgatga

SEQ ID NO: 10108 - DNA, 20 bp, Saccharomyces cerevisiae
ccgataagcatgccacagta

SEQ ID NO: 10109 - DNA, 20 bp, Saccharomyces cerevisiae
aaaattttgcgatttgccag

SEQ ID NO: 10110 - DNA, 22 bp, Saccharomyces cerevisiae
cgtctcattcttcagacgttta

SEQ ID NO: 10111 - DNA, 20 bp, Saccharomyces cerevisiae
gggtgaaccaggtgatatgg

SEQ ID NO: 10112 - DNA, 20 bp, Saccharomyces cerevisiae
acaaagacagcaatttgccc

SEQ ID NO: 10113 - DNA, 20 bp, Saccharomyces cerevisiae
gaactccttcgatctggacg

SEQ ID NO: 10114 - DNA, 20 bp, Saccharomyces cerevisiae
cttcaagtcgtaacccctgc

SEQ ID NO: 10115 - DNA, 20 bp, Saccharomyces cerevisiae
ccgtcgtcaaccttgatctt

SEQ ID NO: 10116 - DNA, 20 bp, Saccharomyces cerevisiae
agaacggatggtgatggaag

SEQ ID NO: 10117 - DNA, 20 bp, Saccharomyces cerevisiae
ggtgatccgcagagatgatt

SEQ ID NO: 10118 - DNA, 21 bp, Saccharomyces cerevisiae
tgtatttagtgtggtgacccg

SEQ ID NO: 10119 - DNA, 20 bp, Saccharomyces cerevisiae
gcggatgagtaagcgaagag

SEQ ID NO: 10120 - DNA, 20 bp, Saccharomyces cerevisiae
gctattcttttgtgcaagcg

SEQ ID NO: 10121 - DNA, 20 bp, Saccharomyces cerevisiae
tgctcaatgagatgccaaag

SEQ ID NO: 10122 - DNA, 20 bp, Saccharomyces cerevisiae
gtattgtgttgggatgctgc

SEQ ID NO: 10123 - DNA, 23 bp, Saccharomyces cerevisiae
tggaagaattgcaaacaaaaatc

SEQ ID NO: 10124 - DNA, 20 bp, Saccharomyces cerevisiae
tacaggagggaacaagcagg

SEQ ID NO: 10125 - DNA, 20 bp, Saccharomyces cerevisiae
gcatcaaaaggtaccgcatc

SEQ ID NO: 10126 - DNA, 23 bp, Saccharomyces cerevisiae
gccctcacaattataaatggttc

SEQ ID NO: 10127 - DNA, 20 bp, Saccharomyces cerevisiae
aaatgataacggctgcgaac

SEQ ID NO: 10128 - DNA, 20 bp, Saccharomyces cerevisiae
atttgtgttcacgtccagca

SEQ ID NO: 10129 - DNA, 20 bp, Saccharomyces cerevisiae
gtggcctttcaaagttgcat

SEQ ID NO: 10130 - DNA, 20 bp, Saccharomyces cerevisiae
acccactggttcacagatcc

SEQ ID NO: 10131 - DNA, 20 bp, Saccharomyces cerevisiae
atactccctccttgccgtct

SEQ ID NO: 10132 - DNA, 20 bp, Saccharomyces cerevisiae
gcttccggatcgttacctta

SEQ ID NO: 10133 - DNA, 20 bp, Saccharomyces cerevisiae
acccagaaacaaacggtgaa

SEQ ID NO: 10134 - DNA, 20 bp, Saccharomyces cerevisiae
ggtgaaaggctatctctgcg

SEQ ID NO: 10135 - DNA, 20 bp, Saccharomyces cerevisiae
agcatcgatcaaagagccac

SEQ ID NO: 10136 - DNA, 20 bp, Saccharomyces cerevisiae
tgtttcggattcgctactca

SEQ ID NO: 10137 - DNA, 21 bp, Saccharomyces cerevisiae
aaatggcccaactgtatgaga

SEQ ID NO: 10138 - DNA, 20 bp, Saccharomyces cerevisiae
caaaatgccattaccatcgg

SEQ ID NO: 10139 - DNA, 20 bp, Saccharomyces cerevisiae
tttaaacacccccagagacg

SEQ ID NO: 10140 - DNA, 20 bp, Saccharomyces cerevisiae
tgaaccacgctggattatca

SEQ ID NO: 10141 - DNA, 20 bp, Saccharomyces cerevisiae
cgatcatatctgcgttctgg

SEQ ID NO: 10142 - DNA, 20 bp, Saccharomyces cerevisiae
cagccttgacaatcttggtg

SEQ ID NO: 10143 - DNA, 20 bp, Saccharomyces cerevisiae
gctaaaatagggcttcgcgt

SEQ ID NO: 10144 - DNA, 20 bp, Saccharomyces cerevisiae
caatgcgttccctgctattt

SEQ ID NO: 10145 - DNA, 20 bp, Saccharomyces cerevisiae
tctcagaagggagaaaccca

SEQ ID NO: 10146 - DNA, 20 bp, Saccharomyces cerevisiae
ggttgttcgagataccgcat

SEQ ID NO: 10147 - DNA, 25 bp, Saccharomyces cerevisiae
caaatcagttattaacatcgtgagc

SEQ ID NO: 10148 - DNA, 22 bp, Saccharomyces cerevisiae
cacacattccaaactatcctgg

SEQ ID NO: 10149 - DNA, 20 bp, Saccharomyces cerevisiae
ggaaaggtctgtttgaccga

SEQ ID NO: 10150 - DNA, 20 bp, Saccharomyces cerevisiae
atttttcttgccctggacct

SEQ ID NO: 10151 - DNA, 21 bp, Saccharomyces cerevisiae
ccacctttgatagaggcatga

SEQ ID NO: 10152 - DNA, 20 bp, Saccharomyces cerevisiae
cgtcttcaaattcctccgaa

SEQ ID NO: 10153 - DNA, 20 bp, Saccharomyces cerevisiae
taaatttgacggacatgcga

SEQ ID NO: 10154 - DNA, 20 bp, Saccharomyces cerevisiae
tcaacataggtagcgtcccc

SEQ ID NO: 10155 - DNA, 20 bp, Saccharomyces cerevisiae
tttgggctgtaatctccacc

SEQ ID NO: 10156 - DNA, 20 bp, Saccharomyces cerevisiae
ttggatcgcaatgatcaaaa

SEQ ID NO: 10157 - DNA, 20 bp, Saccharomyces cerevisiae
atttgccgagtatccaccag

SEQ ID NO: 10158 - DNA, 20 bp, Saccharomyces cerevisiae
gtttgccttcttcaccgact

SEQ ID NO: 10159 - DNA, 23 bp, Saccharomyces cerevisiae
aaggatatgaccctgtcaaacaa

SEQ ID NO: 10160 - DNA, 20 bp, Saccharomyces cerevisiae
gtagatgcgcagaaatgcaa

SEQ ID NO: 10161 - DNA, 20 bp, Saccharomyces cerevisiae
ttttgaggacgattcgaagg

SEQ ID NO: 10162 - DNA, 20 bp, Saccharomyces cerevisiae
atcaggaacaaagcggcata

SEQ ID NO: 10163 - DNA, 21 bp, Saccharomyces cerevisiae
cctcactgatcctgaatccaa

SEQ ID NO: 10164 - DNA, 20 bp, Saccharomyces cerevisiae
gaataactctgtcgccctcg

SEQ ID NO: 10165 - DNA, 20 bp, Saccharomyces cerevisiae
ttgatgcggatgaagagttg

SEQ ID NO: 10166 - DNA, 20 bp, Saccharomyces cerevisiae
gcaccgtgttggtgtagttg

SEQ ID NO: 10167 - DNA, 20 bp, Saccharomyces cerevisiae
gacggcgataatggtaagga

SEQ ID NO: 10168 - DNA, 20 bp, Saccharomyces cerevisiae
gctcaatcatccaacggttt

SEQ ID NO: 10169 - DNA, 20 bp, Saccharomyces cerevisiae
ggtcgtttggtagttcgtcg

SEQ ID NO: 10170 - DNA, 22 bp, Saccharomyces cerevisiae
cgacaacaaaaataagcgttca

SEQ ID NO: 10171 - DNA, 20 bp, Saccharomyces cerevisiae
cacgcagagaacgaattgaa

SEQ ID NO: 10172 - DNA, 20 bp, Saccharomyces cerevisiae
ttggtccaatattcacgggt

SEQ ID NO: 10173 - DNA, 23 bp, Saccharomyces cerevisiae
aaatggatggaaagaatggatct

SEQ ID NO: 10174 - DNA, 20 bp, Saccharomyces cerevisiae
gccatttcgccaaaattaca

SEQ ID NO: 10175 - DNA, 20 bp, Saccharomyces cerevisiae
gtgacgaatcgaatgacgtg

SEQ ID NO: 10176 - DNA, 20 bp, Saccharomyces cerevisiae
ataacgacaccactggggaa

SEQ ID NO: 10177 - DNA, 20 bp, Saccharomyces cerevisiae
cattctcctctggttggctc

SEQ ID NO: 10178 - DNA, 20 bp, Saccharomyces cerevisiae
attcctctttacgtcgggct

SEQ ID NO: 10179 - DNA, 20 bp, Saccharomyces cerevisiae
aaatccacaaacaccgacaa

SEQ ID NO: 10180 - DNA, 23 bp, Saccharomyces cerevisiae
ctgtcctatgatctctcgatgtg

SEQ ID NO: 10181 - DNA, 20 bp, Saccharomyces cerevisiae
ggaggcaatgatggtgaagt

SEQ ID NO: 10182 - DNA, 20 bp, Saccharomyces cerevisiae
cgatctctggcctcaagaac

SEQ ID NO: 10183 - DNA, 20 bp, Saccharomyces cerevisiae
aacaacagcatcactcgcag

SEQ ID NO: 10184 - DNA, 20 bp, Saccharomyces cerevisiae
ctttggaagcccaaagattg

SEQ ID NO: 10185 - DNA, 19 bp, Saccharomyces cerevisiae
tcgttgacgctagcattcg

SEQ ID NO: 10186 - DNA, 20 bp, Saccharomyces cerevisiae
gcgtttcgtatcaaaaggga

SEQ ID NO: 10187 - DNA, 21 bp, Saccharomyces cerevisiae
cgggtaacaaacaccttagca

SEQ ID NO: 10188 - DNA, 20 bp, Saccharomyces cerevisiae
ggctcctccgggtaatactt

SEQ ID NO: 10189 - DNA, 20 bp, Saccharomyces cerevisiae
aaccctttaggaagcatcgg

SEQ ID NO: 10190 - DNA, 20 bp, Saccharomyces cerevisiae
cggataataaggggatccgt

SEQ ID NO: 10191 - DNA, 20 bp, Saccharomyces cerevisiae
attattcggccgttaattgg

SEQ ID NO: 10192 - DNA, 20 bp, Saccharomyces cerevisiae
cttccgccttagatctgcac

SEQ ID NO: 10193 - DNA, 20 bp, Saccharomyces cerevisiae
atttagaattcctcgcgggt

SEQ ID NO: 10194 - DNA, 20 bp, Saccharomyces cerevisiae
ggcgacattctcaaactggt

SEQ ID NO: 10195 - DNA, 20 bp, Saccharomyces cerevisiae
gagctttactgcacgttccc

SEQ ID NO: 10196 - DNA, 21 bp, Saccharomyces cerevisiae
tcgtcatcattgtcatctcca

SEQ ID NO: 10197 - DNA, 20 bp, Saccharomyces cerevisiae
gatcaaaccgtgtcaagcaa

SEQ ID NO: 10198 - DNA, 20 bp, Saccharomyces cerevisiae
agaatggggaatcaatggaa

SEQ ID NO: 10199 - DNA, 20 bp, Saccharomyces cerevisiae
atacaggggttgttggtgga

SEQ ID NO: 10200 - DNA, 20 bp, Saccharomyces cerevisiae
caccgttgagcaattgaaga

SEQ ID NO: 10201 - DNA, 20 bp, Saccharomyces cerevisiae
atgatgacaaagacccctgc

SEQ ID NO: 10202 - DNA, 20 bp, Saccharomyces cerevisiae
ttctactcccgtccaaccag

SEQ ID NO: 10203 - DNA, 20 bp, Saccharomyces cerevisiae
tgggcaatattttcctccac

SEQ ID NO: 10204 - DNA, 20 bp, Saccharomyces cerevisiae
gagttagaggcccagtcagc

SEQ ID NO: 10205 - DNA, 20 bp, Saccharomyces cerevisiae
tgaactgaggcctatccagg

SEQ ID NO: 10206 - DNA, 20 bp, Saccharomyces cerevisiae
gcgagacgggtattcaatca

SEQ ID NO: 10207 - DNA, 20 bp, Saccharomyces cerevisiae
agaccttgatttgccagtgc

SEQ ID NO: 10208 - DNA, 20 bp, Saccharomyces cerevisiae
gctggaagattggttccgta

SEQ ID NO: 10209 - DNA, 20 bp, Saccharomyces cerevisiae
agatagcacggtggctgagt

SEQ ID NO: 10210 - DNA, 20 bp, Saccharomyces cerevisiae
atagtacggtgccacggtgt

SEQ ID NO: 10211 - DNA, 25 bp, Saccharomyces cerevisiae
gagaaaagagagctagagaaaaggc

SEQ ID NO: 10212 - DNA, 20 bp, Saccharomyces cerevisiae
caacgccactgctaagaaca

SEQ ID NO: 10213 - DNA, 20 bp, Saccharomyces cerevisiae
tttgcctctgctttggaagt

SEQ ID NO: 10214 - DNA, 20 bp, Saccharomyces cerevisiae
gctgggtggctacgaataag

SEQ ID NO: 10215 - DNA, 21 bp, Saccharomyces cerevisiae
gaaaacctgaaccagattccc

SEQ ID NO: 10216 - DNA, 20 bp, Saccharomyces cerevisiae
ttacgttgcccaaaatgtca

SEQ ID NO: 10217 - DNA, 20 bp, Saccharomyces cerevisiae
ttatgtgacgaggccaaaaa

SEQ ID NO: 10218 - DNA, 20 bp, Saccharomyces cerevisiae
atttttccaggctccttggt

SEQ ID NO: 10219 - DNA, 20 bp, Saccharomyces cerevisiae
gttcctgcaagaatgcacaa

SEQ ID NO: 10220 - DNA, 20 bp, Saccharomyces cerevisiae
ccatcattccaaacccaaac

SEQ ID NO: 10221 - DNA, 20 bp, Saccharomyces cerevisiae
taaatccgtttgcaatgctg

SEQ ID NO: 10222 - DNA, 25 bp, Saccharomyces cerevisiae
aaagcaaaatgatgtcttctcaaat

SEQ ID NO: 10223 - DNA, 21 bp, Saccharomyces cerevisiae
ccgtgattctgagtttgaagc

SEQ ID NO: 10224 - DNA, 20 bp, Saccharomyces cerevisiae
aaaacggcaagaaccattga

SEQ ID NO: 10225 - DNA, 20 bp, Saccharomyces cerevisiae
tttcccgagctacaatgtcc

SEQ ID NO: 10226 - DNA, 20 bp, Saccharomyces cerevisiae
cgactggtcgcaagagtaga

SEQ ID NO: 10227 - DNA, 20 bp, Saccharomyces cerevisiae
aggggaggaatccaggatag

SEQ ID NO: 10228 - DNA, 20 bp, Saccharomyces cerevisiae
tgcaggaattccgactcttt

SEQ ID NO: 10229 - DNA, 21 bp, Saccharomyces cerevisiae
tccagaacctcactagccaga

SEQ ID NO: 10230 - DNA, 20 bp, Saccharomyces cerevisiae
agtccgattcacaaactggg

SEQ ID NO: 10231 - DNA, 21 bp, Saccharomyces cerevisiae
tttcctcgcagctatttttga

SEQ ID NO: 10232 - DNA, 20 bp, Saccharomyces cerevisiae
aacttgggaggaagctggtt

SEQ ID NO: 10233 - DNA, 20 bp, Saccharomyces cerevisiae
catggcaattagtgtgtggg

SEQ ID NO: 10234 - DNA, 20 bp, Saccharomyces cerevisiae
tgtacaccacagccttccag

SEQ ID NO: 10235 - DNA, 20 bp, Saccharomyces cerevisiae
caagctcagcagcttttcct

SEQ ID NO: 10236 - DNA, 20 bp, Saccharomyces cerevisiae
tctggcacaccttgtgagac

SEQ ID NO: 10237 - DNA, 20 bp, Saccharomyces cerevisiae
aaaaatgcccaaagcagaaa

SEQ ID NO: 10238 - DNA, 20 bp, Saccharomyces cerevisiae
gctgcggaatttcctgataa

SEQ ID NO: 10239 - DNA, 20 bp, Saccharomyces cerevisiae
cgttcggacctagctggtaa

SEQ ID NO: 10240 - DNA, 20 bp, Saccharomyces cerevisiae
tgcctaaatcccatggaaga

SEQ ID NO: 10241 - DNA, 20 bp, Saccharomyces cerevisiae
cttcttcaagggtgcctcag

SEQ ID NO: 10242 - DNA, 20 bp, Saccharomyces cerevisiae
atcgaagcattgccgaaata

SEQ ID NO: 10243 - DNA, 23 bp, Saccharomyces cerevisiae
ggactttcaagacaaaggaaaaa

SEQ ID NO: 10244 - DNA, 20 bp, Saccharomyces cerevisiae
tatctgtggctgtggcaaac

SEQ ID NO: 10245 - DNA, 20 bp, Saccharomyces cerevisiae
aaaggcacatttgggttacg

SEQ ID NO: 10246 - DNA, 20 bp, Saccharomyces cerevisiae
tgagaagaagccggttgact

SEQ ID NO: 10247 - DNA, 20 bp, Saccharomyces cerevisiae
caccctaaacacgccaaact

SEQ ID NO: 10248 - DNA, 20 bp, Saccharomyces cerevisiae
aaaattgtgcgttgcctttc

SEQ ID NO: 10249 - DNA, 20 bp, Saccharomyces cerevisiae
gcccacctatacatgatccg

SEQ ID NO: 10250 - DNA, 20 bp, Saccharomyces cerevisiae
tgcaaccatacaggaacctt

SEQ ID NO: 10251 - DNA, 22 bp, Saccharomyces cerevisiae
cgatggtcttttaccaatgaca

SEQ ID NO: 10252 - DNA, 20 bp, Saccharomyces cerevisiae
gatctttggtttccatccca

SEQ ID NO: 10253 - DNA, 20 bp, Saccharomyces cerevisiae
gcacagtcagcgactggtaa

SEQ ID NO: 10254 - DNA, 20 bp, Saccharomyces cerevisiae
aattcgagaggggagcaaag

SEQ ID NO: 10255 - DNA, 20 bp, Saccharomyces cerevisiae
gggtgtagaaagacgcaagc

SEQ ID NO: 10256 - DNA, 20 bp, Saccharomyces cerevisiae
gcctgttgcttttcttgagc

SEQ ID NO: 10257 - DNA, 22 bp, Saccharomyces cerevisiae
ttctactcttgctttgtcctgg

SEQ ID NO: 10258 - DNA, 20 bp, Saccharomyces cerevisiae
tgaacgaagaagtcgagcaa

SEQ ID NO: 10259 - DNA, 21 bp, Saccharomyces cerevisiae
tgaatcagcaaatgtttccct

SEQ ID NO: 10260 - DNA, 20 bp, Saccharomyces cerevisiae
acagagtcggtgaatttggg

SEQ ID NO: 10261 - DNA, 20 bp, Saccharomyces cerevisiae
gataacaggttttggggcct

SEQ ID NO: 10262 - DNA, 20 bp, Saccharomyces cerevisiae
tgggacaaggctggttattt

SEQ ID NO: 10263 - DNA, 20 bp, Saccharomyces cerevisiae
gggaagcacaatctttagcg

SEQ ID NO: 10264 - DNA, 20 bp, Saccharomyces cerevisiae
gaaaaagacggtaatgccga

SEQ ID NO: 10265 - DNA, 20 bp, Saccharomyces cerevisiae
aaatcctgaagccgaaggtt

SEQ ID NO: 10266 - DNA, 20 bp, Saccharomyces cerevisiae
cccatcgcttctttatgagc

SEQ ID NO: 10267 - DNA, 20 bp, Saccharomyces cerevisiae
cactgaaaggtgcgatgcta

SEQ ID NO: 10268 - DNA, 20 bp, Saccharomyces cerevisiae
tttgtgcatagaagcgttcg

SEQ ID NO: 10269 - DNA, 20 bp, Saccharomyces cerevisiae
tgtagcgcgcttaaatgaac

SEQ ID NO: 10270 - DNA, 20 bp, Saccharomyces cerevisiae
gagcttgaattggaagcaca

SEQ ID NO: 10271 - DNA, 20 bp, Saccharomyces cerevisiae
gcagtaggttgctgtcctcc

SEQ ID NO: 10272 - DNA, 20 bp, Saccharomyces cerevisiae
ggaagaatggaccgactcaa

SEQ ID NO: 10273 - DNA, 26 bp, Saccharomyces cerevisiae
tgggtatgaacttttattttcaactg

SEQ ID NO: 10274 - DNA, 20 bp, Saccharomyces cerevisiae
ggaaaacgctaccaaagacg

SEQ ID NO: 10275 - DNA, 20 bp, Saccharomyces cerevisiae
tcgcggacagtagagatgtg

SEQ ID NO: 10276 - DNA, 20 bp, Saccharomyces cerevisiae
tcaaagcatcattgaatcgc

SEQ ID NO: 10277 - DNA, 20 bp, Saccharomyces cerevisiae
cgctactgcctcaaatcctc

SEQ ID NO: 10278 - DNA, 20 bp, Saccharomyces cerevisiae
agttcgtggcataagatggg

SEQ ID NO: 10279 - DNA, 20 bp, Saccharomyces cerevisiae
gtgccgtagctcggttagaa

SEQ ID NO: 10280 - DNA, 21 bp, Saccharomyces cerevisiae
catattggcctaatttctcgc

SEQ ID NO: 10281 - DNA, 20 bp, Saccharomyces cerevisiae
aaccaaaaatcgagacgtgg

SEQ ID NO: 10282 - DNA, 20 bp, Saccharomyces cerevisiae
taaacgcgactcattcaacg

SEQ ID NO: 10283 - DNA, 23 bp, Saccharomyces cerevisiae
aacttgaaatattgccattctct

SEQ ID NO: 10284 - DNA, 20 bp, Saccharomyces cerevisiae
aaatatcctggtcgtgtggc

SEQ ID NO: 10285 - DNA, 20 bp, Saccharomyces cerevisiae
ccccacctttctacacctca

SEQ ID NO: 10286 - DNA, 20 bp, Saccharomyces cerevisiae
cggttcttcaactgacaacg

SEQ ID NO: 10287 - DNA, 20 bp, Saccharomyces cerevisiae
tcagatgctgatgaaggctg

SEQ ID NO: 10288 - DNA, 20 bp, Saccharomyces cerevisiae
gaaaaacactgcattgctcg

SEQ ID NO: 10289 - DNA, 20 bp, Saccharomyces cerevisiae
gtggaccttgagactttgcc

SEQ ID NO: 10290 - DNA, 20 bp, Saccharomyces cerevisiae
agtgttattcatcgggctgg

SEQ ID NO: 10291 - DNA, 20 bp, Saccharomyces cerevisiae
gttgggaggagtctgcattc

SEQ ID NO: 10292 - DNA, 20 bp, Saccharomyces cerevisiae
atacagagcatcgcctccag

SEQ ID NO: 10293 - DNA, 20 bp, Saccharomyces cerevisiae
tcaagacgatgtcttcgcaa

SEQ ID NO: 10294 - DNA, 20 bp, Saccharomyces cerevisiae
cttttgctgttaccgccatt

SEQ ID NO: 10295 - DNA, 20 bp, Saccharomyces cerevisiae
gagggcgactcataggaatg

SEQ ID NO: 10296 - DNA, 20 bp, Saccharomyces cerevisiae
tgaggacattcctaccaggg

SEQ ID NO: 10297 - DNA, 20 bp, Saccharomyces cerevisiae
acccccttcaacgctagaat

SEQ ID NO: 10298 - DNA, 20 bp, Saccharomyces cerevisiae
gaaacagcacatgtcggaga

SEQ ID NO: 10299 - DNA, 20 bp, Saccharomyces cerevisiae
tggggaaggagaatcagaaa

SEQ ID NO: 10300 - DNA, 20 bp, Saccharomyces cerevisiae
catagtcggtattcgcagcc

SEQ ID NO: 10301 - DNA, 20 bp, Saccharomyces cerevisiae
gagatcatttggggcatcat

SEQ ID NO: 10302 - DNA, 20 bp, Saccharomyces cerevisiae
gcctagcaatcggtttagca

SEQ ID NO: 10303 - DNA, 20 bp, Saccharomyces cerevisiae
cttgttgaaaggcttcctgg

SEQ ID NO: 10304 - DNA, 20 bp, Saccharomyces cerevisiae
tgcctctttaatggcatcct

SEQ ID NO: 10305 - DNA, 21 bp, Saccharomyces cerevisiae
agcgtgataatctggtggatg

SEQ ID NO: 10306 - DNA, 20 bp, Saccharomyces cerevisiae
gtcgcaaccttccacatttt

SEQ ID NO: 10307 - DNA, 20 bp, Saccharomyces cerevisiae
gtggaatcgcggtttatttg

SEQ ID NO: 10308 - DNA, 20 bp, Saccharomyces cerevisiae
agggcattccgggtattatc

SEQ ID NO: 10309 - DNA, 21 bp, Saccharomyces cerevisiae
gcctcagctccttcaatcttt

SEQ ID NO: 10310 - DNA, 20 bp, Saccharomyces cerevisiae
cgttttgcaaagccacagta

SEQ ID NO: 10311 - DNA, 23 bp, Saccharomyces cerevisiae
ggaatcagattttatcgtagggg

SEQ ID NO: 10312 - DNA, 21 bp, Saccharomyces cerevisiae
gaaccaattgcttgtccaaaa

SEQ ID NO: 10313 - DNA, 20 bp, Saccharomyces cerevisiae
cctgacaatttgcccgttat

SEQ ID NO: 10314 - DNA, 20 bp, Saccharomyces cerevisiae
gtcccgaaatcagcacagtt

SEQ ID NO: 10315 - DNA, 20 bp, Saccharomyces cerevisiae
gaacggcggtctgttgtaat

SEQ ID NO: 10316 - DNA, 20 bp, Saccharomyces cerevisiae
ccttgacgccaactgttttt

SEQ ID NO: 10317 - DNA, 20 bp, Saccharomyces cerevisiae
ggaagggaagggaagagaaa

SEQ ID NO: 10318 - DNA, 20 bp, Saccharomyces cerevisiae
aaatgcgattgatgccttgt

SEQ ID NO: 10319 - DNA, 20 bp, Saccharomyces cerevisiae
gaaatcattgcggaagttcg

SEQ ID NO: 10320 - DNA, 20 bp, Saccharomyces cerevisiae
catcaatgctatgagtgccg

SEQ ID NO: 10321 - DNA, 20 bp, Saccharomyces cerevisiae
gagtgttgccatcgatttcc

SEQ ID NO: 10322 - DNA, 20 bp, Saccharomyces cerevisiae
ctggtctggggcttactgag

SEQ ID NO: 10323 - DNA, 20 bp, Saccharomyces cerevisiae
ctcaaatgcaacaacatccg

SEQ ID NO: 10324 - DNA, 20 bp, Saccharomyces cerevisiae
agaatgtttggtggccatgt

SEQ ID NO: 10325 - DNA, 20 bp, Saccharomyces cerevisiae
tgctcttgaaatgaaaacgg

SEQ ID NO: 10326 - DNA, 20 bp, Saccharomyces cerevisiae
ggtccccataaaaacaagca

SEQ ID NO: 10327 - DNA, 20 bp, Saccharomyces cerevisiae
actcgacgaggactaacgga

SEQ ID NO: 10328 - DNA, 20 bp, Saccharomyces cerevisiae
catgttcagccgggtatctt

SEQ ID NO: 10329 - DNA, 20 bp, Saccharomyces cerevisiae
gcttggaacgaagaggttga

SEQ ID NO: 10330 - DNA, 22 bp, Saccharomyces cerevisiae
ttcttctggacagagttcatgc

SEQ ID NO: 10331 - DNA, 20 bp, Saccharomyces cerevisiae
caaatgggatccagccataa

SEQ ID NO: 10332 - DNA, 20 bp, Saccharomyces cerevisiae
tcgaagtaaatcgaaacggc

SEQ ID NO: 10333 - DNA, 20 bp, Saccharomyces cerevisiae
aggctcacgaaattacacgg

SEQ ID NO: 10334 - DNA, 20 bp, Saccharomyces cerevisiae
ggatgtagccaccgactctg

SEQ ID NO: 10335 - DNA, 20 bp, Saccharomyces cerevisiae
acgattcaaactccaagggt

SEQ ID NO: 10336 - DNA, 20 bp, Saccharomyces cerevisiae
tgcatcggagaattgttgaa

SEQ ID NO: 10337 - DNA, 20 bp, Saccharomyces cerevisiae
tgccatgacatttctaagcg

SEQ ID NO: 10338 - DNA, 20 bp, Saccharomyces cerevisiae
ttgacgaagatggtaagggc

SEQ ID NO: 10339 - DNA, 21 bp, Saccharomyces cerevisiae
cggtactctagctaacgcgaa

SEQ ID NO: 10340 - DNA, 20 bp, Saccharomyces cerevisiae
caagggttcggtgttgctat

SEQ ID NO: 10341 - DNA, 20 bp, Saccharomyces cerevisiae
ctatcgcttggacggaaaag

SEQ ID NO: 10342 - DNA, 20 bp, Saccharomyces cerevisiae
tccctcaacaacaaaggagg

SEQ ID NO: 10343 - DNA, 20 bp, Saccharomyces cerevisiae
ggtccaatgagttggaatgg

SEQ ID NO: 10344 - DNA, 20 bp, Saccharomyces cerevisiae
ggcctgtcatggtagcgtat

SEQ ID NO: 10345 - DNA, 20 bp, Saccharomyces cerevisiae
ttcactggagtatctggggc

SEQ ID NO: 10346 - DNA, 20 bp, Saccharomyces cerevisiae
agaaatgttcgctcatcggt

SEQ ID NO: 10347 - DNA, 20 bp, Saccharomyces cerevisiae
agttttatggcacgacctgg

SEQ ID NO: 10348 - DNA, 20 bp, Saccharomyces cerevisiae
agttgatcgtacagagggcg

SEQ ID NO: 10349 - DNA, 20 bp, Saccharomyces cerevisiae
gccgctgtgttattaccgtt

SEQ ID NO: 10350 - DNA, 20 bp, Saccharomyces cerevisiae
gtggctttggggatactgaa

SEQ ID NO: 10351 - DNA, 21 bp, Saccharomyces cerevisiae
agcaaaacttgacggagttca

SEQ ID NO: 10352 - DNA, 20 bp, Saccharomyces cerevisiae
ccaagccaagccagataaaa

SEQ ID NO: 10353 - DNA, 20 bp, Saccharomyces cerevisiae
cgcttttgaaaaatgcccta

SEQ ID NO: 10354 - DNA, 23 bp, Saccharomyces cerevisiae
aatttgtggaaaaagaccaacaa

SEQ ID NO: 10355 - DNA, 20 bp, Saccharomyces cerevisiae
aaaaatatcccaaccagcca

SEQ ID NO: 10356 - DNA, 20 bp, Saccharomyces cerevisiae
atagtgcacttgctgatgcg

SEQ ID NO: 10357 - DNA, 20 bp, Saccharomyces cerevisiae
ctcttcctttctggcctcgt

SEQ ID NO: 10358 - DNA, 20 bp, Saccharomyces cerevisiae
ctgtcataacgcgtggtgtt

SEQ ID NO: 10359 - DNA, 20 bp, Saccharomyces cerevisiae
ctggagagaccatgtgggtt

SEQ ID NO: 10360 - DNA, 20 bp, Saccharomyces cerevisiae
ggcttttcggactcatacca

SEQ ID NO: 10361 - DNA, 26 bp, Saccharomyces cerevisiae
gcaataattttaaacggtttgataca

SEQ ID NO: 10362 - DNA, 21 bp, Saccharomyces cerevisiae
agctcaaggaaatgcatgaag

SEQ ID NO: 10363 - DNA, 20 bp, Saccharomyces cerevisiae
ccttcaacgccagacttacc

SEQ ID NO: 10364 - DNA, 20 bp, Saccharomyces cerevisiae
ttttgtggcatttttgttgg

SEQ ID NO: 10365 - DNA, 20 bp, Saccharomyces cerevisiae
tcgttgttcttgacacccaa

SEQ ID NO: 10366 - DNA, 20 bp, Saccharomyces cerevisiae
tctcgggaaacttctggatg

SEQ ID NO: 10367 - DNA, 20 bp, Saccharomyces cerevisiae
tggatttgctttgggacttc

SEQ ID NO: 10368 - DNA, 20 bp, Saccharomyces cerevisiae
tgatgcaatcgctgaggata

SEQ ID NO: 10369 - DNA, 21 bp, Saccharomyces cerevisiae
aaaattgggaaagtcctcgaa

SEQ ID NO: 10370 - DNA, 20 bp, Saccharomyces cerevisiae
ttccggttataagggatgct

SEQ ID NO: 10371 - DNA, 20 bp, Saccharomyces cerevisiae
gtattcatggggcaaaccac

SEQ ID NO: 10372 - DNA, 20 bp, Saccharomyces cerevisiae
tataaccagcggcgagtttc

SEQ ID NO: 10373 - DNA, 20 bp, Saccharomyces cerevisiae
ttatgggcggctaatcaaac

SEQ ID NO: 10374 - DNA, 20 bp, Saccharomyces cerevisiae
cgcaactaaatgagcaccac

SEQ ID NO: 10375 - DNA, 20 bp, Saccharomyces cerevisiae
aatttggtgtgggacacgtt

SEQ ID NO: 10376 - DNA, 20 bp, Saccharomyces cerevisiae
ccgtgatgctggtaagattg

SEQ ID NO: 10377 - DNA, 20 bp, Saccharomyces cerevisiae
cccgtcatcgtacaatctcc

SEQ ID NO: 10378 - DNA, 20 bp, Saccharomyces cerevisiae
ccaactgaactatggcgtga

SEQ ID NO: 10379 - DNA, 20 bp, Saccharomyces cerevisiae
tcagtttgaaaatgcaccga

SEQ ID NO: 10380 - DNA, 20 bp, Saccharomyces cerevisiae
tgctggaaaccagggaatag

SEQ ID NO: 10381 - DNA, 20 bp, Saccharomyces cerevisiae
ttgccgctttttgactttct

SEQ ID NO: 10382 - DNA, 22 bp, Saccharomyces cerevisiae
caatgtttatgatttccgaacc

SEQ ID NO: 10383 - DNA, 20 bp, Saccharomyces cerevisiae
tgaagctcacaagaagccaa

SEQ ID NO: 10384 - DNA, 20 bp, Saccharomyces cerevisiae
ggcgatcgcatagtaaaagc

SEQ ID NO: 10385 - DNA, 20 bp, Saccharomyces cerevisiae
tgttgacgaagacggttttg

SEQ ID NO: 10386 - DNA, 20 bp, Saccharomyces cerevisiae
tcaagggagttggaacgact

SEQ ID NO: 10387 - DNA, 20 bp, Saccharomyces cerevisiae
aattgaaatgggatcatggc

SEQ ID NO: 10388 - DNA, 20 bp, Saccharomyces cerevisiae
ttggagaatggtagcctggt

SEQ ID NO: 10389 - DNA, 20 bp, Saccharomyces cerevisiae
acgcattcacaggtcaacaa

SEQ ID NO: 10390 - DNA, 20 bp, Saccharomyces cerevisiae
ccgctggaacgttgtaaact

SEQ ID NO: 10391 - DNA, 21 bp, Saccharomyces cerevisiae
tgattccactggttttaccga

SEQ ID NO: 10392 - DNA, 20 bp, Saccharomyces cerevisiae
atattctggtgcgattccga

SEQ ID NO: 10393 - DNA, 20 bp, Saccharomyces cerevisiae
caattgcgaatattctcccc

SEQ ID NO: 10394 - DNA, 20 bp, Saccharomyces cerevisiae
attcaccaacctctcatggc

SEQ ID NO: 10395 - DNA, 21 bp, Saccharomyces cerevisiae
gacggagctatcaaatgacca

SEQ ID NO: 10396 - DNA, 20 bp, Saccharomyces cerevisiae
gtaatggcggcttctttcag

SEQ ID NO: 10397 - DNA, 20 bp, Saccharomyces cerevisiae
ccaatctgggtgcttcaagt

SEQ ID NO: 10398 - DNA, 20 bp, Saccharomyces cerevisiae
caaggtttgcaatcccatct

SEQ ID NO: 10399 - DNA, 20 bp, Saccharomyces cerevisiae
aaaagcagaggctccaaaca

SEQ ID NO: 10400 - DNA, 20 bp, Saccharomyces cerevisiae
ggttgggtgcttaaaccaga

SEQ ID NO: 10401 - DNA, 22 bp, Saccharomyces cerevisiae
aaccggacatcagtgtctacaa

SEQ ID NO: 10402 - DNA, 20 bp, Saccharomyces cerevisiae
gaaagacttagcggatccca

SEQ ID NO: 10403 - DNA, 20 bp, Saccharomyces cerevisiae
gcaccagccaaggctaataa

SEQ ID NO: 10404 - DNA, 20 bp, Saccharomyces cerevisiae
tgatgcctcggtactgttga

SEQ ID NO: 10405 - DNA, 20 bp, Saccharomyces cerevisiae
cagaaatgggcttcaacgat

SEQ ID NO: 10406 - DNA, 20 bp, Saccharomyces cerevisiae
tgtctgcaaaaatggtgcat

SEQ ID NO: 10407 - DNA, 21 bp, Saccharomyces cerevisiae
tccctcgttcactatgagacc

SEQ ID NO: 10408 - DNA, 20 bp, Saccharomyces cerevisiae
cgagcataaggagccaaaag

SEQ ID NO: 10409 - DNA, 21 bp, Saccharomyces cerevisiae
tcaccgaatttaccaaacaca

SEQ ID NO: 10410 - DNA, 20 bp, Saccharomyces cerevisiae
ttcgggttttgaggtgtagc

SEQ ID NO: 10411 - DNA, 20 bp, Saccharomyces cerevisiae
gtgatactgcggtctggctt

SEQ ID NO: 10412 - DNA, 23 bp, Saccharomyces cerevisiae
cctctaaaggttccgtagattgg

SEQ ID NO: 10413 - DNA, 20 bp, Saccharomyces cerevisiae
caagggatttttccctggtt

SEQ ID NO: 10414 - DNA, 20 bp, Saccharomyces cerevisiae
aacatcctttgcacgcttct

SEQ ID NO: 10415 - DNA, 20 bp, Saccharomyces cerevisiae
ccgaaggtttgccagttaaa

SEQ ID NO: 10416 - DNA, 20 bp, Saccharomyces cerevisiae
aactgagtcgcaatcaatgg

SEQ ID NO: 10417 - DNA, 20 bp, Saccharomyces cerevisiae
aagaaagggttttctttgcg

SEQ ID NO: 10418 - DNA, 20 bp, Saccharomyces cerevisiae
ctgcaggtatgtgcaggaga

SEQ ID NO: 10419 - DNA, 20 bp, Saccharomyces cerevisiae
tttgcccgtgttgatgatta

SEQ ID NO: 10420 - DNA, 20 bp, Saccharomyces cerevisiae
gggaagtcgcaatatccttg

SEQ ID NO: 10421 - DNA, 24 bp, Saccharomyces cerevisiae
tttttcttcatcgtttcttttcaa

SEQ ID NO: 10422 - DNA, 20 bp, Saccharomyces cerevisiae
ttattggagcctcggatttg

SEQ ID NO: 10423 - DNA, 20 bp, Saccharomyces cerevisiae
ggatgatctgatgtgaccca

SEQ ID NO: 10424 - DNA, 20 bp, Saccharomyces cerevisiae
cgccagggtaataatgagga

SEQ ID NO: 10425 - DNA, 20 bp, Saccharomyces cerevisiae
gcagaaaagtcgttcaagcc

SEQ ID NO: 10426 - DNA, 20 bp, Saccharomyces cerevisiae
cgggtgcctttctctaaaac

SEQ ID NO: 10427 - DNA, 20 bp, Saccharomyces cerevisiae
tcgaggctatttgatgaccc

SEQ ID NO: 10428 - DNA, 22 bp, Saccharomyces cerevisiae
ttttcgttaccttggatttcct

SEQ ID NO: 10429 - DNA, 20 bp, Saccharomyces cerevisiae
tcaacacatctttctcgcgt

SEQ ID NO: 10430 - DNA, 21 bp, Saccharomyces cerevisiae
aaacgggcttttgaataagga

SEQ ID NO: 10431 - DNA, 20 bp, Saccharomyces cerevisiae
tagtccaaagaaagtgccgc

SEQ ID NO: 10432 - DNA, 20 bp, Saccharomyces cerevisiae
actgtttgggcagaaggaga

SEQ ID NO: 10433 - DNA, 20 bp, Saccharomyces cerevisiae
cgtaaagacaaaatcgtccg

SEQ ID NO: 10434 - DNA, 20 bp, Saccharomyces cerevisiae
tgaatgcagtcctgaagctg

SEQ ID NO: 10435 - DNA, 20 bp, Saccharomyces cerevisiae
gatctttgtttgaaggcgct

SEQ ID NO: 10436 - DNA, 21 bp, Saccharomyces cerevisiae
aagacattctcctcaaggggt

SEQ ID NO: 10437 - DNA, 20 bp, Saccharomyces cerevisiae
gagagaaacaaagcgccaac

SEQ ID NO: 10438 - DNA, 20 bp, Saccharomyces cerevisiae
ttgctagtgaaacagctgcc

SEQ ID NO: 10439 - DNA, 20 bp, Saccharomyces cerevisiae
tagctattgaggtcccacgc

SEQ ID NO: 10440 - DNA, 20 bp, Saccharomyces cerevisiae
gcttggcttgtaaagcttgg

SEQ ID NO: 10441 - DNA, 20 bp, Saccharomyces cerevisiae
caattccccaggaagttgaa

SEQ ID NO: 10442 - DNA, 20 bp, Saccharomyces cerevisiae
tgagaaaagcatgcgaaatg

SEQ ID NO: 10443 - DNA, 20 bp, Saccharomyces cerevisiae
ttcagaggaacttcggttgg

SEQ ID NO: 10444 - DNA, 20 bp, Saccharomyces cerevisiae
cagcggttgacttgggtaat

SEQ ID NO: 10445 - DNA, 20 bp, Saccharomyces cerevisiae
ttatgccctccctgaaagtg

SEQ ID NO: 10446 - DNA, 23 bp, Saccharomyces cerevisiae
caaaatgaaaggaaaaatgttcg

SEQ ID NO: 10447 - DNA, 22 bp, Saccharomyces cerevisiae
ttgccaatgaattcctgaaaat

SEQ ID NO: 10448 - DNA, 20 bp, Saccharomyces cerevisiae
tttaacccaccatatgtgcc

SEQ ID NO: 10449 - DNA, 20 bp, Saccharomyces cerevisiae
ccaggatcgtctcaggctta

SEQ ID NO: 10450 - DNA, 20 bp, Saccharomyces cerevisiae
tgcgaatcagatcctacggt

SEQ ID NO: 10451 - DNA, 20 bp, Saccharomyces cerevisiae
ggtaccatcatcaccccaac

SEQ ID NO: 10452 - DNA, 20 bp, Saccharomyces cerevisiae
atggcaaaaatcggttcaaa

SEQ ID NO: 10453 - DNA, 20 bp, Saccharomyces cerevisiae
ctgtgtctagccttcctggc

SEQ ID NO: 10454 - DNA, 20 bp, Saccharomyces cerevisiae
gagaaacttgcatgggtggt

SEQ ID NO: 10455 - DNA, 20 bp, Saccharomyces cerevisiae
tgaatttcccttccgatttg

SEQ ID NO: 10456 - DNA, 20 bp, Saccharomyces cerevisiae
ggcccttggtttgatttctt

SEQ ID NO: 10457 - DNA, 20 bp, Saccharomyces cerevisiae
gaattttgcatagcgggaaa

SEQ ID NO: 10458 - DNA, 20 bp, Saccharomyces cerevisiae
cctcgagtggcaagttttgt

SEQ ID NO: 10459 - DNA, 20 bp, Saccharomyces cerevisiae
cgtcgtcaccgttattgttg

SEQ ID NO: 10460 - DNA, 20 bp, Saccharomyces cerevisiae
aggttcagtcaactgtggca

SEQ ID NO: 10461 - DNA, 20 bp, Saccharomyces cerevisiae
atatgtttgggtgtgcccat

SEQ ID NO: 10462 - DNA, 20 bp, Saccharomyces cerevisiae
ttagggctcctactgtcggt

SEQ ID NO: 10463 - DNA, 20 bp, Saccharomyces cerevisiae
aaaattggatggttcgttcg

SEQ ID NO: 10464 - DNA, 20 bp, Saccharomyces cerevisiae
gcagcacctgcatactacca

SEQ ID NO: 10465 - DNA, 19 bp, Saccharomyces cerevisiae
acgtcgcgttcggacttta

SEQ ID NO: 10466 - DNA, 20 bp, Saccharomyces cerevisiae
tgaggaaattgagtctgccc

SEQ ID NO: 10467 - DNA, 20 bp, Saccharomyces cerevisiae
cccgactaatgaggtcgttc

SEQ ID NO: 10468 - DNA, 20 bp, Saccharomyces cerevisiae
tctttaaggccatctcggac

SEQ ID NO: 10469 - DNA, 20 bp, Saccharomyces cerevisiae
cattcttgagagtctccggc

SEQ ID NO: 10470 - DNA, 20 bp, Saccharomyces cerevisiae
gctgtgagtctttgcttccc

SEQ ID NO: 10471 - DNA, 20 bp, Saccharomyces cerevisiae
caaaaacttggctggtgttg

SEQ ID NO: 10472 - DNA, 20 bp, Saccharomyces cerevisiae
ggtccgtgatgtgagtgttg

SEQ ID NO: 10473 - DNA, 20 bp, Saccharomyces cerevisiae
aactgtatgcccgcaaagat

SEQ ID NO: 10474 - DNA, 20 bp, Saccharomyces cerevisiae
tggcttttggttttccttgt

SEQ ID NO: 10475 - DNA, 20 bp, Saccharomyces cerevisiae
atggcgaattcgaaaaattg

SEQ ID NO: 10476 - DNA, 20 bp, Saccharomyces cerevisiae
tccagaggaactttggagga

SEQ ID NO: 10477 - DNA, 20 bp, Saccharomyces cerevisiae
cacagcctgtagacaatgcc

SEQ ID NO: 10478 - DNA, 20 bp, Saccharomyces cerevisiae
ataccagccactgccatttc

SEQ ID NO: 10479 - DNA, 20 bp, Saccharomyces cerevisiae
ctcttcagcaccctctttgg

SEQ ID NO: 10480 - DNA, 20 bp, Saccharomyces cerevisiae
cgtttgccatgatctaccct

SEQ ID NO: 10481 - DNA, 20 bp, Saccharomyces cerevisiae
atttgcagcggtggtaaaaa

SEQ ID NO: 10482 - DNA, 21 bp, Saccharomyces cerevisiae
catggtgtaaaaaggtccacg

SEQ ID NO: 10483 - DNA, 20 bp, Saccharomyces cerevisiae
tcaggcattggatttccttc

SEQ ID NO: 10484 - DNA, 20 bp, Saccharomyces cerevisiae
ccatctctttcgccagtctc

SEQ ID NO: 10485 - DNA, 20 bp, Saccharomyces cerevisiae
cggcagtttcagctttgttt

SEQ ID NO: 10486 - DNA, 20 bp, Saccharomyces cerevisiae
atctgccggtggtaactacg

SEQ ID NO: 10487 - DNA, 20 bp, Saccharomyces cerevisiae
gagtttgaagccacctctgc

SEQ ID NO: 10488 - DNA, 20 bp, Saccharomyces cerevisiae
atccggttcgtcatatctgc

SEQ ID NO: 10489 - DNA, 21 bp, Saccharomyces cerevisiae
cgaactaacgaaatccagacg

SEQ ID NO: 10490 - DNA, 20 bp, Saccharomyces cerevisiae
tgaaaattcggaggaagagg

SEQ ID NO: 10491 - DNA, 20 bp, Saccharomyces cerevisiae
aataggtgcgtggactctgg

SEQ ID NO: 10492 - DNA, 20 bp, Saccharomyces cerevisiae
gaagaacaagagctggacgg

SEQ ID NO: 10493 - DNA, 20 bp, Saccharomyces cerevisiae
tggctacgttggatcctttc

SEQ ID NO: 10494 - DNA, 20 bp, Saccharomyces cerevisiae
cgtattacgatgaccttcgg

SEQ ID NO: 10495 - DNA, 20 bp, Saccharomyces cerevisiae
tctcacgggttcttaatcgg

SEQ ID NO: 10496 - DNA, 20 bp, Saccharomyces cerevisiae
agtgtacgggacattttcgc

SEQ ID NO: 10497 - DNA, 20 bp, Saccharomyces cerevisiae
gccacatcgacgtttctttt

SEQ ID NO: 10498 - DNA, 20 bp, Saccharomyces cerevisiae
tgctttgttactcggtgtgc

SEQ ID NO: 10499 - DNA, 20 bp, Saccharomyces cerevisiae
tgaagcttctaaattggccg

SEQ ID NO: 10500 - DNA, 20 bp, Saccharomyces cerevisiae
tttggggagaaaaagcagaa

SEQ ID NO: 10501 - DNA, 20 bp, Saccharomyces cerevisiae
tccctggaatttagtgcgtc

SEQ ID NO: 10502 - DNA, 20 bp, Saccharomyces cerevisiae
gttcgactttgtggagggtg

SEQ ID NO: 10503 - DNA, 20 bp, Saccharomyces cerevisiae
gaggaggaatgatgagtgcc

SEQ ID NO: 10504 - DNA, 20 bp, Saccharomyces cerevisiae
gtggatcatatggggcaaac

SEQ ID NO: 10505 - DNA, 21 bp, Saccharomyces cerevisiae
gcaactggtaggaggatatgg

SEQ ID NO: 10506 - DNA, 20 bp, Saccharomyces cerevisiae
acgccggtgttattgtgttt

SEQ ID NO: 10507 - DNA, 20 bp, Saccharomyces cerevisiae
tcagacggtaaattagcccg

SEQ ID NO: 10508 - DNA, 20 bp, Saccharomyces cerevisiae
cagatggattggcttggttt

SEQ ID NO: 10509 - DNA, 20 bp, Saccharomyces cerevisiae
ggatacgctttcgcatgaat

SEQ ID NO: 10510 - DNA, 20 bp, Saccharomyces cerevisiae
ttagggttatgcatgggtgg

SEQ ID NO: 10511 - DNA, 19 bp, Saccharomyces cerevisiae
cgcgagcagcttcatgtat

SEQ ID NO: 10512 - DNA, 20 bp, Saccharomyces cerevisiae
ggaccagtttccgacctgta

SEQ ID NO: 10513 - DNA, 20 bp, Saccharomyces cerevisiae
gctcctttgtgcctaagtgg

SEQ ID NO: 10514 - DNA, 20 bp, Saccharomyces cerevisiae
ccaagcgatggttcaaagat

SEQ ID NO: 10515 - DNA, 20 bp, Saccharomyces cerevisiae
tcgaccaggtagtattcgcc

SEQ ID NO: 10516 - DNA, 21 bp, Saccharomyces cerevisiae
cgaatcgtatatgaccaaggc

SEQ ID NO: 10517 - DNA, 20 bp, Saccharomyces cerevisiae
tcaagcagtggaaactgtcg

SEQ ID NO: 10518 - DNA, 20 bp, Saccharomyces cerevisiae
aagcggaggtgtgatttgtt

SEQ ID NO: 10519 - DNA, 20 bp, Saccharomyces cerevisiae
ctggagaggttatcaaggcg

SEQ ID NO: 10520 - DNA, 20 bp, Saccharomyces cerevisiae
aatttccgattgaatctgcg

SEQ ID NO: 10521 - DNA, 20 bp, Saccharomyces cerevisiae
tcctgtggaagggaatcttg

SEQ ID NO: 10522 - DNA, 20 bp, Saccharomyces cerevisiae
gatatcttggaagaacggcg

SEQ ID NO: 10523 - DNA, 20 bp, Saccharomyces cerevisiae
tggacctctttggtcagtca

SEQ ID NO: 10524 - DNA, 20 bp, Saccharomyces cerevisiae
ccaattgatgtgccttgcta

SEQ ID NO: 10525 - DNA, 20 bp, Saccharomyces cerevisiae
tctggataaggccagctgaa

SEQ ID NO: 10526 - DNA, 20 bp, Saccharomyces cerevisiae
gcctacattacttcgctcgc

SEQ ID NO: 10527 - DNA, 20 bp, Saccharomyces cerevisiae
ccaggccactagtcttgctt

SEQ ID NO: 10528 - DNA, 20 bp, Saccharomyces cerevisiae
gccgccatgctactatgatt

SEQ ID NO: 10529 - DNA, 20 bp, Saccharomyces cerevisiae
tcactctggcgtgctatgac

SEQ ID NO: 10530 - DNA, 20 bp, Saccharomyces cerevisiae
tccttgattcagataccggg

SEQ ID NO: 10531 - DNA, 20 bp, Saccharomyces cerevisiae
ttttgctcttgtcccaatca

SEQ ID NO: 10532 - DNA, 20 bp, Saccharomyces cerevisiae
cacatcaccattaacggcac

SEQ ID NO: 10533 - DNA, 20 bp, Saccharomyces cerevisiae
gcagattcactgctccaaca

SEQ ID NO: 10534 - DNA, 20 bp, Saccharomyces cerevisiae
caacccataacagccagctt

SEQ ID NO: 10535 - DNA, 20 bp, Saccharomyces cerevisiae
ccaccatgcattatcgtctg

SEQ ID NO: 10536 - DNA, 20 bp, Saccharomyces cerevisiae
gaccaaaggaatgtcgccta

SEQ ID NO: 10537 - DNA, 20 bp, Saccharomyces cerevisiae
gacagaaggccagaagatgg

SEQ ID NO: 10538 - DNA, 20 bp, Saccharomyces cerevisiae
atctcgcaaaggtccgttag

SEQ ID NO: 10539 - DNA, 20 bp, Saccharomyces cerevisiae
actttccatgtcgccagaag

SEQ ID NO: 10540 - DNA, 20 bp, Saccharomyces cerevisiae
tgcaattccagaaaacgaaa

SEQ ID NO: 10541 - DNA, 20 bp, Saccharomyces cerevisiae
ctgtgccgttcctaaagctc

SEQ ID NO: 10542 - DNA, 20 bp, Saccharomyces cerevisiae
actcttccagcaattgcacc

SEQ ID NO: 10543 - DNA, 20 bp, Saccharomyces cerevisiae
ggaaccgttgtcggatacag

SEQ ID NO: 10544 - DNA, 20 bp, Saccharomyces cerevisiae
ggcatctttcgtgggttaga

SEQ ID NO: 10545 - DNA, 20 bp, Saccharomyces cerevisiae
aaaatggccacagttggttc

SEQ ID NO: 10546 - DNA, 22 bp, Saccharomyces cerevisiae
ctgtctctgttttggtcgacag

SEQ ID NO: 10547 - DNA, 20 bp, Saccharomyces cerevisiae
aattttcgctgttccaccac

SEQ ID NO: 10548 - DNA, 20 bp, Saccharomyces cerevisiae
tgtgagtcctggtttgttgc

SEQ ID NO: 10549 - DNA, 25 bp, Saccharomyces cerevisiae
aaaaagtacagacaaggaaacgaaa

SEQ ID NO: 10550 - DNA, 20 bp, Saccharomyces cerevisiae
gcacagttgttgtcgtctgc

SEQ ID NO: 10551 - DNA, 20 bp, Saccharomyces cerevisiae
tggatcgaaagaagggtgac

SEQ ID NO: 10552 - DNA, 20 bp, Saccharomyces cerevisiae
gaagatggaaccaccgctaa

SEQ ID NO: 10553 - DNA, 20 bp, Saccharomyces cerevisiae
cgtggttcacagtgagtgct

SEQ ID NO: 10554 - DNA, 20 bp, Saccharomyces cerevisiae
acgttcggaaatcatgaaca

SEQ ID NO: 10555 - DNA, 20 bp, Saccharomyces cerevisiae
attgccataccggatgatgt

SEQ ID NO: 10556 - DNA, 20 bp, Saccharomyces cerevisiae
tgttcaggtactgcagccag

SEQ ID NO: 10557 - DNA, 20 bp, Saccharomyces cerevisiae
cgctatcgaatcagccctta

SEQ ID NO: 10558 - DNA, 20 bp, Saccharomyces cerevisiae
tctgatatggacgatgccaa

SEQ ID NO: 10559 - DNA, 20 bp, Saccharomyces cerevisiae
catcgcatttgattttgtgc

SEQ ID NO: 10560 - DNA, 20 bp, Saccharomyces cerevisiae
aaataggcccatccagcttc

SEQ ID NO: 10561 - DNA, 21 bp, Saccharomyces cerevisiae
tctggtgtgtttgaatggtga

SEQ ID NO: 10562 - DNA, 20 bp, Saccharomyces cerevisiae
gagtcatcatcggaagccat

SEQ ID NO: 10563 - DNA, 21 bp, Saccharomyces cerevisiae
tcgtcatttgagaatccctct

SEQ ID NO: 10564 - DNA, 20 bp, Saccharomyces cerevisiae
acaacaggctcgcaagaact

SEQ ID NO: 10565 - DNA, 20 bp, Saccharomyces cerevisiae
ggcgccgtacagacattact

SEQ ID NO: 10566 - DNA, 20 bp, Saccharomyces cerevisiae
atattaatggacggtgccca

SEQ ID NO: 10567 - DNA, 20 bp, Saccharomyces cerevisiae
ttggtcgtttgtcatcaagc

SEQ ID NO: 10568 - DNA, 20 bp, Saccharomyces cerevisiae
tggtttagaaggcctggttg

SEQ ID NO: 10569 - DNA, 20 bp, Saccharomyces cerevisiae
cagatccctattaccgcagc

SEQ ID NO: 10570 - DNA, 20 bp, Saccharomyces cerevisiae
tttttcggtgcgtcaacttt

SEQ ID NO: 10571 - DNA, 20 bp, Saccharomyces cerevisiae
cccacaattgggattaacca

SEQ ID NO: 10572 - DNA, 20 bp, Saccharomyces cerevisiae
tggtggcagtgtcaatgaat

SEQ ID NO: 10573 - DNA, 20 bp, Saccharomyces cerevisiae
gggatggtcatccagcttta

SEQ ID NO: 10574 - DNA, 20 bp, Saccharomyces cerevisiae
actcagcgaagaacacgaca

SEQ ID NO: 10575 - DNA, 20 bp, Saccharomyces cerevisiae
tatgacgcgttcaaaccaga

SEQ ID NO: 10576 - DNA, 20 bp, Saccharomyces cerevisiae
tgggtaatgcacgtgttgat

SEQ ID NO: 10577 - DNA, 20 bp, Saccharomyces cerevisiae
ggaaaaacgggaagaaaagg

SEQ ID NO: 10578 - DNA, 20 bp, Saccharomyces cerevisiae
agccgaaaatctttcaagca

SEQ ID NO: 10579 - DNA, 19 bp, Saccharomyces cerevisiae
agatgtgttgaagctgccg

SEQ ID NO: 10580 - DNA, 20 bp, Saccharomyces cerevisiae
actttcgaaatgtgcgttcc

SEQ ID NO: 10581 - DNA, 21 bp, Saccharomyces cerevisiae
gccattttgatccattcttca

SEQ ID NO: 10582 - DNA, 20 bp, Saccharomyces cerevisiae
gcagcgatcagcaataatga

SEQ ID NO: 10583 - DNA, 20 bp, Saccharomyces cerevisiae
ttactccgcaacgcttttct

SEQ ID NO: 10584 - DNA, 21 bp, Saccharomyces cerevisiae
gcctgattggcctctattttc

SEQ ID NO: 10585 - DNA, 20 bp, Saccharomyces cerevisiae
gcggccatatctaccagaaa

SEQ ID NO: 10586 - DNA, 20 bp, Saccharomyces cerevisiae
tgcgtagtgagttcggtgtt

SEQ ID NO: 10587 - DNA, 20 bp, Saccharomyces cerevisiae
ccaagaggatcgagaaacca

SEQ ID NO: 10588 - DNA, 20 bp, Saccharomyces cerevisiae
gaacaatcgcaacaagagca

SEQ ID NO: 10589 - DNA, 20 bp, Saccharomyces cerevisiae
agcgggaagaagtcaaaaga

SEQ ID NO: 10590 - DNA, 20 bp, Saccharomyces cerevisiae
tcgggaccataaaaattcca

SEQ ID NO: 10591 - DNA, 465 bp, Saccharomyces cerevisiae
atcttgggaacaatatacagacattttattggcggtagcaactctgatattccactgttcagctttcctaataagtaagttcaagattatgtggtcatcgcgtcgaacggaaatacacccatacaccaaacctctgtgaatttgaaaaattcacatatgcatttaatagagcataggcaatgtagagagagaaattaacaatggtgaaaagaaatattaccaaacaccagcaaaagaaattgtatagtattagcagtacattcgtggtcaagcagaataacagtaaaataatatgagtgataatggttcccccgcggttcttccaaaaaccgaatttaataaatacaaaatcggcaaagtgaagagtacaccagccatccagcgagatgcgaagactaacttaacatacatcaaactaagaaaaagaagtagtgagaaagtttacgggtgtacagttttccagaa

SEQ ID NO: 10592 - DNA, 442 bp, Saccharomyces cerevisiae
cgcattttaccacatctctacttgttctcacgaccccttgcatcgcatatcctacacattttaaatcggcattccttccaagcatattcttaattcctaattttacatagtttttttttttttttagagaaaataacaacaatatacatagaacttacttactcaattctactatatcttttttttttgttactattagtcatgtttgcatgactccattacattttcgtttttttgctagccaattctggtcgtcggaaaaacttttcattgaatctttcaaagcgtgtagcagttgcatttttttaaaaatgaatatgtatgcaaaatatatatatgtatatatatgcctaatatacataataatagaaaaaaaaaacctcatacgaaataggcgcttctcgtatctatactcaacccgcccccaatgctgaaaattgtt

SEQ ID NO: 10593 - DNA, 401 bp, Saccharomyces cerevisiae
actagttttcttctttcctcctcttctttgaactgcttccaaattctgtctttaagtccatcacatggtgttttatgggattttgtattattacggtgttcggttttcttttgggtattgagcttttattttggtcttaatttttttttttctttttcaaaccatggactttattataattaatctacgacaacttttaatgattatttctttcttcaaatatacacgtatgtattatttctttttactatattcttaactctttattcctgctcagacaacgtttcaaccaacgttaatatttcgttcttgtaattaatcaattgggctattaagggaatacaacctttgaaacttgtctgcgattgtctcaatgaagaaggaacggacagtactccacc

SEQ ID NO: 10594 - DNA, 406 bp, Saccharomyces cerevisiae
aagatatatagaccactcgataccccatcacctgcataattatagaaaaaataaatactaatagatacccgatttataacactagacattacaatatacgaatttcataataaaattttaagttcagactatagataaataaataatatgaagtaaacgtttcaagcaaacgcttatatatatatagagagataataaaggatatgatttagtctctgtcccttctttcaaatgaatatttaatgccttttttttttcgggttgtgtgttcgtggtgatttttttattcttcttttcatttggagacctctatgttgtctaactcgtccttctccttagctgcagcttcagcttctaatatgtatggcaacaggtaaggaacatcctcttgggctttgatccattc

SEQ ID NO: 10595 - DNA, 482 bp, Saccharomyces cerevisiae
attaaaatgaaggaaataacacaacttcgttttgcattatcatattcacatctgcatcctattttttttttctcattgttgttgtatcattattactaactagtgcatcaccacttgtctaaataccaaacgcaaaatatatatattcttacttcataacgttcaaaataaagtttttagtttaaaataaaataaaataaaaaaaaaaaaaaaaaaaaaaaagaaccttttgttttcgcccagtatatgggtaaattaacggttccttttattagtcattttcaactctataccatgctccaaaacggcgttcggcacaggttttttattttaccacgataactcaatatgtacaagattattgcataggcgaaaagtaaagttttaatatggtactttgcgcaataaaactacgaattcaaacgtaaaataagactacagagactaaggtaagacctgttctgctcagataagtggcgttg

SEQ ID NO: 10596 - DNA, 424 bp, Saccharomyces cerevisiae
aaaaacctttctcttctgtttgacatatataatttaaatggatcgttcagagtatgatcgtaccattgcatagctgtaacaatattcacattcataaagcacataagtactaatagcattcttacgcactaaaatgaatcacgcggtcttctatgttcaaccgatagcaaaggcttaggttcgaacgcgagacaattttctattcgagatgttagttatctatatcatacaggaagataaagatacactgctgtacgctgggtatcttcaaatgtacaagtcacgatacttcactcgatgataaaaaaaaaacgaaataaatctctttgtaaaacggttcatccttatgcaggggaactgctgatcatctctgtattgtttcaaattgaccaaatgtccacgaagggttacttcgcgaacacat

SEQ ID NO: 10597 - DNA, 436 bp, Saccharomyces cerevisiae
cataattaattggcattcttcaatttgatagacacttatccctgcatattttttttataaacagcttatagactttcatgtaaatttttcctaattaatgtattatttacttcgttaattttccgttgaattattgacatgttaaaggtgcactaaatatacctaatacaaaaaatggttttctgtggcaaatatatacagtggaaatttcagcatataatccctgctttactctttccttaagatttcgtcataattagaactttttttggtaaactgcattttctaccattattactttacatatgtatagctacaaaactgtattttgaagtgaaaagtatgatgaataaatgaatcgtgaataagttgatctttttttatcaagaaaatcattgagatgcacattgaacaccttcgccaccttgttcttctt

SEQ ID NO: 10598 - DNA, 435 bp, Saccharomyces cerevisiae
ttctcgtcaggaataggatgttgattgatttttgctgtagttatatagcagggacccacggaagagagcgagcgccttctttcacagggacttttgtcagccacgtctccgcggaaaacaattgccgtccgcgtcgcagtgagattacgcagccgtgcgcttcagggacagaaaagaagcatttcgcggctacggagaaacagtgcactaactctctcgagggtagccgcaaagatttcttgtctcttccattaggacatagctatctttttcttttctgtttttggcgtatgatctgttctgagccaaagttatagaacattgcttgaataagcacctcacagagtagggattgtatagaaagtagctgagcgtctgcccacgtaacaaacaatcttgccccttccccgctcttgttttcgcgtgcctcttcta

SEQ ID NO: 10599 - DNA, 446 bp, Saccharomyces cerevisiae
acaaaggcatctctaatgaatagcatcacaaaacttgcatttagcattaacatatatggatatatatgtacacacagaaaacgtataaacactcatgtataaccctacataataagagtatacaatgatactagtcataaaaagtattgtgtgtatagacgtgcgcatattttcaaaatattataaacctgaacaatagacagaataaagtatgcagcgcaacgacaacgatgatggacagcgaaaatttcccgttcgattgtgtctccgtattattattactcgatatttgagaattcaagaaataagacgactgtgcccacccaagagccacaattgcccattgaattgcttgaacagtcctcaggcgcttggacatatccaatatattcaatataacacaaacgggtatccagatcaagttagcgtacccgtaaacggaaatc

SEQ ID NO: 10600 - DNA, 439 bp, Saccharomyces cerevisiae
tatctcttgcgtaataacggtatacaaaatgaggcaataaaaatcaaagaactacactataaaataacgaaacataaagctgaaagactagcaaaatcactaaaaaactaaaataaaaaaagaaaatgagcatttcccctttgcattgaagtatcatccctttcgggcaagaccatgtttaaggaacttcactaatgacatcggaggtctatatatagcagacctcttctttaaaagatataactttataattataaccccgcgcaaagcgtattaatactttaaatgggtagtcaagttgcttttattacttgcacttactttgaaggaggatgtcagaattaccctcgccatattggtaatgtaatttttcacggactcgagattgaaaaaatttcagaaaaatttgcaaaaaagtgccgatgagatgagccttcat

SEQ ID NO: 10601 - DNA, 456 bp, Saccharomyces cerevisiae
atctaaacaaacaacaaagttcttccagcaggtaccatgagattgaagttacggttttaggagttggagattcaatttctggttctttccacatcagcaacgttaaaaggcctagtcctcttccgattatataatataacttccacagcaagtgtaccataacataataatgtccactaagaagcacaccaaaacacattccacttatgcattcgagagcaacacaaacagcgttgctgcctcacaaatgagaaacgccttaaacaagttggcggactctagtaaacttgacgatgctgctcgcgctaagtttgagaacgaactggattcgtttttcacgcttttcaggagatatttggtagagaagtcttctagaaccaccttggaatgggacaagatcaagtctcccaacccggatgaagtggttaagtatgaaattatttctcagcagcccga

SEQ ID NO: 10602 - DNA, 482 bp, Saccharomyces cerevisiae
agaatggtttgaaaaggtcttaagacagatcacaattgcatatattcaaatagtaaattgggggatagctggataaaattcaccaatttaaatttatagaagtttcatacaagtacacattatcatagaagtatttttttttttagcaagtaatgtcgttttacataaagaagaaggtgacagaaatttgcgaaagctgttggcaaaaccaaatttatttcaagtatatcagtacattattctacataaaaacaacaacagttttttctcagtttttgaaaatgttgtctcctttatttatttgaatctttttgtcttgaccagcgctgataatacccactttttcagcccatttgacagcaaaaactttgtcattgacgcccttttggaccgatttgtcttctcttgttatggtgtacatcggagaagtagacctgacgtcccataccttcacggtaccatcgtgagaacccgagcataat

SEQ ID NO: 10603 - DNA, 497 bp, Saccharomyces cerevisiae
atgtgaaagcttctgtcaagaaaaaacaagaaggggtttactgatttgatgataaaagttagcagcaacttttgaatgagaatgtgccatccttcacgtaaagagcctaatactctttcttcaaagcgctagattgttctaaacgtttctttaactattgttttcgttcgtgcagcgtgattaaccgagcctccttcgaggcggggatggatattgtaagctgcatatatagtcgaacctcaaatcggttgagacaataggcaaagtgcccacattggcgcaaacacaagaacattaggaaagaaggcaatctgatatttcaaaaatgtctgcttcattgattaatcgttccttaacaaacattaggacagaactggattttctaaaagggtcaaatgtcatttcaaatgacgtttacgatcaaataaataagagcttgccggcaaaatgggatcctgccaatgcaccccgcaacgccagtccagcttccttggaat

SEQ ID NO: 10604 - DNA, 405 bp, Saccharomyces cerevisiae
aggtttctctgatagaccccccaccttttcatcgccttcaccccacccatttgcattatctaaaaatagtaaactatatattctaccaccacattcattatatataatatttaaaacaacgcattaccaccaagcgcccgggtaatattcgcctcaaacgatcgaagaaagaaaaaatgaggtcacaataatgatgaaaaaaagcccctctatgaattttctagcacttgactaagttggagcaacagctattaaatttgaagaacagagtgaaaagcgacaatttattaagctgttagagcattggacttttatatttttaccaaatgaaacgctttaatggtatgtataaatatttctacacaattaacaaatgtttaaaaaagggattatgcgaatgctcat

SEQ ID NO: 10605 - DNA, 439 bp, Saccharomyces cerevisiae
aaaactcgcataaactctcaacattaatggtaatcaactggttctgctggacggagccattctaaatcattaactttataatatcatgttttataccctaatatttaaacaatttactgcttttggcacttcaactgttagaaaaagaacaataatatttagtatttagtttcatttttaaattttctgattcacttcatttgcagcttctaatgatgtttgtggtacaaaaatataaacaattttaaaatattaaaaaaaaatgcttccaatcggatttgaaccgatgatctccacattactagtgtggcgccttaccaacttggccatagaagctaaatctctgaaagctgcgctcttcaaaggcgaaccaagcaagataaattaatattattatgtaaaactatcgttttccttttgttgattcctatatcccgga

SEQ ID NO: 10606 - DNA, 478 bp, Saccharomyces cerevisiae
gctctccatatctacatcactttctgcattaatctgaaatatttttcaaattttcatgtgtaatgatattaatccttatctatactacttacttctatttacgttctctttagcatttactttgtgcatttggccttcaatgagcattaatttcactggttttaatatattcactcactttcattcgattttttgtttgctttatggcttagcgttctttcctctctcctttctctttttacacacgagaaaaaatggataattgttgtattatgccatatgcataactttacgattcgttatgctatgcgaacttgaagcccagatttctacacgaaaagtttgagtttattagtatcttctccaagataaatatagcatcaagttacaggtatgtcgaacatcacttatgtcaaaggtaacatcttaaaaccaaagtcatatgctaggatcctcatccattcttgcaactgcaatg

SEQ ID NO: 10607 - DNA, 417 bp, Saccharomyces cerevisiae
cattagaaactctgatcaatagcatagtgtaacatagtgtagcataccattcaggttgtattatatacgcaacaacaataaaatattaatttaattattgcgatgacaattaagtaaagatgattgaagaaaacaatactaacaaattttgaagcatttgtatttacttaattttaaatttattattataggtacagtttcaataatatatttatataaagctgatattttatatataggaaaattacgctaggtatgtaacattgattaaaaattaaaaagcggagtgataacgaatgtagtccatcctccgaatctttttaaacttcctttgtttcttgaatccaattcgaaattgttctcctagtggattcgtgtggaatagcgttatcaatgttggcaatgaatttgtctgct

SEQ ID NO: 10608 - DNA, 407 bp, Saccharomyces cerevisiae
cgataaacaaattcttgcattggaatgacgcgtatacaaggtcatttttgttttatttaacgcatttatgtattatcaacttgtaatataatacggtatattaatggagtcttatagaatttacgggtatattcaaatcagtattgataatgttttcatattctcttgttaaaattcaggttattagctgtctattgattatggcttggactttttttttattttattatttttcatagttaagttgcgccaaagggaaactagaaacagtttagtcgaactctgcagagcttcatctcagtatgaaaaattattcatttgagctatcgaaacgtttggatataaacatacataaaacctctgttcttctgccaatttaaatgcaattcgctgggaagaaaactgat

SEQ ID NO: 10609 - DNA, 420 bp, Saccharomyces cerevisiae
accgtttcctagctgattttttgacactttattcagaaatgaccttttgagatacaagtttactaggggaaagatccatatgacatggtagtaggtttacccttcaaaacaacatagatcgtaaaaaaggtggctgaagaacttactaaaaatgttatatgcttagattaatatattgtcaccgggctaccagtacaaacccttgataatgcgaccagacatctgttttgacttatttatgagcaataatgggtaacaaaagaacgctctgaggcaactctatgtgagtcgaaacatatgtgtttttggcaattaaacaaaatacgagagattcttctcagaaaacattgtcacaagaacttagtatctttaattttctgcaaacatactgatgatttcttcggcaatagcaactacgtg

SEQ ID NO: 10610 - DNA, 482 bp, Saccharomyces cerevisiae
taacacagacaacgataacagttctttaacagaattgtcaaccccccctctttgcattacattcaacattacattgcatttttttttttttattcactattattatggttcttcttttttaccagattttgctccttccttttccattgttttaccattcttttttaactagcatttcaacatgtgtttggttaacaccccttcttttttttcaggaaaatcctttcatttcttctcatactttcaacaaagttttttaaaggtactttaaaatagttcaacaccctcttccttcatttatttattctcttcatattcaacatactcgaaaaggaagaacactaaaagtacttacattttcacatgtatgtatacctatatatatatatatatatactcttatagatatatttacaaattaaaggaaaaaataataaaataacctccctgtcacaagttaaaacacggccccatcacttata

SEQ ID NO: 10611 - DNA, 499 bp, Saccharomyces cerevisiae
aaacatctcagttacccgcactgccttttttctctcccgcttttcagcagaacgaggcgacaagcgaaggaacaaaacaaaacaaaagaaaacaaaaatattgaaatgcaagaacatggacacataaaaacatttttgatccggtcgaaagaaaacgatcagaaatttttagctgcttgcttagaagaaaagaaaagaaaattgcagagaaaaagctatttattgtttctgtccttcgctttaaaacatagagatattttgtcctttttatcattgcttattataaatgcatcataactcacagtctttgagctctggacacatcaggagccccgaggatgaaaatgtggcacctataggtaatcttaaacacaggactggatccctcagtcatatttcatctgcgcacccgagggtcgcacttagcgacgttaccaatatagttgcgacaaactctagcaacaacagcataagtaagccaaaagtcgccccaattaaa

SEQ ID NO: 10612 - DNA, 433 bp, Saccharomyces cerevisiae
ttgtttcatttggtgatgcaacaacaagaacttccgaagttcaattggttaggtgtactcaaggtctaaacctttggaagctgcatcaagttcatgccgtttacaaaagagttgtccatgataccttaggtgccgatgaaggtaatgctttactcgatcaaattttggctgacacgaatctatatccaccttggatgtgtgttcttttatatgcattttgttccgctatggtcactccgtatgcctttggtggcgattgggtaaacctggcaatctcattttttatggggctttgtgtggggtcattacaatttattctttcacaaaagtcatacatgtattcaaacgtcttcgaaatttctgcatctattgtcgttagcttctgcggtagagcttttggctctatccctcgttctcacatctgctttggtgc

SEQ ID NO: 10613 - DNA, 446 bp, Saccharomyces cerevisiae
tcattgtaacgggaaaacatatcaccacaagttcgctgtaaatgtgcagactgggtggcatgcttcaaaagcctattctagtacttccctgctgttttcgcacggaaccggtaagaaaacttcgtaccgaaatcgaacaactttcattacttgcacttgtacaaatttaagggagcgggattttaaaacatataaaaggatagtggcacaactaggaataaggtgtattacccaatatgattctcaccttcggttggggactggttaattaattgaatagcttcataacccaccgccccaaaatgtgctcttcgaaatgtctgaggcttttggacctgcacctgaaccacctaccgagttaggacgtcttagggtcctatctaaaacagctggtataagagtttctccactaatcctgggaggtatgtctattggtgacgcctggt

SEQ ID NO: 10614 - DNA, 492 bp, Saccharomyces cerevisiae
ggagaccagtaaaactatatggggggggttgttcttcccgcctccttctgggattatgaagacgcgctgatctgctatagttcaacgtccttttcgcttactatttctggtaagaaatataaggaattctcggattaattacttttctcgaaaggggattccgaacacctaccggaaaaaaatagcagcccttaaggggagagtacggctcttggcatgacgggaggcaggacagcactaaaggcagactagtcactgagcgctccaagttgggtatgatagtatcttcaagttttggtcgagtagctattcctcttcttcaaagccacttacgcttcgcccaataatgtcatgatttacaaataaaccttcctctccgaacccttaaaagtaggcaaattgagaaaattttttgctcgtctttttttctctcgtttcgattaccttattgggaacttctcgaagaactcggcgaagaggtccagaggaaga

SEQ ID NO: 10615 - DNA, 476 bp, Saccharomyces cerevisiae
ccccctcctttttggcacaaaagtgtactacacatctgttttaagcccacaattgatagaccttctcttgatgatcatctgttttcccgaaaatattacttgccaaagcaagttgtagttatattcacacttccgttatgaccccctcatccgtttaatgttatttgtttttatggtattccctttattcattttttttcttgcttttttttgttgatccctgtaaccccttttttttttttggaagttgctattattattcattcacatttgttctgtctttgttaattttccaggtcaccgtatttaatttctatataactgtttctaatatttacttcgttttatccaagcgttatttactcaatattcaaaactttactttttaccacctgtataacatctttttcaatttgataaaacgttttgaaatctaagggaacaatgtcacagtcagtttcgtcgttgatgtctgg

SEQ ID NO: 10616 - DNA, 444 bp, Saccharomyces cerevisiae
cttttctcagcacctgtccagagacataacatcacaatcacatcgccccagtaaatgcatacgcaagataagatacaaactggctacgggaacactacgccaacgtgattggcaattgtgctctaatagttactctattattgctgttaattgacaatgtttagtcacgtgcaacacaattcaagtcacgtggaaaggccttcacatggtgatccatcttctacatcttcatcggtcctgcataaagtcataatatggggctactggaatgtatgcacttaacagtactattatatggtgaggctgtaatgcttaccgttttgtggctattctcgtattctgtaggcccccccatacacatttttcggtaactgcggcatatagatgaaagttgaaatgaatattcaaaagaatatatataataatgcaggagatcaaggaaga

SEQ ID NO: 10617 - DNA, 498 bp, Saccharomyces cerevisiae
gtttggggagctgtttttatgaattaacgaaattttatgaatttacgaaatatagcatgctatataaaataatttatatgcgcatgtattttggtgtgcaccttcttactggagtgtatacaagtctacaaatcaacacatgtggtttttttaatgttttgtcgtcacaacgcgaccttaaataaaagaattccacgctagattcatgctactatcacgaacaatacgtaccaattaagctttcttggtgtaataaaaaaagagaaatgtacacaccaccatgattccgtttacgtcttgcttttctacttgtttcgctcatgggttctcatcagctctattgtgtgtgccctctttgtagataattaaacacattgaaaaaaaagaaaacgaaaagatggcacacggcttggtcatcgagtgaagaaatgaaacttcaaaaaaattgccggacacttaaaccttaacgagttatacagaaccgtatccagacctgga

SEQ ID NO: 10618 - DNA, 473 bp, Saccharomyces cerevisiae
taaatttttacaacaacgcaaaaacgaaataccccactatttaaccacttaacgacattaatattaattacaaaagtgtttgatacacgtactattatagatttcgacgacctttaagattaagtaatacctttaataattttaatatattttaagcctactgctctaaaattgcccaaaaaaaaaacccaaaaaaatcaacatttaaatatgatgatactcccatatatatcgtatttaaagaataactctgctgttgtcttgattatttgattgttacattattatcaacgcggtattacccgtatgcaaatttttcaatcaagcaaagcattgcaaaatttgcattacctttaaaaccagttgacctttatacaccataaaatactcgatcagcaaccaagaacatctataaaaatacttaccaccttagatcggaatgagtgatacaaagagagatccggccgatttac

SEQ ID NO: 10619 - DNA, 453 bp, Saccharomyces cerevisiae
tgttccatttgccattgccaactggacggcttgcttaaacgattccgataagctcggatgagggaacggtactttacagacatcatgggcggtaaggccaagcgacaccgccatcgatgcttgcgacagcaattcatttgcatcgtcgtttatcatatgaacgcctagtattttcatgtcacgagaatctatcagaactttaatgaaaggagaaactgtagtattctcttcccgtggtaataacgtgttatatctaacgttctgtgagaacaaaaccctgcctttttgatatgggatgcgagcctttgccaacccctcctcagtgtatccgacccagccaatctgaggctgacagtacagcacatttggtgggaagccacaattcgaggttccgtcggagcctgtacagcctattgattgaatggcccttatagcttgttcttccgctttcag

SEQ ID NO: 10620 - DNA, 401 bp, Saccharomyces cerevisiae
tgactacatcgtatttcaccttttctaaagtaaaatggattcgacgctgtttcgcagagggtataaatgtttgcacgatcgatagagcgtatggaagcctgtgcataatcatatctctggagaaggaaatcttcgataagggccagtgaaatagcggagtatcatggaatccgggtaatgggcatcgaagcagctcaccgaagagaagaatagaaaagaaaaagtagaactattctcgggatttatagtaaacaggggacggacgattaagaaataacctgatcaaacactgtacactactgctgtttttttttttttttttctgctagaaaagaacatatgaagaactaaagcgcatggttattaaagaggactgtatcaataatcttgccaggtggcag

SEQ ID NO: 10621 - DNA, 406 bp, Saccharomyces cerevisiae
gggagttagcacaagatgaatctaagatttgaattgcagaaactattgaacgtttgctttttgtttgcatctgcttacatgttctggcaaggcttagccattgctactaatagcgcttctccgatcgtggtggtgctttcaggctccatggaaccagctttccaaaggggtgatatccttttcctatggaatagaaatactttcaaccaagtaggtgatgtcgtggtgtatgaggtcgaagggaaacaaatccccattgtgcatagagttttgaggcaacataacaatcacgcggacaagcaattcctcctgaccaaaggtgacaataacgccggcaatgatatctcactatatgctaataagaaaatttacttgaacaagtcaaaggagattgtagggaccgtca

SEQ ID NO: 10622 - DNA, 470 bp, Saccharomyces cerevisiae
acgccatagaagagcaatttccgtcctctactcatgtgattcgaactatgaaacaaagaaaaggcaagagtaaatagcgtgatacctattacgtattacgtatacatcctattattcttgaaaaaaagtgcggggctccagagctccacattggtgaccccagagtatactgctctttctaatgccttttccatcatgttactacgagttttctgaacctcctcgcacattggtacctagaaatggctatcatgccggacggcaccgggcaataaaccggacggcacaaaaaaatcgaagaaaagagatttctttttctcgcgggcagtttttccggtcgatcgacattcgtacggtactttctctgtttcagggacatcatgttgtaaaagaaaaagacagtttaggtaatcgttcttttctttctgaaaaattttccacgacgacgacgacgaccacgaaacaccttt

SEQ ID NO: 10623 - DNA, 499 bp, Saccharomyces cerevisiae
tttttttgcatattttttcctttggatgttgcataatcttttcccgcttacgtcattggtgatagattgtttcggatcttcaaaaggcaacacgcataggccaaagaaaaaagaaattttgcattttttcatttttgcatattctcgcatgttttctttctttttctctagttttcgaatgtttttggctgcaatgtatattgtatataaaccataaaggtgcaaaatgccagatgtacgcggccaatcttaattttctagtaaaagtagcagctaaatctgaaactctctagcttgtaataaacgaaggatgactgtacaaattccaaaattattatttttacacggcttcttgcaaaacggtaaagttttctccgaaaaatcatctggtattagaaaattattgaagaaggctaatgtccaatgtgactatattgatgcaccagtccttttagaaaagaaggacttgccatttgaaatggatgatgaaaaatggcaa

SEQ ID NO: 10624 - DNA, 500 bp, Saccharomyces cerevisiae
aatcactagaagtgtgccaatcatgagttcacactaactaaagaaaaagaaggaagtcgcccatcgtatgcaatgtacttattattgaagaatattgtaccgagaaaatttcaaatgttacgtaaatatctccttccctttttgccacgatcattttaaaaaaattgagaagttactaactaattattttaactctttgcaaacctgcaatactcgtgatgaatatttaattagatcattcaaaatgccaaagaagagagcttccaacggtagaaacaagaaaggtagaggtcacgtcaaaccagtcagatgtgtcaactgttccaagtctattccaaaggataaggctatcaagagaatggctatcagaaacattgttgaagccgctgccgtcagagatttgtccgaagcttctgtctaccctgaatacgctttgccaaagacttacaacaagttacactactgtgtttcttgtgctattcacgccagaattgtcagag

SEQ ID NO: 10625 - DNA, 456 bp, Saccharomyces cerevisiae
ctttttttttttttttttttcattttcttttcctcaccgaaaactaattattcttaatctgatggattcatcgcaaacggttggatgagtcctaaactgggctggagttatcatatcacatagcattttctttttaatcttattgtattgtcgggtcaactaacttcttttcccgctcttctatggtataatcaattgcagaagaggcaggaaaaaattgtaatcataacaaaaatgatacaaattttttttctaagttttatattttacatatctttatttttgatccttacggatttttaatacagtatttagctgaagtttccattcacttcacttacctttttgatctcttttatttttacttgccccgttgccttgcatttttcaatagaaagtgaaaaactaagtaccacttgagcaatgccacattagaagaaaaaccatccgcaagtg

SEQ ID NO: 10626 - DNA, 492 bp, Saccharomyces cerevisiae
ttccttcactagtcagctaatagatttattttttcttttttttttacagttccacttgcatccctcatttttcacattcctttttttatagaaaagcatatcactatataaaaattctattatagttgtaacagcatagcatattatagactttttttttctggaaacggttaaaccgtttggctgagatgcaatgatatacgcaacattgcattcaaagaaattgcaaaaaagacacaataaaacgtaatttgtacaaatattttactatcattagctactggatgcagaatggatgattgttagggggaggtggggtacaattgtttgtttttgatacattttctctttcaaatcgcaaccaattcactctgctaatgtgataacaatggcgcctgtcggaaaggtgaaaaaaaaaaaatgcaaacaaataaattggcacggtgtgacatatgccttctataataatgaaggaactcgaagaaaaagggg

SEQ ID NO: 10627 - DNA, 400 bp, Saccharomyces cerevisiae
tgaagaactttatgacaacagaatgttctgattgtaatataatgacaaattttaatctttagtaatatctaatataatagttaatgataaatagttaattctaatgtttaatgatctgcaaatactttttatgtttttcaacatagtttttaatgtgtttctacacttgatcgcaactaaatctaaataaacacacaagcacaaaatatgataaaaaagcaatttggctagaagcacaggaaccaaatatgacgttcaattcaaatagacccttatttctggtcttgttcatcagtccctgatgtcttgctctttccttctgcaattgatagcgccacacttctcaaaagcagtggaaaaaaaaatcatttcccagaagaacgcgagagaactccataga

SEQ ID NO: 10628 - DNA, 500 bp, Saccharomyces cerevisiae
aacatagatcaaaattatagccagctaaccccctgcatcttaaatatcatcgatagacatacttctttatttcttttatgtattcaaaaaaagaaagaaaatgcattattcctcactttaaagataattttccaattatgggagaaaaaatttataaatgaattaattattacagcctacaaaactgataccgtgtgataatatatatgagataaccgttatatgaataatgaatgcctgatttttctataaaatagatgataaagtaaggaagtgagattttggttttctgtgtaggctagcaccttcactcatgcaatgtcataatatcatatccatttttccttaccttcaatgcccattcgatagaaattatggaagcctttaaaaatcttctcgattgatattttttcaagaactcgtcgtgaatagtagatccaacaagataatccatcagtaattggcaaacgggatatagttttgcctttgtgtaaccacca

SEQ ID NO: 10629 - DNA, 496 bp, Saccharomyces cerevisiae
tctaatctctagtcattatttattcgcaaattcatttccctatacggcattcatacatatcattgttcacttcagtcctagcatatatcataaaatatacaattgttttctaattaccttacgttttttaaaagacttctataacacctcttttaactttacatgtagtcaaaataaagtgcagttccatcgatggtactttctcaccccggttgagtgatgttaacgatgtttaccgtataaaacttaattatattatatctttttttgcttatatgttatacatagaataaaaagttgattaaacacacattggtctgaaaacacgtgtagtactttctcctttgaagaataaaaaaagaaaataaagataataaaaacgaaaatagcgtacaattattactgataatttccttaattgatttaagctcttcttctaccagtggtcttggtgtgttgacctctaacacgtaaaccccagaagtgtctaatacca

SEQ ID NO: 10630 - DNA, 492 bp, Saccharomyces cerevisiae
tgagaatgccaattccgcccacttactacttttcatgtgttaaatagtacgcataaacacgagatctgacttcgattgtttcctcgtcttcgtcaaacatcggtttccaattaaccatttcaattagctgaggaaccaaatggaactcgttcttagccaattcgaagaattctaaatccttctccaacaattttggtctatgcggtgaaaatactaccaacgcctgacctttctcagctaataaatcctttgttgtttgaagtaatttgtgatgttccgtatgattgaagactaaatcacttaaaatgattaagtcaaactttccattattgttacctattttttcgatatgtgccaacaatggagaataatcgtttccccaaatataaccctccgtactgacattattaaaatcttcaggaacgttagactttatattataatcgatgttctgcattaaatcaggatctggataatcagttgaaacaacca

SEQ ID NO: 10631 - DNA, 485 bp, Saccharomyces cerevisiae
ggttggatttattttacggataacataggatttgcgagaaatatctgcttcactatcactttccgtgcgacgtgtgtatttgttagcgtaggttgcttatcgttttcacacaaagatctcaaacgcgtcaaaaaactcgtgtaagaggtcaaaaagaaaaacaaacaaaataaacaaacaaaataaatgcagctttaaatcaatattcggcgaaggcaagtaacggttgctagcggtttttcccattcacatactattacacttctgcggtaccaagctagattaagtgctagataataaacctttatgatgccagctaacgaagataaagagaataatatcgtatatacagggaatgaaagttccggcattaactttccacagacgccggctcacttgctgaaaaggtcgcactctaatattttaaaaccacctgtaagattggaccaactcaaaagggatgcgaacagcaacaatggcaacac

SEQ ID NO: 10632 - DNA, 452 bp, Saccharomyces cerevisiae
ttagttcgtataatggaccctttctcggtattcgcaatgatgcacctattactaatcagcggccgatttgttggtattaaagcagcgtgtggttacatccccttgttgaatacatgtctacttagcagaaggccaggtatatggaaacatgcgtttaatcagtaaagttttggtgaaaacaaattgcctagaggtaggtatgaggagggccccacaatggtattctcactactctactacagcgggcaatgctcgtgtgaacaagaagggcagcaaagtagtgcctgtgttaacagggttagcactggcatccatattcgcgaagaaatggtatgacgattcccagatcaaaaaggcggatgccaccagcgttgcagtggacgcatccatctctgcgttccctaagaagatgggccccccacagtggcccttctccacgcaatatgagctga

SEQ ID NO: 10633 - DNA, 443 bp, Saccharomyces cerevisiae
aaaaattaaacgttctaaccccctggcccccagaaaatcgcgcagattgacggcactccctttaaatcatagagttaatcagctactcaccactctctttcggtactggcgttattctgaattccaaccttgaacacagccacacggcattcagatgttgctcccatgcgtggactcacgctctgcgattaacagctcatggaaatttcctcgtgctatttaagactgcagtcgtttggaaatcggaatatcttttttcgtgcagttttgcgggaaattttccctacttaaaaagctgaatgaaaatcagaaatatctgcaaaaaaaaaaggtaaaaaagggaaattttaagacatagcataaaggacttggttttgtttcaatactcagcccttttcattcatttctatcacaagtttttttttgctctcgtttccattttc

SEQ ID NO: 10634 - DNA, 431 bp, Saccharomyces cerevisiae
tgtctgtgttagtttttccttttctacataaatattttatagactactattgcatttttaataaataatattcatcctcatctttgaataaaagaaagaaacattcgattatttcatcatcttacttgattgcttggctatttgcttcaaaagctctaggcccccactgtcacgacacatactataaaatataccgcgttcatctttcaacagttcactagggcgatcatattcttttacctcaccggcatccatcacaattatcctgtcgtaatcgataacagatctcaaacgatgtgcaatagtaagaattgtgcttttattaaactcacttcttataataccctgaattaaatggtcagaatcgtaatcaatagaggaagtagcctcgtccaaaagtattatctttggctcgcgtaacaatgatcgtg

SEQ ID NO: 10635 - DNA, 485 bp, Saccharomyces cerevisiae
taaattcaagaaaggaaaagaaaaaaaattaccaaaatgaaaagaacggaaaaaaaagatgaacagaaaataaaacaatacgtggttcttctactgtccttcccacatcgccgacagagaaaagacaagcaaaaagatgggcaagaaagcacacggaggaaagatgaaacctgagatcgacgaaaatggtactctgctagtaccgccaccaaggacgattgcgaaccaggaccatttccatagattaaactacctctaccaaatatccgcttaccaaacaagagcaagacagaaagcaagaacagacgcacatacgcctttggcacgcaattatatcaaatcaatggacctaattagtaagaaaaccaagacatcactgcttcctacgataaagagaacaatttgtaaaaaatgccatcggttgttatggaccccaaaaaaactggaaatcacatccgacggagcgctttcggtaatgtgtgggt

SEQ ID NO: 10636 - DNA, 421 bp, Saccharomyces cerevisiae
tgcggcgctatcatcaaacgtatttgacttgatgcctatggaggttatgggtgcccttaattagggatcgctgtggaaagttatagaatattacagaagcagccacaagggtgaccagaagatggttaagggatgtatcatattgcacaattggaaacgaatggaagggtatataaagtgactgaaattggtagcataaacattcttgtatgtcaatgtttgtcactaaacggatagaataggtactaaacgctacaaagaaaaatgtctagagcagttggtattgatttgggaacaacttactcgtgtgttgctcatttttccaatgatagggtagagataattgcaaatgatcaaggtaataggaccactccatcgtatgtggctttcacagacaccgaaagattaattggtgacgccg

SEQ ID NO: 10637 - DNA, 493 bp, Saccharomyces cerevisiae
ctcaccatccctatccaaccgactattcttctcatcgactactactatcccatttaactcgggcgcgttgttaattaatcactcgatggggaatgccttgagctgaccgcaatgaaaacttttaggggatcgtccaacattaaaggaagaacgaaacggactccacagtttctaatataaataaacaatgataaaacatatagtttcgccattcaggacgaattttgttggcatcagcaagtccgtgctgtcaaggatgattcatcacaaggttacaatcataggttctggccccgctgcccacaccgctgctatatacttggcaagagcagagatgaagcccacattatatgagggaatgatggccaacggaattgctgctggtggccaattgacaacaaccaccgatatcgaaaatttcccagggtttcctgaatcgttgagtggcagtgaactgatggagaggatgaggaaacaatctgccaagtttggc

SEQ ID NO: 10638 - DNA, 407 bp, Saccharomyces cerevisiae
tcaactgtttacgattgatgatttttcatgtaaataagcattaattatatttagatatatattcgtattttattaataattaggaggaataaagtccgacatttttttcaaaaaaaaaaaaataatatttcacaacgaaaaatctataaataaaatatttaacatatgctcttccaaatgtacatactttcaattgatttcactcaatgacaacgcaatggccaattgtaagtcttcatcaacattattactagcatcaacgccaacagaactaccgatagtgttctcagttgaggttcgttcggatgactctgctgcaccatatgtagcaaaattatcgtcgctcaagggcccatttcgtcgacctgtagtatgatttctaagatgtcttctcctttcgtcctcca

SEQ ID NO: 10639 - DNA, 460 bp, Saccharomyces cerevisiae
ttctaaatcgaatagagaaacatgcatataaaagatcagaaaacagtaattagatcttttccattacgacattaacgatatagatgttttacaaatttgcggttctaatttctaactacaaatacaccagggtataggttaaagataaaataaagaagacaggaagcaagaatgtaagtttggcattgaaatgtgcacgagtacttcttactcttcttatatacgggattattcagttcatttacatatctacattatcatttcactttgtatattataacattcaggtaattatcaatttttaatttttagaatggttgttaaaatttcatacttattcaagtcaaggaataaattaaaataaatactcctattatttggcccgattagtgtcagttcaaacgttatttgattttatccttacgctttatgtggtttgtacgtgttgatgattttccta

SEQ ID NO: 10640 - DNA, 472 bp, Saccharomyces cerevisiae
tgactgaattttgaatttgattatcttcaacgactgagaagaatgagcaccattttgatattttgattaattaagtggtaatcttaagctcatatacaaaaagggaaggaaaaaaaataaagatagaaaagatcttaggaacggatagaggtttgaaaaaggaataacaggtaatttttcattttcatatcggttgtaacattataaagctcacaaatttaaaacaaaaaaaaacataaacctaacaaggttaatcatttgcacatgatctcatcatatagatcaattcataatctatataataatgaataattagaataaaaatttcctcttgtctcagaacgcccatcggatggcataactttagttaatgatatcacgacggacgaagtattgaaagacaacctaacctgttcatcaatttaaaagtcaacgcagaaactataatacattgccacatagttctttccga

SEQ ID NO: 10641 - DNA, 484 bp, Saccharomyces cerevisiae
ctgcttacttcatcgaacaaatggaaaaaggtctagctccaccaaaggaaggccacacattggcctcggacaaaggtcttcctatgattccggcgttcgtcaccgggtcacccaacgggacggagcgcggtgttttactagccgccgacctgggtggtaccaatttccgtatatgttctgttaacttgcatggagatcatactttctccatggagcaaatgaagtccaagattcccgatgatttgctagacgatgagaacgtcacatctgacgacctgtttgggtttctagcacgtcgtacactggcctttatgaagaagtatcacccggacgagttggccaagggtaaagacgccaagcccatgaaactggggttcactttctcataccctgtagaccagacctctctaaactccgggacattgatccgttggaccaagggtttccgcatcgcggacaccgtcggaaaggatgtcgtgcaatt

SEQ ID NO: 10642 - DNA, 412 bp, Saccharomyces cerevisiae
caactacatttttgtgcaacttttggtacaccgctacacgtattgaaagcgcaaaagactatagctcctccagcagggaaaactcacatcggtgggcaacaacatagaatatgtcaaagttgtaaaaacacccacgagtgcataccacttttcaacattaccggggaaaaaaaagtttgcacctcgttcccagaaacatacgcaggagtgactgcgctagtgacagattgctctttccgttggaaaaagaaacgactttttttcgcaaaagtacccgaaatcctcggaattttgcaaatagtcgatgatcacaattgttaggtgactatttaacaaggacggcgaggagaactgaaaaaaaagcaacctatccggcctcctctagttacacaaacaagacaaagaaattgca

SEQ ID NO: 10643 - DNA, 427 bp, Saccharomyces cerevisiae
aggattctcgatgttctttggggcatcgttaaacgtgatattcctactatgttactaaatgttgaactgaaagcatcttgaaacgattctaatcagttttaggtgtgtcgccaatgtacagttatagaaaagacgccagattactcaagtacgttaaaatcaggtatcaagtgaataacaacacgcaacatgtctggaacatttagttatgatgtgaaaacaaaggagaacgaaccattatttgagtttaattctgcttattctcccagggtatcgtatcattttaactccaaagtttcacattaccattatggtgttaagcatccaatgaagccgtttcggttaatgctaacggatcacctagtttcctcttatggattgcacaagattatggacctttatgaaacaagaagcgctaccagagacg

SEQ ID NO: 10644 - DNA, 475 bp, Saccharomyces cerevisiae
tagtaatttttctgattttttttctcgctagaaaaaaaaaatttcatggttagaaaaattttaacatagaaatcatggcatcatcgccacaattggaagaggaagcagctgggaaattagaaacaatccacgcatcagctatggcaaagagcaaaaaaaaaacagatgttgtcgattcaacaaacctgcccattctagaattactatcattaaaagctcccattttccagtctcttttacatcctgaactgcccattataataactggctttggtacaggacatattgtgtgccatcgttatgaccccgctaagttgcaatcgcacctagatcgtagacgtagaattgacactgcaactacaggcaaggatgcaaagaaaggtgtatgcccttggattagattagatatagacctagaaactggagatttgaaatttgttgatattgaagaacaacagcaacaaaagcaaacagg

SEQ ID NO: 10645 - DNA, 435 bp, Saccharomyces cerevisiae
cctataactgaaaattcacacccgcattacccagcgcgcccgcacgtgctctttatggaaactataatgaataacgaccaaagaacatctttttttctctctcacacaaataaagcttttcatgtttatagatatatagcacatacttttactaagttttctagattgattacgactcttccagttgcacattttttcatagcgaaagtacaagagtaggaagagtggcacaatggcggttcaacaaagaaagaagaaagagggtagaaagtccgataaaaatgccccatcggtcccacaagtagatgcatcattagacaaaccacttgatattgatgctcctcctactatttacagtgttaatttgaaaccagaatatggtacagctgcattgaatttgtccgcggatttcatcagacaagaacaggcattggc

SEQ ID NO: 10646 - DNA, 465 bp, Saccharomyces cerevisiae
gagttttgagaacgaacaagtatttacgcacataaccaatattcccatgtagctctcttgtcaaatatattgtcggacgggcacgaatagagataaacatcaagaaagattgaggggcttcaggagatcattggtgaagaaaacattccctgttcgccaaattgacagctctcaatctttatttgtaacccttattgcaaatttatggcatgtttaccctcaaacaaaggatattcagcatttattaaaaatatctttgcttggtaagaaaaaaacgtcaacgaaaatgacggagatatctgacggaaaaaaaaattgatttcgcccaggatcgaactggggacgttctgcgtgttaagcagatgccataaccgactagaccacgaaaccacttaattgttgaataacggacatctaaagtcatatctatagtgcagcaagttcttcttcagctcaccccagtct

SEQ ID NO: 10647 - DNA, 446 bp, Saccharomyces cerevisiae
cattgatctcagaatatatccaaatggataaattataaatttaccaataacagtaattatgtgtcagttttaatacccaaccaattgattcctctaaatgataccgtaccaaatgacatgtttgccaccgattataaaactggggtttatgagcgatggttaaggaggattaagacaaagtgctcatccgcttacaagatcagtactagcgtgtaccagtctatttaaactggaatgatcaccccaaagggaacgcacgatgctgtggccaagtttcaaaaaactgacctgcatcaagatctcgattacatcgtactgcaacaacgaagaacacagctagagacgcttattaacgaaagagaatcttttgtcaagaatctgtgttctcttttccacaaaattcaaaataccaagaattaccaggaatttgttgatgtattggcgga

SEQ ID NO: 10648 - DNA, 413 bp, Saccharomyces cerevisiae
tcaacggggattttcagtatataagatcaaaatgaaaaacaaagataataaagaaagggtggcaactctttactgcaataatcggtagaaaacttcgtgtgatcaaccatatatattatacagcgcttcagatgacttcggataaacacctttttgtgctgattcacgggctatggggtaactatactcatatggaatctatgaggacaattttatccactacattaaaaaaggaagatgttaacgatgatatgatatattttttaccaaagcagaatgccatgtttaagacgtttgatggtatcgaaatcattgggtacaggacattgattgaagtttgtgaatttatccgagattataaagacgggaaaatcaccaaactaagcgtaatgggatattcgcaaggcggatta

SEQ ID NO: 10649 - DNA, 481 bp, Saccharomyces cerevisiae
tcatcttaatgagcatcggaccgaagcataagaatgcagcaaattgataatattcccgttaagccagtcgtaggaaaaggaaaagaatgagtagcaaatgtcacacaacaaacgcgcaccatccctacatacacaaacacacacacacacacacatatatatatattctaccccatataagcgagtgattcatcatgaaaagaatttatcacttcgaatttaaataataacattcttacctgatgtacaactctttactctcatcttgcgaaaagaaaagggcagggtgccgctgaaacagcggcgttgctgatgaaaataaccctgtgttttcgcctcattctctcaaaaccttcacagatccttttcttgttatagcctcaataaaatcacagtacactaacacgtaattataaatagtaaccggaaccctcgctgcaatacgcaaattggtacctactttgtaaggcacaggaaaccc

SEQ ID NO: 10650 - DNA, 437 bp, Saccharomyces cerevisiae
aactgattgcggaagaaaaaaggaaggaaagcgggatatatcgctggaattgtctctctgaatttgccattattcttattcaatgaatacaaaactggctgtcagcgaatggcatcattttgcaatccgaaaatgaaaaatttgggcgcctcgggcaggagaattcagaacccttaatcccgcacatctacgtaaaatatctctgaggtgttctatagtccatcacttaccatccatctgcaaggctgtatgattgataaagaggaacattaagggtaaatagatttgttgatttgtttgcactagtggctttgtattaaaaacttcaagggcatacacatgcattatattcaagagcacaaccaataatttaccattatagaaggtacttctttgaaaactaaatcatacactttttcccacgaaaaggcttacat

SEQ ID NO: 10651 - DNA, 446 bp, Saccharomyces cerevisiae
aagcaagccgaagcaagccgagccgagccggacggaatttatagctatagccgcaagaggttgcaattttcaaaaatggatagttcaagtagattgcgatacgcactccgttactattgtggttaacggggacaagaagaactacagaaaatagaatggtccgcagaggctgcgctcttcttttagcaactctcacacgacttatgttgcttattcatttcttttacagcattatcagaattcttccatctacggaattgagatcaaagaccgacctgttgtcggccgaaggacggacgcttatacccgcggatgtcaaagcgaagcccgcggggcgcaagtcgaggttaccggaattcgccaaacggcaaaggacccttgcattgcctgaaaggaaagattcgcttttctgtttgttgccacttttcttacatagtctgggccgg

SEQ ID NO: 10652 - DNA, 496 bp, Saccharomyces cerevisiae
ccgcgtattatcattatcattattcttattatgttaataattactgaacggttgcattgatagattttcattacctctgaccacaatcctgagcattggtattatttgttttgctattttcagatcaaattacttgtaaaaaaagaaatggtagtatattggcattgaacactggctgttctatttgtattacttttatgtgtagacatatattattaggaatttgtaatatcactctaattattatttggtattctttctctatctcccctgtttcttttgtctatctctttcttttttttttttaaacggcccttttttaatggcattttctttttcttataatgcccacagttgaataatttaactagcttttgactgacacataaacaataatgtatatggtccatccaatgaaatgacagttctattgcattttacctacttgtatattctggatactgcacaagaaaatgggtgtctcacaaatatggga

SEQ ID NO: 10653 - DNA, 461 bp, Saccharomyces cerevisiae
aaagtggattccaagattttcgtacttctaaacaaggctggtacttgttgctatttctttggaattatttgtaaatttatgcacgaagcagatagagttttatttattcaacagtatttatataataaatattgatcttactatacaactagattcgtataatcgtctgtttcgtcacagacgggaaaagagggacaaaaagagaaaatgttaaaaatattatggcctattttttggcgttcttcctcttttgagcacctttagatttgttatcattctttttcgcattgtcaactttctcagtctttttaccggcattggcagcttctctttcttcttgagcataaaactcctttaatcttttttgcaaatcccagttactgtaccacaaaccaatttgtaggatgataacaccggcaaacataactaataaaattatgttggaggaagcaataactgcc

SEQ ID NO: 10654 - DNA, 416 bp, Saccharomyces cerevisiae
aaaaccgaaaaccgaaaacaataaaaaatggaaaaacgacaacattccacccaacaactacaaagaaaagttaagggtaattttacctatttaggattttaatctgttggagttaaggtgaatacgtttttccatattggggtatgcagctcgaacctaaagtggtatgtacacatcccctcaagcacacccattacccttataggattaatgtaagcaacagcttacacggaattggaaatactattcaacgatccatgcatctgccagattcggacatgcatattccccaattggatatagaaaattaacgtaaggcagtatcttttcacaatgtacttgcaacgcggcgacttaaagttgaagtacaacctgcagcagcggctttttgtacggtacgccaaactgtcaatgga

SEQ ID NO: 10655 - DNA, 422 bp, Saccharomyces cerevisiae
atcctgtaaatatactgcttcaaagtttcttgccgatctatactcatcgcttgtaacgaagttaaaatttttttctttcactgagtgtggaaagtgaaaaattatcacgatggcaaaagagagggaagagaagccctagttactcgctgtattgaaaggatcaaaagaccaaagaccaccaggaataatgagtgaagttgcaccagaggagatcatagagaatgcagatggatctagatctatcattacatacaagattgaagacggtgtcaagtataagattactcagaaagtaaaagaggttaaagtattggaaaaagtccataaatctgttgcagaaagaaaaaactggcataaatatggctctgaaaaagggtctccagcaggtccaagtgctgttacagcaagattgggtgaagaag

SEQ ID NO: 10656 - DNA, 434 bp, Saccharomyces cerevisiae
ttttagagtcttccttgaccaatcatcttattcgcgcagggcaacccatgataggaaatgtccctttaaacgaactgtgggaaatcctgcaaaagtgatgaaagtgacgttttatgaaaagaaagtgaaaaagttcttgtttgacaatattctattccgaaaagtctttgtggtcagtattgtttctagaacgttctagaataatcctggataaaccaatttcggtaccaaaaaaaaaaatagccgcccagtggagcatcacacagccgtacatccggccacacacggtggttaccccacttcgtttcttttttcaggggcgatgccacttatcagttgtttttagaattcagtgtcatttgagggcggttcctccttttgggggtatatatagagaggctccgggttttgccacctttgaattcgcctgctta

SEQ ID NO: 10657 - DNA, 473 bp, Saccharomyces cerevisiae
tttttcgtcagctctccgagttcatagaatgcttattttattgtacttccctggtttgcgttgatgcaaataaagactaaatgtaaacttttatgatgcatatgatatcgaatgtttacaacaacgagagatcaccggtaagaactgtgctcaataaaatacaacatcgataaatacttaacgctcatccaccattcctgttcaagtcaactatctcacagttgcctcgtaatccaagagggatcccaatacaacgcctctgcaccaccttgataatcaatccacaataaaccgttagcgaccatttcatcaagagcagatttactcctaacagcctcccatcccaagtttgcctttaataaagagatacttgagtagcccagaattgagcatatttccaaaatctttgtttgatctgatgtcaactcatttggaacacttcgtaaaaactttttgccgcgaatttgaaatat

SEQ ID NO: 10658 - DNA, 448 bp, Saccharomyces cerevisiae
ccgcaaaggttaccataaaggatcgcatataaacaaaactcgccctttctcctgcatcccttaccgaaaaggaaagtttatatacacttaaaggaaagtgctactgtaggtcgtcaggccgttgatgtactgctcttcgagacaactattgtaccttaactgtaagaatttgctcaagccctcaaaaaacacaacgtgcgggtaacgacaacgaagtgggcgcaagacaaagatggaatatcctatccgatgggcactataaaaggcgaagggaaaattagttttttttcttgtcaagcatttgccgagcgcttcaatgttgattggtctagaagtaacaatcaagacagataaagtctagtacgtgtgcaggttaatgcgcaagtgagaagtgtagatattgtagttgtgatatttactattctaacttggcgctattaacgctttc

SEQ ID NO: 10659 - DNA, 438 bp, Saccharomyces cerevisiae
atgttttgttttagtattgttttggttattctgttgttttattcatgttttttgtactgcgggatgtttggttattttggagtttaaacgttgttgcatttttgtatattttcgtatttttttatttatttgaacctgtatttgtcgttgaaatactatttatatacacattgttgttccaattcctacaaagttatattgttttaaaaagatttcaaaattctttgaatcggaaatgacgagtaacagctaacttacattttaggtatttagttcttctttattaaagcctcctaaacaaagtggaaattgaggtgtaatgacgtacatctcttttctctttgtattattctttcacaacgtccttatttcacagtcaagaatctctaccaggcgctggacttctaattttcttctagcatcttcgatccagctttc

SEQ ID NO: 10660 - DNA, 403 bp, Saccharomyces cerevisiae
tcccactaatttcattgcttaataatcagaaattctatcacaaaccactcctaaaaatatttcaaatgtcctccgctgcaacaaaagctactttctgtatccaaaatggtccttcctttgaaggtatatcttttggtgcaaacaaatctgttgctggtgaaacagttttcactacttctctggttggttacccagagtccatgactgatccttcctaccgtggtcagatattagtcttcacgcaacccttgattggtaactacggtgtcccatccggcgaagcccgcgatgaatacaatttactgaagtattttgaatctccgcatatacatgtggtcggcatcgttgtcgctgaatatgcttatcaatattcgcattggaccgctgttgaatctctggcaca

SEQ ID NO: 10661 - DNA, 427 bp, Saccharomyces cerevisiae
acaaagaaatttcacaaagtgagcgtctactaatattgataatgccatttccacattacaactactgctaggcgcagggttatattacttacacacgcatatatatgtttaattgggtatagaggggttattgtttgaccatgccgaagagaaaaattgctcctaacaaggaaagcagcaggcgtacggtctcccacgatgatttaaccccacaaatacaagaatttcaaaacctaatggatctcgaatcgcaaaaagtggaaaacatcagacagtcgtattcgaggcaaaactccctgctggccaaggataactccatattaaaaattaaagttaatagcttggaaaaaaaaataagccagctggtacaagaaaacgtgactctacgatctaaaacctctataagcgaagctatctacagggaacg

SEQ ID NO: 10662 - DNA, 410 bp, Saccharomyces cerevisiae
atctggcataataaagttgattgtcttgacgttgcataaagatttaatttttatttactttgcatataccaacacagggaacatatttcatttattttgtaattttaacgttttcttttatggagtttaatattttagattacacctgtttttgcaccgtttaatggcataaaactatttacttaacttttaactcgggaaatatgtatcactatactaaaaaacattaatttaatcaaagaaaaataaatttaatgtatgtatctatatatatatatatatatcacttaaaacagacaatagccataatcaactgggttattattatacaatattaaaggaagaacgcatatttgaaaaaaaaataaaatgggtaatgaattttagcacaaatacttcacaaaaggaaa

SEQ ID NO: 10663 - DNA, 479 bp, Saccharomyces cerevisiae
acaaagacattaaggagcctttgaaattacttaattgaacaacacaggtctaattagttgatcaatcatcgattaaccattagtgataagaaacaatgtctttggaaagagaggaaccacaacatttcggagcagggccagctcaaatgcctacaccagttttgcaacaagctgctaaagacttaatcaatttcaatgacataggtttgggtatcggtgaaatttctcaccgttcgaaggatgccaccaaagtgattgaagactctaagaagcacttaatcgaactgctaaatattcctgacactcatgaagtgttctacttgcaaggtggtggcactactggtttttcttccgttgctactaatttggcagctgcatatgtgggtaagcatgggaagattgcacctgccggttatttagtcaccggtagttggtctcagaaatcttttgaagaggcaaagagattgcacgttcctgct

SEQ ID NO: 10664 - DNA, 497 bp, Saccharomyces cerevisiae
ggcgtttagctggtattctgcagaaactattggatgccctcaagatttaagtgaagaattaaaccgcacttatccgtctgtgaaagatgccaccatacgttaccaaccataaagaaagtggccgcacacaggtaccttagagaagccacaagggctcgattacacggtggcgatcaagagccatacaaaagtagaagacccccggatgaagaagcacctctttgtacgttccttctgcaacgccatatctaagtaacaagaaagaagccacagcattactacaaccccacacagggacagacagatatcataaacttgaatctactatatcatactctaataactacctaagcgttaagaaatcgtctaatcttcaactgccgttgttcataccgtgactaatagtggcagtaagcagctttttttttttttcaaaatttttcattttttttttcagttgactcgccccgtcggtagtgacaagtgccgactgactc

SEQ ID NO: 10665 - DNA, 492 bp, Saccharomyces cerevisiae
tttcgttttctcacaaataaatcctagcaggaggaaaagaaagcgcaggttgaaactccgttcagaagaagaaagccactctttgaaaatactgcccacgcaattgtccctttctgacaataagaccccttactactagtaaatgtttttattctctaagcttcttttcctctaacttcgacgctagagcaggcactaccctgttgggccgtacgtaacaacaacgaccccttatttagtcgaagggatcgccagaaacagggagcaaaagatatttaagtgatgagaatcaatttcgatgatgatcacaagccaatgttctttaaactcaattcttgactaataaaaaagcagctatcaacaaattcatactttgaacaagctgataaaaataagaaaaccatcgcatacacaaaataaaatcaacatgtctactgtaaccaaatacttttacaagggtgaaaatacagatttgattgtcttcgctgcatc

SEQ ID NO: 10666 - DNA, 478 bp, Saccharomyces cerevisiae
tacaaaagtgaagaactacaatggtttaattctactagacggcatgctaacctgaaaaactcaagcatttttatcttttcagtcggtcgtagctctccaacggttgttttttcacagtatatactttttcatattatcaggcgaaagatacgagaaagccaaaatcaggcacattgaaaggataaagccaaaatcaggtatactgaaaggatgaaaattttggcactagccgtcgcctttcaaggcttggcattggtatgctgtacggatacaacagacaattataacaattttacgcataatacatcgacattttaccgcatagcggattatgataagagattttggagcgtaaaactaccaccagtgaattggactacttgcggtaatgaagatcatccatggattactatccactacgacgagattgataaactcgttgacgataaactggcaagttgggacaaaggacctgttc

SEQ ID NO: 10667 - DNA, 460 bp, Saccharomyces cerevisiae
tggaatggtagtcgaaaggtaagaagtacgcagcaaattcaaccagaatacacactgtaccttttaaaattttactcatagtagataatggcataaatcagtggtaaaaaaagaatacgcatgacaaattttgaaaaccgtacgtgacataaaatacctataataagatgaagacatcaattctcaagttccacttttcgccggttgagtgtatcggtcatagtacaaaggcagaaatgaataatagtaatattaatcgcagtttcctgttgtttagagaactgaaacgctttgtgggcatcaggtttagattaactgctacccttcttctgtatttgtctggccatgcttctcaaataaaccgctgcggataacatttcaagtggtttctcaagggagaatcatagtttagcttaacatacagcaaatcgtcactatcttgactgatgcccggtgtata

SEQ ID NO: 10668 - DNA, 468 bp, Saccharomyces cerevisiae
tactaatgaataataccatccgccggtgtcacttgtttaaacatcttgcaagtaagtcgagatcctagagagccttgtacatgtgattgcacagtaaagaaggtatgcaggctaaattattgtttaccagactaaactttagacgtccctccacaactttacgccagtttcccctaacatgttttttatttcatagcaaagcattttactcggatctggtcactaaggagccgttgatcacaccgaaaagaataataaataagacgcctgggttaaacttatctatttctgagagggcttccaacagactagctgagatctaccgcaatagtaaggaaaatttaagaattagtgtggaaagtggtggatgtcacggtttccagtacaatctaactctagaacccgctaccaagccagatattaagaatgatgtcaaagacaaggagttttcagacgaccttgacgatg

SEQ ID NO: 10669 - DNA, 474 bp, Saccharomyces cerevisiae
ctgtggtgacgaaaacataactcaaaggatgttagaccttttttaattattgctattgtttggacttcccctactgtgttgttcaccgcgcttcaatagcgtttctaggtccgggatcttttccctctcaagctcagtttttagttcggagtcgagttttaatttgtctactttcttgatgccgagcacttcaaccaattttgtgctatcaaatttcttgtgcgtgtaaggacttattttgtttttcaatgagtcaggaagctctgggatttcaaattccctggaatcattgatcatcagttggtgaatccattccagtagcacctgttgttgcctgtagacaaaaaccgtgggtattctaagaggatcctttttgttttcctcttggtctttatttaaagagggaagtgggagagtggtgtctgttgttacttcgcctatgggttgatagtagttgcctaacggaatctctgg

SEQ ID NO: 10670 - DNA, 417 bp, Saccharomyces cerevisiae
tgcagaatatccgtacaataaaggaatttattggtcttatatattctacgtgggagctcgaaaagcatttctggttctatttagtaaccaattattttcactttgctcagaatagttctgcatagctatagaaagaaagttaacacaaagtacggaaagattgagtaaatatgaaactcggaagcaaacaggtaaaaattatatccttgttgctgctagacacagtgttcttcgggatcgagataactaccgggtacttgtctcactctttggctctaatcgcggactcattccatatgctaaacgatataatttctcttgtggttgcactttgggccgtaaatgttgccaaaaacagaaatccggattcaacgtacacttatggttggaaaagggcggagattttgggtgctctga

SEQ ID NO: 10671 - DNA, 452 bp, Saccharomyces cerevisiae
atctaaccgacccgaccggtttgattccgttagcatatttcaaagaaacgggccttttaatgatttaacgaccatataacttcaataacgtgtatgcatatataaaatgatcatgtcaaacatcctttatattacttcttaaatacatgtttacgataaaaaataaaatttacattataagtttttgattgcccatatttgttgataagaatgtagccttaccgtggccggtttgttcacctgtaacctctttgggggcgaccgttagtactgcgcgtgtatgctggtgcaggtggagctgtcacaggcggtctgttatacattttactattatttctgtttccattcacatttttgttgccaccaactactggaggtgcagtattggcattggaatgtttctcattttcttctttttgatgcatgagctccgcttgctttctttccaatgc

SEQ ID NO: 10672 - DNA, 457 bp, Saccharomyces cerevisiae
tcactgtcctcgttataagtgattcgtggggtaacggcgatatcatactattattggcccatctgatggattagaagacctacaggttaatgtgaagcgacactaatgataagaaaactgcatcggatcatatctgtttttgcagcgtggtatattggttgttggtcatgtttcaacgaaagactttacagagaaggaacttgaaagggctcaatcttaacctgcacccagatgtgggcaataatggccaattgcaggaaaagacagagactcaccagggacaatctcgaatagaaggccacgtgatgtctaacattaatgcaatacagaataatagcaacctgtttttgcgaagaggcataaaaaaaaaactgacgttggatgcgtttggtgatgaccaagctatatcgaaaccaaacactgtggtaatacagcaaccgcaaaatgaacctgtttt

SEQ ID NO: 10673 - DNA, 466 bp, Saccharomyces cerevisiae
tttacatctttcacaagcacaatcaaaaaaccaactgtcggccaaaaaggcccggcgttttactgttggtaagtccagtaccccggaataatcgatacagatctgctcatccttttttatatctctattcatagtgaatagcattgaattacctttacgatatttcgttatattggggttacaagagtggttgaaataggaggcttctggaaatacccagtatccaaaatattctctgctgtctgaggcttcgccctcttgccataaaccaaaagcattcccatattcagtacctaatatatgtctcaatagcggtatggagagcattctatgcaaatgtgaaggtaatagaatatagagtgtttgaaatactaatttttgaaagtgcagtaagacaggaaatttagatattttgctaagctcattcgattgtaacatattgaaagctcggtatgttatgcactga

SEQ ID NO: 10674 - DNA, 429 bp, Saccharomyces cerevisiae
aagaaaatataatagatgcttgtaggcttcaacatctattagagtcatcggcgacgagacgccaaaaaataaagcgcaaaataatcacacccattttttttgtcgagaatgagaaggagatggcttagaactggaaatataagggatagtggcatcacgagaagctgttgttctgtttttttaaagtgtcaattggcctgattatactcataactgcattttcatcacttccacgatcacttgaagttgttacagcgagtgtttataccttcaattctcgtgtcacattttgctatgaataggactgtctttttggcatttgtatttggatggtatttctgttcaatagctctctccatatacaatagatggatgttcgatccgaaggacggattgggtattgggtatcccgtgttggtgacaacattc

SEQ ID NO: 10675 - DNA, 490 bp, Saccharomyces cerevisiae
aataacatataagacagtcaacctcgtggtaaatgataactatattctggggctttattcatttttttacacttttttatctttgtacgaagagctgaaaataaaaaagtatagagccagccttttcccacacactaacgacaaaagacgatatgcaggctgtgcgcatgggggagaatccagtttttgcccgttaaagagaaaaaattagtgtctgtgaaacgcgaatacaaaaaaagaaaagtagcaggatcttacttctcgtaaagacgtcaagaaccaaatcaagtcaaatcgtggaagttacaaggggaaagaccaataacttttagtaaagaacaaagaaaggtctatctcacgcagtgacggtctttgcggtaaatctgtgtatacttgaaagaaaacccttttacaattaaaaaaggcaattaaaaatagaaacaaatcaaatgagttataataatccgtaccagttggaaaccccttttga

SEQ ID NO: 10676 - DNA, 496 bp, Saccharomyces cerevisiae
gaactgtttcatcggccctatatagcaattacatccttccgttgctgggtccctgcctagataccatatttgttgttgaattaaccgcgggaacccgcaatatacgaaagacgaacacaagagagcaagcacacacagctagtgcgtagcgttgctagctatattgccatggtacctacctttcacctccttgttaaatccataagtggacggttttcctaaaccagtatttatcagttctcgagcacgcagagaaaagtaaacgaagcgacctgcattgcggtaactataaacacccagccgcctccagcagaaccagccatgtgcgaagaaaaacaatttttcggccaaacttaccaacaatagcgacgcgttcctcacatcgttgggtttttttcgcctctcttcaagtttcctatacccgagcttaacacaacacaacggaccctcttaattagaggtatcctccgttcttttcttccgctttcctaatcga

SEQ ID NO: 10677 - DNA, 465 bp, Saccharomyces cerevisiae
tagacaaaattacccgcgcaggcctatttttctagaagacagaagaaaaaagtgggcagagaaagcgaggaaaaaaagaaatacatatgaagaagaaaaaagctgaaatttaagcaaatactttttggacaaaatcatcaaactactactaaagtttgaaacgatcggaaagttacaacacatttacgataaaatatggttgtcttgaatccaaataactggcattgggtggataaaaacaccttaccttggtctaaggactacttgaacggtaaattaacgagtttgtccactgtttcctctgatgggaagagcaaaattgagttaacccaggtgagtagcatcaccggtgactccaacgtatctcaaaggaagggcaagccgatttgctactttgacttacagttgtcgatgaacgtcaaagtgacaaatttggatactaataaggacgacgaggatgatgac

SEQ ID NO: 10678 - DNA, 447 bp, Saccharomyces cerevisiae
acgtcttaatgtggtagtacgagttttttctccgcaatctcggagttagtgcagccgcgcccgctgctgcaccctttagcatatatataaagtgcgtaatgtgcgtgctaaaaaagctcactagtgcgtactctgcttatctctgcgtatccgccgatcaacatccgcggctaaaatggaacagaacaggttcaagaaagaaacgaaaacttgtagcgctagctggccgcgcgcaccgcagtcgacgctgtgtgcgacagatcgcctcgagctcacatacgatgtgtacactagcgcagagcggcaacgccgctctcgcactgccactaggcttaaccttgtgtttttgcacggcagcggcatgagtaaggtggtatgggagtactatttgccgcgtctggtagccgccgatgcggagggcaattatgccatcgacaaggttttgtt

SEQ ID NO: 10679 - DNA, 413 bp, Saccharomyces cerevisiae
tacatgtgcatgaagtattatgaaaaaaagaagtatatattcaggaaccgaacggcaacaacatcaatacataaatcacaatcatctatatttattgcattagattaatcacataatataaaaaatttgcatttgaataccggggtcacttctaaattcataaaaataagctgattttcattctaaaatggctcttttgctaatgcagtctctaccggtactcagtttgagatccgttccccacctggagggtggccaaacaattgttatagctttccctatgaccaacccactggaaatggggccaaaagtattgctatcaatcgaatgaaaataattgtccccttcgacccatatgtgtcccctgggcaggttcacttgaggtttagggtatggaaacttcgtgtcaatgg

SEQ ID NO: 10680 - DNA, 401 bp, Saccharomyces cerevisiae
atctcagtttcttcttgaaatttagcatcgtgcatgggatagcggctagtaaaaaagaaaattaatatctcattaacaaagttattgtacataatccggtacaatattcttcaatgtactctctaatatcgagcacactggcaatattcatgcacacattcgcctaatgctgacgaatgcttaatcagtgcaattactgccaccctcttgatatgtgggctaaatcctttaggacctgtaaaaaatgcaatcacgttttcacatttttttttttcttgcggaattgcggaatttcccagttggcagcgttatccgatttgagatcgacttgcatcaacctttgaaaaatataaggatgagaaagtgaaatcggttttttttttccattgtcgtcatcaaca

SEQ ID NO: 10681 - DNA, 438 bp, Saccharomyces cerevisiae
acgcagtagaggagaagttcttttacaaaaaaacatgcttgcgacagcagctagatagaaaacttgcatattgtaatggaagacagtcgagagcaagccattggcttggacttgcgcttggacctatctttcggaccaactatttaatgattagtaagacaaaaatgacatttaagcatctataaaataagaaaaataaaaaaatgaagggaaaaagctaaacactaacttcttgaccaaacaaacaaggaaaagccagtaattgcgtgaacaaaaggcacctgcaattgttctgatggatgtactttgtccaacctattctgcaagaaaaagaaatcaactccaaagaagtatggagcttactggcactctagcctccaaaagctgttaaagtgttcattcgattgtcaaaaatcttccccataataatcacccacc

SEQ ID NO: 10682 - DNA, 476 bp, Saccharomyces cerevisiae
ccaacttattgatactaacctaaaactgtatacttatacatttttatatatcctccctctcaccctctccattcatagaatttgtaatactagtttaaataatgtaatattatgtgtaattttaaatagtccatgaagattccgcacgttttcattttacagtttttgacacctttacccgacgctttataaaaaaaatagtataagcatcacgacataagcagcctcaggtcattaaaacaataaaagactgggaattataaacgtacaacggtaaggtcattcacgcagtgtatatgaatgactgaaagtgctatagatgaccaaaggtttaatcttacaaaggagttacaacgacactcatgcagagatcaagggaaaataacacaaaaggatgatgctttagattttataagttacagttcttttcaatcctcttttaatactgaccaaaaaagcgcgaacaatggaagtac

SEQ ID NO: 10683 - DNA, 424 bp, Saccharomyces cerevisiae
aaatgacctagaaaagtaaggaacgtacgattggtatcatgatctcttgtgatgctgtgctactgtggttgcttccacactatagcgtccatcgctacttacgaggggcgacagccccttcggacttcgaagtgtctggccgttttttcattgaattttcttataaatgaatacatatcggaaaagccattgttgactaaagcaagccaaagccacacaaaccgaggacaaatagaaaagcatggctccgtatccatacaaagtgcagacgacagtacctgaacttcaatacgaaaactttgatggtgctaagttcgggtacatgttctggcctgttcaaaatggcaccaatgaggtcagaggtagagttttactgattcatgggtttggcgagtacacaaagattcaattccggcttatggac

SEQ ID NO: 10684 - DNA, 437 bp, Saccharomyces cerevisiae
ttaggaaagtgaaaattgagatcattaataaaatactacagtggcatacatattcaatgagctgagcataattattagcattatgaattggaaccacgtattttgctcggtgtgatataactacaatatttactctagatgcaccattctacgtttaaaagatactggactgtcacaacgtaactggtttgtcaaaatatttgtttgtgttactggtaatactcatcaccatacttatattcccccaaacctggccatctgtagccttatgactatgtacggatgttaggccgtcttcgttatcgctccgttctgaaaatttcttagcgaggacgtgcttctccagcgaaagtctcagaacgtttgttgaaaaaaatttcatccacgcaacttttttttggatgtgtaagaccaatttttttggcattgggctattc

SEQ ID NO: 10685 - DNA, 471 bp, Saccharomyces cerevisiae
atgcatcaaaataagaacacttaaacaagcacggtagtgttggtactctgccatctatttgtatggatactttttgaattttgatgtaacggatttcggcatacaatatatgggatctatggggactaaattgtcgtatcccattaaacttaaaccagcaacaccaaaaactgtatggaagacatccacttcattttcaggcctgtcgcttattccacccttcttctcatcttgacatttgagtataaactcagttagcttctcataatttatccaatctagtctaccaataatagctaatgaagataaaacccaccaactatagcaaacatcgggcagtttacttggcctaccgtttagtccaccttctggtaattgtcgttcgcaaagccaccacccaatttcttctagttggtcgtcactaagcatatccaatttgttagcaattgccaaagcgccaagacaggtaaa

SEQ ID NO: 10686 - DNA, 424 bp, Saccharomyces cerevisiae
aaaactactgtgttctgttatcgcttccaataaaaaaaaaaaaaaaaaacctatgcaaaaatttcagtcaaagcataacaaaacgaaccttttttgtactgctcattgaagtatttacggggcagtatgggcacttgaaagtaattgttccgttcttcgataatctgtctagcgcctttttagaaatgatgtgatggcatgccagtgaataaggaggattttctgtagtggtttcctcctttaagacgggacagatgaagatcggatggaaatgagtcagaaaatctggtaacttgacatcaaatggcaactcatctttcgtagtccagtcaacgtgcgctaactccctgatggttttgtatttgatgaaaaattggaaagaaattaaaccactcaatactatcaaaaacaagggagagtcaaa

SEQ ID NO: 10687 - DNA, 463 bp, Saccharomyces cerevisiae
taaagtctattttcaatttttcaagaacttgaactacgtttgtaagtatgtttcaccagatataacgataaaacaattcccactgctgccagggctatatttggaatataggaaatcaggaatgcctttttgtagacatcaagaatgcgaacaaatatatccgttggaaaattgggccctctcaagtaactcgaatcattgataagggagtagtactgctttttggtgaagtgatattcgtcatcacgcttggttttgaacatataattccataacatggacgacaggctattctcataggacactaaagttaaagaggcaccaagaacgttaccaatggatctccacaaatagaaaacaccagtcatggttccttgctgtgatttttcgacggtgaatacgatgcttactaacgtggccactaatagacaagcgtaaccaaaggacacaaggactgatgcaa

SEQ ID NO: 10688 - DNA, 418 bp, Saccharomyces cerevisiae
tattacacagaattattttcttcacttcctccgtcatcagattagtagcttcctaatacctgtcacaacttcccatttattcgtgtgtttgttgtatgtacaacccagcagctttttattggtaacgggacaatggccttcattattaaccaaatagcttatggcacacgggtagcatgccacgtatcctgtttccaatacacaggggttttgtacagttttttcgcaaacgggacaggcctcagaaactccctctttatcttccgttttgtcactatgtgaggagaaaggcggccttggaatatcttcatccaagtcattgacccttttctgcaatttagtagtcatgtcttgtgtggtccaccattggtacactcttaggacaaatataaaagtggggaagaattgcgaacccata

SEQ ID NO: 10689 - DNA, 500 bp, Saccharomyces cerevisiae
tgcaacagtcgtgaggtgattaacaaacagtatcagactaaactcaccctttggtgatatgcaatttcttgaggcgcaaaaggttgatcctgaaagcttttgtgatagactaccttcaagcaaagcgaacgtaaacggcaaagatggataccagcaaccacaaccaagaccacgactcccacgtggcggcacagagggagaacgacaataattatatgccaccttccccctccatgagcgagagttctatgatttttgaaagaaatgtagaggacccatcatacctttataaaacggtgtcaaacaacgctgcaaactctctctctaggcagagcagcaggaccagtttgttcaatcataataattctagtaataggaacttccataacttaagccagagatcgtctgctgtgaatctacatttgcaaccttctaggactaatgagtcaatagcatcgtaccagacatacaatccggattttgttgtgcagactccactg

SEQ ID NO: 10690 - DNA, 426 bp, Saccharomyces cerevisiae
agtacaagttatgtttaattggagggatcagtaaaggtttgatatatacgtgacaaaatgtccggcaagttccctatgttatcctgatagcaatatttccaatactcaatccaatgatcatctgtttctggatctttaggtgagtcaaagcgcagtttctgcttcaattttgttttcatcttgtctattattattctgggatgtctgaattggtaagttcggggatgataatcgtccagagattctgaacagtcattatcttcggatattttttcagcaacaagtaatttcccctccatagcagtcaacagtaccttaggtagttggtagtcagttacttcatcaggattgtcacaagcatcaataatattttcgatgatacataagcattctatggtcaatttatccatttcagatgatgcttcg

SEQ ID NO: 10691 - DNA, 433 bp, Saccharomyces cerevisiae
cccatcttcaacaacaataccgacttaccatcctatttgctttgccctttttcttttccactgcactttgcatcggaaggcgttatcggttttgggtttagtgcctaaacgagcagcgagaacacgaccacgggctatataaatggaaagttaggacaggggcaaagaataagagcacagaagaagagaaaagacgaagagcagaagcggaaaacgtatacacgtcacatatcacacacacacaatgggaaagctattacaattggcattgcatccggtcgagatgaaggcagctttgaagctgaagttttgcagaacaccgctattctccatctatgatcagtccacgtctccatatctcttgcactgtttcgaactgttgaacttgacctccagatcgtttgctgctgtgatcagagagctgcatccagaa

SEQ ID NO: 10692 - DNA, 400 bp, Saccharomyces cerevisiae
tcatgcgaagaataaatttaaaaaccgttaagcctgtaaattcaatcattatggtggtgatgatccgttttggaaatgtttcgtccttgactacctttgtttaacatgatattggaacgtcaagacatattgagaataggtaccgttataatgcataattaaaaattgctttgatattgaggtggaaagctgggtcggaccttgacatgtattaaatttaaagaatcgaacctagtgtttttttctccagtgttcaaaaaatcctttcaatttggtctactgcagtagcccacttataacacacattcaagatgggtgaaccgtggctcaaacttccccatttttcagagtatgtgcaaccacaaaacctttgtcagaaattcttatggcaggccaaatt

SEQ ID NO: 10693 - DNA, 449 bp, Saccharomyces cerevisiae
ctccacctaacaaacccgcaccaacaccaagtaaaccacccatcatggcaccgccgtgtccactacctttactggtgcttggcgcagttccatagtatgcttgctgtggtgctgctgctggcataggggcttgttgaggatagtaacgctgctgttgagggtattgagggtactgaggctgttgaggctgatagtaacgaggttgctgtgcttgggcccctgcttgcacttgcggtgttgattgagaagaataaggtggaggagcctggtctgcctgttgacgagaactcttctcattgttaacacctggtggaggacctttgggtcttggccatgttgttccccttggtggttcccactgagagctgttcgtagataaatctacataataccaagtctggtattcatcatcaaaaacagccttccagccagaaggcacttgaggagga

SEQ ID NO: 10694 - DNA, 495 bp, Saccharomyces cerevisiae
aaatccacaggaaggaatagttttcatgccaggtcgtactgataaccgcagcaggtctccaaggtgaacagcctctagttgatagaataatgtagataagggaagtcggcaaaatagatccgtaacttcgggataaggattggctctaagggtcgggtagtgagggccttggtcagacgcagcgggcgtgcttgtggactgcttggtggggcttgctctgctaggcggactacttgcgtgccttgttgtagacggccttggtaggtctcttgtagaccgtcgcttgctacaattaacgatcaacttagaactggtacggacaaggggaatctgactgtctaattaaaacatagcattgcgatggtcagaaagtgatgttgacgcaatgtgatttctgcccagtgctctgaatgtcaaagtgaagaaattcaaccaagcgcgggtaaacggcgggagtaactatgactctcttaaggtagccaaatgcctcgtcat

SEQ ID NO: 10695 - DNA, 426 bp, Saccharomyces cerevisiae
ctagatagttgcgagccccaacgagaagattgtcagacaaagacaacattcaacaacctacatccgttactattcgttaactcgaggtacttgaaacttttcagttaagtatgaacaagaaacaaaatttttacgcagccattattgtggctatttttctttgtttgcaattgtctcatggctcttcaggtgtcagctttgaaaaaacccctgctattaaaattgtaggaaacaaattctttgactctgagagtggggaacagttcttcatcaagggcattgcttaccaattgcagagaagtgaagaggagcttagcaatgcaaatggggcttttgagacaagttatattgatgccttagcggacccaaaaatatgcttaagagatattccatttttgaaaatgctaggagtgaacacactgcgtg

SEQ ID NO: 10696 - DNA, 418 bp, Saccharomyces cerevisiae
taatattatgctcccctggattttatgcgaagacactgctgaaaaaatttctgatatatgcagagaaggagcaaataagccagttttaaggaaccgagataagctgttttcgcccattgttctagttctacaaaatatctacagggaatcgatgaggttgtaagaaatcctgaatactctatgatagtgcataacactaaaaagttgaaagaatcccgtatcatggacgatttccttgaacatttgagcaaagacgataacaaagcatggtatggcgcggaagaaaccgagagagctgcaaaattagatgcaatagaaacactacttattacagatagtgtactaaaaaggaacgacgtgaaaaaacgtgaaaaatacctagacctaatagagaatagtggaaacaacaatggcaaaa

SEQ ID NO: 10697 - DNA, 408 bp, Saccharomyces cerevisiae
tatttgtaagctttgtcgatgggataaaggtaaaaagaacaacgtaattaaatcattacgaaaactctactgcattattttttagtctttttatagagacatgaacattcaattactttcaaggataaatattctaatattcatattattcacttatgtatttttaacgaaactctactccattctactgggatcgggcatactttacggggtgcacggattttagcagtctttttctttcttggcttttgcgagatgccttgagaggaagatttttttttcactcaaaacctctgtcttgtacatatctagaacatgtttcattgatattggacgttactatttcaatttaacagtcaaccagtcgtccaaaaatgtccaagatcacttcttctcaagtcagagaac

SEQ ID NO: 10698 - DNA, 499 bp, Saccharomyces cerevisiae
tgcccctcataattttctcaatgagatgaaagaactttgagagagtcaatataatacctgtagcctttttctgaaaatgactgatagtgagaatgaatccaccgaaacggattcgttaatgacgtttgacgattatataagcaaagagctacctgaacatttacagagactaatcatggagaatttgaagggttctactactaatgacttaaagcaaacttcaaacaactcagagtttaatgtcagtaaaaacgggagcttcaaaggtctcgatgatgcaattcaagctttgcaaatgcaaagcgtgttgcatccttcttcgttaggatcgttagcaacgtcctccaaattttctggatggtcgtttgctcaagggttttttgtaggacagctaagcatagtgttgttgttcatctttttcctaaagttctttatattcagtgatgagccatctaaaagtaagaatccgaaacctgcagcctcccgtcacagatcaaaa

SEQ ID NO: 10699 - DNA, 461 bp, Saccharomyces cerevisiae
attaatgagttactatccgggttacaaatcctgagagtatatttgtactaaaaaaaaaaattgtaaatctagtaattgaaaaattttggcgatgagacgatatggtaagagtaaagcaaaggaaccgtcatgtcgtttactgctccttcagatcccgtcaataaaccgacaaaagtgaaggtatcacagttgtgtgaactatgtcattcaagaaaggctctcattagaagacccaaaaacctgtctaaactttgcaaacaatgcttctgcctcgtgttcgagacggagatccataacactattgtagcaaataacttgtttcagaggggagaaaaagtagccgtgggggcctctggtggtaaagactccacggtgttagcgcatatgctgaagcttctgaatgaccgttacgattacggcattgagattgtactgttgagtattgacgaaggaatcatcgg

SEQ ID NO: 10700 - DNA, 461 bp, Saccharomyces cerevisiae
tagggccaaaacacaactgatagtaacaatcaccaagagattctacattaaaagtgtaagaattcccacataggagtgctctaattatgtcatatatgcttaattttcaaaataaaatagccataaactgtgttgtgacgcaactgcaactcccagatgaaatacggtccggtaaagataggaatattctactctacaagcatgaatattttttaacgcggcgcagtactatacagcataacaggtcttccacgcatgagaaactgtccatggctaaattagttcctcacacagaattagaaatgtgctgtgacaatggcacatacgtagataaaagataaatataattcagaatggctgtggcgacaactattatcatagaggtgtcccatcgagcgagcctcattggccgggtaatcgacatcaatattgaaccaatcacgacgctttttctcttcacc

SEQ ID NO: 10701 - DNA, 435 bp, Saccharomyces cerevisiae
agggaaatttaaaaatgtaacgtttagcatttgatagacatagaataaaaataagtaactataaaaaaaggaaaaaaaaaattgggcaaaatagggatcatattataactatttatatacagattcgaaatatgaagaagagactatgaaaggtgggtgaatatcaatattaaataaaaatcaaacaatgattgaaaaaacggtaaaagatcataaaaagccctccaggtaatatgtcaataagtaaatatactttatcgaaggaaagatcaaaaaaaaaaaaaaaaaaaaatgcaaacgaacatagccaaaggaccacaatattaatctgacaataaatttggaggcagtcaatgtaaatttgtgaatataacgacataattgcattatgctttgctataatattgaaatttttcgaaggagctttcaatctca

SEQ ID NO: 10702 - DNA, 496 bp, Saccharomyces cerevisiae
agttatattattttctttcttttttttgatggacccaagatctcaactttcaagttattgtctatattttgctaaaaagccaagacgcaaatttacaaacttcattgtcattgaaagtcgggctaactacttgtaggcctattggaaacccatctatctcaccagattgtattaaatcattccaatatgttttgatcattttatcttctggattgagcgcagaagtggtatccattagcccatcaatttggcaatcgacactacctacaggtatagataatgatgggaaatttaaaacgttgaatagtaaaatgtatcgtaaagttgtctttagcatgtcaccaggcctaaatggcatcagcgttgtaggagatatgataacatcaggcctttctgattccgggaaagaaaggtaataatctctcattaattgttgtgcattataaactcttttggtcaaatcccaccattcattaacagtatatgggggccttcc

SEQ ID NO: 10703 - DNA, 456 bp, Saccharomyces cerevisiae
ataatgtacacagttagcgtctaataattaattaacgataccaatttaattcattcacgtattcctcacctcgtgtgtaaattactaacagagtagtaataataataagaatcaataataataataaatccatccttgtgtattacccgggttagagggtagaaaaatttttgaaaatcgcgatgagctgaaaattgaaaatatttggttataacataagatcgataaattaggaacagtgcattatacagtggactcattcggttagaagctttagacgtcgtaccttttatatcgatacaaataaaaataaaattataccatgggaaaggctgcgaaaaagaagtactccggagcaacttcgtccaaacaagtctctgccgagaaacatttgagttcagtatttaaattcaacacagatctaggtcagcatattttgaaaaatcctttggtggc

SEQ ID NO: 10704 - DNA, 473 bp, Saccharomyces cerevisiae
gctcagtaaagcgttaaataatccttttaaacattaatagcattgcataaaaaagatggtcataaaaaagactgcagcgggaagtaaatggtttcctggtctgtattagacaaactttggaatagagaaggatatggtttatgtccaataattattatccgagtccgtgtatttttttacatcaactggaacaatttattacccggatgtttaaaaattgttgtcgcctggagaaagctaatactagttctggccatattttcaaccattaaacactactaatgtaattacttgacttatttgctcccactcttggtcggttctttcccatggcgcattctaccattctttttttctactccaatcgttcttactggaaactgtgggaatagcgaagaacgactattatttgctaatacagagtaagctatcctgctgaataggtagacgatagtagtaacccaacgccgcta

SEQ ID NO: 10705 - DNA, 426 bp, Saccharomyces cerevisiae
attcttttgacatcgcaaggttactcgcatccactccctattatttactctgtttcaactcattgtaacttcattttcgctaacttcccgccagaccagctcttcaatccacacttgccagataatgaatcagtctatttcttcgttgattaagcttaaattccttcaatcacacagtaacgataaaaatggcaacaaaaagggcggaagcaatgtttcaacaggcatagataaattaagagagtcggaaagttatagaagtccttttcttcaactcgcagaaatacaggaacacactaataatgacgacgataaacttgatgtaaaagaatgcgagcccacaaaaaaacacagcaaactaagcaggatacggcgtaagatgggtaggttagacttgaatttcaggtcagccaatgaaaagggttc

SEQ ID NO: 10706 - DNA, 419 bp, Saccharomyces cerevisiae
catttcaatccgccctatcaatgctaacctgttacgaataccaaaaccacaaaaacacggaccttgtttaattactgtatgaaataactgtactccattaatattcaatgcatttagtccttaaaaatcagcgggaatctaataagccggcgaaggtactacacctcacccttactgttatttaaaaatcctatttgtggggatttgcaattagttttcatcgccaaataacaatccttcactgcacaccactacttaaaaaaagggtacattgctaacattcttggtatgaaaaattgcagtcatttagattgagttggcaaaaatacaaatttaacgcatgagtataaaatcgctattcgctttattattatttcctccctgattaataaatatcgaagggtaatcagggttacggg

SEQ ID NO: 10707 - DNA, 476 bp, Saccharomyces cerevisiae
atgtatttatgattgatgtatttttttacatggattttttcgtcccaaaaagggatgatagtgttggcagcgggcaaacacaaaatagtgtcatataagtggaaaccctatggagaataaccataacaacggccagataggaggttaatcttacacatgtgtgatggattctgagttgaaagggcagcagctaagtgatgcagaatggtgtgttaaaaaaattaatggtgagggaaattgtctcctattatttctaccgatgtcatctccaaccacaattgtaatgattgttttagtttccttggagcgcttagttccctacgttttcaaactttcacaaactcaattatcacagcaatgccagagccaaggttttacggatagtatatcattaaatctaattaaactaaaactaatggacattctacaagctcctcaagaaattaaccaaattggattggtagattcaaatttgg

SEQ ID NO: 10708 - DNA, 468 bp, Saccharomyces cerevisiae
agaggaaaataatatcaagtgctggaaactttttctcttggaatttttgcaacatcaagtcatagtcaattgaattgacccaatttcacatttaagattttttttttttcatccgacatacatctgtacactaggaagccctgtttttctgaagcagcttcaaatatatatattttttacatatttattatgattcaatgaacaatctaattaaatcgaaaacaagaaccgaaacgcgaataaataatttatttagatggtgacaagtgtataagtcctcatcgggacagctacgatttctctttcggttttggctgagctactggttgctgtgacgcagcggcattagcgcggcgttatgagctaccctcgtggcctgaaagatggcgggaataaagcggaactaaaaattactgactgagccatattgaggtcaatttgtcaactcgtcaagtcacgtttggtgga

SEQ ID NO: 10709 - DNA, 442 bp, Saccharomyces cerevisiae
atatgagcataataaaaagggagaatattaactattatcaagtattaaaactattctttaataaagatggcggcggcacccataccagtaccgatacacatactaacaaccccgatttgatcctttttcagttctcttagtatggtagctacttgccttgcgccagtacaacccaagggatggcctaacgcgattgcaccacctcttggatttactttattcaaatcgatgcccagtttatggatgcagtataatgcttgggccgcgaatgcttcatttatttcaaaaatatcgatatcttggacttgcaagccagtagcttccaggacttttggtatggcgtatgcagggcccacacccatgatttcagggggaacccccactgtttgaaaatcgatgtagcgacctagcacaggcagatttaactggttggctacggacc

SEQ ID NO: 10710 - DNA, 415 bp, Saccharomyces cerevisiae
tcctaacgccgcttcgaggcgggtgagcataggttattgcctgatgagtaatttcttagcgagaattgataaaaaaaagcaaggctattattaatatacgtgctattgtgaaattttcattggcgtatatatgtgaggtgaatgtaaatatctccaacaaaaagcagaaggctaaaaaaaaggaaaggaaaagaagaaaaggcaacgtcgaaaatgtttacaccaattgatcaagctatagaacacttcaagcagaataagtttgtaattgttatggacgatgccggtcgtgaaaatgaaggtgatcttatttgcgctgctgaaaatgtcagcactgaacaaatggcctttcttgtacgccattcctcaggctacgtctgtgcacctatgacgaatgccattgctgataagttgg

SEQ ID NO: 10711 - DNA, 469 bp, Saccharomyces cerevisiae
tgtctagtcattcaaaattgctacgaaattagcgtatccgaaaaatcaaaagaaattttatctgttttaattggcgtggggaagtggggtagggtcgaggatcattacgctttctcgtgggaagggacagggacggaccgaaaaaaaaagaaatgccgcagaaaaagaaatgttttagtgtggggtatgggctgaagctcgtatagtgcagggtgacttcacttttcttttttaccctgcaggaaatggagaaagtgtttgatggataaggtatatagtcataaggtgacacagcgtgggtgtacatctagaaagcttggcgattcgagcgaagtggtggtttactcgttttataataagagtttttggacattattttttctttaggacacagttgattcaaattctacacttgttttgtcgtctggtaaagtttagccattgtaaagtggacaaagaagaagctgca

SEQ ID NO: 10712 - DNA, 480 bp, Saccharomyces cerevisiae
gtaaagagaaataacgttaaaaataaatcaaagataaaaacaaatcagttttgtttaacaaatgctacactacatatggtcgcaccctggaccccgccaaattggaaaacagggtattttattgttttccacattttcaaattatcagtctctatgatctttactagttcatcttgtgtgaaattacaagaagtgatcaagaaaataccgtcttttttcaaaatcctttccactactccggcgtatacatcgactacatcaagtttaccgttgatcttcatgccactcaatgaaatggcatctagggtccctttatccaacacaatgtcatactttcccggcttccagtcaccactaaagatgtctgcttgctggaaactgatgaaattgtcaacaccggtggcctcggctatattactagcgagtttgacgctttcctcagaatagtctatcccgaccagtttcccttggaattccgtt

SEQ ID NO: 10713 - DNA, 484 bp, Saccharomyces cerevisiae
ggttgattatgaagaaaattccataattttgcgaggtgggagaatactcttgggaaagtgttgagaacaaaaacgccactaaaaacagcaggattattaaaaagtaaaaaaaaaaaattccttttcaagcaggcaaacaatgggttatttgaatggagaagtatgctactatttctgcatgttgtggatctaaggcgatgtgggcctagattctttcctttttttgtttttaccttaattatcttacgttgttctttccgtcagttttacacctgacatgggacaagagaacaaattgtgaaataagttcaagcctctgttgacatttattgatgtatctatttctttgagggttaattaaagataacaaattgctttcttccgctaatttgagcctattgaatttactgggaaatgccaacgtggtcagacatcaattcaagaagtttagttctcagagagtgtaacttgcctgtttggtcgc

SEQ ID NO: 10714 - DNA, 434 bp, Saccharomyces cerevisiae
gacgagtataaaattcctcagtttctactatgatttttttccttcttttcttttttttttgtgtcatgttgaaatgcgcagtccgaggaagcaaggacacgaaacaagagaacaatagggaaagtggggtacacgagcattcagaaaacaaaacaaaaggatcatcgcgtcgttcagcaagtaccatataagcagcaaaacgaagaagatcgagtgtgaagtgttaatgtttggtaaagttttcgtaagctacatcagaacaagaattgggttcaaacctttaagcacgatatacacgcctgtttcttcttcttcgctcagcttcgataaggaggcatgtttcccctttaaaaaatggcacgaactgaatatgtcccagaagcaagagtttattcagcgttttgtcaaaaactacaggcaccaatacccaagtt

SEQ ID NO: 10715 - DNA, 448 bp, Saccharomyces cerevisiae
aaagagaacttggcaagcaggtctgtcgagtctttcccactacatacatattttatagaataaatcatttttacttaacttgaaagttgttgcgttcgaaaagaccacggctaacggagaccacttaggtaaatgcatgccagtaagaggtatattagtactttaatgaatgaacttagcaaggtaatgcctgcactaaaataaaattctaacgtcatcctaagaagcatcaattggacatagtgaggaaaagttttcaccatttaaaatttgttttgcagaataccattctagactatgatcccttagagattctcattctttaaatatcagcttcaacagcatatctttatagtattatcgtactactggcgacattagcaaatcaaagtatttttgctcagtttctagttttatctgtttgattccccattagatggtaaacacg

SEQ ID NO: 10716 - DNA, 444 bp, Saccharomyces cerevisiae
gcagcacaactttgtacctctcgaacatctttctacgcattggcatttaacaaacctgacattcaaagtttactacgaaagtcgaggcaacattactgaagattcaaatcaccgaaatgaacaccgataacgcaataataatgaaaaaaaacaaaaaacaaaaaaagataactacaataaatttcaaaagaaaaatagcaagtatcatccggctgtaatattatcaccttcacaagactacatatttttaacgttttttttaatttccatttcacacggttgtgaccttttgatttttcgcatgatttcatcccaaatgcttgatgtatttaagttagattcatactcttatatagacaattgcataactcactaggtaccctcaaataaatgcatttcttcttattatccatttttttttcctgtatggcgcgaattttgaaa

SEQ ID NO: 10717 - DNA, 454 bp, Saccharomyces cerevisiae
cttaaactctgctacttgttgtctatgattacccgcacatcagttaatttggatacttttttccctttctcagactttgcccctataacaaaataagagaaaaacagcccgcatttaacacaagatactatagcaaaggagaccagagaagactcaacacaacacacgcgaacgatcaagcaatggaagccgattggaggagaattgacatcgatgcatttgatccagagagtggcagactaaccgctgccgatctggtaccaccatacgaaactactgtcacattacaagaattacaacctcgaatgaatcaattgcgctcgcttgccacaagtggtgactctttgggagccgttcaattactcacaaccgatcctccatacagtgcagatgctccaacaaaggagcaatattttaagagcgtccttgaagcattgacacaagtcaggcaagc

SEQ ID NO: 10718 - DNA, 483 bp, Saccharomyces cerevisiae
atatagcggaccgcgtaacatattatggtatttgtatagtgggtaacccgcagagtaggctggaaagtattcgtgaagaacataaaggaagctggcagaagttcttttcatacacctctacttccagaagccataatagcagcaacgctgtttctgcaatataacttgtggaaggtctataataggaagaacatgtctttcactgaggatcaagaaaaaatcgcgctagaaatactgtcaaaagacaagcatgagttttacgaaattttgaaggtagataggaaagccacagatagtgagatcaagaaggcatacagaaaactagcaatcaaattgcatcctgataaaaactctcatccaaaagcgggagaagctttcaaagtaattaatagggcatttgaagtactaagcaatgaggaaaagcgcagtatttatgacaggataggtagggatcctgacgatagacaaatgccatccagaggt

SEQ ID NO: 10719 - DNA, 482 bp, Saccharomyces cerevisiae
tgacgcagcgataaaaccgcggcatgcaaacatctacacaattagcaagggcaatccatattttgtcttttcgcgccctggaaaggcctaagtaatgtcgtaaacgcattctatctgtacttcaactctcctctgtgcattggtttgtgcaaatcacattttacgatactgccagatttatgcaaaaagagaaaaccaagggaccagaacaaagcaaaattacgataaacttcgaattccttcgtgcttgactaagacaaagggatggacgtagcgatttttagcgggccaagaactggttccgaaaaagcacaggtacaccgaaccctcagctaaggagggacagcaccgatgcggaaggacaaactttctttttgcctatcacagtatcttatcgagctaactattttcgacacacatgaaaaagcagaaatattaacgaaaaagaaaagaaagaccatgtcatgtacgggcaatcagaa

SEQ ID NO: 10720 - DNA, 460 bp, Saccharomyces cerevisiae
tgaataaatatgccttcatctcccgcataggtgactttttggtgtcctgccagattccatagcaatgacaacacaacttcaggtagagccaattgtaacattaatatataaaaggtaatataaaactagcaggttctcaggttgagtaaatatattcttttttaatcttgacatctgtcacttatggaaaaacaagtaccaaaaaaatggcgataatgttatgatattattttactgaagctcttcatacatcgagtatgtagcaattgctccacttgttaccgcgaaaactaacaagaataaaaaatagatgtcttgattcgcaattcgcagtatatttcatctaatagctgcagagccaattgggatgttactggtagtgctacctttcgatgtgttctgttatcaccccagacgataattattattgtagatttttccctattcttcctcgaagggc

SEQ ID NO: 10721 - DNA, 460 bp, Saccharomyces cerevisiae
agcttaagcgcgctacgtaactaacataatctcttgacagcacatgtgatttatagttctcctcccacgtttaacccacataaaacaaggtaaaagaaaccttgtcaaataattgctctattgacaggagcaaagcttgcccaaagaggttgcacagaagcgccgtaaacggaatctttcaggggcacaatttcccgatcggtacggcaaaggcaaaagccacctgcgcggctactcagggaccatttcctgccacagaacttcccgtgaaacatgccccggcctatgggttcctggaaccccccacaagtaataccccttggaggatttttcagaaagaaagcgaagctattgttagctggtcaattgaataagggcagacaagaggctgtatgactacagttgcatgcggagacggcttcaacagcaacagcaacaggaagtgttcacaccaacgcac

SEQ ID NO: 10722 - DNA, 443 bp, Saccharomyces cerevisiae
acgcggcgttatgtcactaacgacgtgcaccaacttgcggaaagtggaatcccgttccaaaactggcatccactaattgatacatctacacaccgcacgccttttttctgaagcccactttcgtggactttgccatatgcaaaattcatgaagtgtgataccaagtcagcatacacctcactagggtagtttctttggttgtattgatcatttggttcatcgtggttcattaattttttttctccattgctttctggctttgatcttactatcatttggatttttgtcgaaggttgtagaattgtatgtgacaagtggcaccaagcatatataaaaaaaaaaagcattatcttcctaccagagttgattgttaaaaacgtatttatagcaaacgcaattgtaattaattcttattttgtatcttttcttcccttgtctcaatc

SEQ ID NO: 10723 - DNA, 486 bp, Saccharomyces cerevisiae
tcaaaataattaatgcccaaatttctatattagggaagtgttgcatttctatgatatctggcctaaggcggagccctttttttctttccgataaaaaatgccaaaccacgctcatttgcaagaaaccttcaaagggtgataaggtctcaagactcagtagacttaaagttttccactacgtctaactacagcagaacaaaattatttcaatcaaatggcatctaatcaacctggcaagtgttgctttgaaggagtttgtcacgatggaacacccaagggtcgtcgtgaagaaatcttcggtttagatacttatgcagcaggctctacatctcccaaggaaaaagttatagttatcttgacagatgtgtatggcaataaattcaacaatgttttattaacggccgacaaatttgctagtgctgggtacatggtctttgttcccgatattttattcggcgatgctatctcatcggacaaaccaattga

SEQ ID NO: 10724 - DNA, 403 bp, Saccharomyces cerevisiae
gctcatacaagctattagtgatgaaaatggcctcccgttggatgtatttttagttaatttcgtatacatgggcgaaaatatcatatgattgcaaagctggtcatgtaaatatattcattataaaccagacggtagaaaatctcgtttctttccagagtgtagcgtagatttttgcggacaagaattaccagtatcttcattttatttagaagttaagagaatccggaggcaatgatggtgaagtaaagaaatctttcaacggcgaagtataatctgtcttcacaaacagaataactgcgtacaaactcgcagttatatgaccgttacgagttgtattgattcagtgaagtaatagtcctattacatccatatgaatcctgtcctggtaaacggtgcaatgatc

SEQ ID NO: 10725 - DNA, 430 bp, Saccharomyces cerevisiae
tattaaattgcgactctgccagagacggtcacatcaccaaccctagaaactataaagtttgtacagaaaaaaggtacatttaatgatgcgtccacttttggaacagggttgacaagtcttaaatcttatttcagaagtgatttttgaagtaaaattggaaactgaaattggaaacaaggcactcaactcaattatgcttgcatgacgaaaggttctgttacagttttacgttgaaacctaggtactgcagaaatccataatcggagataaataactaagctttgtgctgcaaaattttccagattaggaaacctgatcctcagtgcccttttaagtactgctgtatctgatgccgtgaacgagacactattggctgcgtgggcacgtaccaagtatactcatcaaaatttgtcttaggttttccgatgcg

SEQ ID NO: 10726 - DNA, 484 bp, Saccharomyces cerevisiae
tagtgttataggaatagccgcccaaaaataccggggcactgagagcggctcgtcagataggtgaaggttgtcataatatacgatatatatctcaaaacggcaaaatgtaaacattggcactttgggaaaatttcaggacacttttggtttacaggtaaaggataaggatgcttgtagctagtaaatcaactccagaaagcatttagccattaacgggcaaatattaaggagggagtactgtttgtttactcgcaatatttctgtcccttttctttcattaagggttttatagtacacataaacttataacaacctctctcggcattgtacctagcaaacaaaagctacgttgcagggagactcaagcaacagttaaagtgctagaagaaaaaaatacaaggcataaattcaagaaataactaaagaaatctataggaccaaaaacggtgttaatacaatcatggataacgttgtagatccgtgg

SEQ ID NO: 10727 - DNA, 428 bp, Saccharomyces cerevisiae
cttctaaatatattcatctcttcgctttgaagggggcacgttttacttttcctagttctcttgcctttttaaaaatgaccttttcggtgtaaagcggactaaatataaaagactacgagaaatggcaaaggaataatagagttcttccagatgggagaatatgaggagaacaataactccacaaacttcctagtgatttccaagaacttacggaaacaattataggatgacatcaaataattcgttattggggcgtggaaggatgtcatattcctctaccgctccaccaagattcaaaagatcagtcgaccagcgtgacactttctcggacaattttgattatgataaggattcatccaatcgaggcaggacctatattgcagcatctaattcaactactggggtacccccacccaacaactcaagat

SEQ ID NO: 10728 - DNA, 420 bp, Saccharomyces cerevisiae
taataggctggcaaaagccctttgcatatttcatgaattagatagacgtgattagaaacagccgttagtatgtttctgataaaaataatactttttttgtaacactattttcatatattggattgataccggttatagcacaaacataacagccatgaaagtttctttgaaaaccccttttaacatttgcttgtaagagataggttaattttttatagttgctgagattccattgttggtaaagacttaatattaggtatacagaatatactaggagttctctctgggtatgtaggaatccacaaaagggtgtcactagttcaacataataacatcttttttttattccttctttgatattttgtcatattatcctattattttatcaatccttgcatttcagcttccaatagatttgat

SEQ ID NO: 10729 - DNA, 471 bp, Saccharomyces cerevisiae
agaggtcttctttcatttgttcctttcttttcgcactgcatgtcatcaatgaagcattcttaataatgtacattattctatcatgatcgttttatggtttttttcgtttattttatcatttttttttttttttagctttttttcctctatagaaagtgaagtacacacgtatatattatgattcaggatctttatttggtctcaattttaatatttttttgcaaggactcgattaatctatctttttctatccacctattttcaagccacttttctaaactctcatcattgtatgcgagtaatggttgaatttgatgcttttttacatttaccatcacaacaatggggtccttatcctttatgttgttttcagactccatttctggttgaatcatctcaaagattgtcggagatatttgctctaattgataacctttatgaagtctcaaatctccgttggtatgatcatgc

SEQ ID NO: 10730 - DNA, 484 bp, Saccharomyces cerevisiae
tccttcaaaacatactactagcaccatcgcaactaccacttcgacttctactgagatgactactgtcactggcactaatggtcaaccaactgacgaaaccgttattgttgctaaaagtccaaccactgccacctcatccagtttgtcatcatcttcttcagaacaaataaccagctctatcacgtcttagcatccaattattaccccattctatcctagcaatggaacttctgtgatttcctcctcagtaatttcttcctcagacacttcttctctagtcatttcttcctcagtcacttcttctctagtcacttcttctccagtcatttcttcttcattcatttcttcccctgtcatttcttctacaacaacctccacttctatattctctgaatcatttaaatcatccgtcattccaaccagtagttccacctctggttcttctgagagcgaaactagttcagctagttctgtctcttcttcc

SEQ ID NO: 10731 - DNA, 438 bp, Saccharomyces cerevisiae
tacttgaaactacttcctcaataatcgcttggagacctacccccacgcttttcaaacaaggcgctagcaaaaagcctgccgatatctccttgccccctcctcctgttcgagagaactacgacccgaccaataataatgtcatacaagaaccgccaagaaccaactgctgaaccttagatctccaatactttcagttggagtatgtgaatatataagtacctggtcgactaatcttcttgcatcttttcgtattcttacatcctatgtcgctaatacagttcccgcatagagaagaaagcaaacaaaagtagtcaatgctaaaatacaaacctttactaaaaatctcgaagaactgtgaggctgctatcctcagagcgtctaagactagattgaacacaatccgcgcgtacggttctaccgttccaaaatccaagtcgt

SEQ ID NO: 10732 - DNA, 454 bp, Saccharomyces cerevisiae
tcggttatgtaattaggtattgtgttgcttttctgaaggatatatattcctatattccttcaacttatacactgcatatgaaacttcttgagaagttttaaataattggtcttttttttaatcgggtacaggcgagataatggatacctgttctagggtaggcaaatttggaggcaagagcccaaaattgttttgttttgacctggtttctctcagttaacatattatgaatagcatcttacaaataatttacgagcgaaactttcgatctgcaaagcgctccttttttctttccgaaaaaatacagtaaaataaggtctagtacacagcctgatctacaattagtgttcttttctgtttacttcgatcagctgtttagctttgccacttttctagtagctccacacgctgtgaaagtaacgagacatagaagtcacggatggatttgaaaagg

SEQ ID NO: 10733 - DNA, 473 bp, Saccharomyces cerevisiae
agcttgcaagagtgcctcccgaaaaatttgtttttgtgacatttatctggcgccgtaacagatccgcgcagaacacagaacaccaagaaaagaagtactatttaatttcaagattacttagactccgtcattcaaatcgcccttttattcaaacaaaaatgggccatatattctttctgtctcaaccttcgtttccttggatgaattattttgattgagctccaaaaaaaaagttgtagccaggaactatccaaaacttcgattgagaaacccataacaatgatgcctgccagacttttcatactatatcttttttgtagtactcatgcctgttgttcattgttcgtccaacctgcccatcaccctatatatctatgagcgtctagtatattttattaaggcaagctctatatcaagctgcatatctgacaacttacttcttgttaataaaaccttcaacgacggaggttgtc

SEQ ID NO: 10734 - DNA, 438 bp, Saccharomyces cerevisiae
cctacgtcgaaatcaaattctgctaaagctgtgactgtagttaaacctaaaaccgcgattattgcttgaaaaactgtggagaaattcatgatggacggtcacgttcagggtctgagaaaaccactcattcctatgtcccatgtggttggttgcaatttgctgctatatatacgacttggctgtagagagatctacgtaggatgtgtccactatcaaggggggtttaccaacgttatcttctattttaagtgctcaaatgaaggttgcattatatccctggcagttttcccggcaattttgccggccgcttataatagtcatggtgaaaggattgttgcttgttgtggttgcaacatgacagttgcctactaactaaataataatcaaagtcagtttctcaacaatggaaaacctgttgtgaccttatcgaagtaacaa

SEQ ID NO: 10735 - DNA, 417 bp, Saccharomyces cerevisiae
catgttcatgcccctctgcttcttcttggttgattattgcattaatgttactttgatcattagtagtaaccatccataatttttacgcccttgcataaatgaaaaaaagttgtacttcttcatgaacctatactacttttctcatccctacataaactacccgacagacatttaattttataaatacatatctcataaacatcgaacatcgacatactactccagttattcaacactgacttttttggtggaaagctttcgttctgcaattcttatgcaaataaaggtaaacacacatgcaaaagcgtagacttcatcaaaccaagaatctatgacaatgtttgggacggtaaactttccacccaatagctcctttaatctttgtgatacttcaaaagggagatgggacctaaccat

SEQ ID NO: 10736 - DNA, 498 bp, Saccharomyces cerevisiae
aagatcagcatcctttcaattgctgaaaggttcacctaaagtaccgctcatattccaaaaggattcttcactacatagaaagggcagccaattgtgtgtttttcagaaagggttttaaaaaaacaggagggtgcttgttcttgttgttccctaccatcgatggatttcgaaaaactatttataggaccatctgattttcacctccatcattgtatcatatactaacaagcatatccaaatttgtaattctatcatgaaatttccagagaaagaaacgcaagggaactgagaaatcaaacctaaaaacggttcttggcattgttatgaaaaatgaataaaccaggggggcaaaacaatcgagaaccccaatcaaaaccatgtgagatacccacttcgaaagttactgatattataactcttgtgtcctctcttctaataccttactttcacctttctcacgtagttaaagttgcaacaacacattttgtcctcatccaa

SEQ ID NO: 10737 - DNA, 439 bp, Saccharomyces cerevisiae
aagtttggggcagccagaatttctaaaacggaggatccaataattctatgaaacaatgaagatttgaatgaacgaaatttaatcaggtttgaccaaaaattcagccatttataggaaagggataaatggttcaaattgtgaatggaaactaggcaatcctttttgatacaaattggaatatctggttgaacagtgatagatgcaattttaccattttcgtctactagcctgaaacgggaagtcgcaatatccttgcttaagttctcgatatatgtcctttctttagttacgacattactctccgtcttggccgcttgtgggctcaaaagagaaattgatctctgccaaactcgagtattcacccttgggcttatcatgatgggtggatatccttttctgtgcttctgttttgtttatctgtatccgtttattcgccagc

SEQ ID NO: 10738 - DNA, 490 bp, Saccharomyces cerevisiae
aaacggcaaacccgtattcgtgtatcacccggccagctttctccgatgaacgcgcacaagtaagaagttaaattgcatcccccagacaccacctcttttgttcacttcttgcctcatgccgtcaaaaaatttttttcgcatcgaaaaaaatccccaaaagaaaagaaaaaagttcttatttttatatagtgccaccatcgggaaaaacttccctgtaaagcattaacagagtcttccatccccgcttctgtcctttatttgtttcatagaagctattaagcatcatatactgcacacaggagcatgcatagtgtctgaagcctcttttgttctgtactgcacataatatttcatagaaaaactaacggaaagaatctacaactcatagtatctgtaaatccgtcctattgtcatatcacaatcacagactatgaccactcaagaatcgatcaaacctttggtagatagaatcctatcaaatcccctgcag

SEQ ID NO: 10739 - DNA, 439 bp, Saccharomyces cerevisiae
accagttgttgacagatttttactcaaaagattatggggaatttaaattacacgacatcactcttattgaaaggcgtctccatctagcgtccaaacatcttcaaaagttggctttgacccattcatacgctgaaaaatctaaaatattagttgaaactctacagaaattatcaggtactaccgaaatggattcacatcaactagaactaccagacggattgaataacatgacgatggatgcagacactttaattagcctttttgtgctcgttgtttgcagaagtgaacaaaagcaccttaaaagtcatctttactatttgcaaaatttttcgaataactcttcttctacaaaattcggcattctagggtatgctgtatccacactggaagcagtggtttgttatttcgaagacttcaacaaaaatacaggcaacgtggc

SEQ ID NO: 10740 - DNA, 496 bp, Saccharomyces cerevisiae
actaacatttcgagtattcttttggtttttgttgtgactaatacgaacgaatatataaaagcgggaaaaaggagagagatatgatgtgcatctataacagaatttttttttttttttttaatccggtaaaaaaaagggaatattctcaaaattgcggagggaaagcgatgttttctctatgtgctacgtattcactcacactgtagcccaaaacatcgtgaatcttctcactgggtaagcccttgatcttcgcaagctccagactcgtataattggagcggacgcatccaacagactgaatcggcttcgagatatccaattcgccattgggtaaccgctggcctattttgagatcaacgcattcaagttcgtggaagttgtctcggacttcgatcacggcgtttggagtcagactagccatatcctttgacaaaagtttatcatagctgttctcgtcgatgataatggcgcccttggtaatgagcccgtgcagaat

SEQ ID NO: 10741 - DNA, 466 bp, Saccharomyces cerevisiae
aatacggccaaaattatgaacccttttgtgggatctttgtagaaataggacctcaggatagtatgatgaagaatgttggcatgctatacaatactacagtcatttgcatgaattggctgcttgtataggaatcaggttgcgttggcaatgatattcccataataacgtgcaaaagtccctacggtagtaggctgatcactccgcacgtgcgcgctgagagggtagaggcgccttccttaccttagtaaccgaagagtgaactatttcagatagtctttatccttctcatgttcatctccacacaatctcacgcaatccacgctataatataaagatacaggtacggtaataccatccatatccaagacaaatcgattataaaagacactgattgcaaacggtgcctggcaatcctgatcagaagcacgttaaatttatcgcaaaaaagggcgaactgagattttca

SEQ ID NO: 10742 - DNA, 404 bp, Saccharomyces cerevisiae
tcttttcagttatttaccttcctttctctcacgtgtaaatatttgtgtgtcatacacaccgctaaaaacctttgcatcaacttataccctacatttctatagacgctatttggaaacaagatgtaaccctttttttcttttagttttgagatttgtactcgtaaagagtacgtttatttatttattcaaattttattcttcataccatgtaaatataagcgcatataatcactacgatcttagtacagctagaattgctgacgcttacaattgctttattgtttgattatatgcacgtatacatatagtgtcagcaaaaaaaaaaaaaggcagtacttgattggctacgccgcgcatcgtccgagaaatccggcctggtaggggcaggtttgaaaaggcggata

SEQ ID NO: 10743 - DNA, 496 bp, Saccharomyces cerevisiae
ctgtctatcttgacgtcatcccgggattgacttgcaatttactattgtccacacctacgaaagtccattttacttcgtagttcgataaatgcgcttacgggtctttttcgagcgggacaactcttcagctcctcccctaaaaccgaggccgaatatcccttctccatataaataagacacttttcaccaggaaaacaatacttcagaagcttatttctcttgacaaaaagaggggtaagatctttataaaacataaagcaaatcaaaacataataactactacaagtaacataatgtgctcagcaggcggtatcagaagaccaatccagatcgaagaatttaagacggcgataagcggcatgtccgacatggagttggcacagattaaaacagaaattgagaacagtatcaatcatttgcagaggtctaacgcccgcttgggtaaatacatagctaagttggagggtgctgacgaccgtcttgaagctgacgacag

SEQ ID NO: 10744 - DNA, 449 bp, Saccharomyces cerevisiae
ccatcccgaaattagaggttcagtcagaaaaatactcgaaaaatataaaaccaaagcagacaaggccaattgcgcccttgctctcgaggctatttcggagcacgcaagatctgtgtacgaatatttcggtttcaaaacctatttggtgtttcagttcggggttggagaagtgaactccaaaggagaacccgatccgcaggggaagggattcacggcctacttgatgctctaccacaaagatgcagacaccatctttcacgcctgattttcttctaaaaattttatagacatttattgtatgtatggagcatatagcaacaataaaacttagaccaacattttttgccgggtcacaaccccctatcccggctgcgagaaaggaaaaaaaaaagtatcagacaattgattatcaaagagtatgtgaaactacgctttgttttccacttcaa

SEQ ID NO: 10745 - DNA, 470 bp, Saccharomyces cerevisiae
tagcggagataaacagccgaacaattgtatttgacacataaactaataaatatacaacaatgttatcaagggccatattcagaaatccagttataaatagaactttattgagagccagacctggtgcttatcatgcaactagattgactaaaaatacgtttattcaaagtaggaagtattctgacgcacatgatgaagaaacctttgaggaattcaccgcaagatacgaaaaggagtttgatgaagcctatgatttgtttgaagtgcaaagagtgctcaacaactgtttttcctatgatttagttcctgctcctgctgttattgaaaaagctttgagggctgccagaagagtcaatgacttacctaccgcaattagagtatttgaggctttgaaatacaaggtggagaatgaagaccaatacaaggcctacttggatgaattgaaggatgtcagacaagaattgggcgtt

SEQ ID NO: 10746 - DNA, 412 bp, Saccharomyces cerevisiae
gcttttgccgcttcactcgccgttactaaggcaatcccggttggtttcttttcctccgcttattgatatgcttaagttcagcgggtactcctacctgatttgaggtcaaactttaagaacattgttcgcctagacgctctcttcttatcgataacgttccaatacgctcagtataaaaaaagattagccgcagttggtaaaacctaaaacgaccgtacttgcattatacctcaagcacgcagagaaacctctctttggaaaaaaaacatccaatgaaaaggccagcaatttcaagttaactccaaagagtatcactcactaccaaacagaatgtttgagaaggaaatgacgctcaaacaggcatgccccctggaataccaaggggcgcaatgtgcgttcaaagattcgatga

SEQ ID NO: 10747 - DNA, 467 bp, Saccharomyces cerevisiae
gtaacatcatgtgtcattttgcacgttacatcggtttgccaatcggcttccaaatatttgtacatttttttcttcctccatcactatctgttaagggtcttagaaaatgattactacagtgcaagaaatcagcaaatggagaaacctgtgcttcattaggatgcaatctcgcaaatggtacccagtacttaaaaagactcctttagtagcggacggtcgaaagatcattaaacatgccgataaagttcctcatccggaagaaataattcacccattttaccaaccaacagcaatagaacaattcacggcatgcgctacggaatacaatcctagcctgcttgatggcaaaaaaattgctccatcactgataaaacacccggtgagcctaaaaaccatactagttgatagcaaattaaagtttgatgatattaggggagtgaataaatggttgatggaattcgttgcaa

SEQ ID NO: 10748 - DNA, 486 bp, Saccharomyces cerevisiae
acaggtcaggagcagccacatctcaataaaggcagttaaagacggtgatgtaggtgcagaaagagaaagtgaacaaaggatgatttgagatgtgtaatgattcgtttgagcagcaacaactgctaagatattcatactaataggccacttcacacattatgccttggagaatatcctgcattgctccttttatagtatagtctattcagcactaacaagcaaagcgaacataatggtaaaactaacttcaactgttgctggtgtcgcctgcatcgctggccctcccctccactacggccattttagcacaacttgaatgagtcaacttggttgagttgcatgttaacgtctctgatatcagagctcacttgctcaataatacatgttacaaactgcccactaaattgaacactctaacattatattgacctgaattatttgaaacgaagtcaacagaatgatcactgattttccaatgtactccgc

SEQ ID NO: 10749 - DNA, 412 bp, Saccharomyces cerevisiae
ggttattggtagggttttggaccaatgttttgagcaggacaaaaatgcggagtttccagattttctttaagagccgaccccccacccccttgcccctatacatggggtacgtgcctgtattttgagggaaaactacgacataaaacacagggaaaaaaacgagacgcccgtttgaagaaggtaatgtaggattccgtcttgccagcatagcggataaacaccgcaaggaggtgttgtggtcggtaatgagtggcacgaggtgtttgctaggcgtcggactaccagttgatgtgactgctacggaaactttgactcatgatgaacaaggaccaggtgtagagccaggaccgtgttcgcgaggaagttctatagatggtctgctgccctcgttgctcggtccacatgatgatgt

SEQ ID NO: 10750 - DNA, 480 bp, Saccharomyces cerevisiae
gaacgcccttctggacttaaaaattcatacttttgcattctgttagatatgaatactacactctattgagtgactttaaaaggcgagtggacacttttatcaagcgatttatcatgcagtaatactaatattactaattaatcactactacctctcttaaacaggaaatatgctattcatcagtaagaagctgcacaaatgttatatatcataccaggaatacacataagagcaaaaatgctattctacaatatcctcatcttaccagctcactcacaaaatattcttactccgagtacgaccataaagcaatgctaacgaatagtcatactaaagtactataaaatctttccgtgcgctcaaacggaggccatgccataaagttaaatgtgataacttaaaagcatcataagagtgattttccagtattgtttcagtaatgtaaggcctaaagaagaacgcatattggtaaacctccaa

SEQ ID NO: 10751 - DNA, 400 bp, Saccharomyces cerevisiae
attcaaatttttaggatttttcttagcatttgcatatattttcatagacacagtacttacatttaataacagtaattgaaaagcaatattaaaatatagaagcccaaattttatatttcaaatgaataaatgttgttttttttggcaattttttgctcttctatataacagttgaaatttggataagaacatcttctcaacgcgaaaatgacgcctccagtgaaaaaacataaactttcaatgcagtcttcggtacacttatgagtaacccatatagagatcgtacacattttacaaggatttagagacaaagtaatattcttcgttgatatagaggtgttcaattgttaaatgcttttcttctttttattagaaaaagcgccttgctttttgttgtatc

SEQ ID NO: 10752 - DNA, 431 bp, Saccharomyces cerevisiae
ctaaatatcgcataggtacttcagttttacaaaattttacatgtggtactatttctcacgtacgagtttttttcttttttaaatgcggccctaaaccatgctgaaatttttcatgagctcatcgcaaaatttatctcattatcaggtcatatagtcactctcaggagaatcctgctcgatcaaagtgaggcaagtaaatgcgcatatagaagagagcaaaactgtcctatttacaagcttttcaaaacaatgggctcaaaagtagcaggtaaaaagaaaacccagaatgataataaactagataacgaaaatggttcacagcagcgcgaaaatatcaataccaagacgcttttgaaaggcaaccttaagatatcaaattacaaatatcttgaggtgattcaactagaacatgctgtgacaaaattggtgga

SEQ ID NO: 10753 - DNA, 412 bp, Saccharomyces cerevisiae
tgaaaatgggaggggaaattgagcatatcagataaatctgtttatagaattattattttacttcgtgggaaatcgaatggtgtatataaaagaggttgtaaaattgacgaaataaatagtatttaggcaactaaagataaaaaaatattatttatttttattcgcggtgcgttgccagattttttttgacatgcggaattttggtaaaaagaaaaatgcagatatgaatagtaaacaaaggaataaaaagcctttcatgaagaagttcgtgttcgagatcttcttccttctttttcgctgtcgacgatagatatgaatgcttttgccattgatttcaaatccgtcattaagctaacatgacctgaagaactggcgattttacaaacaactggaaagcctctctgttcaggca

SEQ ID NO: 10754 - DNA, 485 bp, Saccharomyces cerevisiae
ccataaagatagaaacatttattttgacttagaagctacaaggaggatcaactattaatatttttcctagagaacatttttaaaattggattcaataaattagcgccatctattgcccttacacttttctccttcatatctggctagaaaagggggggttacatctcggaatcaaatattttcctctgcgtcgagttttaatcctgcttctggttacattcttttttatcatacacgattctttgaacatcaacttctctcaaaaccatccgccttcagcggctacaattacgtaattgcaccaaggcattcgcggagaattcacgaatttgcagacgccaacagtatacgactcccaacacacgtctaatatcttgtacggatttcaagagatagaaatattacttccatggaagccgtttagagcagactgaatatgggcttagacaataagcttctgaacgagggtcttaaatctaaattcg

SEQ ID NO: 10755 - DNA, 470 bp, Saccharomyces cerevisiae
tataaagacaagatatcattcaaacgctgacgttaaagttttaaggttaatcgtgtatgcattatgttctagattcatcaacactggatattgagcaaaaaggacgtatccgaggcccgaaaaggtccttcaaccaagtcgtcaaaatattggcaagccaaaagagcagcgagaatgattggcaaacggtttttccaaacaacaagtaaaaagattgcttttgcattcgatattgatggtgtgttgttcaggggcaaaaagccaattgctggtgccagcgacgcattgaagctgttgaaccgaaataaaattccatatattttactcactaatggtggagggttctctgaaagggcacggacagagtttatctcgagtaaattggacgttgatgtatcacccttgcaaattattcaaagtcatactccttacaagtcccttgttaacaaatattcaaggatcttggccgt

SEQ ID NO: 10756 - DNA, 407 bp, Saccharomyces cerevisiae
accggtgaaaacacacgcaagcaaacttcaaagtacattgataaataatgtccaatgccctctgtaatataggggctttttaattcctaagactgattcgatatattaaacaccagggctactgaagactgacagtcacgttgagtcctattatatcattttactcacagaagatttggtaatatgatacttagatgggcttaacaacaaagtgttttcttgatgttactgcccatgaaaaaaagcaaatcaaattagtaggcggattgttaactttgtttattttgaaacccgtcaggactaccaaaatataacaaagtattgattatcgtcaacgctttatagatcacttttttttttttttgaggaaccgattaattaatacatcgtagcctctgcttattgca

SEQ ID NO: 10757 - DNA, 419 bp, Saccharomyces cerevisiae
tgcgttccagttgcatcatgtgtattgttagggtttttgttttaggattgctaccctcttcctttttttcatacattacaataatttcgtggcattgtagatttaacggctttcttttgcatcaatgatttttatattcaaatgggttttttcttttttctgttttgttattcaaggatatttcaactctcacaccataattataactaattatgtcggcacatttgagaaccaatggttagtttccagcgcacctagcgactaactaccctattatggagggacgaaggtggtctttctgagggaaggaggaaaaaaaggtaagaacctcttttctttgttccccattgagagatcgactgaatatgtttggtttttttggtacttgattaaagtttacaacggtacgtatccacgtg

SEQ ID NO: 10758 - DNA, 480 bp, Saccharomyces cerevisiae
taagagaatggtatgactccaacaattcatatcagactttatatttcaattcgcggcaaaaaaagcaaaagaaatgggaaggaaaattgcatgggatgaaaaaaaaatacaaaattgatacaaatctctagcagcctgaagaccagtcttgtacttcgctactttgcaagacaaggagtactatttgctcgcttcttacgacatactactccgcttggcacgcctgtctaccttgctttttttgctcgtcatttttttttttcgcatgctccctatttcatgttacaatttacgacctccagcatcaacataatcattcttcaaaccaggcctgttttattactgtgatattaccctctatactacgatatctttgttttgcattttacattcaacttttatatatatatatataaatataacctaaaagaatatgaacacttcctcacaacaaaaactaggataacaaccgtgtgtggg

SEQ ID NO: 10759 - DNA, 456 bp, Saccharomyces cerevisiae
ttctgactctcactattgctatgttgtgataaccctcgttggtagtgatacgaacacttctcttcttttttgttgtttttgtgagaaaaaaaaatctaaatgaacatattgctaatgcaacggatagttagttttattttggtggttagtcaagggcgatactttcatgttggagagctgaccatgacaatgttgaaaagacctcaagaagaagagtcagataataatgctacgaagaagctgaaaacgagattaacgtacccttgtatcctcgggaaggataaggtgacgggcaaattcatctttcctgcaatcactaaagatgatgttatgaatgcaagactgtttttgaaggacaacgatttgaaaacttttttagaatattttttgccagtggaagtcaactcgatctacatttatttcatgataaaattgctgggattcgacgtcaaagat

SEQ ID NO: 10760 - DNA, 476 bp, Saccharomyces cerevisiae
tgaattagcttcattcttcacttctatctttttctttgatttttttttccctaatgcatacatgatttttacgtctttatataatactgttctattcatattctagcctagtttaattataataatatctataatgtttttttatatatccgcatatctgtgagcttgggtatacagaaaaaaatggcacacgcacccctaaagtaggtggggaggaaaaaggaagtaagagaagggaaaatcatatgagagcatccaaatagatcactctaaaaaatataaacaggcatgaaactcagtcagtcaaatcagagttaatattgtaattatctgaaactagttcctataggttgagtgtctatcaaaaatttacggagacgcgatgaaaattgcggtagaaacgacactattcgacttctttgtcatcgatcagtttaaaaaatctactttttcagcgccaaacaccaaagttgaca

SEQ ID NO: 10761 - DNA, 426 bp, Saccharomyces cerevisiae
aaaagcgcgattatgggccgctcgtgacagtaaaggaagcaagcagatcgaccccctgaaaatgtggtgtggttactaagcagaagcgtcttcgtcgcatatcctattcctagcgcaacaaggccccacggtgtggtttcatgtgacgtggagtcatgtaggcttgtggtgcgcacatttttactaagctcaacaaccctactggcgctgctggaagtgaatggcgagtagatactatcaagtgttggctggtgggacatatcagcaactaatggatagaataaattggatcagaagctcagcccaacttatcctccatatggtgatatagagtgtaaatgagcatatacattcgtttctttttctcctcccattagtctggccctttagcatacaagtcaactgtagttttcagaagcgggcttt

SEQ ID NO: 10762 - DNA, 453 bp, Saccharomyces cerevisiae
tgatcatagagtgcatatgcttgtcttgataggcaacattgtatattatattttacataataatgtgtaattctaatttgtcacgaatttatgaagattcttggagctatgaagatcaacatatgtagaaactggtatgtgtcataggtaaaaagtattcattaagacaaaattgtgtctaattcttagtcatttattcaattttttttttttttttttacgtaaagcggggtggagtgacatgatatggtgatggtgatgagaaactctaaatggatccatttgactatcgattgaaaatcatgaaagatgcgcttgaaggaacataacacgttactatttgtctaaataaaacaatatacaaaaatacgacattatatatactctacccaagatatttagtcattactatcgagggcgcgtagatcagatcacctttaaaatcacacttgg

SEQ ID NO: 10763 - DNA, 458 bp, Saccharomyces cerevisiae
gtaaacacattgctacttgcattttacctttcaagatgtagtgattacggacagttgaagaggctaatagcatctatttcttctttagtatatggttcctgcagggcaaacaattatttcctttgcaattttgcggcagtggggaagaatgatagcactaatagtgaacttgtggacaattatgctattatagcaagaaaaaaaatttatttttttttcaaggggggtgattgtgatgtgaattaaatcaaggatatacgcttttatcgtcatgatagtcgtgcgatttgtacttggttatagatgaaatgagttagtttttaataattgtgatcacaatatagctgtacttatcaggccattaaagtttcctgtaaggtgcacgagaagtcatggtcataaaattatcagaatctccaaggagaggttcaacggcgtcggttgcccatactccatat

SEQ ID NO: 10764 - DNA, 432 bp, Saccharomyces cerevisiae
aattaagtgatgcataatatggttttcttattaagtacaaatgacctgctatattttcaagtatcttcatgattatgttatgctactctcgaaatgctttacgagttcgtcattaaagtattcaaattttattttccctttgtgttttgttttgtttttatttctacgtgatttttttcttgaaatccagctcttttatacctggatgggttttattttgatgtttaaatgttaattaaggaaattattgaattccttcggtttcggtgtgtttttttctttttaagtttttttttgttgcgtttagtacttgcctttggctatacatatccttttaatctaatttttatttcttcaaaatttgattctttaaccttttgttctatatatatatataaatgtatgtatgtatgatttgattgaggaggcttt

SEQ ID NO: 10765 - DNA, 424 bp, Saccharomyces cerevisiae
atgaaacgtaagaaaaatcatgggttgaagaaacgaactgtttgatcaatttcgaccatccatctaccttgcaagtaataaacaaaagcaggttgagtggggaactttatctaagttgatcagtatatctgacaaatttatacggaatgctgcagtttggattagcacgaacattttatctgtacggtttgtcgcttttagctgctcgggctcttcctctcggttaccgagatgataactcggccgaattttgtaagtacaaataaaaagaaagtgacacaattctaaaagtatcactataatttattattttgagaaagataaggttccataggtacatgatatattgactgatttctgatagctcttttttttccaatatcgataaaaaactaaaatatggaggaactaggtttaaaaagca

SEQ ID NO: 10766 - DNA, 500 bp, Saccharomyces cerevisiae
atttaagaccctcgttcagaagcttattgtctaagcccatattcagtctgctctaaacggcttccatggaagtaatatttctatctcttgaaatccgtacaagatattagacgtgtgttgggagtcgtatactgttggcgtctgcaaattcgtgaattctccgcgaatgccttggtgcaattacgtaattgtagccgctgaaggcggatggttttgagagaagttgatgttcaaagaatcgtgtatgataaaaaagaatgtaaccagaagcaggattaaaactcgacgcagaggaaaatatttgattccgagatgtaacccccccttttctagccagatatgaaggagaaaagtgtaagggcaatagatggcgctaatttattgaatccaattttaaaaatgttctctaggaaaaatattaatagttgatcctccttgtagcttctaagtcaaaataaatgtttctatctttatggtaacggctcatagttacagctcaa

SEQ ID NO: 10767 - DNA, 452 bp, Saccharomyces cerevisiae
tgaaaaagtggaactagaccccacgtcagcgggcctaggcccttcaatgtgttagaatacacagcgtgcctagttcctggtgcctggatctcgaggccgcggcactggaaaagccctttcttttccagatcgggaaacctaatgagtccataaaaagaaatgtagaggtggtgttgacgttttgccgcttttgggcaagtaggtctttctgcacggcccggcccgggtcgtgcggaaaaagaaaaaagcagacaaaacaaaatttttcctttttttcgcctttgtttctcctgattcgggtatataagtgaataccatctaatgtgtttccttctcgagacctcggcgtctcccagatcaaagctcagcaaagattttaaaccgcaatttacgctcctttcatcggtaactaagaagaaaaaaaaaaaagtacgaccacacaatttccagtg

SEQ ID NO: 10768 - DNA, 463 bp, Saccharomyces cerevisiae
cgttgaagtaactcaggcccgagttgactgctcattgaaggtatgtatgataaacattatagaataatgaaaaatgcctcgtgacatacagataaaatctaacaaggatatattcaaaaaaaaaaaacaaaacaaaaaaataataacgtgataaacattaatgaacaatgtatttacattcttaagcataggtgagaaattaccttctttacttttttttttttttttggtgatattgtatattaaaatatatagtaatcaaattcgtttcattgatcaaattgctcactagttcttttttcaaaaatttcatctttataggtagatacaagtgccagagagatatataaacagaaaactctatcgatgtgataatgtatgccattatcgggactgtacacccacacatttacaagcccacacatcctacaactttcttttcatttcttgcgcttcttccact

SEQ ID NO: 10769 - DNA, 424 bp, Saccharomyces cerevisiae
taaggcagggcaggtctaaaaggctattgctctttccattttttttttcctatcgattttactactagaaatttttgctacccatacccattctcgcattgcaacatggaaaaactgaaaattgaaaaaaaaggtattgaaatttcaactgtattgtgtaaatcatttttgggcaaactagacacaataactagcgaacagaaaaatggatagaacgtggctattactgacgtggctgttgctactctgtggggtagttcaagggaaccaagaaagcataaatcaaaaatatcacgatgtctgttcagggatgtattccaaggaggatttcaatggaaaagttgacccctatatatcgtttacgttggaggaattgtcacttgctgatgaagacgatgatggcgagggggttagtgttgctgtg

SEQ ID NO: 10770 - DNA, 499 bp, Saccharomyces cerevisiae
ggccatacataaaaaaatgatgctagaaaaattttgttcgaaggagagtacttatgaaagaagaaaggtttgtgaatatcacacacatacctctgcatagtttatttcccgataaggtagacatatcgtttccctatctatttaagttttttattcgctctctttttttttttttctctgtaacctgaaaacaaggaacggcaaattaaaatgtttggaatacgttcaggcaataataacggtggatttactaacctcacgtcgcaagcaccacagacaacccagatgtttcaatcgcaatcacagttgcagccacaaccgcaaccgcaaccacaacaacagcagcaacacttgcaattcaatggatcatccgatgcaagttctttacgatttggaaactcactttccaatactgtaaacgccaataactatagtagtaatatcggtaacaatagcatcaacaacaacaacattaaaaacggcacaaataacataagcc

SEQ ID NO: 10771 - DNA, 471 bp, Saccharomyces cerevisiae
aaggaacctatggtacggacgttgtctctttaaagaatttttcaccttaaataatatcattgttggcctattaaattataaaatgggcaatccaagtggcattttaggcatatcccttccccttgcagaatttacagataatgttgaaaatgcatttgctttgaacagaaaactcttcgtatatgagaattctaatggcatttgaaagacaaggaaagatcgaaaagaagatatcgtattccttatttttgaatggacctaatgtacactttgggagcatcttattcggtgcagtcgataaaagtaagtacgcagaagagctctgcacacatcctatgcgtcaagcttataatacccttgattcaaactcaagaataattatcacagtacagagtgttgcaattttggacggcaaacttgtatggtaaaagtgttgtagatattcagtttccagtgccattaaattccggt

SEQ ID NO: 10772 - DNA, 470 bp, Saccharomyces cerevisiae
aaaaatagatataatagatggcaccgctcttcacgcccgaaagttggacattttaaattttaattctcatgatagtaacgatcgtgcacattcaattaattatcgcataccaaacattttttttcctttttcaattcaactaatctcaattttttaattttcctttttttatttcctttttttttattctcatcataccattttcattcgttgttgatatctctattgttttttttggcaaaatatagtctacatataatatttaataatctaatctgatagcgttaatttccataccgcctccttttatatccgttggcactcgacggtttccgtatgccgtcggaatgcatccgcttcttggactccttgatcgtggtttgcagtatatctacactgtaaaatatagaagtttttggaatggtgttactccattgtgataatatctttgggggttctagcttctttgg

SEQ ID NO: 10773 - DNA, 427 bp, Saccharomyces cerevisiae
tgaagctacagcaaggaaaatgaaaattccagcaagcaagcaagcgaagaccgttcttctctttcctatgatcttccttagcaaagaggtttgccagtcaaagtaaaagagctgccattaagaaatgtatttcattttgacagcttcttcgatcaataccgccagctccctcgagcctataactattttgcggatctgtaagccgtaatgtttttcccataaacgtcactgaatgtccatatatcatactaccagtaagcgcctgttggaaaccttcctaccttcatacgtgtattctgctatatcccttcttttcctctttacgtacagaatgacatctatgtaggcaagtttctttttccatcattggaaaacgaaaatacatttttcactagcaccacaaaattttcaagatggccaggctagt

SEQ ID NO: 10774 - DNA, 456 bp, Saccharomyces cerevisiae
aaaagttgcaaggctttcatcagctatatataagtagcatggtatgaacagagtaggggcagtgttcctatttgtatatgaaagaaatttttttttgtctattgttccagatcgtcacaggacggaaataagaatgtctagttcagaaaggtcagaagtcaagtttgacaagcactttaattggtggtccctattaggtatcgcgttctcattaagttgctcatgggtcggtatctcagcgtcgatggccgttggtattgccagtggagggccactgcttatcatctatgggttgataattgctgcttttttcagtctcatgtgtggtatatctctgggagattttgctgctatcctgccaaacagcagcggtggttcattttgggttcttaaaatgttggaacaagaatcagtcactttgaaaacccctgagtacgaggacccttctgacgatga

SEQ ID NO: 10775 - DNA, 450 bp, Saccharomyces cerevisiae
atcctgtaaacttaaacttaaaccccgtgtttagcgaaattttcaacgaagcgcgcaataaggagaaatattatataaaagcgagagtttaagcgaggttgcaagaatctctacggtacagatgcaacttactatagccaaggtctattcgtattggtatccaagcagtgaagctactcaggggaaaacatattttcagagatcaaagttatgtcagtctctttttcatgtgtaacttaacgtttgtgcaggtatcataccggcctccacataatttttgtggggaagacgttgttgtagcagtctccttatactctccaacaggtgtttaaagacttcttcaggcctcatagtctacatctggagacaacattagatagaagtttccacagaggcagctttcaatatactttcggctgtgtacatttcatcctgagtgagcgcatattg

SEQ ID NO: 10776 - DNA, 498 bp, Saccharomyces cerevisiae
tctaaattgcctggcgagaaacccagctcttggataaatgttaaaaccttttcatgagtaattgttctttccgaatcaagatcacatttcgtacacgctataataattggaatatccaattcacattccaaacgtacgtggtgaataatacaaatataagactctaagctggcaagagagctgtcattagtagaatcgaaacataatataattgcatcagactgcctaatttgaagagtagttagctccgaaaggtacgaaacctccatttgattggtatcaaaaacttgaacatcaatactggtgcgtctttgagcagtcgatttattggcattgatcaggcgctcttctaggaaattgccacaactttcataaattgtgccagagtttttagctttgaaacccgcataattcggcaactgtccttttacgccaaaggtacgatagtattttaccaaagtatcaaattggattgtcttgtggtagaggtccgaaacc

SEQ ID NO: 10777 - DNA, 407 bp, Saccharomyces cerevisiae
ggtttttaacgcctatattcttctaatattctaagaaatattattacccttgttttctgctaatttattaaagaaaatttgcaaagacggctacataggacttcgagtccttttatttatacatattctttttcggattatttccaatgtaacaatattcaagaatggatcaacttaaggattatttatcagtttgttatcacgacctccctcctttgtaaaatgatgaccacaccaaagtagaatatttattcactacctatttattttattcttattaatattttatatatcatgcatttatccgtgtgcatttaccaaaattcatgagtaacgataacgcttcttataggtatctatctattcccattccggtaactttttttttttctccaacgctcagtcct

SEQ ID NO: 10778 - DNA, 459 bp, Saccharomyces cerevisiae
ggctaaccttagtggtttattgcaatactcaatactgttcttagacaattatccaaccatcgccattaaatgataaaaaaataaattgactgcttaattttgctgatacaatgcactatattatcggctgatgtaatggtattgttattcaacctcctctcggcattgcaacatactaatagccaccctagggtgtcattagcatgcctataccgaggcatacgaaagcaactagccatcaattccatcaccctgtcattcaactccgcttcatgatcaggacagtttgcacgttatcagataaactatgataccgctattattgaactctctatgatattctatgagcgtttctattaaaaagcttgagagaacagtaggttccacttgagctacatctgggttgatagtagggtctgacattgttactgactgacattcgcataatttggtaccggt

SEQ ID NO: 10779 - DNA, 422 bp, Saccharomyces cerevisiae
aagttaagtactgcacgtttcatatcggaggtatatttttcaaatgaaaatctcgtcgaaatgcctcaagacaagaattaaaaaatcaatgcccagtaaagtaggacagggtacggttggagtaagaagccttctactttgggaaaaagccattgtactagaccaagaaaagattaaaagtagatgtgtcaaattaagccacaagtatgtttgccccgctatgaacaatgcacgccgcatgtgaggacaactttatatgttttgcgagcgcgctgggcatgtgcaattcacattttttttttccttttttttaacccactctatttatctaatcaagccgctagcggtctacattcgctatcaactgaacgaatagtgatgcaatctgaaccttaaacttttcgctcgcttttactttccag

SEQ ID NO: 10780 - DNA, 424 bp, Saccharomyces cerevisiae
aaatgtggaaaaccggcggtattttaattagaaacaaactgtctgataaaccaatcatgaaatcttgtatcactgtcagcaagctctggatgaaaagaagtcacaaggatattatgattttgcgttgcagctacaaccacatcctttccattcactggcaattcatataaacttttaaccgcgataggatcaagaattctctcgatcacgggtgcgcgaataaatgtagcaggaaaattatcacagccaggtatgaaattggaaaaatcacacttttgtgtaaaagattgagcttgtcttccaaatgcgtttcttctcacgtcgaccttcaacacacctaaagtctttactagggcactttcgttttctaattgcgcgcttaaaaagatgagaccagcacaagtaccccaaactaccttttccg

SEQ ID NO: 10781 - DNA, 439 bp, Saccharomyces cerevisiae
cctaacagagacagtccaacggcgtagttgaacattttgttcgtgaaaaagccgatttcgaagattgactttgtgttatgtctgcaggccaaagcattaaacatatcaaaaaaaacaaaacaagtaaatgtcatagtagtatctctagcagttactttaccatcttcggccatctctttaacaaaaatgtaaactgtcccaacgatgatacaggccgcggtggttagtaaacgtttcattacatcatgggtcaaaattttatcggtacgttttcttggaggttttttcataacttcatgatcaacaggttccacacctaaggattgagctggtggcccatccattaaaatatttatccaaagaatttgcattgcgttcagtggattgggtagtttaaacgctgtagatagtgcaactaatgatagtgcggcaacagaag

SEQ ID NO: 10782 - DNA, 435 bp, Saccharomyces cerevisiae
aagggacgtatagtatagttatggagaaaggagatcatcactgttcattctgaactcgcctcattgaaacttacctatttagttatacccaaatgtattgcatatgactttctttgaaaaatcatcacccaaagaactggtgtggccccacggttttctcgagttttcagtgtccaccaccgtagcaaaacatgataaccagtgcagtcttggaaattgctcgttaatggcactaactgtatcgatatgaatcagatcggtattggatccgacattgtcaagcgtagtagcaatctgcagaatgagccccaaggtggtaatgtagccagtcccagtcaaatcctggtgacgaatgatggcctcagttactgcatctgcatagtcctgatttccacctgtcgcattaaatacaagctcccttgaaagtatgccacc

SEQ ID NO: 10783 - DNA, 451 bp, Saccharomyces cerevisiae
tctgaagaagataaaattcaaactgaaattacttactctatagcatctctcttcaacacaggtctgaaaaatgtgtttctcaaaagtgtgcgtaatattccttcatctcaaccagatgatcccacttcaaagactaactcagagaaaattgggcttataacaataaaaataaagccccctagtaatgctttgccatattggtgtccaaatctaattcaaaaacaaaatgtattttcaatgagaaacaggcagaatcaaaagaactggactaatttaagaggtctattgtccgttgaagagagagaaaaactagaaaatttacggcttgaactagtatgtatgcaagctgctaatagtattccacatgacccaccggaaatcagtagtctggagacggaattgatttgcttaacaacgaacacaaaagattgcaaaccagtgaggttccaca

SEQ ID NO: 10784 - DNA, 491 bp, Saccharomyces cerevisiae
acattagcaaattattctaggtggtataagacaggctaaaaatctataattgaaatgtcagcatcttaaaataaaacaggaattaatttctaaatacgcaattgatccaagtgttatgtcaatatgacttactgagaacatactctggcgggctttacttcccgatctcacatgttgccttcaagaagcacaaaaaatttgcagcccaaacactgtcagacacgggaatcgatctaacatcgtaaaatttcagctgcttcgataaattggtacccaaatattggagagacctttcaccacaccgacttgaaatagtaaactcaagcgcaatgatgaaaattgggttgcaatgtatatttgatatcacaaataccaaaattagccgcttttttggtacgcacttataatcgaagaaattgattcttttttagatttttaacaaatgaggttatatgagaatgaagcaggtcataacaagcggaaccaaagct

SEQ ID NO: 10785 - DNA, 420 bp, Saccharomyces cerevisiae
tatggaagcctgagccccctttggctggatagcttggcctcatcacaactagaacgtaaaaaagtccattaaccatcaaatgcttctcattaaagtgggtatttttatcgaaagaaagggacctgaatatctaactcgccgctatgtcgaatgaaaacttatctcccaatagtagtaacccagatttaactaaactgaataacggcgaaagcggaactattgataccagcaaattctcgcccaacgaaatgaagctatacaaaatgtacggaaagctgccatcaaagaaagatatttttaagcataccatgcagaaaagaaaatatttcgacagtggtgattacgctttgcagaaagctggcattcaaaacaatgatccaataaactatggaaagaataacctgccattaacaaatccca

SEQ ID NO: 10786 - DNA, 414 bp, Saccharomyces cerevisiae
gtcacgtgaacgtctatctatttatttttataactccgggatgtcattgccggtggtccgaaaatcggcaaataaggaaataagggaagaatatgcagtagtcaaatcatcagtgttctctttgatacctttcagggctaggaatagtgggggtggagtataatatcaaaaaccggacttaacattattggttcggttggaattggctataggcaaactagtctccggcatgatatataaatgacagcctgcaattgtatgttactacactcttgacttgtcgactacagtcgctgctcaggcacgagaataggaggtaagaaggtaacgtacgtatatatataaaatcgtaatgacaaagattaaggtagctaaccccattgtggaaatggacggcgatgagcaaacaagaat

SEQ ID NO: 10787 - DNA, 479 bp, Saccharomyces cerevisiae
agaaaagcatgagtttgataagaaaaaaaaatttgctaaaaatgagtgtaacactaccaacatggcgagtttagtttgatactaggcgctatacattattatttatatgcccagaggttacaacagtggctacaatgcaaaaaatatactggcttatatttttcatttgagatctggttcctcaaatatatatatatatttatttattttttacacatacatactgccctcctgattactttaaacatctatattacaaaagagaagcattcttttccgtccattataccgttctcgggcggatccttagtttcttacgttttagctctaacactaatcaaaattcttatgaagtgttgggacgggcttttgggccccaattctttgttggattttcctgatatctcacaatttttagcttccttagtttttcaatattaccgctttgttcatttggtgcgaacgacagctttgagtca

SEQ ID NO: 10788 - DNA, 415 bp, Saccharomyces cerevisiae
gcaaacgttgcagatctcctttaacccggttttcacaccatattccttgataagtccgtagcatatctcgtccaaatctatctggttaaatctttctccccccttccatagcgctattgaaattttactcatgggcagaaaacagttacgaggtttgcctctctcaccgggcattgtaatgatgaaatttatctgcaattttatcgtcgtgagtcttccttctctaataactctttccacaattaatgagtcactattattcattagataacacctggttttccttttcaataaattaatcaaattttggaaaattccagtttttttggacttgatcttatcaaactcataaaggcttaatagacacttctggaagttacgtgttgccagtaattgcttggccttcagtctaacg

SEQ ID NO: 10789 - DNA, 412 bp, Saccharomyces cerevisiae
attattttcaacagaacacatcgcatccaactgaacaaactgttaccgctgttgataccaaggaacattcagtgaacgtagggaagaacgaacattctccatatttttgcatactagatacaagggggaagaatgcaattatttcacaaaccgaaagaaaaagaatcacaagctatgtttgctattatcaatttttcttatgattaatttaacataaattatggcctttttcattccggctgcgcttgttctccaattttttttttttttttgagaaaactttaaaaatttcaaatgtaagaaagtagagcagatcttttagcaaggatccgcttaacattccaacaaaaaaggaaaaataaaacaataatttcgttccccatctatccttcgcctctccttcgctctgtaa

SEQ ID NO: 10790 - DNA, 450 bp, Saccharomyces cerevisiae
tagaaacacaacacgtcatggttgttctttctgtacatctatttattcttgcttgatgatatttattgtattgctttacgggtacccccgctgggtgaaaaaaaaaaaaaaataagaacttcatgatatcgaacgatttaatcgtgggttgaggacatggaagacaaaaataaagcagcatagagtgcctatagtagatggggtacaaatgagcacgggagattttttaactaagggaatagaactggttcaaaaggccattgacctggacacagccacgcagtatgaggaggcgtatacagcatactataacggattagattatttgatgttggctttgaaatacgagaaaaaccctaagtcgaaggatttgataagagcgaagtttacagagtatctaaaccgtgcagagcagttgaaaaagcacttggaaagtgaagaggcaaacgc

SEQ ID NO: 10791 - DNA, 443 bp, Saccharomyces cerevisiae
accagcgagtaacactataaagaatattcaccaagatacaataaaaaaccacagctctaccttttttgtacatatgaacctgaagaccttcatgaatcatcgtcattatcagtaatatccggttcgtcatatctgcaatgacaccccacaaaatcccagagacattacaatttagtgtagagatcccgacacaacgggccaatggctgctatgaactaatgttcacatagtttaattttgttgaactttcagtatatatttgcataaaatcatatagacgagcgcacttagcggaaagtgcggcagtcatacaagcacgaggaaaaagaggacacgactcatttttctttacatgataagcccaacaaaatgaaaacaaatagagttccttgttttcatttcatctaatcaagaaaaaaaaagcaattctatggcgatgtagg

SEQ ID NO: 10792 - DNA, 405 bp, Saccharomyces cerevisiae
acaatccacaattcttgggaagtcttgatttggagattttggaagaattagaaaaactcatttccgcacaagaattttccagaaacttcactgaagatgttgacgaatctttacagagtgaaattgacctcatgaattatgacaatgaagccttgaatcaactaatggcaattgatcttgataagctacttggaattttccctaacctgagtaacttttgaggggaatacaaatttgaaagatacgaggagaaagttagtaaactaatgctacttttagtcttctatttttttcgcaagcacgatcatataatcaataccacacaaagatttttggtagctacggtcctaagaaaattaaattccctctctaatctgggtgagaccggaatcgcatcaggtctta

SEQ ID NO: 10793 - DNA, 483 bp, Saccharomyces cerevisiae
gaatacggatatttggaaaggctaaaaaaaaaaaaacaagccaaaaacaagaaacactgttatcctccacgttttttccactgttttaagactcgacaagacggaaagattcctcacatttcgcagtgtttcttttaacctgctcgtcaatttgaaaaaatgagcatggttaggcaggcggaatgtaataggtgcggtgcgtataaataagtatctcggccgttcctctattgcgctcggccgagatgtcctacatgcataaaatagattaaaaaaagggatcacgatactcaaatatgcatataataacaacaacacactttgcggtaaatagaaggataatatcgtaatcttttgctggtttcgatgatgacttgaaaaaattcaattactctttcgatcatctagaagaagcatatccatcgtgcttaaaatgattgggtccgcgtccgactcatctagcaagttaggacgcctccgatt

SEQ ID NO: 10794 - DNA, 414 bp, Saccharomyces cerevisiae
gccatggtttgactattgcttatataatatcaaactgaacttccttgcatttcatttatcaagtaaattgaagaaaaaataagaaaaaaaagccaaactaaaaatacctccttcggaacatgcataaaatataatgtgtatataccaagtactttaaattatatattcaaactttctcatgacttattttttttgtcgtcatcaactttagtgcccgttattttatcgatttttacgacgggcataaatgaagcctcctccacgtttattgccttatttaacttggcaccaattcccagtccatcaggatgtatctgtgaaacatttgaaacgtccttgtttcgactctgtgtcttgtcgcctttagaatcttgctcggagtcactttcccaccccataccccgaagtaaagca

SEQ ID NO: 10795 - DNA, 402 bp, Saccharomyces cerevisiae
taaaacatgtaaatatgtacctcccaaatcacactcatcatctcatacgaaactgtatctttttgggtaaaattttcatcgatgagctttaaaagcaaaactacttcaccagcaatgaagctactgtagcatcctatgatctcttcggctctacacatcatattactagcctagtcaacatgaagttcttaaccaccaacttcctaaagtgctccgttaaagcctgtgacaccagcaacgacaacttccccctacagtacgacggcagcaaatgccaattggtacaggatgaatctatcgagttcaatccagaattccttctgaacatagtcgaccgcgtagactggcctgcagtgctcacggttgctgccgaattgggaaacaacgccttacctcctacca

SEQ ID NO: 10796 - DNA, 437 bp, Saccharomyces cerevisiae
gtgttgtacacgagaattagcacactattagcataaaagacacttggcatctttacttacttgggcaagtaagtcacgtacttttttttttttttccggagcattcattgtcattctatctgcactttcccgcacttacattcaataacctcggatcgggtctcttctacgacagaaactttttgatatatacatatttatgtaatataaatactgagaaagtaaaaaaatttaaaatataaaataataaaaaatttactattactataattgattaatgtaatctttctttgttcaaccgtgctgtttagcctccttctcgagagacacgcgtttaccgtcgctgtcactacatccacaatcgtagtcctccaggatggtagcacagtcatatatgtctttctttaggtattcgttcaccttgttgtgaatgtggc

SEQ ID NO: 10797 - DNA, 423 bp, Saccharomyces cerevisiae
ctggaaaatgagtagttaggcttttttagtaagtaaacaactaggaaggccgatgctgtgccgtgatactcttttccgcaacaaaagcaatatttccctcggccaaaacgcgaaaagacgataaataagtatatcgttccaaatactgatagttctgtacgacctgttggaataacgcgaaaagaagggtacggcgtaatcaccccacacggcttgtatttttttcggagaactaagtcatagacgtaatgctaatttttccgtctagccgatgtttatgcggcttttatttttttttttttttttttctcatctttgttcttccggtttccaagatgtctcacagattattacagtgaattccaaaatcatgtttactactggaatttgtatgcatatgttttggcaatcttaagcctacgg

SEQ ID NO: 10798 - DNA, 429 bp, Saccharomyces cerevisiae
ttctccaattgaaaacgaaacatatgcatctggcgaactccgtaattcgcctaacttttaatgaattcatgaacgggaaataagaaaaacaaaaagaaaatatacatagttagttactatccactcaataatattaaacgagtgaatgcttttacttttaactttagtttaatcttaatttacattattttagtatcatcagtttccctttgcttacttgatttgggagggacacctttatacgctttcgtactaactgatcaaatgaaaagcttaccagaaacttacgatgctattgtgaaggagaaaaaaaaagcgaaaagaggcatcgttttaacgcacactaacagaagactctatttctcttgtcagccaacaaacgttgaagatttcatcaggaaagaaggaagggcagcaagaccgaatata

SEQ ID NO: 10799 - DNA, 406 bp, Saccharomyces cerevisiae
tgatgactgaacattgatctgttgatttgaccagttgactgcttccccttcctcttccaactcttccatttcctttatggcaatagaggatggacggtaaacttcaacgtccattatcaatggaatctcaaggatatctttcaatatggaaaattgttgcttatttttgtggtccttagtaacaatattttctgactcatattggtaatcctctatcaaatggataacatggcccatccccatgctcaacgcgctccgcacattgctttcgttgtcatcaataaaccaggcatttgcaaagctcgacaacccactttgcaatttagctgtttcgaagaattttggatctggcttgcaaatgaattcttcctcgatgggtctgtcgtagtggcaataggttatgccg

SEQ ID NO: 10800 - DNA, 464 bp, Saccharomyces cerevisiae
ggaaatgtccatgtttatttcagtagtttttttctgtaatccgcaaagcttaatttctttttcgaatgcagttgtgaggacgaaaaatctgataagtgcattatactttctggagtggattctcgccttgaattaaccgaagcttctgtcatgatttcttttgtttttgcttgactgtgttgtgcttcctttgacagttctttattgaaatttgaaagagaaggggttctacttaatttatgttcattctttgattgactctcttcgacatcgtttgcagtttgccttgacgtcttgtttattggtaaaagaactggaattggtaattcttcaatattggtaatgtgtgattcgtcataatctgtgctcttcgtaattattaaaggtttttctgaagtttcattttttttgggaacagaaatattagaagaatgttgtgcaaataaggcgaatttgaagggttt

SEQ ID NO: 10801 - DNA, 419 bp, Saccharomyces cerevisiae
accagtaattacatgtgcggctctattggcattgttcatatctgtaaaagcaactcctgctcccagtaccgtttctttccgtattggaaacggtcacagcaccggtcttgtagacaatacccgagtttagctaaatgtcacttgggcactttctaatgacatttccagccaaaagaagtaattttgctcatttaaaaaaatagtttgccatatcacaaaacagtcggtcggataatatctccttccaacagtaggagaatggaggaccacacccttgtggccatcgttgttttctttgggaatggtgaacctttccatgtgtcgttgtctgtagaaatggtgttcgtgctgcttctttcatccactagaattcatgaggtagtagttcttatatgttataaacttcaacacgccacctg

SEQ ID NO: 10802 - DNA, 480 bp, Saccharomyces cerevisiae
ttttctttcgattagcacgcacacacatcacatagactgcgtcataaaaatacactacggaaaaaccataaagagcaaagcgatacctacttggaaggaaaaggagcacgcttgtaagggggatgggggctaagaagtcattcactttcttttcccttcgcggtccggacccgggacccctcctctccccgcacgatttcttcctttcatatcttccttttattcctatcccgttgaagcaaccgcactatgactaaatggtgctggacatctccatggctgtgacttgtgtgtatctcacagtggtaacggcaccgtggctcggaaacggttccttcgtgacaattctagaacaggggctacagtctcgataatagaataataagcgcatttttgctagcgccgccgcggcgcccgtttcccaatagggaggcgcagtttatcggcggagctctacttcttcctatttgggtaagcccc

SEQ ID NO: 10803 - DNA, 464 bp, Saccharomyces cerevisiae
ataaataaaatcgtgactaatacgtccggtaggatttgccttcctgcaaaatttcttctgattttggaatttgaaaggttgtaagaccatctcggaactaaatataatctccggagtatctccaacgaagaaaacataaagcgttgttaggacttaatagaggtcagataaagaaaatctactgaaacgtatagagcggatgaaatatcactttctgatcttgctgaacaaaatttcttcgataaaagatgtactttacagacgaatcatcaccggcaatgaatagagtaggtaaaaaaaggaatagactttcttttgtttgccaagcttgtagaaaagcaaagacgaagtgtgaccaggaaaaacctagatgtggcagatgtactaaacaaaacctcttttgtatatatgatgtcgccagacaggcggcccctaggaatccgaataaggatgccaccatagcg

SEQ ID NO: 10804 - DNA, 438 bp, Saccharomyces cerevisiae
taggcaaaatctgcattagctttcgcatttgtatttatatatacagcacattataatattatttttttatttatttctacttactttttttcgccaaatgagaaaacaaaagtaagttgcccctattagaaaaagagttaacattaggaaacggggacaaaacaaaaggtagaattcaaaataggaattcaaaacccaaattatctgcatcttctcgttagctaagattttatagatcattgcaggctcgataaattttacatggtaacgaaacatgtcgtttgattggcttaatgttccgggattggacttaagcagcggggaccaagcagaaaagaggccatcgaatggattaggaccacccagtgtgtcttttgattttggtataaatactgctgctccacatgattccagcttttgggatcagggatcaagaag

SEQ ID NO: 10805 - DNA, 488 bp, Saccharomyces cerevisiae
ccatagcatcacagtttgacattttttacaatattaaaaaaatcctttttcaaacgttccagaagtgcactatttttcttttgttccatctatatctaacggagcgtcaccaacctgaccttccttttggctttaaacaaaatgatccggaaatatcgtcacatttattgtgaagagagagaagttttacagttaattgtattgcaagctcttcccgctctagaaagtttttgttttgttcgtcctcaagaattgagagttcaagtatttcacctcaaatttgcatttgaattttagtagtaactaatataagattcccatcccgcatccgccactgagcaatgtcattctctcttttctcgcctttttatggatagaagcacatagacgatggatatcagagaagcgttcacataattaagcagttagttccaaatatgcgtacagtctttatagatgagagactgttaaaaacgaccttccgttcg

SEQ ID NO: 10806 - DNA, 448 bp, Saccharomyces cerevisiae
gagctgttcacttgtttttatcgtatatcctcgcgtaaaacatgattaatcaatctgttcgctttaaggaagatctcataaggacaccgactctctaattattctggagatatgtggacccctacaggcgtgattttctgtctaaacattgccacataaaacaggcttgacattatattggccatttgatttatacttgtttcagatcctttgtcgggccggattctaagagcgcgcgcgaggcgtcgaaataaatcaaataagaactaaaatacataattcttgtcacaatggattgaatttcagtgcataagattacatttgtcggagctataattccattacggcaaaacagaactgaaacaagtatattggctatctctagtataaattgttgtaaaactgacatcatatggaaccaaagtagtagactcgcatttgcaaacat

SEQ ID NO: 10807 - DNA, 444 bp, Saccharomyces cerevisiae
tattccaaggataaggaaagcatgcactgtttatttcctttccttgcttaattgattttttttaaagggaacaaacattttgatttcaatttccacaagcctagactcttcaacacataatctgtgggttattgtttgggaaagcattctccgctagaagaatgaaactggcgctcaggtttgattctataactacggcagtttttcctattctattttcgttttttgattttcccgccgcattggatattcaattcgcgacgctaataattggcatttcgtgttcttaagtaatttcgtgtttcaaataaccgtaaacagagaaagacccaagaatttcagatggcttagaagaggtagacattaaatcaatctgtatgtgatggagagggagtgtatttaaaagacgtaagaaaatgaattatcaagatccgttatggccat

SEQ ID NO: 10808 - DNA, 421 bp, Saccharomyces cerevisiae
atgcagatatagtgttgaatgataattcaccttttttttctttctttttttttttacctgggacgacattctaactaatgaaatttacgattaattattcttttttttttttttcaagaaataaatataactgtaacatatatatattaattatgggggatcacaaagaaaaatagtaactttaagaatcaaataataatgtgttgcgcttcttagtactcatccggcatttacggtttccatggtatggtttatttttcgtgcatagtattacccgtcgtgttcttttcggacattggaaagttgtccatcccaaacacttaagatgagttaaaaggcgttggcgtttgccttctccgtgtgattgatttacagttcagcccagtgatcatttagcttacccatcatcgcgtaaaatgtg

SEQ ID NO: 10809 - DNA, 494 bp, Saccharomyces cerevisiae
gcgtcatagttgatgatctttttttttttttttttttttttttttgtgctgcaaagtttcttaaagccttcgggcttacgaaatcctttatcgccgaaaggggaccgcttcgaaaagtggatataaaacaaggtatttatttttatagacaatgaccaaatgacaggatagatcgagggtgagttccaatatgtccagaactattccatttctatttaaattagtcaacagggcagtaattttgcctacggcaggttttacattaggagttggtgcgtttgtaaaggcgtggcccgatgatgccggtgttctatcattgaatgatccgcaaacgccagcggagttgattagtgcgaccaagagccgccaacctatggagctgcagagggttgacatcctcgctcaaatcgagaaaagcgaggtttacaacaagttggcccaggatgagaagatgcaccatgtcttattcagtgagaaaataccaagcgggcata

SEQ ID NO: 10810 - DNA, 412 bp, Saccharomyces cerevisiae
aaataaaacttgactaagtaccgaacaatctaaaaaaaaaagtgtaattgtcacaatagcaaataaattggtacacttcttcagccgctttaaaaattgtgtacttcttcttaaaacaattgggaagtatttatttttcacgcttttgtaatctgaaaaaaaaaaaaatatcaatgatattcaacaggctagcaactaacgaaatcaaaagaaataaaataagccataagctatagtatcataaagtcaaaatgcctagattagaagagattgacgatttcaatgatatcgacgaccttgatatggaattggccgagttagatccatctttgaggacgccgatcgctcccaagataacgcctaaggttgtaaggagccaggaccaagagaaccctgcatttttacctggcac

SEQ ID NO: 10811 - DNA, 436 bp, Saccharomyces cerevisiae
aagccgacagggacaacgcgcgataaaaaaaaaattaaaagtaaaactacgtacgcggcggcgcgactcgaatccttgactccgactgaggagacccgaacaacgctccctgctctccgccttcggcgccttccgataactgcgcacggcaaggagtagtggcgataacggtgtttattgccggttttttcgtttttcttcttgattttcttcttttttttcctcaaaagatgtgctgtagcctccgctgttgtttttttttatcctaccaaggcgcatcatcctgtcatgatctgcgctggatagtatttatactactactccgtctggatttactaaactttgtctctcttttgatgtaaagttaaagaagaattacgaaaaaagagagaaaaaatagaaacaaataataggaattaaggccttgtagcaatca

SEQ ID NO: 10812 - DNA, 469 bp, Saccharomyces cerevisiae
aaatgaagcgcagccagatgcgacaaaaacttaaaggcgcggctcagcctagattacgttctttttcaggtgatggtgccatttccgcccttctcgttagagccggaacgcagatgagctgccctctggcgcccgcgctcctcgcctggtaagttcactactaggctggaagttgtatggtgtcctctgggattgcaagggcacgctagttggatgtgctcacaattggattggcacttcaaatgccaactggaagggcgcgaaaccgagggtaatgcgacagagggcactgacgttgtttcgtaaccttgtaagctctttctgatggtagtgcttcatgtacatgtttactctattatttgaccagtctcattgttgataggttccttagttttacatagtcttgggtcttagtatatttcaattgcacgagcagataatccaaagtacttgaaaatggccggtttaa

SEQ ID NO: 10813 - DNA, 456 bp, Saccharomyces cerevisiae
tctaagaagttaaacgtatgaaggaacctacctcaagaccgagaatgctttgttcttttctggtcggtttcgcttttgcttcataacaccagcaatgaagcatgatcgcgggaaactttcagaatctacatcttctcctggtcagcttgaaacttcagattattcgtaaggagaaattataatattatttctgtgataagaaaagaggcattaagcttgggtatttgcgacaaaatacttcaggataaccgatgatcgcaagtgggttattaatttctttcatcccttaaccaaccgtcgctttcccccagtgacaagccttaaaaaagtcacaccatggaacggagtatcgttgatgattaaaccaatcattaatctttcataaaagttaagataaaagcacttgttgatatatataggtacatgtgtatcaatacgccatacattgtaaataga

SEQ ID NO: 10814 - DNA, 417 bp, Saccharomyces cerevisiae
ttgcgtccccacctttctacacctcatttacactaagtgcgactcgaaaacctaatacttcaattaatgagaggatacgtgtaaattcctcgccatcaccatgcgctgtttttagtacaccattcttttttcgcatacagatacaagcactaaactgatcgtactttgccaatgaataaaatggtgcatctgcgtatcaacttgttgattgcgacggaagaccaggaaattttgcagcaaaatatatttgtttgtatcctccgcccctactggagcttgttagaaagcttaaatactataaacataactatacagaaaaatcttgttctatagtctaaaaatttaaccatgcatacgcttatcctggatggcatgatctttgttatctgaaattatacggaagatatcacggagagc

SEQ ID NO: 10815 - DNA, 470 bp, Saccharomyces cerevisiae
agttgactactttcgtagaattccttcctcaagaaaaattttctccgcctttcctctctgaagatggaaataacgctgcatggggaagaaaataatgtaattttcgaagcgaaagcgagagaaacggaggggaaaaataaaagtgtttggcgtatcatagcctcatttggaagaatttaacgcagtgtagttttcttggacgatacagtaaactcgaccaggcactaacattacagaaaatctcgtattgatattgttattgcttaaagggtaatcaaggtaaacaagaaagaagctcctcgttgtccgtaaattttttaataaggagagagaaaaagagagataaccaagaggagaaaaaggaatctgcatcacatttattcaggatagtacgttggctgatttagtactcaggataaaaaattctatttaaataatgagaccgaacaaaacaagtctgcttctggcgt

SEQ ID NO: 10816 - DNA, 432 bp, Saccharomyces cerevisiae
tcttccatatagcattagtatagcattaatataacttttatgaactaggacatagaggacttgtgacaacgcattacccggagttagaacgttttcttgccaagttggccacatcggcaaaccagcgatggtaataagatgtagtactgacaaaacatggtggataggccagaagagcgtgcattggctggcgaaaagatcgaggacaatgattccaaaattatatatacatttgatactatctttattgttgttgccgctaattttggcgcaggattattatgcaatactagagatagacaaagatgccactgagaaggaaatcaaatcagcgtacagacaattgtctaagaagtaccatccggataaaaatgctgggagcgaagaagcccatcaaaaattcattgaagtcggcgaggcatacgatgtatt

SEQ ID NO: 10817 - DNA, 471 bp, Saccharomyces cerevisiae
atcggcatctattacatctttgtttggcaaataataattaactaaaattattgtgtttgattgtatctcatctaataacttggataatgaattttgatccttcggtagcaatttagcgattttgggaggtgttatcgtaagtcttaaatggtcaaatgtttcgtattggtcgccagatttcgctttcaatccgattgtcgtttcgttagcagggcgtttcattatttgcgtaaccgggttcccagtaactattttgacgtttttaaattcgttcaaagcatttctgactatcttgggaaacgtttctagtcccccagcaagacccaacatgggatatttctttagcgtgttggataagtctaataactttgacctgtcttttccaaacgcatttgagtagtcgttaaggcagccagttaaagattggtgcaggttctcagtttttttacttcttgactttccgcgcatatt

SEQ ID NO: 10818 - DNA, 455 bp, Saccharomyces cerevisiae
taaggcaggcccagtggacgaaaagacataactgcagaagtacagctgcctttatttcttgtggtcatttattgcttttattttcaagtcagatatacaagaaaatcaaatcccatcgtcaacgtcacgtataaacgattaatttacagtaataccatactctaccaacattattttagtccgacgttcagtcctgtaggtgttccaaatccttctggcattgacttctgtgcagaaacccttcaaaatgagttccactttacgtcagatcgcataacaaccggtcatatatttttttcttttgctaaaccccctactgcaagcacttttaagaaaaagaacaataaatgcgtctttattgctgtgtggaagtgatttttgtctttcggacaaaaaaaggatagggatgcgagagggctgtgaagtagtgatcaagcggggcctatataagaagg

SEQ ID NO: 10819 - DNA, 444 bp, Saccharomyces cerevisiae
taattaattccgcggggcggggttcggataatccttatgtgacaagagtgactaaaggaaaacgagaaaattttttcgtggaacttgaaaaaaaaaaaaaaaaaaaaaaagaaaacagaacaagtgaagaagataaaaaaaggttctatatcgcactatacaacaatagtagcgtttcccgtgttcttttcccgtcattaaatatattcaaaagttgttgcacatttgattttacagaagtaatatacactgattgtgcgtacggttaattcgcaactaaattcaatcagtacaagaaaaatttttattccgttccatcattattgaaagataaactatcacattgcgataataaactaaaagacactaggatactgccttcggatataaacatttaagtttaatttattactgtttttttaagggtttaacagcaacatttca

SEQ ID NO: 10820 - DNA, 439 bp, Saccharomyces cerevisiae
accatataaaggttagtacatgaagaagtgtgtacagttatggcaataactgttctcttccgttttaaagagagtattatcacggtctgaaaattaagcaaaaaaagaaaagcgtgcacttaaaaatcggtggtggacagaccgcatattccataaacatagatggtacaagggcattatgagtccttgaatagaaaaaatgatgaaagaatgaatgcaattccgtattgcgacactggcgaagtgttcgaggctgacacgatagcgaatgtatggaaaagagaagataaggaatggttaaaaaggactcaaagtgatcgaagtggatacgagtatccacgactaggagaatcaccatatatcaatatgacaagacgacttcagaatggaaaagaaggtaatatgtcaagatatcttttggtcatgtgatggtacatcg

SEQ ID NO: 10821 - DNA, 430 bp, Saccharomyces cerevisiae
tgctcctatcgggattcgatatggttgccagctcgctatgtgactcacttaaagtacatgatccgtcattgtgcacttttttacgaaataatggcctttttccgctctatttaaaagcgtgaaaaaaaaattgcaacatgaagaaaattcgactcttaagtgcaagtgactgcgaacatttttttcgtttgttagaataattcaagaatcgctaccaatcatgtttaaaagatatttatccagtacgtcatcaagaagatttacaagcattttagaggaaaaggcctttcaagtgaccacttactctagacctgaagatctatgtataactagaggtaaaaatgcaaagctgtatgatgacgtgaatggtaaagaatatatcgatttcaccgcaggtattgcggtgaccgcattaggccatgcaaatcct

SEQ ID NO: 10822 - DNA, 449 bp, Saccharomyces cerevisiae
aaagggactctttttccaaatataaaattcaatagaccatgcataattttcttcttgtaaatatatacatacataaaatatgaaatcgagatagtgtattgatttctttgtatcaaaaattgcataaattactattaacatatgtgcctatgcaggaaaaaataatactatatacatatataagtcaggaatatcaagaagaaaggaaatccagttgccttattttcgctgtttcagtcgatggttctcttctccactataaacccagggtttgactttctcaactctcgttgctgcgatggtgttaattcatgttctgttacttctactttgactaactcttttactttagctagggagccagctatggccgggtttacttttttgtagactatggaccctcttttacctaaacccaaacttttgacaatgctcttcgttgtgtgtgg

SEQ ID NO: 10823 - DNA, 480 bp, Saccharomyces cerevisiae
taatgcatcatgaagaaagaacagcatcagacatcagtttcacataaaggatgctcttgcgctttttctccttttctattaagtcattgcgtgcatatattatgtgattttttttaatcataccacatcttgattaactcttctgaaacggcacttggagtgaggacccctaaatctgtaatcaatgcagtaatgtattcttgggcggtatagtcgatcgtgggcccacgcaatgcatcttctagatcgtccgtacgacgtgtgaaatccaaaggagggccggccataggtagatcatctgaagacaatggaaacatacgaacaaatttgtgactttcagtgaccacatagaatggttttcttgcattatgtgctaaaacacccactgaataggtacccacgagatttataataccacctgattcagcaacaccctcagcaccaacgaacactttgtcaaccttatcgattaccgctcca

SEQ ID NO: 10824 - DNA, 443 bp, Saccharomyces cerevisiae
tgtgtgatatattcgtttttacctgcatacccttttctcttcactaactttagatttttttttatgcatattccctcatcatatattctgtaacgatcgatataatttcttagtttgacaccacatagatgataatcactaaaagactgtacacttttctatttggtatgataacagcatgtctatgtctatatctataaaacgatgttttcatatatactctcctactcttcccccagaaatctcatgactaattcaaacgtcaggaatgtcgcaccattaacgggcgcggacctaaccattgttggcccaaaccctttgaaaaaggctctgataccttcttttgcataaatggtctttgctacgtaagaaatggaattcttgtatttaggttttcgtaaatcatcgttttgtataatggatttcacaacgtccaatgggta

SEQ ID NO: 10825 - DNA, 418 bp, Saccharomyces cerevisiae
aaaagaaaagagaatgcagtatacccaagataacgtttcattttcatctgtataaatttcatgacaatagattataagaaaaagtgtgagactgaaggcagagcgatcgcactcaagtttctgtgccaggcataccttcaaacaatcgtccataacagcctgaatatgcttctctaaaatgttcataagggtcctcaggataaagtaatactccgcatataaaacagaacagcgtcccgcatacttcgcatttcattttattgcaaccttcacttctttctacaactaccttacactttggacatcgctgcaaattcgaaccctcttttttaatcgctaaatctaacattttttcagcaaggtaatcattgacttcaagttctaatactcttctcccatattttgcctccagtttccg

SEQ ID NO: 10826 - DNA, 472 bp, Saccharomyces cerevisiae
atttgaagaatcttagccttatagcggctaataattgcatatgataaagtcattcccactttatctccataaacataaaaacgcaagacaaataacgacaataaaagtaacagtggtaataataatacttctgtatgaggatgcttatcttttgcgggttgagtacaaaaatacacatggtaagaaatcactgttcaacgttataagaataaagagggacgaggaaggataatgcaagtgtagtttacagtaaaaagaatgactttatggtactaatggtatgaatagttgaaattatgtacattagatttgcatatgtatgtatatatagcttgctgtcatacaagaagattgataacaatgataaaagttaatgaaaaatttactttttttctttcattaaaaggcaaataaatgtttcttgtgaaaactttattgacgattgctcgagacaatcagtgggcaaaaggat

SEQ ID NO: 10827 - DNA, 493 bp, Saccharomyces cerevisiae
tattcaccatcctagcgaagaaacgctttaaatttataacggttaccatccaaaataatgaacataagcagatctggcaccgtagcagctcattggggaaaaaaaagctgtcatgtagggccctctgagcataataaaaaaagaagatgcttccgttcaataacagcgataggtagatgggggaaaaaaaggagaggaagatgaggcccttatgtacgtgcatatatatgtgcgagtgcacgaaagtgcaccacggcaatccgcgtaatcaagcttatgtaaatggcgtgtctgcgtaaactctgtccctgcgaaaatgtgtttatttatagactgttcgcattgttttttccagcccccatccggagacgcatgaaaaggtgtggcctcgatacatattgttaaacccatcaacctagcttgtagccaaacaaatcagtcaactctctcatagctctttcaattttaattaccagtagtccgtaagggaagc

SEQ ID NO: 10828 - DNA, 496 bp, Saccharomyces cerevisiae
cgcgttggtaatgatgagtgtgtgtcaaggatacgccgtttttcatggtgatagacgccgtattctcggagcggcacgcaagcgcaatgctgagacccatacatcatgaaactccttcagggtcgaatgacgtataggggagatgcacacccccacccccgcatcacacccagtcttctagccaattatgttggtaattttaagggtttcgccatgtggcatgccaccggcaaaataatacacgtgcccgtacggcaccaaacgggcatgcatttttgcatttgaaaaagtttgctgcccttcatgtgcttttatgtatgcatacacatacacattcgtgcatacattcatttatatatatatagagtgtgcatcgtgcatatgattattcattaccactttttttgtttttgattttgttcgtcaaaaggaagagaaaaggcatatcgaagggtgtaatgacaaaagcttatactatcgttatcaagctgggcag

SEQ ID NO: 10829 - DNA, 435 bp, Saccharomyces cerevisiae
cagtaacccaactccgaaggccgtcacatcccctgcgatttcccacgggtccagtcattccgcggagaaagaaagcaaccggaagcaacggcatccctgcttataagcgattttcgcgttgcgcgtcatctttttgtcttccgtcttagtaatttttatgatttttttcattccacccgactctatttgagtgcaagcatgcgatatatctctctatatattgccagatctttatcgcaataggttcatgcactatatgcgcatcccactcttgtacatgcacaatattgtgctcattgtctgaatatatatatatttatatatatatatgtatgtatatatatcagttctagatagactaataccacttcttcgttagaaaaatatttcaatccttattttgtttctaactgttcccttctctccatccaacaa

SEQ ID NO: 10830 - DNA, 495 bp, Saccharomyces cerevisiae
acttgatttgttatactatatgttcactgatgatacagtcaacttttcataaaactttctaatgacagtgacgaacttttcttcttttccatttttttctcttgatttcttttcgataaaaggtttgtaagtgagttcaactttctcttcttggatctctccttaccagtactagttttactcttttggggcttctttaccgcgtacgaaaccttcccgctgctggtactattgatcatcggactaacatcttgtccaaatgttggaacaacgaactcagatttccactcaaacaatttagacttttcacaattcaagcaattaacctggatacatttttttggtccttccatactctcgccgccaagttcgtcggagtcaccttgctcggtattagtcgttaactgaagacttgcgttaaaattaggaacgtaaacacacccgcaatgggagcaaaatttcccacttttcagttgttctggcagcatgatttga

SEQ ID NO: 10831 - DNA, 447 bp, Saccharomyces cerevisiae
ggtattgtgccactttcctccagttcccaaattcctcttgtaaaaaactttgcatataaaatatacagatggagcatatatagatggagcatacatacatgtttttttttttttaaaaacatggactcgaacagaataaaagaatttataatgatagataatgcatacttcaataagagagaatacttgtttttaaatgagaattgctttcattagctcattatgttcagattatcaaaatgcagtagggtaataaaccttttttttttttttttttttttttgaaaaattttccgatgagcttttgaaaaaaaatgaaaaagtgattggtatagaggcagatattgcattgcttagttctttcttttgacagtgttctcttcagtacataactacaacggttagaatacaacgaggatatgtccgacgaaattgtttggcaagtga

SEQ ID NO: 10832 - DNA, 492 bp, Saccharomyces cerevisiae
tttttattgtttctttggcgaaaaggcgtaattaaacaaagatcaacatacataatccgattttgaggagtgataaaatatacttagattattccttatccattacagtttgcttttttgaagatagccaattgatgaaatcaataaaaatgttaggtccacattttcctttttgcatccactctttggtagttgcagtatacaagtcaatcaattcgtcaagcttgtcgttaccaccgatttcaacgtataacttactcaaaaacagtgagctggttgagcacattgaataaaacactgcagcatgctgacctggcttagaagtcagcatcagcttgtgtgtttttttcaacaaatccataagctcgatgtctttgttcatgtctttgaatgcagttacttttatcttgaatattttacccttcaacaatttagaaattttgtcggcaagtggcctatcaagagtttcattgacacatttcagcattggga

SEQ ID NO: 10833 - DNA, 496 bp, Saccharomyces cerevisiae
cagcacttcactagctcaaatacagaataaaaccacatttcccacatgtaaatatagaaagcagtttattcgctctttgaagcgagatcttcttcgatagacgtcacctcaacgtcaggatagtcggtgccgtcaaatcttgctgattgttgcgcttgaatagactcttcatgtattctaaaaatgttaattagtgggaacgccacaataaaaattaatacgagtaaaaacattggtaaaccatcaaaaatataaagataccactcgtgcgaggcaatttctccgtcataaccctgaataaattcaacagctctgacgatcgacctaattaaaatcaggaaactgttcaccaataaagcaatgtttaggtatttccaactaccataccttaccgatacattggttggttttttgctcatcttgaaaatgaacaaaacctcatttataatgaagagaccaaaaaaagcaatttgaatgaacaaaccagctgtaacga

SEQ ID NO: 10834 - DNA, 473 bp, Saccharomyces cerevisiae
ccaaaaaggtacttaccatctcatctcgattcttataatcacgtatgaacattcttataattgcattttctttatacaaaatatataggtaccaaacctcattataatttctgccatttaatagtttaagatgctattccgtttcgtattttttcaatttttatacctactattgcgcgaaatcaaaatagcatactaagaaaaagcaatatcatgaattgctgatgagatagattcaaattggaattaactaaatctatcagcaacgctataaacacagataagcgctctataaaatcgtttgtctaacgttttatatagttctttattgctcccttaccctctttccgtcaatagtgattgttgtctcgggaaagcttttttttttattaatcaaaggcccaattgagttacaactgaaattaagctgagttggcggaacagtgtggtattagcgaagggaaaatctgtga

SEQ ID NO: 10835 - DNA, 414 bp, Saccharomyces cerevisiae
gtaagattttaaaagacgaaaagaacggaaagtaggacaactaccaaaaaaaaagatggaaggtttctttggttagttagcagtatccgcgtaatgccttagacgtttttgatcagaaaaaaataaaacttgatttcgcccaggatcgaactggggacgttctgcgtgttaagcagatgccataaccgactagaccacgaaaccagttttttgatgtttcgtttaggacaagagtcctatgagagtccactaaaattctaaaaataattgtatcaacaaccgtcatgcagctgttgtatcaagaatcgaccaccatctatagactattgttcatagctgtattacaatatcatataagatgtaaggatagaacgtgaagatcgagaaacagtcagcagatttaatggaagctga

SEQ ID NO: 10836 - DNA, 458 bp, Saccharomyces cerevisiae
taggaaacagatggcatccaccatgtgaaatatcattcaagcatttcggcaaaaccatgtaaatatttgattattagcgggtaaatatgtaatagttatgcactttaattcttttgttcatctagaagacaatacaacgcatttcttggctaaccatcttacagccttgagggtaaagggcgggcaaacgaacaaaagtacaaaatttccatccttgtttgataatcatttcctcggaccagataagaatgagcagccgaaataaacggtaacgtgattaaaaccgctagaagagtgtttttgtaaggatgaaaacctcagtgagaaagttgacaatataaacattatcagcttttctcgccctcttttgcacttcctgcaacattacttgttctgcagcttgtttcttccaaatatatccatgctctcggtgtgccacttctggggtttctcaccaa

SEQ ID NO: 10837 - DNA, 458 bp, Saccharomyces cerevisiae
taatgaacaggcacagtatagaaaaaaaatcagatctgcatttaaaaggctgtcttttccaatgatcctcgaccttagcgcggctaatcaattctactcacttttttgttcgcttttttttttttgacccgttgaaccaagcgggttaattattttttaaggataaaggctaccacaatcatgagagagacaccatgtacttgcaggattctgatattttttctatgcttgtttgctgacatgcagattcggagctggttttgatatttcataatcacctatttttgaagcaatacttttggacaacaagatagcattattattaggatttccctatcaaagagtcatttccgtgcacttcgtgaaaaatccagtcagaaagttcagcaagcagtcaagaatatctacttttgtttccaagaaaagccttacctgacagcgttcaaagtctcctttgc

SEQ ID NO: 10838 - DNA, 407 bp, Saccharomyces cerevisiae
aagagaggcgatacgataatatgataaaatacaagaggtcctctctttccggttttttttttctggttgttttatagaaagggttaaaagaataattaggtataataataagtaattaatatcagaaacagtcataatactagtgacattatgtatcaaattttgacttagttttttcatgttcgtcagacgtgataggttttctccaggtcttattttcatctttcattttcacatttttttttttctaaagcgaaaactaagatgaaaaatttcagaatatttaaactgtgatggcagctataaaagcccagttgccagctcattgcttccataacaaccgcagcaatgtctaacactctatttgatgatatattccaagtctcggaagttgatcccggtcgtta

SEQ ID NO: 10839 - DNA, 499 bp, Saccharomyces cerevisiae
atattatttgttgcatgatttttctcttttatttatttatatgttgccgatggtacaaattagtactagaaaagaaaacccactactatgacttgcagaaaaagttatgtgtgccatagatagatataattgcatacccacattgtatactcaaaattccgaaaagaacatttcattttttatgaggcaaactggacaacgccttcggtcctttttcattctagaaatatatatttatacatcattttcagaagatattcaaagaacttattgggatgtctgtttactgaataaagtatacacaaaatacgaatttaaaatggaaggcataaaatagaaaacttagaagtgaaaatcctaaaaccgaaggatatttcaaatacgtaaaagaagtgaaagataaaataaagcctaaataaggaagaaaagaagggataacatttttttttgttactttttgcttattcctcacctaaacagaaggaaaaagccattcttg

SEQ ID NO: 10840 - DNA, 495 bp, Saccharomyces cerevisiae
aatcacctattgcgccgctcgcggaatacaattactaaattttatatatattctttaaaaatgcatctatacattcgtttttccacgtataccaaattcgaaaaaagttgttaaaccatcgttttcacgttttttaatttttttttggttctctttttttttttttttcaatatcaactttttttcaaacttcgtgttgcatttcctttatcgtaaattttcaatggatctctataatcttcgaagttcgaagaaaagaagaaaaaaagtattgaaaagttgaaacatcgattccgttttgctaacaaatagcactcagcatcctgcataaaattggtataagatatggatttcacaaaaccagaaactgttttaaatctacaaaatattagagatgaattagttagaatggaggattcgatcatcttcaaatttattgagaggtcgcatttcgccacatgtccttcagtttatgaggcaaaccatccaggttta

SEQ ID NO: 10841 - DNA, 500 bp, Saccharomyces cerevisiae
tcgttaaggaagaaacaagatctattcatgcattcccattctcattctcataatttcatttcatcgtacaactgaatcagggtgtaattttatagttgtttgttggtctttttttatcaacgtagaattcacttatttcagattttatagagtttcatagtataaaaataataatgaaaacaaaacttcatgctttttcttctgtttatacaatttcacttttgattgttattcaaaaaaataacatttagtcgcagcttctcagtgttactaatctttttcttcttttttcgaacataagattttctgatggaacgaaaaaaggtgatcttttaattatttgtgaatcataaatatccttttcattaatttttaagtggtatagcgtatttacatataaaacatacatgattatttcatgtttataatcaaaaattataaataattatttaatctctaatatagattaattagagtctttccacaactcagtagcatcc

SEQ ID NO: 10842 - DNA, 412 bp, Saccharomyces cerevisiae
tatacgcatttaaaagtgtcattcaaatatcgcagaaaataacttggacgttgaaaatagggccacatttatacggctgcaagaaaacttttactctctttctaccaagtttgttactgcaattaaataatctttatcatgggatagcgaaactaaaaactcatgagtggaaaagagagaatcgtagtttttcgagagctgttgatactttggatacttttttccaaacatcttatcaaactctaactgaggtacacctgtatcggtttgtgttttatatagcattccagcgtacagtacttgggcaggaggtagatcatgctttgaaacacagcaacacaacgctttcaatgagcattccttcaaagcccaaactcccgctatatattcatgcaatcgtggagttaagcag

SEQ ID NO: 10843 - DNA, 413 bp, Saccharomyces cerevisiae
ccatggcaattgcatatatctttgtactatattataaaaccccgcgaaatcaacttttcagttttcttcaaaaatcgatgtacccatcataagaagttcccccaaaaggaaagaaatgagaggaaaaagacacgaagggaaaacaaaatgaaattcagtggcttgtggtgttggttgttattattccttagcgttaatgttattgcatctgatgtgggtgagttgattgatcaggacgacgaagtaattacacaaaaggtgtttttcgatattgaacatggtgaagagaaagttggcagaatcgttattgggttgtacggaaaggtatgtcctaagacggcgaagaacttctacaagttaagcaccaccactaattccaaaaaggggttcatcgggtccactttccatagggt

SEQ ID NO: 10844 - DNA, 424 bp, Saccharomyces cerevisiae
atagtgccgaacagtcaggagcacacaatacatgacctataatgacactatcttaatgaaattctattacactttctcttttcttcacattcgattaagaatttaatttattccatttcaagtctcattctccattttctggttggccatagatgtattatttacaagtctgatagatataaaagcgccaagtaaaacatatatacaacatatacatatacacctcgcatcaattaaaacacgttcctttgctttcctttctttttctttttttttttttttccgatctttttcactccaatgtttccattctttcaaatacaactttcctattcacattgctgttcttactagtggcccatgcatcatttaatataccagcctttcgtaatagtttagtaactgtttcgctaggttgtgctcc

SEQ ID NO: 10845 - DNA, 413 bp, Saccharomyces cerevisiae
tcactgagattatacgcctcgaaaacatactaaataagcataggaaggctgaagctaagaataatattaacaaacttgaaaagaagttgagtgaaacagatggttttacatctgtaaacacatcagttccagtaactcctattatgccggtcttaaatacgagaacttcttatcccaatatcgactttcatggtactaaggtttctgatgttctagatgcctttgaatttgaaaagcatgatgatcccttaagggataaatggaacactttacagtttttggaaaagagctttgaatctaaatttgaatctgcatcagagttaatccaaggaggcgagctagctgctattaaagaaagaaattttcaattagccaaactaaataatctttgctttcgggtacgagagtccatc

SEQ ID NO: 10846 - DNA, 460 bp, Saccharomyces cerevisiae
tgctatgactccaggcaaggttctctttactaatgctttgggtttaggctgttccagatctagggggttgtttttggaaatgtttggtactgctgtgttgtgtttaacagttttgatgactgctgttgaaaaacgtgaaactaactttatggctgcgcttccaattggtatttctttattcatggctcacatggctttgaccggttacactggtaccggtgtcaaccctgcaagatctctgggtgccgccgttgctgccagatatttccctcattaccactggatctactggattagcccacttttgggtgccttcttagcctggtcagtgtggcaattattacaaatccttgattacactacatacgttaatgccgaaaaggcggcaggtcaaaagaaggaagactgagagtagtctgctcagaattttatcttttttggcataacgctcccatcgtag

SEQ ID NO: 10847 - DNA, 442 bp, Saccharomyces cerevisiae
gatatacctcgaaaataataaaccgccacactgtcattattataattagaaacagaacgcaaaaattatccactatataattcaaagacgcgaaaaaaaaagaacaacgcgtcatagaacttttggcaattcgcgtcacaaataaattttggcaacttatgtttcctcttcgagcagtactcgagccctgtctcaagaatgtaataatacccatcgtaggtatggttaaagatagcatctccacaacctcaaagctccttgccgagagtcgccctcctttgtcgagtaattttcacttttcatatgagaacttattttcttattctttactctcacatcctgtagtgattgacactgcaacagccaccatcactagaagaacagaacaattacttaatagaaaaattatatcttcctcgaaacgatttcctgcttccaacat

SEQ ID NO: 10848 - DNA, 447 bp, Saccharomyces cerevisiae
aggttgtgtcatagagaatgtgttagtactgaatcctaacctcccaaattcataagtagttttatgtacctttaatgatttacgattagcaactttttgaattttttttattgaaatgttgagcccgaagacgtgaaacgctataaagtagtatcactgttacgccgcgaaacctgataatgtattgttaaactactacctggtcgatgattatatcgacgcttctaaaatgaatgctattacccgaacttccacttgattgccgtctcttcccgggtaacattgtaagtgtgaatatgatttttttttttgctttctcttttcaaaatttccgaaaagcatatcaagacgtgtactacatacagtaaaagccctcctagggttttcagtagtggttcgaatagtatagattactgcttttgttactctgcaacaatcccaaaactt

SEQ ID NO: 10849 - DNA, 409 bp, Saccharomyces cerevisiae
ttgacggtatacccgtgtttttctcattagcagtactactattccgcactttacatcattttttataaactcatgcatacatacattgtacttcaaaagatttttttttttttttggcatcataaatcactttcagatcagtttcctttcaaacgcgcggcattaagaaaacttttaatgtcaaaaaaacggaagcaaaaacccctcccttccgcttaagatcatgtctggacattttagttgtaaggctgcgcctcggtagcaagtagtgctgcaacaaggctattatgccacctaaacagaccacttttgcttaatacgagactgtgactacctcctgacttcctgtcataacaaaaaaacagacgtcgctgcattaacatttacaaccccaaaccttcttcattca

SEQ ID NO: 10850 - DNA, 446 bp, Saccharomyces cerevisiae
gacttagaatagtgagttgtaataataatcataaccataatcataatcataattactccgcgcgccgtttattttttttttttttttttcagggccactgatcccttcattttgtgtcagtaattcagggtccgggcagacaaaggcatattatactatcaaaatttgaatgaaaagtaaaatgaatggagttaataatacgcttcatattaacaaaagcacatagacgcacgatacaaatactagttcaaattgtattcctaagcctttctttctttttttgaaggcaagaactcgcattagttatggaagaaaaccaattaacgtgcttaataggtatggcaaagaagtttaagaaaacagacattcgaacaaaaatttactaacatataaatgtaaatttaaatttccttttttttacagttggagaaacaccagcagcacaa

SEQ ID NO: 10851 - DNA, 410 bp, Saccharomyces cerevisiae
tcataagtttacctctcatagtcgcatgaaaacataaagtcatcgtagcatattctgtacattagtcatttctgtctccaaagggcataatttgggtcggttcatttttttcttcttaattcgtctcttcatttcataaagctttcttttgaaacctatgaaatgagctttacagttcttcactcttttttttaaagtttgtttatttttttatactatatacattattatttctaaaaaatcattataaattacgttaaaagcgcaccttatactttgatagagttttcccagaaaaaaaaccaacgaatttgatagtaccaagacttcacgggattgaaatcggatgcaacttcaactattcctgggacagaatatttctcagacattactttgtgtaccgtggagcc

SEQ ID NO: 10852 - DNA, 461 bp, Saccharomyces cerevisiae
gactgatccccgctctcggcgccccgagtcggctaccccgcgttggcaatcccctccgatcgtccgcggcaaaatggtcgtcaatcggacaaagggggatgatgggatctggtaatagaagaaaatatggactaaaggtagccgctaaagcgatccaggcatgtgttgccaatgatgtaagtcaagcgaaggaaatggttcagtaatatgatagacagactgcacttcaagggtgcgccccctcccccgcgcatatgcttacaacgcaaaataattgacgtttaatgtggatacttatcgtaatcgctgcattatagatttcgagtcatgttcacttaaccccacatatttatatagaacgcatcttcaaagtacttataaagtttagttttacatttttctgctttctatttcttctttttcggttcttcttcatgccagttggcatggcttaagagctt

SEQ ID NO: 10853 - DNA, 454 bp, Saccharomyces cerevisiae
tctttgaacaggacagatgtaaaaaactggtttccaatttctttgctgctcgtattgatgatttatacgtcgtcaaagagcttacaataccttgccgtgcccatctacacaattttcaagaatctgacgatcattctcattgcttatggcgaggtcctcttctttggcggaaaagtcacttctatggagttgacgtcatttattatgatggtcctttcatctgtagtggccacctggggcgatcagcaggccattgcaatcaaagcatcatctttggaggatctcgatcaggaacttgttgagtcaaccatctttgtgttgaatccggggtacctctggatgttcaccaattgtatttcgtctgcattgttcgttttgattatgcggaagagaattcggctgactaactttaaagactatgatactatgttttataacaacgttctggcattgc

SEQ ID NO: 10854 - DNA, 493 bp, Saccharomyces cerevisiae
ggtcaaatatagatgaaactacaggatgatatctgtcggattgggttagctgataatcgtatagccgatgtgaaatatgattattaattgatttacttggttatggtaaatacataaatatatatatagaaacggcaaattacccacatttgcatttgtattaataacactaaagataatattcataatataccatcattgataattgaaatcgacatcaacatttatcaattgagagtttagtggtcttctattgcgagaatatcgaacgatatgatttatcttgatcccactgtgtcgcgaaatcgcggaagtaaattgaaaacaaaagaaaaacaaaacttcatcgataaatattgagaaaacatctcttaaaaacagtagtagataatcttgagaatttactttataaaaaacagaagaaggactgaatatagaaagaatactaatataacataatcatgtcaagtaaacaacaatgggttagttctgc

SEQ ID NO: 10855 - DNA, 457 bp, Saccharomyces cerevisiae
atttcttaaaagcgcattcatttaaccctctgatctcttatttattttttttgtggttttttttttcacatcactttctagccttcgctacattgtctctttctttccttcttttattctatcattctccctttcctttttccattgcaccgtgactctggattaatatggacataataaaatttgtaatattcaatataatcatgtaagcattccaagtaaatacgcaggttggctagtctaaatcgaaaatgtaacattactaccatactatatatctacatattgtaattgtgtaggtatatactaatcatttaccaatgtttaggttccatgccttctggtggtgaagttttaaccgttcccttagatacgtcttcccagtctgtactcaatgcagtaccattactttctataaaggatttcatcatagcccttttggtatctggatccgctc

SEQ ID NO: 10856 - DNA, 500 bp, Saccharomyces cerevisiae
aaaagcatgcctgtctcaaaatagcctattccgtgttaattaatattctatattcaaaaaagttaaacatatatactgcatgtacttaccgccgaagcacaaacgtgccacttccatgaacacttgctctttatttatagtggggctgatatgcgatggcgtaaagctactccagcctccttcttttcatatcctcatgactgtcactatgtgttggtgtagccatcgaacttccactagatttgttcttccttttcttactattgttacctgaatttgagccggattggctttttcctgtaccgtctagatcaaacgccaagtcgtctatatcaaacggcgcttgggctcccccttggttctggtttgcgaactcgcttggatatgacctttcaaactgcgatagtaccgaagagcaaaggtcccaatcgaaatttggaggctgaaacaatgctatgtctctattgcgcagctgttcgcgccattgttgctctgacatg

SEQ ID NO: 10857 - DNA, 436 bp, Saccharomyces cerevisiae
atctcaaatcctactgccggaattatgttaatgacaggttccgttggcgacggtagtgaattcgattgggaagaccaaaaaactttcatctctagagatggcggtttaacgtggagatttgttcataattcttctgggttatatgctactggtgacctgggaaatattattgtgtatatcccatatgatccagaggaagatggcgattttcaatctgaattttattattctttggaccaaggtagaacatggaatgaatatgagctgaccaatgccataagttctgtccatccctacaaattgataaatccaacaccagatggatctggctcaaaatttatttttaaaggaacgtttgccactaccgattccgaaaccaacagtataacttctttaaaaggtgtcgagtatataattgatttttcagcagcattcg

SEQ ID NO: 10858 - DNA, 400 bp, Saccharomyces cerevisiae
tattaaatcatagcgaaagcagctttgccataacttttcttcttaaaatcaccctcggtcatttcgttcttctttttccgattcaattcctaataatttatgcatattacagaacttttttttccctttttctgtcacaggtttcccaatttttttgacgactaaataataacataaccactacgttcacttccccgtatatatacatatatacttaatattataaacgcatatacttttataaacttggaataagtattatatatttattttgaccatccggaaatgctttattttacacttggaaagaaaagtgcatttggaaaacttttacatgtcacccaagtgcatactgctgacgatacaggtttagagactaaagagagcgcatggaagaaaa

SEQ ID NO: 10859 - DNA, 435 bp, Saccharomyces cerevisiae
acatagtggacaagtgttagtttataacatggtctcaataattgcaccacaacggcttctcttttatagatggttaacattatagtatcaatattatcatcatgattaaatgatgatgtataatacttacccgatgttaaatcttattttttcatgcagtaagtaatcatgcaacaagaaaaacccgtaattaagcgaacatagaacaactagcatccccgataagacggaatagaatagtaaagattgtgattcattggcaggtccattgtcgcattactaaatcataggcatggaaatttccagttcaccatggaacgacggtggatacagcccctatgagagaaacagagtcgctgtatcaccattttcatcagcgttggaaggcgaagaacgaatagaaacctctcgatctttgggtgatcattgctttga

SEQ ID NO: 10860 - DNA, 480 bp, Saccharomyces cerevisiae
taggttgaacatttcatttttcttattttttcatctattttagcgaggcgatcttgagcgtttgtgtaactggataaaacttggcaagctggagtagtccttatttctcataaagaaagccgaaagcctgctctcctacagttattaattaagaacgctcgttttaaacagttactgtgtaaagcgacggtaatcgaaaaagtatgtgacatcgtgcaaaagaagataatcaaaaccatgcagaacgtagaataaatgtgagttctatcacttgcggagataataccctctgacgccgcggggccgattgttccacggagggaaagaatcggccctcgggttttacgagagcgccgcgggtgaactcacttttttctcgagaagaagtttcctacggcagaataagacccttttccacggataatcagcggagcttctggacataatagatggtttgtgaaaaagcttaaggaaagccgc

SEQ ID NO: 10861 - DNA, 424 bp, Saccharomyces cerevisiae
atgaaattaacatgcccttttctggaaaaaggaaaaaaggtggtaggcaccgttttttcctgagtttgcatccttttttttctaaaaccctctaaacaaaacctaacacacacacacacgcacaaaaaaatgcacatgatgttttattatttatatattcccacttttttcgaaatgatgcttgactaatgcacaagcaaaaaaccccgacaagattggttgatcacttcagctttttcctcccattgtcctatatatatatctgtgattatttatttcttcctcttatgtttctctatttattttatacgccaaatcccatttgtatatacgtaacgaaagctttataattcttatgccccgcaaacactcaattgccgaatgtttcgtctactcacctcagtcattggaaaaactctttggc

SEQ ID NO: 10862 - DNA, 472 bp, Saccharomyces cerevisiae
aaggctatatgatagatttaatttcttgtaaatatcaaacgataaaaatataaaaagtacgaaagaaaaaggggaggtaatctaaactgtaacggggaggaatggtttctttggtttttattatttctaaaaaatatttgtgattatattacaaaatgtaaagtattaaagaaaaactatttttaatttcttagtaacccaaagcggctaattgtttagcaacatcagattcagcagcagtagcattagcagaggcaactttcttggtgaaagctctcttcttggcatagtattcagcggatgaaacctttctctttgcttccaatttggcaacaacatcttcgtatttccaaccaacggaagtagacaacttacccaaggtggtgtactttctacctggcttcaatctcaaaactctcaatgcttgtgggacaacaactctcttcttcttatcgtatggaggtgggatacc

SEQ ID NO: 10863 - DNA, 424 bp, Saccharomyces cerevisiae
agttattgtttacattttgactccatcttcttatctgacgataacttcagaaatctttttatgtcagatatatactcaggtgctaatgcgaattgcccgaatagtgaagcatttgcatgtcatacaacatctcgctgatttaccaaataacaagatttcctattgcataaaaattgatcttgtgcaatccttcctatattgttgtttcctatagtccagttctattactgaaacttatcgattaaagtgcatgtgaaaattcgcgggaagtgacgtttttttttttttttctttggcgttctgccaatatgaaagattagatagcaaaaggttaatggatactgaattcatgaatttgaaaatcatctaccatggattcgaaaacagtattactaactgattcaggggaaacaatgggattctt

SEQ ID NO: 10864 - DNA, 466 bp, Saccharomyces cerevisiae
actttccttttcttagagcttggttcctcgtcggatagtggcaagtccacctcaccgagactgccatcgtcatcctcgctgtcgccatctgcgcttaacccggattctccttcttcgtcttccaagtccctctgggcctcagcatagtacttcacacaaaaagggtagatctcttcactgaacaatgacgccaatgagtcgccgtgcgggaactccttcccgggttttaggccggtccatctgaaccagccaaatatggttttcattccctgtctgtacttttttttaccctctggactgcgtttgtctttgatcaagtccgggtttatcgagtcgtaactctggggccactcaattggaacgggctcactagtcagtatcccgtcttcttggtcatctttgccttttttgatttggaacaccttggtgacttgctgctctttgaagtctccctcaattccatgga

SEQ ID NO: 10865 - DNA, 428 bp, Saccharomyces cerevisiae
acaggtagtatattgccgtttgttgcctttatggcttagggatttgagctttatagtaagaactgctgtggtgtcatgatagacgaaatgctgaaaaaattttcttttcgttccttttctcttttggcaagagttgtaataaggtcatcgatggattagaaatgctctttctgctttgggggcacttgaggattgtattattttaaggctttcccttcagaaatcaggaaaaaagaaaagaatacgaaaaagatgtctcaaaaagcttgttacgtttgcggtaagattggccatttggcagaagactgtgattctgaaagactatgttacaactgtaacaaacccggtcacgttcaaacggattgtaccatgccaagaacagttgaattcaagcaatgttacaattgtggtgaaaccggtcacgttag

SEQ ID NO: 10866 - DNA, 468 bp, Saccharomyces cerevisiae
acctcgtaagacatgatccgcgcagcccaacgcggcggtgccaaattgcagtgacgtctcggagtaatataaaaaaaaaagaccaaataaccaaatttaagggtgctctgaatataagggagtggaacgttttcacacgaaggaaaagggaaagaggggagtggtaagaagcaagagtcaatgaaaggtcttccttccttcttgatgctaaaacaaggatagtctggaatggggaggagcattcggcgcagatgccgacatataaaaggatggttgctttgcaacagttacttgatcttgctttgttctcttgattagttatccgttagatgcaaactttaagtacagtaattttgaagtgaattaaaaagaaagaggtatttacgtttaacgcttatactttcctttttatccaagtaacaagtaacactaatcactataatctaccgctatgattttcaaaaggtt

SEQ ID NO: 10867 - DNA, 406 bp, Saccharomyces cerevisiae
agttgacgctttgtgcggcggccaacaagggatgggcggctatttggcgatcgtgttcattccccaaactaacacgaagagcatgagagagaaaaaacaaaagtgcttgaaacaggtaagacgtttatcattgatatcaccaaagaaatatataatgccggattctatttttgaacagccctttgtttactgtggtgtttgccacagaagaacatcgcatggagatccattgaggctgacctcatgtgctcatatcctctgttcgcagcattctccattaacatcaaaggtgtgtcctatatgccgttcgagcgatatctccatcattaaccttgtggaatctaaacagctgcctaccgacattaggattttttttgagccactgcccccacttttggagtcgtta

SEQ ID NO: 10868 - DNA, 460 bp, Saccharomyces cerevisiae
agaacagagtaggtgcttaatcgaggccattatttgccaacgacgtttattcatagctgaagaattcttttcaccaagaaaaaaaaattgcataatcttataaatactaagacccattatttaaaagggtctgaaaaccatcgatcatattgcctgaaaaacgaacatgcatatgttaattaacgctttacaaacagagcataattattgttattcttttatatacttcatgtcttattgtcacatctactgttttcgcgtacagaatgatattatgagtttcaaatcttgtagtaatatcagaaagagctcttttcagtgaagaaagcctacgatataaagaacactttcccaatgactaagcgttatctgttgtagctttattgtcataatacaccaattatctgggtacgaactcacttcctgcagcttagtttttttttttgctcagcttcccact

SEQ ID NO: 10869 - DNA, 481 bp, Saccharomyces cerevisiae
tgaatttgtgcagaattagcgcggtggcggtttagttagtgatctccatccgatgtcaacatattattatttgtagttgtatttatgtgcactcggcggtttgtatgaggaaaagatgttatgaagagaaaaactgccgagtaattgaaagagatgtctgaagtagcggaaacatgggtggatacctggatggcaaaactagtcaactatgactacaagcactttataagattggtgataattgtaggtggttatttactcttaagaaatatcgcatccagggaattggcgaagaagcagttggctgcccaagtggaaaaggacaaacgagacaaagaggaaaagagatcaaaagacctgatcgacaagccagatgatgctgcaacagcagaaacaacttctttcggttggggtaagaaaactagaagaagagttaaaagacaacaggagttgtttgaaaacgctttggaagaggctaaga

SEQ ID NO: 10870 - DNA, 401 bp, Saccharomyces cerevisiae
cgatttcccacatcctgcgtttccgtagtcaagggttcataatggatgatgagcctgtaaacagctttgtatttacctcttttacttcaagaatgctcttgcgtcgtttgcagtgtcgaagaagatccagtagagctatacaaaatggagaaatgaaacagttgaaccagagcgccgcatttggcaggtagtttcgctaaatttcctcatgcgcgtttgtaattatgctagttaaccatatgataaggttgcctaacttgcagtcaccggaaggttatttccggaatggtgcagaataatttttaaaatagtagcatatatttcgttccaattcccaaatagggaattataattatgacagataaattcccgattaggaagaagcgcgaaaattcttgaaa

SEQ ID NO: 10871 - DNA, 500 bp, Saccharomyces cerevisiae
acttaactacaccactcaggtctggacacttcccattagagccggttgatgatatcacggcatgtccttagcgctgagtaggtatgacttcacaagcacatttgcttgtgccctcccctcccttaatgaccttattcgtttctgtaattttatattttttttacatacattcattaatcatccgtagcatacatacccgcacaatgtcgttattgtttcaaattttgctttatcctcccttcaacagaacgtgaaggaggaatttctatggctttggaaaccgttcctattcttgcctatcccttccagcgcctgtcaaaccccgcctaaacagtactacctctttgggtaatggaaaggatatttcacctttgaatggccaggtagggaaaaaaagaaaaaaaaacctttcttcttcttggtattttgactaggaggccatcatgaaatagtcacagaaacaacaaatttattgtcttggcttgcgatccacattgata

SEQ ID NO: 10872 - DNA, 400 bp, Saccharomyces cerevisiae
aggaaaaagtaggaaaacgcaacattcacaattgtaagctacaaaatattgaatgtgaatcctgcttcattacaaatgaagaatttcaaagcgtatctagttcaccaaaagtcacaatatcttattattatttggaagcttttatatgcatctaatggtcataaatcccatctcactttataaaacaagttaccgcgaatgtatccagtgatacagaatagagtgtaacaaatgagaataaaaataccatattatcgtttaattttggtagggtacgctaaaataaagtggtgtttgcgtctccatataactaaaaagaattgaaatggcctactatcgattagactattcaggcatggaagcagtaagaacatttcttgattttggaaaaatgagatta

SEQ ID NO: 10873 - DNA, 472 bp, Saccharomyces cerevisiae
cataaaactcatgattcaacgtttgtgtatttttttacttttgaaggttatagatgtttaggtaaataattggcatagatatagttttagtataataaatttctgatttggtttaaaatatcaactattttttttcacatatgttcttgtaattacttttctgtcctgtcttccaggttaaagattagcttctaatattttaggtggtttattatttaattttatgctgattaatttatttactttcgtattcggttttgtacctttagctatgatcttagctaattgaagagggtggtgtgatctttaaccataccttattatctttcagctgcttaccattttcttatattgatttttagcgaaagatttttattcacaagctttttttatccttaatgctcgaatactacaacaaaacaaaaaacattaaacagtttttaattttgtgaacaaactgaattacaaggcc

SEQ ID NO: 10874 - DNA, 465 bp, Saccharomyces cerevisiae
cagtgctaaatttcctcgtaaagcggtaccattaagggctctttctacttctttaaattatctacatatgtataaatattcttattatataaggcgaaaaaatgaacgagaaaaaaaagtgttgaaagtatgcattcaactggctcttcaacaagagactcaatcaattaagcaatcgaagatggctattgatgctcaaaagcttgtggtggtcatcgtgatcgtggtcgtgcctttgctcttcaagttcattatcggaccgaagaccaagcctgtgctggatcccaaaaggaatgacttccaatcatttccgctggttgaaaaaaccatcttaacgcataatacttcgatgtacaagttcgggctacctcatgctgacgacgtactcggtttaccaattggtcagcatatcgtaattaaggccaatatcaatggtaaggatattaccagatcgtatacgcccac

SEQ ID NO: 10875 - DNA, 436 bp, Saccharomyces cerevisiae
gagtagttaagttgagaaggtttgttgtattatatgtaaaatcaaaatataatgtagtggggggagagtatataatgttaattcaaggatagaagattaatgatagcatttttttataattgttttgattttgagaacagaaatttataaaggtaagatataaaagtgaaaatttgaagtctagtcgaggtggattaatgtaaaacgctcgctatatattttattggaattgacgttagctattatcaatcagttttttcatcttgtttgattctcttataggtgaagaagacatcgcttttaacaatcgaattggccgtcaattctttcaaaaaaacggtaggggtcttgtcgaaaatgatctgtttgagtagagacaaaacattcactctctcttggaaaacaaagttcttaatgtaggttgggtcaaatccag

SEQ ID NO: 10876 - DNA, 419 bp, Saccharomyces cerevisiae
ctcgaccgactggttgtaattttacaaaaagagagacaattaagaaaagaaacaagcgccaggcttccgtatcccagtttttcatctcactttctgggcacgattgtaataatacttcatgataataactaaactatataagtagtgtctcatccgtaaatatacatttagacagattcttgtattttctccgggcaatttttaactttttttctgttagggcacatgacacttgcctattatggacagccagtaaagatgtgccatatattgccccctttacgctctctgccagtattagtgggaaaaaaaaaactgaaaaaaaaaaaatcgcagactactaataatcacgtgatatttcttttcactctcttcataaagttgctaaaaacacacaatcgaatgagcctctgagcagt

SEQ ID NO: 10877 - DNA, 425 bp, Saccharomyces cerevisiae
tttttcaactggttaaaacctactatctaagtgcgctttaattctaaggaggcaaaatagtctgcggtcacagtcgttgaaagttctagatttgggtacggaagcagccatgtaaatggtcttcctttgtaataatatcatcactggagtttttaaattagagtacggattcaagttagcgaaaaatttctgttggtatctgatagcaatttgtcgacaaggtggagagtttttgaagtttttttttgtaacagttatgttacactatttaccagagaaacaccaagacaggagccctcagaagctttcgtgttgtcagaacataaatatcttctatatgttttaatcttttatattaatcaatattttatgttaaatcatattattattcgttaatggttaacttgcgctatttcaaaattgga

SEQ ID NO: 10878 - DNA, 498 bp, Saccharomyces cerevisiae
agctaattctaagaaaacggtaacaacaagcaaatatttgggattcgtattcaactgcccggtttttcttctacaaatatgagtgtattatagcgggtttaggagaaatatgtacaattataaacatataaagggtatttaatttaattttaattgggtttaaacagtttgattatttctgctacttaccgaacttgcatggaatagggatcgcttgtctgtaacttacacgcgcctcgtattttttaatgatggaataatttgggaatttactctgtgtttatttatttttatgttttgtatttggattttagaaagtaaataaagaaggtagaagagttacggaatgaagaaaaaaaaataaacaaaggtttaaaaaatttcaacaaaaagcgtactttacatatatatttattagacaagaaaagcagattaaatagatatacattcgattaatgataagtaaaatgaaaaatcacaggattttcgtgtgtggtc

SEQ ID NO: 10879 - DNA, 461 bp, Saccharomyces cerevisiae
aaaaactgcatttatttatatacgaaaatcatgatttcagaaaaaaaaatataacttgtataatactatatttcagagaatactattttgaataagaatagaagcaatttcgattaacttttcttactgtatatgggtcgctttcacttttgaactactgaaaattagtgttacccgtattattgttttggagaataataataataatgagcatcaatttatatcaaacaagagctgcaattaccttatgtccatgacgcactgcgaacaaagaataattgagtaatcgaacttgaagttctatagaacagcttgtatatggtttcattgttcaaaagaggtaaggctccaccgctcacgaaagaaggccccacttctaaaaagcctcctaacacagcgtttagacaacaaaggcttaaggcatggcaaccaatactgtctcctcaaagtgtgcttccgtt

SEQ ID NO: 10880 - DNA, 462 bp, Saccharomyces cerevisiae
agagaacgtagacagtattctcaaactatatggaacgagtcaaacatcaagttcccttggcgaaaattatccacaaacaactaagggcacagaccaatctgtgtatgacatcacaagtctttttaatgatctaccaaggaccttagatcccaatcaagataaactggcggtaacaaatcaagatgaaccaccgcctgaaatcaaatctccattgaagcaagcaggtttggtgagtttcttcgctccaaagttgaatggtaaacaaatattttctagaaggcatgttgaaaatcaaaaatccttatctttggatgaaatcaatataaccgacttacctgcaaagcaagaaaatgtggaaatgcctactgaaaaaaaaaggcaaatattttatattatgagggaatctcaagccattcacaagataactacgaccctccttggttatttggcgttgaggctacc

SEQ ID NO: 10881 - DNA, 427 bp, Saccharomyces cerevisiae
ataatttattagtcgattctttcacgaatgaaagcaaaatttaatgtcactgctttggagtgagagcgattcagagaagttattaatgtctaatatgtccaacttggtgacagtttcgccttgcctaattagcggggatcaggtgccggtagtatatctcagatgaccgtgacaatcaaactttctacttcattcaagtgactgtcaattgtcatgctgttcatgaataaataagatacggagacaattaaggcgatcgctttgactctactgctaacgaaaattgtccgaattgaacagatgtggaagcaatcactatacgttacttcataatgaagatatttgttggctttccgagatatagactgatctttgtcacttcatatccggcacggcaatttttacatgggatggctcgtcataaaga

SEQ ID NO: 10882 - DNA, 437 bp, Saccharomyces cerevisiae
aataggcatgttgcaataaaacgaaaacaactaaaaatcacgaaaacaaaatgatattatacaataaaaaattcttattatgggtaatgatagtattcttcgcctgcttaggcgtccttttccttcaacaacaaaaattccaaaaaaaaaaagtaaaaaaacaaaactttgattgttttttaatgatgttaatgattttttttttctttctttatcataaaaaaaaagttaaaatgaaaaacaaatatgggtctggaaggccattattttttttttatttatataccgtttctggtacttagttatttattctcatacatacactatattcaaattacctaagagcattttcacatatccgtttactttcattttttttttttttgcttcctttttacatatcttccgtatatcacatcacgtttacgcgtatggtg

SEQ ID NO: 10883 - DNA, 464 bp, Saccharomyces cerevisiae
ggttgacacatattctttttacacaaattttttgcattatttaaactttaaaattatttttcaatcattgtcagcatttggcagatcatttacgtaattatttaatattctcaacacgaaattatgggtaacaacgcttctgactgtgcaaaagaacattctaaaaacatacctacggcaaaaactgctaattactcaaattaatcaagtttttataacgacataagcgagtgctgaaagaaggaatatttagagtccgattaccgttttattaataaacgacatacttatatatttgctgggcgttccacccgaggcacgtgatcaaaagtgattttggttttttcaaaggctaagcttcgatctcactggaaaaggaacaatagcaatacctaatataaaactcaagcctcccaattatgtttataacggtgaaataaaaagccgacagagcagctttttct

SEQ ID NO: 10884 - DNA, 485 bp, Saccharomyces cerevisiae
taagaaaaagaaaagcagaaatcatgctctttctatatttgcatttttttatttcattgttattactcaccctgccccacgctcaaagggctcgataacgacatagcattatagacactgtgcagcgtaaagctgacatataaagaaattacaaaaaaaaattaaaaaaaaaaaaaaaaacaatcaaaaaagacacacaactacagaacaaaggaaatctttttctatgcacaagcacaagagtacttagagagtagtgatatccccttttttttctactatttttttttttcccatttttttcctccaagactcctcttatgtggttgttatgtatagcccatagttactaaataaaacactaattaatgattaataatccctctctaataagaaatagataaaagctattgttcttctcatcgccggttctcggcgttgtccgtacccttggccgaaactcgggcgggggcttattagtcata

SEQ ID NO: 10885 - DNA, 449 bp, Saccharomyces cerevisiae
tagttggatgcggggctagcggggatactgttatcgaatgccttttcctttactgaaactgctcaatggatcataaaagtattttcaagcgttgaacttttgatgagttcagtagagagaataaaagaatatacagatataccttccgaatcaaacggctacatatcacctccagctaattggcctcaaacaggagatgttgaactaaaaaacttatcattgcgctattctcctcattcctctaaggcactagataatgtatcattcaaggtaaaagcaggaacaaaagttggtattgttggtagaacaggggctgggaaatcttctattatagcggctatttaccggctttcagactgggaaaacggtacgattactattgataacaaagacataaaacatatccctttagagcgtttaagaaattctataagctgcatcccacagga

SEQ ID NO: 10886 - DNA, 438 bp, Saccharomyces cerevisiae
tataaacaacctacatttgtgtttgaaagacagtaatcaacgcttcgatggtcactgggatttttctttcaatttagcgtcactttcaccttattcacagcttttacgtgctatttttggtcacccttcccctttcgttgcgcctcaacgggctaaaaaaaaaaaaataaaatcaagcatagaaacaccacaacaaacctgccctttttccttgtttcaggttacgtgaaaagcatccagagaagatatcccaaagactgaagaggtgtagttggctcattcacgtcgttcgtttatattatcaaggaaggggtttttgatcggctcgaacaagactcgcaagaatccgttttctattgttttttttgaggattccaatatgtcaaattccaattcaaaaaaacctgttgcgaattacgcataccgtcaacagcaaga

SEQ ID NO: 10887 - DNA, 452 bp, Saccharomyces cerevisiae
ctatagctaaataatcatttcattgggaaatgactatcacgatttaacgaatacccccttttctctttcttgccatttaatggtcgtcgctctgatatttgcacacatacgctcacgtacataggtacacgcagatgggacaggcgcataagtacgcgctaatacatgtattgatataagttatgtttttatttatcaaaatgatattgttgcatttttttttttaaatctcacgttatttttcatttatatacatacacttaagagaatgtcagattttctcttttcggccaccattatggtatctaagcggctatttaacttacttgttcctataccgaaactatctctttcgcttactgtccaccaacctagttagctcttcaaggacaatgtttccccttctgtcttcaaattttttcttaagctcatcgatcaacagcgagatctca

SEQ ID NO: 10888 - DNA, 475 bp, Saccharomyces cerevisiae
agagattcctaaatagaaaatcaagtgtacatgtatcataaatcatatctgatgggtaagcgcggttatttttcctttgcaagacgagaattggaatatgtacgggtgtcaatttcaaacgtgaggtatgggttccaagaaaatcaaaataagcacagctgggaagggttaggtaggagcggagaaaagtgtattgagaaaatcttaacgagttcggacaggttatcatcgcaacacaaatgaacataactatcaacctgatgcaactgtacctgagtggctcaaatagcaggtaaatacaggtggatttagaaaacgcgcagtgatttgaatctcgcaagtcgcctctgaaaaaaggcatttcgcaaactggggtgtctggaaagttcattacatcccgttcacatagctccttcctggtacttgagtaagtcttttaaaacaattcaacatctactttgtatcaggcgcttgg

SEQ ID NO: 10889 - DNA, 400 bp, Saccharomyces cerevisiae
taacatctcatgtgcccgcggtattaacagaccagtctttgtctgagattgatatagccaacgattatcaatatctgagcggcagacagtttagttcaacgaattcatcgcttgatggccatattaattcacctctgtcttcatgcagcagcagtatcaatgcatgtgcaggcagtggcaacaaaaaaataaaatgttgtaggaataaagatgccatgaaaccagtaacatgttgcaaccaaaagaataacataatgccatccttagtccccgtttgctgttcagaaaagaaaatagaatccgatgctaagaaatcaatatcgaaatgctgtggagacaaagaaatctacgatagcgagaatagaccgatcactaaagaggatgggtcatggatacctgg

SEQ ID NO: 10890 - DNA, 407 bp, Saccharomyces cerevisiae
aaaatgtattacccccatatctttggtacttaagtaaaataagtgaacacaatgtaataaacagaatggattagggctttatgacttcccagtacaaaataaatgtcgatataatacttgaaaatgcaagcaatgccatcaaaaaatttgagcggtacgagaatcgaacccgtgtccccaccttggaagggtgggatgataaccactacactaaccgcccatgtgttggatggtgtaactgtaatgacgaggtaataagtgatggcgactatatcaccaccgaaacacagcgattacttaaaagggtaatcactactgcgattctaattgttggaataaaccaaacctcttccgataatgttggaacgagagtaattaatagtgacatgtgttgctatggtaacaat

SEQ ID NO: 10891 - DNA, 469 bp, Saccharomyces cerevisiae
aagaaactagatcaagatcatacaacgctgcgcagtagtgaaacttgattaaagcaatagagaactattaagaaaaaaacaaacacatcatcgaaggacgctataagcatgaggaattttttcacgttattttttgcagctatattttcgctaggagcacttatattagccattgttgcatgcgcaggatcaacgaaaaattacagtcccataaataaaatttactgtgcagaattggatctgtcgcagatgaaggtatcgacggtgctcccttctttgagttctgctacgctatcttcgttgggcctgccctcatatataaatatagggctttggtcgtactgtacagtggactcctcgcataacatccaatcatgttcttcgcctcacggtatccagaattttaacctatcgtcattagtgtatgacaatatcaacaacaatgaggctctggagcttatggattccg

SEQ ID NO: 10892 - DNA, 408 bp, Saccharomyces cerevisiae
ttaacaacgcaagtagcaccttatcatgataatgtcaaagccaaaaaaaaaaaaaaataatttacttataatctgcataggcctcatcatatttgttgcatacatatagacatatgcttctgcataatctcaaattgtaacctttattttgtaaaaataacattacgcatgcttgattagttaaaaaaagtcttgtttaccataggtcttcagtctcgcactcctaatttaagcgagtacgagcagcctggcctaactcatttctgttttcaaaaaatccttctcactgcaacgaaatagcatttcgtaaaaaaaaaaaagaaggtttggttctcaagagagctcacgcaaaattttttcttacgttcccgtagaactgatacttggacaacgccacttatctgagca

SEQ ID NO: 10893 - DNA, 436 bp, Saccharomyces cerevisiae
tattccatttgtttcttatctccttctatgtatttactcactgttcaccattcttccccccttaaaagtaagctttatttaagaccatccttgtaaatataataatgtagcatttttcttcaatatgaaggtactaaactccatttggcattcggcctgacctatgttaattgacaaagaatgacacattccgctcattggaaatctcggatacgaaaatgccaaaacaaaatataacaaaaagtatctatcattagtaaaaaatactataatggtccttatccacagagcttgaatttagatcacctaaaggaatgctagcaaaggaactaggaagtggtaagcatatgaacacacgaatataaaagatatggcgcgtcaaaagcttactttcaaagaacaaatggatggtttcccctgggtccaacttgttgtt

SEQ ID NO: 10894 - DNA, 457 bp, Saccharomyces cerevisiae
tgacatagttcataataattgccagtaaacgttatagctagtggcgaatgtcgaagtggaaatgctatcacattaatgttgcagatgaatatatattttcttatttgagaagatacacgctatttactctttcagccattactgctaccattgtggttgttatcttgacgatgaacgatgttggattgcttgacttttttcagtaattcattgataccctcaccacccgcagttagtaatttagtcctgtttctcctacatgtcagtgtatcataatgtcttttcaatgcatctttccttgcaaaacctttgccacattgaggacaaatgttaggcaatatggcgaagtgtgtcttttcgtgccttctcaaatctgatgatcttgaaaattccaacgaacatttcgcacatttaaatcttttttcaccagtactatttctacgatcttggggtttgc

SEQ ID NO: 10895 - DNA, 425 bp, Saccharomyces cerevisiae
tatgtggtaggcgaaaggctgacccggccgctcgcacggaaatatttggcaaatgagtcttgaccatagaaaaatgtatataaccagggaagaagtcatgcttcggaaggaccagaagagaagagatgagcaaaggagacagaacaagagtagcagaaagtcatgggccgtacaacttctgagggaatacacggttttgtggacgatctagagcccaagagcagcattcttgataaagtcggagactttatcaccgtaaacacgaaacggcatgatgggcgcgaggacttcaacgagcaaaacgacgagctgaacagtcaagagaaccacaacagcagtgagaatgggaacgagaatgaaaatgaacaagacagtctcgcgttggacgacctagaccgcgcctttgagctggtggaaggtatgga

SEQ ID NO: 10896 - DNA, 438 bp, Saccharomyces cerevisiae
tgaatgtagcaaaaacctggcttttgcggctggggaggatggaaggcttttgtaggctattatctactcgaggaaggaacgttagaatatctccatttttcacgcaaaatgtggttctgagttaatgcgtgtgctgaagcataacatgagttattccctgtatgtatgtacagtatttcaatttcgcagaccgtgggttacatatgtgagcgattaggaagtagtgaagtaattatggcaagtctagaggtccggctgatcccttgcggtgctgaagtaacgaaaccgcgcgcatatcttttggaagagattaatttgcactgaattttcaaacttaattagcgagaagaagtagatgcatttcaattatgccaaaagcagtatttattacttcttatagaatatagtatcacttacgctcatttagtgtacccactt

SEQ ID NO: 10897 - DNA, 443 bp, Saccharomyces cerevisiae
gaagacaaaaccaggtggtagatcgcaaaagttgctagctgtcaggatggaatagcacggggctatttcctgctggtcgttggttctcgtgtaattaatgaatgtaacgatatagataatattttattgttagtgtgtaatgtattcaatgtaatgtatgggtgctttgtaaagggtgtatgatgtttgccaccggaaggaaataagtcagacgaagtcttttagccatgcttttgcattggtattgcagcaacgacaagctgatacggttactaggacacctaaaacctgataatacagtgtgcatttgcagctgtttcaaagtttagttgttttttcttttggttttcgaggtgcttgaacgaaaagatttgcaaatagagcatgctaagaacaagaaccacaaagacccttagcacagtggcgaggaccacaagagctat

SEQ ID NO: 10898 - DNA, 451 bp, Saccharomyces cerevisiae
gactgtaactaaaattcaatgggacattgatccacaactagatggatgatttgcctttttgaagttatttaacccattacaggatgaaaaaaaaaagacattgcacttgcatcactgtaggagcgactataaaactcaccttcattgttgctttatttttccaagtaaggaaaaatatctgtttactttcatttacctctttggttttgttaggcgggcaagagagacccggtcgtttcagaatgcaactttcttttgtttgcatatctttttttttcagcgatgcaattttcaacatgcagccatttcaccgaaaatacctaaaaaggaaataggcaataaaatgacatcgtaaaggtttcaaatgcgaaggtaccttggttcacagtatataatatattcaaattattaaaagaaaataaaactatcctttttgttcactctgtcttga

SEQ ID NO: 10899 - DNA, 484 bp, Saccharomyces cerevisiae
tctttgcctttttaatctctagttgtctaaaagttcaaagcacctcactgtatgtttattacctttgttccaattacttttgtttcaattacttttgtttcatttcattttaggtatcccaacgggtaatcattgttatttattttattcacttttttttcttttcctcctgatccttgtgattataactatatttttaccaactccggtagttgttttattaagttttcatcacactaaattgtattttccactttcatttccaccttcctttcccctacctcccttcaattcgtatcataataccgcccgttctttctagtatatcacagaatagctacggggtattgtctcataaacagaaaaatgcacctttcgataaacttcctgtacaataattctataagtatatatgtatgtttgctattaaacaaccatcacaaaaagacaccttattctttatggacgccttcaagttgtgctc

SEQ ID NO: 10900 - DNA, 412 bp, Saccharomyces cerevisiae
caataaggggatatagccattgtaaaatatttgtatcactatatgcattgagtgtaaactgttgcacctataaagaatgaaaacaatctagtatgtgtacttacataattacacagtcttttttttttttaccttgtttatccttcttgttcttcaagcttgtaggtttttttgactcagtttttactgcaggaaaatctttacgaatcatgtttgaactgcccatatttgataaactaacttcttgctttgctgccatcgactgctcagcaacttcccttgacattccctttgctgaggaagaacttttcctgatgcttgtatcagaacccgttttaataccatttctattcgtgtttgaattcatgttaatttgcaaaccttgtggctcacgatcacgttttggatttcc

SEQ ID NO: 10901 - DNA, 464 bp, Saccharomyces cerevisiae
caaacataatgtaggaattgcatgtgcatacatacatatatagagaataatacagcattacattaacactatatatagaattgtgaaccttccaatactgaaaacgcatctgtttggaaaagagatcagaaaagtttttgaatttaaagaggccagtaatgataaaaaagcatatctatatatgctttttttctttttctttttttttttcaattggggattaaatgtatgaaccgactctagaaggtggcattttgttaaatgtttctagctatagatcaataaatctgaaatacgatatctgacatgattgcagtggcacagtcttccgatagttacagccaagttttttttttaaggtttctgaattttttcattacgtttcctaattaggttaaacgtaaataaaagcgacttttcaaaagaatatcaaatcatataacatgaaaagagcaagattcaca

SEQ ID NO: 10902 - DNA, 457 bp, Saccharomyces cerevisiae
aaagcttgagttattatttattttatgatcgtatattatttatttatttatttatttatttatttatttatttatttatttatttattttatttagtttattaattttgctgatgaatgttatttcaattaaacatagttttcaaagaactgaaaaaccctgatttcttcttcttcttcttcttcttctctttaccattgtcatctttcaaattaaacttatcttcatcatcatcgtttaagttatggttgatagtgttcctgcttgactttggagaaattatgtttccagcgccacctcttccaatagcaaatttttccggtgcgcttttgcccttgagcttatttttaggcttcttggacgtggacttgattgccgccaaagcattgccattggaagtcaccacaaacaggttgtcctcgtttgcattgatagtatcctcatcctcgatattgcc

SEQ ID NO: 10903 - DNA, 401 bp, Saccharomyces cerevisiae
taatatgccgtttatgatattttcttccttgctattaccctgccttttgctttttttttttcacttcaattgcagggattatggaataaaaaaaaagttgaaagtagtataaacacaagatcaaaaagtggcaaagaggacccgctctgtttattgctactcaattgtagaagagaaaatagtaggatgtccgatttggaaaccgtagctaaatttctggccgaatcagttattgcttctaccgctaaaacttcggaaagaaatttgaggcagttggagacgcaagatggattcggtttaactttattgcacgttattgcttccacaaacctgccgttatccaccagattagcaggtgctttgttcttcaaaaatttcatcaagcgcaagtgggtagatga

SEQ ID NO: 10904 - DNA, 465 bp, Saccharomyces cerevisiae
ccttcatgcactatacacgaaagaacaaaagtgtcttgattattacatctacatttccaggcatagagcttgcagattagccgcccataaatttgccacactgttttccgtggcgccacagtccgcgtttggttatccggctgactcattctgactcttttttggaaagtgtggcatgtgcttcacacaatataattcccgtgagcacagcatgcttcgggccgaagtctgttggaggcatatgctcctaccttggaagactcatcgcatctcaaaagtgtgtaaaggggccttctggccatatatcctctgagacctggttgaaatgtggccagaagcaaagctgataaaaacaactggcgcatacgtagctatattttaaataaataaataaataaatatatatatatatatatatatatatatacatatatatacagtcattgccacacatcccatagctct

SEQ ID NO: 10905 - DNA, 437 bp, Saccharomyces cerevisiae
aaaaagaaaacaacaaacgaataaaatctaaaaattctacatattcttgctatttatttacatattcattcttgctacatacctgtcttatgctataatgacactggaggtcttctttcttctttgaatttatgtcctgacaattcagtaaacgccgtgcggaagggaaccgtttacgtacgccaagctaaacattgaaaaaaaaaaaaaaaaaaatgataataatagtaataatagtaacgacgtaaaggtaaaagaaacaacagacttttaaacttgttaacttttgcatgacctcaattgaagatctgatatcaaatcctcccctgctactgcattcctcactctctcaacttcgctacctcatactcagtgaagggcttcccatatctgaagataaacagcagcagcgcacgcgatgttacgtgtggacggtg

SEQ ID NO: 10906 - DNA, 434 bp, Saccharomyces cerevisiae
ctgcaaccatatttcatatcctttgaaatctcgcggatgaatcgttaaaggaaagggcatacactttcaaatgaaacacaatcacactcaggaaataaacaaaaaactttggtattacagccaaaacgttttaaagttaacacctctcaaaaactttgtatagatctggaaggttggctatttccacgacatccttgagaatgtgtctaggggccaggaaccttcgtttgatacaagggaagagaacgtgttctagtaatgaggatatgtgttcctttctatttataaactgggctttttcgtcttctgacaacgatgcatcagatgtatcgactttcggaaccatatcaggtatatagagtaatgcaatctctcttaaaataccatctagacactcttgttcatcctcccaatcaacttctttacccaggcga

SEQ ID NO: 10907 - DNA, 458 bp, Saccharomyces cerevisiae
ttaatttgggctaacggataaattgtgtagacttaccttcctcagcgcacacatcaatatattatatattctttacgtatacaaacacgcaaattcttataggtatagcgatattagtttgatcaattcccatcacgtaccttgctttctattatttactctttctcctgtacctgctactatcaattaaaaaaaattctccgcgacggggaattgaaccccgatctggcacgcgacaagcgcccattctgaccattaaactatcacggaagaaacaaagcactcacgatgggggtcgaacccataatcttctgattagaagtcagacgcgttgccattacgccacgcgagctactatttgtcggaaaaacattctgattcatctagctaaatgattgtttaaaatatgctaaatttctcaccaaccttttctcataatgagcctaatatgaaccgct

SEQ ID NO: 10908 - DNA, 494 bp, Saccharomyces cerevisiae
aaacaataacacttttgagggatttatatattattacgaaacttcttgtagataaaggaacatatatatgtacattagaatagagagcatgcagtaatatcgttagtggaaccgtttctgcactttcacttgcaaaaattggtatgtgtcttcttaggtactatgaaaaataacggtattgttcgccactgatcagacggatgcgttacgtgcactagagcgttttaaattcaatgctattatttttgattgttaccttggcacttggccattcacaaaccaacctttgatttctcggattccctgtataatatttcttgatttatttgagaaagctcgggacctatctgttaactcaacctggtcagtcaccatcttaatttgaaagacaaaatcgtctatactttcagatggttggcctgaggatctgttaaaatactgtaattcttgtttcatattttgcagttgataaatcatttcagcccaatggctat

SEQ ID NO: 10909 - DNA, 439 bp, Saccharomyces cerevisiae
actcgctgaaacgacaaaaaaaaaatgcatttaacaacaaataaattaaaatttgcaaagcaaatacgttaacatacattaatgatctttttttctttttgttttcacaggactcattatttctttaaatatacttatattacatttgcatagaattacaaaaaaaaaaaaattataaaaacgcacaacctaaaatacgattactatcgttttttctccttacttcctctagtcacattatacattttttttcatccttcacagacgtatcttaatactaagtgtggatcaatataatgggtatagcttgaacatctgcccctctctatctaatgtttttttcttgaattatttagtatttgctgtatactagttttatttatcaatacagacgaatgttcaagaatttctcattgttttccgccaacatttctttagc

SEQ ID NO: 10910 - DNA, 457 bp, Saccharomyces cerevisiae
tctcgttcctaattatattcaaaagtccttgataccatatttctggtttatgttttatagttttttaactacgtgatatttgcatatagtatagatttcctacgccccatatttatgaatcttgcattcgaattttgcttcaaaaaactttgtttaaattgtattttgagagtttgttaagatatacatgtactttctgtttttggtgcattatcattgaccttttttttttttatttcctaactgctgcccaaaagaagaaataaacaggcgggaatttgggtagtatctttaaacttctttgatagcatgatattacaatcagcaagtgctcttgaattgattattgtactagctaagttctgtttaagatatctatgtttttaatcgtggtacttttggttctattatctcttttataaacaccaactaactgttgtgctaattcgaacatgtt

SEQ ID NO: 10911 - DNA, 473 bp, Saccharomyces cerevisiae
tagcaaccaaatcaagtagcaaagagccaaaaaatgtgttaatgtatgctatccccctttttgcttttgcgctcctcacacctcttttctttgctttgaaatttttctcaaataaaatctttacaatcatcgctactagttaattcatccaatttagtgaggaataacggatcaaattccactaaattttctaatcgagatatgctattcgaataatcctccgatacagggtctttcggatattccctggggaaatactctgtgtcactttcttttgaaggaaggatcatcgagggtgaagaatcgcttccacttgactgttgtaacaaatctttttctaccttaaccattttatttacatcaaatcgacgactatggtatgattttttctgtttttgggctaggtcatttaaatcatcaagtgatatggtcttctgcttgaaatctttgttgcacaagcatttcgcaatttc

SEQ ID NO: 10912 - DNA, 441 bp, Saccharomyces cerevisiae
tttttccccttttcgaggtcaactttttttgacaacttataaaaggcaaggccaaaatgcattggtggtggtgctgttgctgctgctgccacttttgttgctgcaaaagacaagtccaatggtaataatagaaaaataataataatggtgatatcgtccaactcccactctgcatatatagccaatcctccggcaaaaaattacagtagcatttatttcattttattagaataagcatccaagttacaataattgaaaaaaaagcattgcttgtagatgttgttttattttgtatataaccgaaagcgcagtaactatgtatatacgtacatttaacgactcatttaacaagccattgatgacctactttgaacatctcttcttaaatcattcattgatctactatatcgatggcccatcgtgtagtcgtgaacaaccgga

SEQ ID NO: 10913 - DNA, 445 bp, Saccharomyces cerevisiae
tagcacgtgatcgggaagccacagtttgcgcggagatattttattttttttcatcagcgtaagaagaaagcaaccttgcagtctgtatcgtaagagaagactgcagttaaagaagtttagagaagaggcttgagtatcggtaaaggggtgtgtgtttggtgatttataaaggagaagggcatgaggagagagaggcaaaggatgatgagtttcgaggacaaggacaaggacgaccttgacaatagtaatagtaataacagcagtgaaatgacagatacggcgatgatgccaccattaaagagattgcttattacgggcagtagcgatgatttggcacaaggatcatcgggtaagaagaagatgacgatggcgacgaggtcgccatcgtcatcacccgatttggcgacaaacgacagcggcactagggtacagccattgccagaat

SEQ ID NO: 10914 - DNA, 412 bp, Saccharomyces cerevisiae
atgaagttcaaagcataactgcacaaatgaatgtaggtgtaaaccaaagtgaaggagtatacaatgtgaatataaatggctggaacatttgatctattattaatagcttcttctaaaaaagaaaaatagaatttaatatatttgcagttttgttttcttgtcttttattttagaccattgtgaaagtaaggacaaggatatgagacgtatcataactataaacaaggaattccccctcaacttggtgcccacgtatatacataattatttatattaaaacaaaaacaaaaaagtctgggagcgtatgctggagggagaagtcgttacacaaattaataaaaaaaaagcataggaaagataaaaacaatgattatttattcaaccataaaaaagccaagggaagattttcaca

SEQ ID NO: 10915 - DNA, 428 bp, Saccharomyces cerevisiae
tggcatcattgctattacagaaatagccctagcctgtcatatttaactgagctgttgagtatgggcatctttccgcatgcgctaactacggagctggctcttccccttctattaatccttctggcaggaagcgaaagcgactgatgtcgtttctacgtttctatgtatattctatcgcgtttaagtgtgtatattttgagctgctcaagtgaagggaacgtattcagaataactagattctctgccatacgatcaactaactgtttaccatatacagtctcagttcgctacggttagcgtaccgtaaaacagcagtttacattcactatataaaggatgacgtaagaatttgcctacgtattaaagaaaacttcacaatcaaactgctaaaatatacaaataattccgttcatttcaggccatgatga

SEQ ID NO: 10916 - DNA, 480 bp, Saccharomyces cerevisiae
tttttctttctttttctttccttcttactgtacaaatattttacgcagaaatcaaagacaaaagaaaaataaaaaataaaaaataaaaaattcaactaagcaatgacgtcctactaaagtcccaaaatttgagccggaaaaaaatggtaaagcaaactattgccatctttatattttgtattctgtttccgaacacgtatccaaaatcctcccactgcctttgcagggttagcattgctccctaccaaaatgatctaatttttttttgaatcgttttttgtcaacgattatttttgttttaaattcctcatcttctgaacttacgcccaactattatttaattcattcattcattaagcaatccatacgtccattcattcattcagttttctttttgtctattactgtcattttattttcaaatccaattgtcctttaggacactaatgtgttaaaatatccattcgctcaagcattttt

SEQ ID NO: 10917 - DNA, 485 bp, Saccharomyces cerevisiae
gacccatacatctattatgaccctagtgttgttttagggcctatgcgccctttttttcttccattgtctgataaataatgtatcattttgacaacttaaaggttcagctaaacgacacgagaagatatattaatactgctttaaagtgaaaggcgtcagtcaggtgcaattaataggtcacatattctttgcttcaattgctctctagcaaactcacacactcgtagattggaagaccgaagaaaatagatagactttcgaataagttcagcaacaacatgtggttgaaatccttgctgctctgcctgtactccttagtactctgccaagtccacgctgcaccttcatcagggaagcagattacctccaaggatgttgatcttcagaaaaaatatgagcccagtccccccgccacacatcgtggaataatcactatcgaatactttgatcccgtttcgaagtcgatgaaagaggcggatctgact

SEQ ID NO: 10918 - DNA, 475 bp, Saccharomyces cerevisiae
ttaaacagcaatttgaatgctataactcggtggtgatgacctcagtgcgagataattacacaatattgtcactaccaacgaatgggctaccttttttttcctttctcgaattcaagaaaaaattaacaacttttccctcgatgatgttaacaaatgtctgaatataaaggaataggaaacggttgctagattgtatttaccttaccaactttcaagttttttttctaacttcctaactttcagtctcgatacattaatcaacaggacgtagtgattgcaaaattgttcagaatatacattagattaaaagacaaatggccaaagacattgagatatccgcatccgagtcaaaatttatcttagaagcactgagacagaattataggttggacggccgctcctttgatcaatttcgtgacgtggaaataacgtttggtaaagaatttggtgatgttagcgtaaaaatgggcaacac

SEQ ID NO: 10919 - DNA, 499 bp, Saccharomyces cerevisiae
ctggcattatttgcagaagttctcttcctgtgttaataatgaatgacgatgagttaacaatgacccttatgtatacaacgaaaggacgaatgaaagaaatgaaaatattatctttttttttttttttctcaattttccttcacttttagaagtttttccgttccgcggattttgttcgtcggaccttttgctttatttgtctccagatctctcgagcataatggtcgtttttcatttcatgcttatagtctttgtctttccagcggtacccccaccccctatcttgggctattttctaatttcgtccctcggattatttaattcatattctccccacctttgtattactaaatttattttccaatgctcttttcactcattcttccttttgcatatttctatcagtatatatagcgaattgtatatataagcgtcttgttaccggtataggaattacctgatagaaagaaatagaacataataggaggaagggcaaaca

SEQ ID NO: 10920 - DNA, 449 bp, Saccharomyces cerevisiae
tggtatgactgactacctttacttacaacatcctgcactttttctgtatacgataaacggacttaaaagaaagaaaagcctacaattacattgttggagaagccacatagcaatttcgaaaaaaaccagaaattgtaaaccacgaattctcctgtattatttcattgttaaaattttttttttacttatattatacccatctttttcgatattcctgctggcattgttttggctacattttcaagaaactttggatccaaagacaaaaggaacaaacgaaatctaaaagcaaaaaaaaagttgactgattataaaaactacattacgacgaaaagaaaataataaaactgtgtacttttagttttgcatttatgtattgactgttatttaacttattatgacctcatgaaagaacaaaacttagcgtgtattgtcctgctcagtgcctt

SEQ ID NO: 10921 - DNA, 444 bp, Saccharomyces cerevisiae
caatcgaaatgggcttcatgccctaattaaggaaaaaaagaaaagaaaaaaaaattgggaagaatggggataaaaaagatttgtaacattataaacaaaaataagaaataattgtttttacgtacttattgtaaataaaacaaagggataacggacaaaaaggcatcgtttcttttgtactatgatttacgcaaatggtaattaattagaggtatgcatatagtttttataattgattcaatgaattttttgttatcgtttttaatttcgagtaatttcaggtaaccaataaaggataagatcactttccaatcgttcaagttctgaaaatcattagagctggaagttaatcccatttccttcggcaaattggcaggtattcgcaaatgagctaattggttaattttcaacgaattcttgataagccagcttatcgagtccatg

SEQ ID NO: 10922 - DNA, 462 bp, Saccharomyces cerevisiae
actgcgagaacccagtgctaataaaatgaagaaaaagtactagattacatttttaagtgttgcactatattctaagggcctccatcgacgtagtgtgctggttccaccttctcctcattatcatgccaatatttacgaacctgtatataataattaaatcataagaaacaacaaaaataaataacattgctgccggattcccgtaggcaaaactaacatatatatcgctgcatgccttcctattccttatcaggggaaagactgccactgaggtttgaggccaaaggctgaaacacttttcttctaaaatgtcgtctattcgccatctagttttttatctgactatttctcgctgtttactttttcttactgccattatgtaggccttttgagtcagctttgtgaagagatcttattaccttaattcttgctgaaaaatacatcgcaatgaagtcactttcg

SEQ ID NO: 10923 - DNA, 477 bp, Saccharomyces cerevisiae
catatgtataaaacccaatatcatggacatagaattgcctatctcgcgagccacggcagaaagttctgaaaaaaaaaaaaaagaggacgctcacaggggctggcgtgtggctaaggcagactccgtggagtgtaagagaagttcaaagcaagattaggctttctgatgaattggtagcgcagagtctggcaaagtctatttcaagttcacagcgtccgtttaccacaattgtttgagaactcttctccttcctgtgcctatagccacacttgcaaacattacatggtgaaggcgctttagagacttttctgttttactatatatataagataacatagcgcgcgtgcaaaccaaaggacaagtaacaatctgcacctgctttagcgtagtatgcctttattacaaccatccacttgcttctgctaccctttgaagcttccgccattaccactgacttccgattccaacgagtttgat

SEQ ID NO: 10924 - DNA, 474 bp, Saccharomyces cerevisiae
cccctcataaacgaagacaaaagtgctcctcctcaagtcaaatttgtctttcttttctttcattttttagtctgttgttatccaatttatactgaatctttgagagaaaacaaaaataaaaaaaagaatggttttgccaagactatatactgctacatcccgtgctgcttttaaagcagccaaacaatccgctccgcttctatccacttcgtggaaaagatgtatggcctcagctgctcaatctactccaatcaccggtaaagttaccgctgtcattggtgccattgttgacgttcattttgaacaatcagagttgcccgctattttgaacgctttagaaattaaaacacctcaaggtaagttggttttggaagttgctcaacatttgggtgaaaacactgtcagaaccattgctatggatggtaccgaaggtttggtccgtggtgaaaaggttcttgacactggtggccctat

SEQ ID NO: 10925 - DNA, 455 bp, Saccharomyces cerevisiae
acgccagcgatcatcattctttattcattacttcaaatacattttttttggtatggttgaaagggcttttttcctcgttggcatatgggaaaaactgaaaaataaaaaaaggcaatgagatgaacaacaatggaaaacaaaaaagggcgaataaataagcagcagttggtaaagcagaaaggggaagttaacggacgttaaacaaatgacacctaacttaccagggttttattatgatagagaacgtcgacgttattttcgcatatctgaaaatcaaagcatttctaccacgggaacgacgaaccagtacagaaaagataatataaagcgacaatgtgttgaggaaaattacgataaaaaattttctatgattaaaaaaaaacgtcagcaaacattacaaaagtacaagcttagtcttctgaatccgttggaaagggcttttcgccctttatcat

SEQ ID NO: 10926 - DNA, 400 bp, Saccharomyces cerevisiae
ggggaagagtaggagagtatatatgaaaacatcgttttatagatatagacatagacatgctgttatcataccaaatagaaaagtgtacagtcttttagtgattatcatctatgtggtgtcaaactaagaaattatatcgatcgttacagaatatatgatgagggaatatgcataaaaaaaaatctaaagttagtgaagagaaaagggtatgcaggtaaaaacgaatatatcacacatcaagcaaactcaaaagaacaatcactggactcgactttatttttcaaagatggtactaattccagctgttggaacttttcagcatcttgatgatagtaaaacccttgaatgttcccggtaacttgatcatggacaatgtaataaaacccatcataagatgcgc

SEQ ID NO: 10927 - DNA, 432 bp, Saccharomyces cerevisiae
caaccctgaggtcaatgtgcttaactacttctttgcatcttcattgtctctaaaaagattcatatcctcatatccattcgcatcttactcatcttcataatcaccctatgtacatatatatattgtcataaatatactaataattaacaatcacattttaatattggaagttttctcattttcttgcattgaattcatgcatctgccgctcagctagaaacaagcgcattcgtctaccaaccagcccttgagacccgaaggcagaatgtgagaaattacaattttatttttaaagaaactaaactaaactaaattgaaattgataaaaaatatacataaaagaaacacaggatttatttattgtattttttgtatgatctatgttaaagtcgagctagtttattccaatttaccaccctttctttggatcaa

SEQ ID NO: 10928 - DNA, 416 bp, Saccharomyces cerevisiae
tattaaccaaacttgcatctcaccttttttttttaatcgaaatttcaagcatttttctctccttcgcttagtcttgtttcatcccattcaacattttttattacacaacattttgaaaatatcttaaaaacaaaaaagaacgatcacaaatttatggcacgaagaatacatacatcaatcgaggacattttttacattttatttcataatcatcattttttcttttctttactactattctgtggtttcatattgttcgtcaggatgttcatatatattaaggagtttaaactatatacatatgattaggtaaataggtaactattttcaatcaatttattataagtatcattaattgatgttactgccagattttacgatattccctctaatttccgggtatcccataaaagcaa

SEQ ID NO: 10929 - DNA, 421 bp, Saccharomyces cerevisiae
aaacactaattacctcagtagtatggatgtatagaaaaaaaaaaattaaaaacaattaatcttactagtttttgccgagtattataacattaagtgctagtgagcgagaaataaagaaaaggagggaaaaattagacttcagccacagcagaggaactgctggtttcaccttttttttgagctttttccttggtgctggcagccttttcagcggtaacgtaggttgtgtagtctaagatttgcaataattgccatacagaccatgctaaaatggatcctaacagcgtgccaatccaataaatccagtggtaatgagggaagtatctggctgcgacagcagcacccaaggacctcgcagggttgacacctgtgcctgtgtatgcagtcaaagcgacgtgtgcgataaacagggagatgccga

SEQ ID NO: 10930 - DNA, 478 bp, Saccharomyces cerevisiae
ttcacacacaactcacaaatcatattttgtaatttacttaagaaagcattttgcggggtttatatttgttccttgccgcaccaataatattcatatattactacataactttagtattttaacaccagacgatctgtcttttgaggaaatatgtccactttcattttcttccgcttgccgcaatgcctataaaaagcttataaaatagcccgactccgtagtcttaatatttatttaagtacaataatagtcccacaaaaatttttaaaacatctttattgataacgtggacgtgttattacattggagcgaatgatgacggaagtaggaaaatctgaatactaaggtgaagatattttagcagggtgccgccatggatgttctatgaatgtcttccttccttttctctcatgggacaccgcaaaaacctgttctaccatcatttaactgcaacatacaaaaagccaccaactttcga

SEQ ID NO: 10931 - DNA, 402 bp, Saccharomyces cerevisiae
aagaatccatgaatagtttttaaaaataaaaaattagcgccatttttttcatggtttccttttatatttccttctttctttattgatagaataatgagtaacgaaaagcagctaaataaacgtgtttaaatttctataagaagtttttatagattgtataacaaagaaacttttttcttattattatttttttgtttttataattcattatatgtaggtatatctttatctattgtgcataagccatcttatctactcgtattctagcgcagcggtccaaaaatttgtttctaattcacaaacttcagcgtagattgttactaaagtgtcaagttgctctggagggtatgtttctaagatgtggttcaaaagtttttcaccttcatccatggcttcacgata

SEQ ID NO: 10932 - DNA, 423 bp, Saccharomyces cerevisiae
ggaagtatagatataaagaactcagcgacacagtagtacgtaaaatataaaaaggttactgaaaggagtgaattccgccatagtataggttgagtatacgcaaataaacgttggaaattggctagaatgttaaaaaaaacattcattaaaaggttcttttcgtataacttttacaacaaataagtggttgtttggccgagcggtctaaggcgcctgattcaagaaaatatcttgactgcagttaactgtaggaatactcaggtatcgtaagatgcaagagttcgaatctcttagcaaccattatttttgccttccgaaaattttgaagctacatattagcactcttcttcagatgtcagacaacgtgcagcatctttttttcctaccattgaatatatatatagtaattacggcaaccgttta

SEQ ID NO: 10933 - DNA, 410 bp, Saccharomyces cerevisiae
caaaattattgtttctcttatccgagcccttcggcccgaagttcaagcaaagctaactaaagaaaaaagttggaaatttacaaaaggttggtatataaccacattatatataaaggaaaaaaaaggcattggttacttttatgtgataagaagaatatactctctacattcaaaccgtcacaaccatccatcaatatgaccacgaccgctacccaacacttcgctcaacttttacaaaaatatggcatcgacacagtctttggaattgtgggcatccctattgtccaactagcggatacgatggttgccaacggtatcaaattcattccatgcaggaacgaacaggctgcctcatatgcagcctctgcttatggttatattagtgataagcccggcgtgttacttattgt

SEQ ID NO: 10934 - DNA, 455 bp, Saccharomyces cerevisiae
gcgtatcttaattatgctcttttctttcctggtttattaatgatgatgactttaacctattcttcttttggggtcctggtacggtgcctcaaatttttatacaacatgactttttcagttacatatttttttataagtacttaatttagaaacggatacatttacactacattttgtctatttttttttttttgttccttttgttttatgctatatttaagagggaaaataggacggggctgcacattacaacggtgaatggaacgccagcatagataataaatctacctagaatgtcaatcttgggctctccaatatataatggacattcgtacttgcttgcaccttctttgtgcgtggcctccagtctttttcttgccgcaacgtttctgtcatccttcagatggaaaactttgatcaataacgtgtagatcatcggtttgctgatcacgtac

SEQ ID NO: 10935 - DNA, 485 bp, Saccharomyces cerevisiae
cctgacacagtgaatttatctcttaatgatcctgatcttattatatttagtaatgaacttttcgatagacatttgtaattcatgaaaaaacgatataacattcatttttgtagtgtggtgtacgcatggtgggactgctcttcttgagcgaaattttgatcttcaatagagtgagcaacgacaactcaaggataaagacagaacagcggtaaacatcgtttgcaaaataactagagagccggatcgatttactttgcaaagttgcgtcctttttccacgacagaatatgtctgcattatttaattttcgttctcttctgcaagtgatattgttactgatttgttcatgttcttatgttcatgggcagtggccgtctctcctagatcgttacaaaaatcatgaggttttgggggccttctggaaaatggcacgtgttggtgaaagggccagtccatatgttagtttagcatgtattttgatggcca

SEQ ID NO: 10936 - DNA, 419 bp, Saccharomyces cerevisiae
ttacaatgagctattttgcatttttttatggttactacaatcaaatcacctttcgtttacaatatcatcatcagtatgtgactttgccttattctactctgaattttgctttatcgttggttgaaaagaattacatgttatttttttacttatatatgcatatttttatagaaaaacacaatcaatattttttttactggtataatccgtccaatcagacgtataaaagtaaataagcctcaagcaaccccatttgatggattgccttactcttcgactctagttgagatgataacctcatccactcttctggcgattaagatggagcttcttaatatatccgtgtaaagcgactgaaaattttctgaaaaattcagctcatcgctctcagatataatagcggtatggcattaaaggtg

SEQ ID NO: 10937 - DNA, 427 bp, Saccharomyces cerevisiae
gttgaaattattcaagagaattgcctgcgagactatatagtactaagtttattgtttggtcagataaattgatgaatgttggataggaaatttttatcaatcatatcaaaagatctgagtgagctgagaaggttatcatcatataacaaataaacaggactatattattggcagacaaaaaatgagtatcacaagtgtacaaggaaaccaggacagtaaacctactgtcgcaaatttcctctatccacctggcgcgtaagaatcacctgataaagatatcgttgaaagcatcgacctagacatttttaagctgccataaattgggctgataaatttgtgatatttttctccaactgtttatggtctcttatatactttgcgaaattctagaaaaacgaaaaggtgaaaaaaagaaacccggaaaggg

SEQ ID NO: 10938 - DNA, 431 bp, Saccharomyces cerevisiae
ggtcctgttccgtgctctggtatctcgattaggaaagcggaagaaaagaacggaggatacctctaattaagagggtccgttgtgttgtgttaagctcgggtataggaaacttgaagagaggcgaaaaaaacccaacgatgtgaggaacgcgtcgctattgttggtaagtttggccgaaaaattgtttttcttcgcacatggctggttctgctggaggcggctgggtgtttatagttaccgcaatgcaggtcgcttcgtttacttttctctgcgtgctcgagaactgataaatactggtttaggaaaaccgtccacttatggatttaacaaggaggtgaaaggtaggtaccatggcaatatagctagcaacgctacgcactagctgtgtgtgcttgctctcttgtgttcgtctttcgtatattgcgggttcc

SEQ ID NO: 10939 - DNA, 455 bp, Saccharomyces cerevisiae
ttatccattcgtccatccatctgtctatcgtcacacagcatttcccatccctcctctatacatacatacatatacagttctgcgtggtctacgcagccatgtatatatatatttccgtcgttttatatattcattactaaaatcgacaatgcattttttgccgctttccatttcctctactttgctcatcacttcgctcgaagaaaaaatgaaaaccgtcttgaaaaacttttgctatttcatccatccaagccacaccaaatagcgcagtcacacagagatcatggttacatatgctggaaaactggttctagctccaatggtaagagccggcgaactgcccacgagactgatggcgctggcccacggtgcagatctcgtctggtccccagaaatcatcgacaaaaagctaattcagtgcgtcaggaaggaaaacactgcactccaaactgtcg

SEQ ID NO: 10940 - DNA, 426 bp, Saccharomyces cerevisiae
taacaaagagcattatttttccattcccttgtataatattgaaaataaaggaaaagaaagcaatagatatattatgtatacatagaattaatcaaattatcatcaaaaaacttataggaaacctatcgttttgaattcagaaaatacgagtgcacagtagaacaatttttattcccgttttactgatcttttcttcttgttgttaccaaataccttggagaaaatgtatatgatggagatgagtaagcatagtaacgtaccatttttgatcttggaataatcctttgtgtcaggccttggaattggtactagaagagttgtcgagttcaaatggcggaatgtagtatcgtctgtaaagagagattcatatcctagaccttttttataaaatggattacgggaaactttattgtcacctgtgtcgca

SEQ ID NO: 10941 - DNA, 485 bp, Saccharomyces cerevisiae
ttcatccttgtctgatgtacaagtactataaaacagacaaaagtaccttttgactgcatttcacactaaaatctctttttaaaacgaaaaaaacgcatgcaatttaaataatattactacgtactatttggcatttctatttaacaccattatatatattcaaaactatatattacacaacttccggaagggaaacaactatataatacactcggaatacaactttaaaaccttgaaaataagaattagccataaaaatcttggagggaagcacttggcatcaagactcctttgcttggctgtttaaaggatttcactttcgatagagagacatcgtctttcaaggcaacgataacctttttgtctgaaccaaattcaaaattatcagcaacaacatcagcattgtacctacggattctgtaaggataattattactaccatcttgatttaaaatgccctttaatgaccaagaaatcgcataagg

SEQ ID NO: 10942 - DNA, 433 bp, Saccharomyces cerevisiae
tttttgggttctttttctttctgatgataatgacaactaatgacaatactatgatttaaccttaaccattttctttttttagctctttctatccccacccttccctttagtaatcgcaataaatcaccctatgtttttgaattttctcgagaagtaactttatataaaacaagtcatcttagtgacgtagtgtgcatatataacatacaacatatataatatatacaataaccctttagaaaaaaataataacaaccacagtggatatttcccttttggacctatggcttccgctaagagaaaagcatgcttttaagttttcttttctttcaaggagattatttggtcttaagcgaagtgagagattgaaacaaaatgttaattacagagtttacgaagaatcagtttgcaagaccaccttattcgtatggca

SEQ ID NO: 10943 - DNA, 498 bp, Saccharomyces cerevisiae
tgacgcctgctctcttttaacagcatacgttctgttaatttatttgaccaaatattattgatgtttatttttttcttttttgcatagcctttctacatttcatggctttatttatttatatttatttttcgtttcctatttttttgcatacatagacactacctttgatttttgcttgtaagatgtacgatataaagtatactatgaaaaatttgaaaatattggtcttagttactttttctggtttgttttatcaattcatgtagcagtgtgcacgaaaatctagttacgcaatgtgaaatctagaaaaccttctacaatttggaattatcaatcacctctcgttgaaagttttcacacaccaattctggacggtcgaagcataaattatgagaacagtcaggtaaaataatcactttacgaagacattctttatttatagtttgtttgtaaaattccaaattttcaataggagctataggatctttttcagcgcca

SEQ ID NO: 10944 - DNA, 499 bp, Saccharomyces cerevisiae
gagcatataaataaccacaacttgtaagaatattttacttgacacacctatatcatcacgtcacgatgccttcatagattatgatgaaatataaacagaacctgctattggaaaaaaaagggcaggaaaaaattttgtgaaagtgagtaaaagaaagatgaagagcgagacatggataataagaaatagatgtcactaatggacaattggaagactgatatggaaagttacgatgaaggaggcctagttgctaatccgaacttcgaggttctggccactttcaggtacgaccctggttttgcacgccagtcagcgtcaaagaaagagatctttgaaactccagaccctcgattaggtttgagagacgaagatattaggcagcagataattaatgaggattactcaagttatttacgagtaagggaggttaattccggcggtgaccttctcgaaaatattcagcatcctgatgcttggaagcatgattgcaagaccattg

SEQ ID NO: 10945 - DNA, 429 bp, Saccharomyces cerevisiae
cagcagacatcccggtcaacctgccccacaggatattcctcgccgatccattgaaaggcttcgtatgttgagtttagctgtttgttatcgttcatgcagtacccgtcaccactcgttaattttaagctcccggtgcgctgcatctctgtaaggaagaccactcgtctcacacgagaatggatcagggccatggagcacattgagcacggctcatgggtcaaatagacgtcgtaatcaagacacagataagagtttgcgtcttcgtctacaccctccctgagtctttcgcctaccgcacggatgcccaccattacactgtggtcgatgggtagcgagttttcgcagtttctgccatcttctgccaccactttgtccttctttcttgatgggtcaacaaagacgctcaccattggaaactgttttcctgcc

SEQ ID NO: 10946 - DNA, 420 bp, Saccharomyces cerevisiae
tttcaatcttttccatttcttgtacattatacttgaattcttttaattggacgaaaaatttttaaggaaagtagattgatatggtttgcataaattcgacatagcggtttatgctttaatcgttttcccttcccaaattggactaggacttaattcttactattgctgcatctctttcagaacgaaaaactctttaccctgttataaatttcttttatttcttccttatcaaatgctatttggtctatttatttcacttacacgcacctcttcatttgtttcctctgccaagagaatggcttttcatttctttttcttctctttagttaaatgttcttatatcaaaactttgtaaaattgctttgtaaacagattattaagtaccgctctatttaccccataacgaaaagaagttccgcg

SEQ ID NO: 10947 - DNA, 492 bp, Saccharomyces cerevisiae
cccggctctacattcctcttttagtattcttcttctcccttctttcaatccctcatccatcggtctctcaacaactatggctgccaagccctacgcgctatgaagaaaaagaaaagtaggcccgccttctttcccagttgcagtttatttatgattcggaaagattgatgttagtaatggcttgtagttcataacagagtgaattaagtgtaggaagcccggaattaaatatatagtaaaaagagcacaggggcgtttacatcggggtaaaaaaaaatgcctgcaccaaaactcacggagaaatttgcctcttccaagagcacacagaaaactacgaattacagttccatcgaggccaaaagcgtcaagacgtcggctgatcaggcatacatctaccaagagcctagcgctaccaagaagatactttactccatcgccacatggctgttgtacaacatcttccactgcttctttagagaaatcagaggccgg

SEQ ID NO: 10948 - DNA, 498 bp, Saccharomyces cerevisiae
ctaaaagtaccatttaggtaggtgctgagcgaaccaataagtaagtttttgttttttctcagtgtttgctttgaatttacattgaaatacgttgttttggacgtactacaatagccgccataatagattttcgggtaacttttacactcttccctctctttcacgtgagtaagcacagaataaaatcctaacggatgtgatagaacaaaagggatatcaatgacaagagagaggtactttatgttagtcgcctgtgcagaaagaacagtccataaacaacaatccgtaaagaacaatataaatatttagaaaaagatgttgccagaaaagagactattgactccagacgatatgaaactatgggaagaatccccaacaagagctcatttcactaaatttattatagatttggctgaatctgtcaaaggacatgagaattcccagtacaaagaaccaatatcggagtcaataaacagtatgatgaacttgctttcgcaa

SEQ ID NO: 10949 - DNA, 405 bp, Saccharomyces cerevisiae
acgcagttaggatgtacaaaagtcaaccacttgtaatatatagaaattaattgcatatataagaagtataataatattatcgcatttcgaaaggaagaataaaactatggatcttgtagtcaaactaatggcttagattcattgggccagtcttcattttgtaattccggaacaatagtcaagactttcccggtcaatatcacattctttgcattttcaacgaccagttcttccattttctttcttgtttctacactatgtgtgcccatatgaggcagtcctaagacttgggacatcgataataactctttggatatttttggctcatattcgaaaacgtccaaaccagcacttctaatctttccagaacgcaaagcatcagtcatggcttgttcgtctatcacg

SEQ ID NO: 10950 - DNA, 428 bp, Saccharomyces cerevisiae
cgcctttatacgcatctgttcagtttattctgggcctatgatttagatgaggaataaattggttcttactgtctatacataacttttacaaggacccattctatattaaaggagattaacgcagtcttcaaataaaggcatcatccacttattttataatatactaagtgatgatgatgtggcaacgatatgcaaggggtgcgccacgctcattgacatcactctcatttggtaaagctagccgcatatcaacagtgaagccagtgcttcgctcgcgcatgccagttcaccagcgtttgcagacgttatctggtctggcaaccagaaacacaatacaccgttctacccaaatacgttccttccatatctcatggacaaggttaaatgaaaataggccaaacaaagagggtgagggcaagaacaatggt

SEQ ID NO: 10951 - DNA, 496 bp, Saccharomyces cerevisiae
ttccctcatttccaataacattgtcgctgataaaatcgtgattctcgatcaatgtgctacgcgtcgtgcagcgtgacaaggggctaaaaaaagatacaagaattcttgttgtttccaatttgcttcgcctcagaaaaaaaaataaacagattatacaatttttgtttgatttgtattgggtactacatgttttagtagttgatacaaatacttctttatcctaatcgtatatatttattttaccagcaggaattcgtctttaatatcgtttcgaccatcgatcattcctctgagtattgcaaaaacatttttggaacaacccaaacttaaagttacaaaactcaaaaaaggaacaaaattaataaaacaaaagaatcgctgttagaggtttattgttgcactaatagaaaatcatagaactttaaaaattatactagaaagatgtcacaacaagttggtaacagtatcagaagaaagctggtaatcgttggtgatg

SEQ ID NO: 10952 - DNA, 500 bp, Saccharomyces cerevisiae
aagttttcgtgtattaaaatttttgctgttagagtaatgctacacgcaaaagcgagaagtcatacatcaaaaaaaattattacaccagagcaacaaaaggttaatgcaaaaacttttttttttcgagtttttaaggtaaaggtcatgggatgttattgctttttagtagttttgcactgctataccacaaaagcaggtgacagcaattgtgtgttcacggaaacaaaaaaaagtttttgaacataataacaccaaaatcttcggtaattgatatcaaaatacaatgaccaattgtaaatattcctctgaaccagcctaatgcttctcaaataatccccaagcacacaaatattctatgtaggagctcacaggtcaacgcgctaagctaccgatgttaccttacattcataaggtgtcatctgtttatgctgtttgcagataaccttcatttgtgatctcttgcaactttcttatctcaagatttcacaatattccgcgtg

SEQ ID NO: 10953 - DNA, 400 bp, Saccharomyces cerevisiae
ttaattttcatttttgtgcatctcaacttcctggtaagtgatagctttccattgtagaaactgtgtttccgcaacacaagggtaaaattcactgctaattgcgacccattttcatgaacagagtaattaattttctatttggaggtctacttttacaagtataagactgcttcttaccatgatgtctccctattgaaaattatatttaataaaatacttttaggcacgctaacgttagcattcttcccagaattcctatactaacagttttcagtatatatacacttttttactgagtgctaagagccagattggatgagatgattgtgtactgatgggagacaagtttagcttgaataggctagctgcaatatggatactttcactctcatcctttcgc

SEQ ID NO: 10954 - DNA, 432 bp, Saccharomyces cerevisiae
ccctttagccttcttataactgtttctttaccgttatcttgagtacattcatttctcttacattccaaaattagatagaaccttgaatcgtgtcaacttttcgccgacatttcgcgtctgacagaaaaagaaatgttgcagaaaattcgaatagatgtttcaaatgaaaatagaccatgagggacacattaacatttcaaacaaaagagcccttgatgattattaaaacagatctttatggtttgtttagcaaacactttggtaatttcatgaatatttgactagcaggaacagaaaatcaaaaatgtttaaccatgattggaagtactccattaattctaagactttcgccgatttaaacattgaattatttcgaaaccacaagttcaaaactgttttaaattacataataggtgtagttgggtggaatgg

SEQ ID NO: 10955 - DNA, 455 bp, Saccharomyces cerevisiae
tgagggaggcataagtgccctggcatttggacaggaattttattaatataggcatttttattgtacatatatacttcatagatcatattcatttaattagacttcgaaaagttgaatctcttacggcaaaggagaacaagagaaaggttaattattaggtcttataaaatttgttcaattaattataaaggtgattacaataccggaatattggccgaacaatacttgaaccaaattcagatgaaattaataataggtagacacgagctggtgaaaaacaagcacaatatagaaaggttcgaatatattaattattagaaaaaactcagatgttttcagaaccggaggtatgaccgttttgactaacatgatgatcggcctcatgggcttcatcatctacaggaacttcagtagtccattcaacttcctcttcttcgactacttgaccggggata

SEQ ID NO: 10956 - DNA, 452 bp, Saccharomyces cerevisiae
agatactaaaaagaaaccttcccgatggtttttttggagactcttcgattgtatcaatactatcccatggacatcagttttaatagaggagctccaaattcccaaggaattgaggaagaagcgccaatgatttatatatacaaactagctgttgcagctttatagagatttagtaataagaattttatgggaacgtggtaccgttatcgcagtaaagagtcaagggtagcgaagatcaaaccatacgatgacgaaatacctttagttcttagcatcaccaatcgcagacatccaacgtatccgtgcgcgtaatccttctcttggtagttgagcacagcatacagaagaagccgcgcgcaagcggtaaatgtctttcctccggccttctaaccaccaaaaccgatctcggaacatgggggggggaaggtcctctgaatcgaaaaacccgagac

SEQ ID NO: 10957 - DNA, 405 bp, Saccharomyces cerevisiae
gattaaaggcaagcgccccggagcaaggtgccagtagcaccagtcggtggctgtgcgcttgccgtagcacatgacatacggactattgtgtgagtggtgatggggtgtaggcagtgccacaccagtttaaaggcctagtaacggcaaatcgccaaaagagatgatgctgatgcatacgataagatcgtcagtttcacgttcgcggttcgaacatggaattgtggctaaagaaatttgggcggtatgatgcaaatgaggtgtacgtatgtatatatagcaaagagtagaataaaatgagataaagcctcgttcgttctctccatttcttccctgtttctcctttattttctctactgcttatttcgagttcaccagagaacaagagagcaggaacgcaaagagtgt

SEQ ID NO: 10958 - DNA, 482 bp, Saccharomyces cerevisiae
aaagcatctaacactttatttcaatctcctatttaatatcacaacaaaactttattccatcctacaccaaggtctgtcatcggcaatttgatgcctacaaagtttgggttctagccccaaaccaagtaacgcagccaaaaaaacgccaaaggaatcagcgatggacacagcacccatggcgaactctgtttcatcaggatcctcttgttcgagaatatttaagaatgtgttaacatatgacgcaccaccaagaaaaccctcatagaatattaatatcatcaccgcccagggcgaatgtgtgacataaaaccatgattgcagtaccgttatgcacaaattcacaccttgtaaaaacgctaagatgtataaactcctcattctcataagatgtccaaaggatcttgatataaagacacctaattggtagagcgttccataggttacgtatatatctctgtatttatggaagaaaaatggcatcg

SEQ ID NO: 10959 - DNA, 462 bp, Saccharomyces cerevisiae
tgatcccttcaagaacgcgccatatataaaatattcaaagttaaaccttccaaaaatcatagcgtttcatctataggcacagcaaatcatgtccctgagctcctggaggcaattccagcttttcgagaatattcccataagagatcctaattttggaggagattccctattgtactcggacccaacactttgcgcagctacaatagtagatcctcaaactctgatcatagctgtaaattcaaatattataaaagttgtcaaattaaatcaatcgcaagtaatacatgaatttcaatcttttcctcatgattttcaaatcactttcctgaaagtcatcaacggggaatttctcgtagcgttagctgaatccattggcaaaccttccctaataagagtatataaactagaaaaactgccaaatagagaacaactataccattcacaagtcgaactgaaaaacgg

SEQ ID NO: 10960 - DNA, 496 bp, Saccharomyces cerevisiae
gattgttttcattctttataggtgcaacagtttacactcaatgcatatagtgatacaaatattttacaatggctatatccccttattgatgaagttttttattttgcagtatgtcattattttcagtttcttctcccttcaatattggctcggtggtaaatcttctcttcaaattgttctgcgattctcgtccagtaccctctgtatttggtaaggtctttgatctattggacttggccgagtttatgcttttcggtataagaacttttggtagaggttgatcaggcactggcactggggtttttggactgaattgtgaaagaggaaaattttcattagttgacaagtttggtatacaagtacgagaattagatgtgtcgtctttgctcttattttcagcatccctataaatctgaaattgttttggataatccaataagggtaaagccttgattactgacgcttcaggtcttgtatgctcatgaaggggtttttc

SEQ ID NO: 10961 - DNA, 408 bp, Saccharomyces cerevisiae
aagtgttgtagatattcagtttccagtgccattaaattccggtacatattctgtttacctacaaaatttgtaaattggattattaagagttttaatgagaaatataactctgatgatcaaggctacacttttgactgctcaaaagtcaggatactttactgtgtgtcgactttgaatgacttaatatattgagtttatctccgatagtgtcccagcgccaccccttgctccaggatactccagtatgtcggtatataagtctgatagctccatcgggacaggagattttattaatgtcagctgaacctcgtatttagaattttcacagtacacatcattgcttgtcactggaatgcaaggcgatggtgttagttctttcccaagtgggggcagttctagcaaaatggc

SEQ ID NO: 10962 - DNA, 481 bp, Saccharomyces cerevisiae
atgtgagaataacgtctcctgattaagcaggtgtgctttagtagttttgccgctttgcttgatcactgttagtatttcggcaaattatatggtattggtcgccttgccaggttctttaggaagttcatcataaactaacgctttcaagaatttacggaaatgatagggtttatagtttttataacagtagtggacctagaaaacaccgatagctggcggcggttatatctcattactactatgaaaactgtggctcctgagtagctactgaaggatgtgcccatcttaatccagacctagtcaatacaatcaatacaactgtctagctgaaaactgacaaaaaagtttgtcgatgtctctagtatattcactataacactaaattttattgtaaattattacacaagttttcaagaagaaaaacaatattaaacacaataactagattatgcgaggcacggcaaaaggagtgaagagggca

SEQ ID NO: 10963 - DNA, 404 bp, Saccharomyces cerevisiae
gcctaagtcactcactaggtattgtgatttagtcatgttttctttttattagtggcattttttatatattgtaacattagggttctgttacttgtccagatatgattggaagggtctagtctatcagcctccgaaggagttgtataaatgtatatatataactttataaacaaaaaaaattgggaaagatattttgcaaacagttattattaaattgtttcttaaactctccttaaagatataccctatttaggttcactacacgagcattcattgagaaattttttttaaaacaacatcgatcttatcttgagcagtttggtgcttatcagttctagtcccaacacgaatatcagtgtgtactctaacatatcctttctcatgaccgtattcatggatttcgc

SEQ ID NO: 10964 - DNA, 460 bp, Saccharomyces cerevisiae
tatcagcggaatatgcctgtaatttggttcaaagaaaaactttttcaagtcatatgtaagttttaaataaatcagtttacgaacatgcacaagaataacttctcttctttttcttgaaataaaggccgaattatacgatatgatatgagacgttctaattacaatacgataccgtgagataaaaatagcgatatcctcgtactcaaagaagtctaattgttttagcccgttgatcaaaaaaataaaatgtatttttatttttttgtcatccagctcaagatcgtaatattggcaattaacaaccgagcgaggcacagggcaaagagaatgtgggtgagactgaactatctctcccaatatattatacttttttttgtcgcgtctaccaattaaatgaaaacataattgggaatactttcctcttcttatattttatcttaactcgtttccgatcttctga

SEQ ID NO: 10965 - DNA, 482 bp, Saccharomyces cerevisiae
tggtgttagtgcataataaatagcattttaaatatttgtatattatattcataaacgaagtaacacaagcatgaaactgttgttcggaccgaaccaccttactcaacgttgtctaaatgattttgtgttgctcatgtcatagcattcaactacagatgaaggtttttagcgccactcccattaacattttcaaatccgagtattgaaaaaaaaaaaaaaaaaaactagagcaagtgaacgaacgggaaaataaaaaaatggcagatgaaatttttggacatctattattacatggcaagatgatcgatataaaattcaaatccagttcaaaagaacagtaggaaaagttttatccaaaagcataaccgagaatcttctttctggaaaacgcatacgttatatggctatataagcaaaagagttcgcattcattggtaaaacgtaaaatacataatttaggatgctttcgttttgtccttcgt

SEQ ID NO: 10966 - DNA, 435 bp, Saccharomyces cerevisiae
tttaaatcagctaatctgcttactgccgccaagagaggtatgcaaagtcagttctacctagtctggcttagcgttttactatttacgaagttgatgttctgttttctaatttatcttttttctactcattcatttccacactacacttaatattttttcaataattttcgatgtttttaatccggttttctattgatgagcgccttcttagctcatacttaatacacgttttttaagatttatacgtttgacagctcacgctgtttgaccaaagttattttcatttttatgttcgtaattatgtatttttgctattgtatatgatatacgtctatatttaggcaattataatatgattataatataacttactacatctctaaaacatgctgtctagcccttccatcgcaagactcggctagacattcgaggaag

SEQ ID NO: 10967 - DNA, 415 bp, Saccharomyces cerevisiae
tgcatcagttgtcaaatcgtcacaaaatgcatacaaaagaaaataaaatcattgtggtgcatatacatggacagaatatgaaacgccaaagtgtttgcaataaagaggtgaaaatatgttaaacatgctatagagagtacacctgcaagttaagaaaatgccattcgtgtttttatctactataatgtaatgtgacagctgttttaaacctttcttaaggtcgtttgtgcgagaacaggctttttttttggagaatgtatcttgagagaaactcaatagtaataactggatgcataaagaaaatttcatatgaatcactacaaatctttggcgttagaattctattgggtaaattgaactttgtagctttttgatggtaaacttggcggttttgcgcgacccatgatcctaagaa

SEQ ID NO: 10968 - DNA, 495 bp, Saccharomyces cerevisiae
agatagggatatgtggataattctacgattctaactgtacatttctcccttatttattaagaaaacctatatatatatatatttacctatttattctgccatcgttagctggcgttttatcttttatgcatccaatatctaatattacttccgatcacgcatttagttctgattacagcagaaatcgtagcgcgatgagacatttcatcaaatggccttttttttttgggcaatttttttatatcttgaaatgatagttgccttgtactttcaaccgttcatttcattaagaacttgactaaatatgaacatttcttaaaaaaaaggttgacatataaaaataatcgaatataaacgatggaatttttataaaattaaacacatatatatatatatattaactataaatatgtcaaagaaaccatacaatcatagatttataactatcttttggatgacattaatgaacataacgctcctaatacaaatgtccaa

SEQ ID NO: 10969 - DNA, 401 bp, Saccharomyces cerevisiae
atcaactccccagtaactgctcgtcggcacattgaacggaagtgccgcgatactagatttttttttatttatttatttctgaactttttaattttatattctgcattttatcatagactcacaaaacaaattcatttcatcatttggtatttttactcaccattctatatgccataataatattaaaaaacttaacgtctgttccctaaaaaaaaactaatttagtaaaaaatacgaccccagtgagggttgaactcacgatcttgcgattaacagtcgcacgccttaaccaacttggccatggagtcgcaaataatgatgaattgggactttaaaaccgcttccacatctgaatcatatctccggtatttatttctttgcaaccaaaatatggatatcga

SEQ ID NO: 10970 - DNA, 435 bp, Saccharomyces cerevisiae
caagtgtgattttaaaggtgatctgatctacgcgccctcgatagtaatgactaaatatcttgggtagagtatatataatgtcgtatttttgtatattgttttatttagacaaatagtaacgtgttatgttccttcaagcgcatctttcatgattttcaatcgatagtcaaatggatccatttagagtttctcatcaccatcaccatatcatgtcactccaccccgctttacgtaaaaaaaaaaaaaaaaaattgaataaatgactaagaattagacacaattttgtcttaatgaatactttttacctatgacacataccagtttctacatatgttgatcttcatagctccaagaatcttcataaattcgtgacaaattagaattacacattattatgtaaaatataatatacaatgttgcctatcaagacaagca

SEQ ID NO: 10971 - DNA, 440 bp, Saccharomyces cerevisiae
cggaggagctttttcctttttttcgcttctttcttttgtctcatactcatgtagcatactttcgcgaaccctattccaacgttttgttgttgctcgctttcatgcttaaaatttttattatgtattttacgatcaaggtgtatcgtgaaccacacgtttatgaaatccttattttagaatcaaaaagtcctacaatcttgtttgtggagtctatataaagctaaagttaggttctacaaagcaagatacaaatacgaggccatcgagtattcaatgggaaatatgataaagaaggcatctttaatagccctcctaccgctgttcaccgccgcagccgctgcagctactgatgcggagacatctatggaatctgggagttcttcacatttgaagtcttttttaatgtccgtttctatgattgggctttctgaaattggtga

SEQ ID NO: 10972 - DNA, 461 bp, Saccharomyces cerevisiae
atatgtacagatcctcctagaagaacgaaaatttatcatgatcaatatgcgtactcaaaacaggctcaacgatttgccaaataagcgcttcaacttcctgaatgcccttattagtaacgtctacaatcgtgattgactcatcgcctttccttatctctttatccaatagcttcataaaagtttgcttcactttttcttgaaacttaacagtttcgtatctttcgtcaccaaatccagatttttcggcgttattgtcgacatcttgagtgcttaaaaataatgtcaaatccggtttcagcaaccctacatcgggttgcaagcaccaatccaaatccattccatttgtccccttagcggcagaatatgccactccagaataaacatatctgtccatgacaatgttcttgccttctagtaaatctttctttatcttgtcaactatttcccatctatttgccgaa

SEQ ID NO: 10973 - DNA, 411 bp, Saccharomyces cerevisiae
tcatatttaaggaggtttccaaaagtagcatcctgacacattctattacacctttttttatcagcccgagcggcctttccttaacggtgtatacattttctaacagtattaagtcaaaaacagcagcatcaaaagtacgactacttttacaagatttctttagatatttacttcacatagaagaagaaaatcaacggaataaaaatccaaaaatcatgcttaaatctggtagactcaactttctcaagttgaatatcaattcacgattactatactcaacgaaccctcaactgactaagaaggtcattggtatcgacctgggtaccacgaatagtgctgttgcatatatccgtgattctaacgacaaaaaatcagctacaatcatagaaaatgatgaaggacaacgaacca

SEQ ID NO: 10974 - DNA, 437 bp, Saccharomyces cerevisiae
agtactagtaatgctcatgaattcgcatactctttacattttcttttctttttgctgaactaaaaggaaaaaattttttgcatctatctatctatctatatatatgtatatatagtttatagtgatatgcgtgttcacttcaacatatataataccaccagtattactactattatcatcattaatattagaattttttttgtttttaaatttattcttttatttttattattattattatcattattactattaaaaaattattattattaatgttattccaatgttaattataataactatactgaaataattttaaaagaaatgaaaaatgagaagaaagcagcattttttaagagactaaggttatgatatttcccataatatcaacatccgatactgatgcttttctttgtctaccctcgctacatgcatcc

SEQ ID NO: 10975 - DNA, 470 bp, Saccharomyces cerevisiae
tatacatgtctatgaaatcgaaaacccccagccatgcatagatcaaacttcaccgtttataattgcgtttaaacgcctttccttttcttcatccattttcctggtatttatctcatcgtctctcttaattcttaatttactaccttcatctgggattatgaactgtggatgttccatatcacattcatccttccctaaaggacaaaatccggtcatgtatctttgacagaaaaccttcttaatatgccgtctaggacaagaactccccagaggacagaatcccatttcgtaattttcacattttggtatcttgctagcgggatctatgtgtagatattgacaatctggactttgtgtacagtacccgtttttgctgaagaagacacattcaggcatttttcgaagattgtattcatgtaagtattcacattggtcattctttttgcacaaccctcgaagccaatgtctac

SEQ ID NO: 10976 - DNA, 482 bp, Saccharomyces cerevisiae
aaggtttcccattccaccccttcgttaacccacacgcaaatacccagataagcatcttgcacccctcacacttgtatatacggagcaaactacataatctctaaacagaaaaaaaaaaaaagaaagaaaattaagaacattactttttccgagcaacaaacgcaaaaatatatgaagtggctgtagaacatgccttacggaagaaaagaatgatgatggcatccccttcccctgccctggaaggtggcctgtatttctgttctttttttatttttgttcgcgcaaagagcaagaacattggttgctttacttattattttcagggtcgcttccgcgggatgccatgcacggatgcctgcggagacagtggcgcggagccgtccgcatgctcgttccgcggagagtctcgagcgggtccgcgaggggcggatctgcaacgcacggtgccggggttaaggtatggcacgatggtaagacgatga

SEQ ID NO: 10977 - DNA, 473 bp, Saccharomyces cerevisiae
tttagagggctactatatcttgttccaagtattaatgagtaatttgagtatatgtacaaatttcttttgcgtatcgcgctttagccgcccattgtacaatattaagattaggaacacaaagagatttgccagtgaaagaattgcaaaactcggtttgggattttgaatgggatagttgaatacaacaaacttctccgaatatgaatcattggttagcatttttgaataagcctgaatccctaaaggaacaaaactcggattgcgaccagcagggggagatgagacatgttactgatggcactttaactaagtctccagaaagtaaaccttttcgagagcggcgttcacaaacttggatagactctgaagtacctacgtccactgaaaaatctaatgtgcaggaaagtatttcttctgatattatatcaaaactgtcgaataggcgttcccgaagaaaccgctcagagagttgg

SEQ ID NO: 10978 - DNA, 435 bp, Saccharomyces cerevisiae
ggaggtacggagtggctcaaatacacattgtggaccgtacactcgatggagtttaggtttacgtacaccttctagtgcaaggtgcatgcttttcatacctcatatgactgagtttgtttagtgtggcctatattctaaaaaagataaacgttagaataaatgagcttgcgaactgagccatttaccggtcatttgccaatatatataatcaaggacatctctatcattgtgagaaatactaaaaatgtaggaaaaaggttaaaacaagaaccactaacacgctagataggtagataggtaggtaggaggaggtcgatattattactgcatatatatatttttttccattctgcgttttcttgctgcagcgtatttatgtatcaagatcccggggcagctgtaagtgtactgtctagaaaataaatcagcaggccg

SEQ ID NO: 10979 - DNA, 400 bp, Saccharomyces cerevisiae
ttgaattaagaaaggtctgcatttttttcctaccacatggcatagatatttatagagtaatgagcaagataaatgagttcgcaaaagaacattcaaataattagtaataaatgagtagaaattcacgcatctttatagagtttataatgcaaatctccgcgcggggtaatttgaagtccaatttttccgagcggcgtgccagttccactaaattatataaagcggataggaattgtaattacctcccaaagttaatattcgactaatgtatatttcatatgttatagcgcttgtaggaactgttttccattaaaactaatatcctttatttctcaattttatttatttatttatattttccctttgcaaatatatttgacgcaggttcggatcagacatt

SEQ ID NO: 10980 - DNA, 493 bp, Saccharomyces cerevisiae
ataagtattggtgtgcttttcagggccccaaaatggtattacttttgatggacaatggcgcgggtaatgattgaaaaattatgatgaaaaattgagtgattttggttgcaatatagggaatcaatccttaaagtgagaaagaacagaagagaacatcttgtgagacacaaaacgctccgaaaacatctccctcttgggcgcatccttcattctgtactctttacttcactttacagtcgtttttggccgatctttggcagcatctaacgttatttttaggttcaatacataacaacaagaccacggatatcgcataatatggttgacctaatggtgccggcgaatgatgaccctagtaatgaaactgattattctagatccaacaacaaccacactcatattgtgagcgatatgcgcccgacctccgccgcatttcttcatcaaaagcgacatagttcttcgtcgcacaatgatacaccagagtcgtcgttcg

SEQ ID NO: 10981 - DNA, 426 bp, Saccharomyces cerevisiae
cgtctcaaaatatggcggcgagaacaccaaaggcggggtgtccaaaacgcttttgcactctgcggccaatgtccatgaactaattctttacacataaccacagtaataaacttgcaaagaaaaaagcaatgtcactcctttcatgtgcgttcttttgacgttacaaaagttgagctgttcaatgacgtatttataagtattaagaagttctctctcttcagtggatgatggaccggatgtcgatacatgatttgtcgatattagtacaattactacagagcccattggggttatctttattattgcactctgcatgtggcatcgacatatccttctgttctgtggccacaccgtcgtcacttttacggtgatctgtttccagttctttacaaacgcaagtagtgttgtcgttacaaaagccgcatt

SEQ ID NO: 10982 - DNA, 411 bp, Saccharomyces cerevisiae
gggaatataaaaacgaccaggaacacaccattacctgtattttccttttatctgttataagcattcgacgctgatacataaacagttttcattatgcattcttttggtccatagtgtcattattgctcttattactcattgcatttttatacttcaaatatatataataataatatcattatgtaatttatgtgctttatcttaaagaaccaaattttttctatttccgtgttcaattgcttaataattgtaaaagcttaatttcttggataagtcgatgccaaataaactgattaaatagattatcgataatcctaatgttggtaaaagtataaagttcaaatttttcaagaatggcaactggttgtatccataaaaggttaaaataaagtaatggccaatagcaaaaca

SEQ ID NO: 10983 - DNA, 442 bp, Saccharomyces cerevisiae
aggaattgaatgtactgaaaaactgtaaatataaattaattcataacacaacgatagaatagcatgaaagaatataacaagtctaacgcatataacataaaataatacatttatttgatgatcaaaaaaagaaaagaattaggatgcaatgcttggatttagtatatatttacagaaatttgttttgttattatttgctttgttatttatatcgtaaatgtgcgtttggccgttcatcttaagtaacgtttgacagccgacacaccatgctttttaatatcttgtatgatctccttgtttgttttgaactctgaatttctaatttgatgttttaagatgaaattccagtctaacttcaattcctcaatcgtcataccgttctggtatagttctgcgcacgcccaaagaaaaatgtctgttcttcctatctgcagtgcgctta

SEQ ID NO: 10984 - DNA, 492 bp, Saccharomyces cerevisiae
aagtcggagaacctgactgaaaattcatgaatctcttcatttctatagcctttcctctatgcatttgtattatatatttattaccgtcattttttacatactgctgcattttggcgccagtgataagtggcaaacaattcgacggaatcgtggtaattataccacgttactctataacatcatgatattgcaattaatcaaacatacatttaatcttaatgctattagcttactacaactcttttctttaagttatatcgtatatttcttgggcgatgtcagaatatttacccggatattcctttttaagcactgaatatgtttgaatagagactgacatatatggcagcaattaaaattggaagaaatgtaatgacagtaggaaagaccaatttttatcatcgtgacaccaatcacttccttaactgagctttacttgtatttatttacaggtagattaggagcagtagaaagggaaaatataccgggtgc

SEQ ID NO: 10985 - DNA, 462 bp, Saccharomyces cerevisiae
ataagtacatccagtcgaatccttttagattgattgatctacagacgatgcacaaggaacgcatcgacacgtaaagaagataagcacacaaaaactgtacatatgtaaaaatacgtatataatctatgtaaatactgtaaactatttaattatcaaaaattcatgaaagacaaattacccactattcacgttctcgattcccactgaactttgacacattcttctacataaccgacaccatgttcatcaaattcaggcatgtaattttcaacatcagtgaaaacaagaatggtaccccattccataccgttatcgacagacactacttcttccagatcaaaaatcatctttggcattaactgcatttcaaagattctttggctcgatgggttgtagcccggtcttggcacagtgcttaaaatatcgacttttgtttcggcatatagcaaaggttttccgcct

SEQ ID NO: 10986 - DNA, 495 bp, Saccharomyces cerevisiae
gatgccgcaaatgaaagaatgctatttagagtaatcgattatcattcttattataagctaagttggtcaagatgacctgtttgacctaaagacaagcactaacgcaggcaccgcactagtacttaagttttcttacgtgaaaaggaaatatgggtgatatgtgtctgttccactcatatcttttggtttctaattttacgtaatctcttgtattttcttgagagggtaaattttcacgacgcgtcagacgcttatatgagggacgaagttacatatttgaatgcattaatcaagaacaatattgttgagtaagcgaatagctaccattgttcgcagttctaggatcgctaaacagaaaaggttactctccacgtgtttagagggctacccacaaaccgtcataaatcatacctccttctttgacgagcgtattgcgccgttcgaatgattcattccgccaagaactaaatgaacttcaggtttgggtctttccac

SEQ ID NO: 10987 - DNA, 460 bp, Saccharomyces cerevisiae
atgaaaaaaaaaaactaatgataatggctttctatttgttttgcatccatggtgggggtgaagtttaaatttgtaatagtatacatgcatcattctttactaagggaaataaggaaaagtatatatctgcctcttgtaatattgttcaaggaaataaattttggagcattcctctgcatctattgttcaattaaaaaaaaaaaaaaaaaaaaaaaaaaaaaaaaaaagtaattattcatataaaaccaccttgcgggcaagatcatattatccaagttgatacttatttaaaaatataaaaattttttaaccgcgtacattaaatacagggtcatatacaggaagagctttcaacacctttttgaatactttatatgcaataggtgcttttttttttcacctatggtgactcctcctttcattctatcctacatattattacaattccattgatgtgcca

SEQ ID NO: 10988 - DNA, 456 bp, Saccharomyces cerevisiae
atttcataagtgacgtataaggaacctgttttatgtattcattaagcgaggcgaaaagcgaggcgacatacttcttttcacatcaactcgaacagagaaaaaagtagacatagaaagaacccaaagaccacaagagcaaacaatggtacagctgagaagaacgtatgtatatatgttcgtggtaagctcgttggtatgcacgtatcttaggcatcactaccaacaaagtgtttcaagcgatcacgtcgactaacgacaaagttgctcactttgtcgtgttcatgtgggagtcgtggctgtttgtaaagatgtttgctgaggacatcgtgactttccgcaagctacaggccaacaagtacgtgttaggggtgctgatctgttcattatgcgcaagtgtaacgagtgaattcgcccaaagcgtggtttcgcggggacaaagggtgttcgatgtgaagg

SEQ ID NO: 10989 - DNA, 459 bp, Saccharomyces cerevisiae
aacgttacatttctctgtttggcttttggtctacggttccccaaatgcagttaaagaatggcaataatacggaaagggaaatgcaagaaagaggaaaaaggacggttccagattttctaatgataagcgcgaaatttccgcaatttctagggtagtgggatgttcctatttacgtttaccattcttgagagtgaaaaacttattatatggcccgttccggccgtggtactgggtgttatggccccaaaacgcgcatattccacgccttttgggccttggccgggccccgcggagtgcctgtggaattgcccttcggagctaaggcagttcagttcgtgttgtttacctctgccgaaactgaggccgcccaggcccactttcgcttctctttggcgtgttgtggcggcgatcgctgcattgtttcaagtgccctggagacgtaaaacaggcgtgggaaaa

SEQ ID NO: 10990 - DNA, 492 bp, Saccharomyces cerevisiae
taggtatttggtctcttgtctctatttatttacacaggtttactttcaattctcctctttttcttaggttgcgttccgtacatttttatcttcatttccatccactgtcttagatttttgcatatattttgtcatatacctcgcaaccctactgcggtcttaaccttttttttcagttcttttaaataactttcgtattgtctgtcacccatgaaatatatgtatttttctactcttcttcccgatgactacttcctcctgcagggtccgcgcggctttatccttttaggggagtgaagagaaaaattttctgatatgtcgccatcctcttataaaaccaacgtaaaataccatacacttctttatggcaatgaatttccttgtcttcgtttcgacgtttttaaattgaataaaaaattgtacttggaaaaaagaatagaacaatacttttgctaacagcaagagaagtacggttgacattacgagtatccc

SEQ ID NO: 10991 - DNA, 445 bp, Saccharomyces cerevisiae
ttggattacatcctacttttacacccctctgcatatttttctttcctcatgaccatttagtatttagcacttatttaatacaataatatattcttttaaccatacactatgataatgatatttataattaagaaaatgaacgttactatttccttcctcgttttagttacataaaatttactaatggttggaaaattgcggaagctatcacgcgataactaggtacacacgcattatttttataatcccattattaataaatccgttatgacccttttagtaataacttattaagaacctccgggtaaaatactgtactgcggggaaagaaggcgcttccccttcttggaacttaatataaataataaatttgcctaagggcattaggccttactgccttggctagcgtacttatttcgattcatacaatttgcactattccggc

SEQ ID NO: 10992 - DNA, 459 bp, Saccharomyces cerevisiae
gttgagtaaaaccttccgttctgatatcacatgtataatagtaatgaattttttttacttttttttttttttagtaaatattctagcatatgagtttatgctttcatttatttaacgttctgcacttttgtttttgctggcaaacccaatttttctaccgtccagtaattcaactaaggctaaaaagactttcattagaaaaaaaaggtccaaggataggaaaatttcaagataaagtatggcattatgttaaagaggttagccaatcgtcaaaatggttttgcgtcattctcgtgcagctcagtcggtctgcgatatggtaggactaatccaagtacaaagagaagcttttcactttttcaaagtgtagcggacacgtttttaacagtgcatgaagcctcacatataccatggatagtgcttgttcctttgactactatgacccttagaaccctcgtg

SEQ ID NO: 10993 - DNA, 452 bp, Saccharomyces cerevisiae
ataatatcttaatctctcgtcgttcgccttatttatatttgaatcaaatatttaattctgccacatggtaggttcattttgccgcagatcaaagaacacggaccatcatgtcaaaagtacacaatttttgtcttttcgaaacaatttggtttagttattaggagaagaaagaacgaatgataatgctcattactcagacctgaatgcaaaaaagccaaatcaaatacagaaatgcacataaatgtgagaggaactaggaaaataatttccaacgtttcatccttcacaccaagatatgaatttccaaagtacagtatgcctctcactgatttcaagggacaccaagtcaaagctcttaaaacatttgaaaagttgcttcctcaaatgaatatgataatagaactacgtgatatacgtgccccgttatctacaaggaatgtggttttcgatcg

SEQ ID NO: 10994 - DNA, 453 bp, Saccharomyces cerevisiae
tgtaattataacgatggaatgatgttttttggaagaaaaattcaactgtttattaatatttacggcattttttcatgtagttgagattattcctattgaaaaaagcaaattgtgagaaaaaagtatacaataaaatttgtataggctgcagaattctcctttccgtatagttgcctacttcccgtctcaaactgaatcctgctatctgattgctttctgtgttggtgcggtgaatctttttatacatataatatttgaaaaagaataaacatttgagaaaacaaaagtagctaaacaaaacgacaaaatcataacatttcctgatctgactgaaagctaatagaacagcagtgttcgatgagggtaaaataaggaggggtcttcggttacgttatactagtaagttgattttgattttaagtcatattattgaacgcattatgatgatactca

SEQ ID NO: 10995 - DNA, 437 bp, Saccharomyces cerevisiae
cctacgccttgataataatacttattgaatcaattcaatatatcaacgtttcaatatccaatattgtttcatttcatttcatttcaaataaacagtgttttaccgtttgttttgtttcccttctttttttcatcaaatggtaatattaaattgatttaattatccatccataaaaattgtattaataagtcatacacgtaatgtcacaacaaaatatcaggcgtactcttgtgacgtaccaaagcgcttagaaacgataaaggcccgggacagaaatttaaacgtcacaagtgggtgcagcccagttaacactaatgttaacgcacttctagatacctcatatatataaatattatctagaatttcaaatttgatattccttttctatactgaataaacgataaatacgaagttcagagtgcgaaaattagggttgc

SEQ ID NO: 10996 - DNA, 430 bp, Saccharomyces cerevisiae
gacaaattgggctgcaaactcttggaaatattcggcgaagttacggcagaacgggtgattaattgttttattgttccaggagacttttctcattccctaaaaacatgattattacacagctttgatctagagccggtattcgaactagtcagaccatttttcacgaaatataacaatatagccgctgctgctggcaataactattgtgtcttgacgttttaacagctgataaccgccatttttggtgctaccgctaaaatcctttcgcgtatacaaaaagaaccttcttgacttacgtcagatttctcatcaagcaaaaattagccggtaacaatatcacccaaaaggttcttttatataagaattaggggtggttttttgggacaacggctagtatagcaaacgtagtagctaatatcggacgtagcgg

SEQ ID NO: 10997 - DNA, 415 bp, Saccharomyces cerevisiae
ttgaactattgttttcgttatcgcgtggcacgatatcatgcggccaaaataagaagcaagaatgcagatgttgatagcctttgttcaattttccagagacaaatgctttacaggatcgggacttgaaatatactgactggatgacggtaaacttagatccggataaagtttggatagacggctgctttgatttcacacatcatgggcatgcgggagccattttgcaggctcgtcgaacagtttcaaaagaaaatggtaaactattctgtggtgtgcataccgatgaagatattcagcataacaaaggaacaccagtaatgaactcttcagaaagatatgagcatactagatcaaataggtggtgttcggaagtggttgaagcggcgccatatgttacagatcccaattggatgga

SEQ ID NO: 10998 - DNA, 401 bp, Saccharomyces cerevisiae
acaggtacgggctatctggaacttttgataagttgtattctatctcttttatttcctctttttatttattttcgagtgccgtaatcttcgctacttcaagtttcataatcaatcgactttctgtatgggtaagcatctggtgtgatgcagtttcattatgacaccacaaatacaaaagagactatttaaatatgtatatagatcacattccaaaaaagaaaaccattaataatatcactctttaatattccaaattgaaacgaaaaagcgctattcttattcgcttcctaactaccgccctagttcgtgcttgcatttttttgtagaacgataaattatggtatcccacgtgattgagtgtaaccctgaattgttgaagagaaaatgaagcggaagaagca

SEQ ID NO: 10999 - DNA, 419 bp, Saccharomyces cerevisiae
gtagaacatcatggccttgaataggttataaacaaaacataatataacgtataggtattcgaatgaataaataagtatgtaaatagggcatctgcatggaaataactgggtaaaacattacaatgtatttttttagagttttcactattccgacgcgtctagtgtgtcatacaaaacgcgaagaatctgaaatcgtgaaatatacttaagaatataactgaaatagcttaagcataaatggactttactgcgaagataaagggtatgttgaaactcatctgctttcattatgcgtccaactaattaacattgcatattttcgtatactatttttttgtgtagagctcgaacgagaactctcagagacgagtgactataagaccttgcagaagaagaccataagtcttcgaagtgagctg

SEQ ID NO: 11000 - DNA, 460 bp, Saccharomyces cerevisiae
aaaccaagtatgcacctaaacaattgatcactttcaattaggaaataaaatcccttgatttagacgaatactgtagaatgcaataaaaggttttgtgattctaatctagtcccttacgttatgcaccgctttcaggaaggttatgggctgtaccatgaaatcaaaggtggctcataactagtaagtaaaagtaaatgtcctttttttatgcaagatctagaacgattcgagtatggtgttgataccactgtggtaagtctttcaagctacacgcaattacacacactcacaaatctagttgtatttactccttttattgttgctagtctaattattcgtcccacgattttatcgttctttgagtatttcgggtctcaaaagattgctaaatgaaataactcttaaaaattgcttcacatagtcttgttgttacattcacaattcacagctttccgttgct

SEQ ID NO: 11001 - DNA, 488 bp, Saccharomyces cerevisiae
gaatgaacagaaagaaaaggatcttatataaatcggaagaaggcagttgcgataatagcatatacatatttattattatcattccccagtaaagtttattatatatatgtaaaattgtattatagatattagtattctacagtgttggtttcatagttgatggtatagtttttttctttcgctacagaaccaatagtcgagtgcaactttatctcgagtgagttgtctgagttcaacgtttccacttgagatatttcttcatatatctcttcacgtatggcattctgatcaataggaaacctgccatatgtttcgcttatgtattctggcgtcagtaacgatttgtcacataaaagatccacactgggcaaggggaaatcattatttttgggtagttcttcatcaaaaacacgtttgactatatgctgaagcagtttatctccttcattactagcatttagtagaacgattcttctccataccaaagc

SEQ ID NO: 11002 - DNA, 419 bp, Saccharomyces cerevisiae
acagtgaaaaacaacgtccaaacctggcgtcaataacatgtgtctcagcgacaagcacaccatccttttctaaaaccaaactacttatttattattaatacgtaatctaacgtactcactaattatttatttatttgactataacatcattgatgaagtttataatgctagcccttgttaatgcatgcaggttttgtgaatgctacagaggaacatgtactttaaatgcaacattatccctctttattgtctttgcatccgcaaatttctttgcttaatttcaagatcatgttcgagagttgcctttaatctaggcatgaaacccaatttgaaaaggaactcgaacattataaaatatggtgccagcaccaagctctgaactagattgtcaattaacgctggcctccttttctcaaaga

SEQ ID NO: 11003 - DNA, 469 bp, Saccharomyces cerevisiae
tatgctagaaaaaaatattattgaacgtcaataatttttctttctcatgggaccaaacacatcatttattctctaataatattctattctctttatttctggtttactcttttaaaattctccaaagagaaatatctccttcaattcttcagttacgaatttatgtttacttttaacctctatcatacacctttaatctaatgcctccaactgtctgtaattttagtacaacttaaaagggaaattttccgaaagtgtgaaaaaattggatttttttttctcctattgaactcaatggaagctatcagtttggagagggacaattattttccttcttgttttttgccaagagaacaatattgtagtatttaagttctaatttaatgttatatatacttatctaatagtttttttttttcaattagattgttttccttacgacgttaatcccttgtcatcctcacttacg

SEQ ID NO: 11004 - DNA, 438 bp, Saccharomyces cerevisiae
taaatcttgaattttgcaatttggaagcaaaatattcattgccggagaaggagttattattatacgtgtaaaaaataactcaatgttatattaggtctataattgttgatatctggcatatcatctgatgaaagaccaaggaaatgtatgaaagcatttaaagttgcacgcataaaaaaagtggtcaagaagatcagttcttaaatacgtacatatctttcaagtggaaaaagaaattttccctttatcacatttatgaaaaaatgcatttatatgaactacttagtttccgctgatggtcttatcattgtaattcactgtagggcttaaggtaattgacttggatagtaaattggaagaaaacgctaacaaccactttacattggttaataaaaatttcatagccgttgtccattcaaggttgggactgctaccatg

SEQ ID NO: 11005 - DNA, 477 bp, Saccharomyces cerevisiae
tcttctctttttcgcttctttatttttttttaagttacgacttcgtgcagcctgggatgtaccaagcttgttgttaaacgagcctgacttcttaatcgcttaatcttagttgaatttagtagttccagtttgtatggctgctatttttgagtatttggaatcatctttcgttcagcgatctttttatcattcactttgtcgtttacaattagaaagcgtcaaaactttgcatttttcatttaataataactgaactccaccaactttttactagcaagttgtaaagttcatcggtcagataaacatcttaattacctgtgaaatactctactgtttcttatgaccagtatgtcaattattgatgatgagaacgtgaaaaaaacttctaatggggcagctgttgtcactgatgtggctcaacacgctgtaagtgattcggacaataacaaagcgcaacttctaggcgatggatccaac

SEQ ID NO: 11006 - DNA, 405 bp, Saccharomyces cerevisiae
acctcttcttggccttttattcgctggtgcaccaaaatcgcgccttctctttttgctggggtcatttgcaatttgacccgatcttcttagggaattaagttgcttttggtcaaccaaaagtgaatccaggttcaaggaatcaggtaagattatctgtcttatggtattgcctctaatgtttatgtattgcaaacttgctatgttgtcacttgcagtaggttgctgtcctccagtcaagtacagactagccatcgcaataccattactgttcaatttatttagtcggggttgtggtagggtcaacttcacgtcagttaagatagcattcatttgtggtgataccgactgcagtgtaccccaaacggtggtaccgttttttagttctatggtaacctgctcattgcg

SEQ ID NO: 11007 - DNA, 458 bp, Saccharomyces cerevisiae
tagtcatagattcatgaaaacgatatgagccaaaaggaccattcaataatcatgaagcgttaaaaaatagtttacttaccttttttccttcttaaagcattttcccagagctgatagataatatattgaagtagtacttatatacctttcaactgatgcatgtgaatggagttgaccttcattcagtttaatgtaatgttattttaattcaagtgtaaaacgcacaatacgtaaacgaaaaataatgaggaactggcgtgagggactgcataaatcgaaatctaatcgttattcaattagttagtaggtgaaaatgtacaataaatatttctaaaatcgattcatatataaataattttatatcactttttttttaacgtcctagggaagcgatattgtatcactgccatagtaattcgtcaaaattatataaccacgataaggcaaaccacgagctg

SEQ ID NO: 11008 - DNA, 476 bp, Saccharomyces cerevisiae
ctagttggcttctattaatctttccacttaaaactcaaacttactcatatgcgcatcggctatagcccagaactagtattttcattttatggaggaaacaaaattactagcgccatcacggctcagtcgttattttggcgatgccctttgctgacacgcgtctgaaaaaatacacaaaaaataacacaaaaacgagtaatgccatttcctgggtggggtctctatccatagaggaaaaaaagtgacaggaaggggacaaattcaactattcactgtagtcatctaataatttttttaacttaatcacaccaacaaaaacaaaaaaaagctaaaactaggttgaaggattttaagagaagttattgcaccggtgtattaacatatataaggatacgtacgaacataacatcatgtccagcttagccgatacagtagagggtagcgaggccaaacgcggcagattttccaacaatgca

SEQ ID NO: 11009 - DNA, 420 bp, Saccharomyces cerevisiae
gacaggactccattccacaatggaaataacagttacgactctaattcgcattcatgggacactgattacttaaaaaatatagacggattcatagaacgctgaagcagaaaagctgacacgtttctcccactgtaacattaaaaatacgtcatgatagcaatgataatgtgttaactacttaggtatgtacattatatagataacggaataaaaaaagatacgttcttattatcatcactcaacacgagctgtaattcccgcccattttttcttcattatcaggttgcgattttgaacaaaaaaagtgaaacttgaagttacgatgtgacataaatttgttaaaataaaaaagataaaattcaggatagaagtaggtgcaacgcgaaattgtctctgtctacttgtgccttgaacatcgaa

SEQ ID NO: 11010 - DNA, 482 bp, Saccharomyces cerevisiae
aacgttttggctgtaataccaaagttttttgtttatttcctgagtgtgattgtgtttcatttgaaagtgtatgccctttcctttaacgattcatccgcgagatttcaaaggatatgaaatatggttgcagttaggaaagtatgtcagaaatgttatattcggattgaaactcttctacaatagttctgaagtcacttggttccgtattgttttcgtcctcttcctcaagcaacgattcttgtctaagcttattcaacggtaccaaagacccgagtccttttatgagagaaaacatttcatcatttttcaactcaattatcttaatatcattttgtagtattttgaaaacaggatggtaaaacgaatcacctgaatctagaagctgtaccttgtcccataaaagttttaatttactgagcctttcggtcaagtaaactagtttatctagttttgaaccgaatattgtgggcagatttgcagta

SEQ ID NO: 11011 - DNA, 437 bp, Saccharomyces cerevisiae
ggtgttcggttactttattctgctttaacgccattatgattatacaattgtattacttattttttaacctgtatattaaaacctttattttatttcacattactcatcatgtggagtactggaattgtatgccaaactttgccgggaaaactggtatattgccgttttctgtatcagttgctgatatagatattgcattatcattcttttcatcatcggataaactttcttgaaagcctctagtgaataccagctctgtcccggcagatattaaaaatcccctccatttgccttcccataatagttttaaagtcttgtcacgtaatgacgtgcttaatttccaaacactggtaaaaatggaactatttattttgttatcaaatttttcgatggtagatctttcttcatcgatttttcttaatgacgacgagaatgca

SEQ ID NO: 11012 - DNA, 497 bp, Saccharomyces cerevisiae
acacacctaattataactacattcgcacgcattcatatatctattttatacactcatgaatatatatacacacacacacatatatatatcacatatatacatatatatatgtatatatatatgcaagccgcattactttgtattttctttcctttgttttccttgcatattatctcgcaagacattagaagatgaaagcaaaatcaaaaagcaagtccatcgccgtactacaagcctcgccacgactatgccaggacacgaattggaagacgtaataaatcaacgtttgaacctatatgatgtattagaattaccgacccccctggacgtccataccatctacgatgatttgccccaaattaaacgcaaatacaggacccttgccctgaagtatcatcctgacaaacacccggacaatccatcaattatacacaaattccacttattatcgaccgcaactaatatcctcaccaatgcagacgtgagaccccattacg

SEQ ID NO: 11013 - DNA, 401 bp, Saccharomyces cerevisiae
taaacaatcggtggttaaacaatcggtgtttgaaattattttcatgcctttcaaaaaataaaataacgatcattctattgggaatataatagaaccttatgtatgcatttttcggttttttattatttcatgtactatatatattaaaaataagtctcaataaaagaaactagtttccgaactgtcttagatagtcttcccttatgtgctcctccatttcattgccgttgagtgcttcgacgtggcgttcgtgtcccctctgttggttaagcagatttacccaaatatttacgcagaaacccatggaatcctcaatttcacgctttttcttgggacatctgcacctgcagccacacccaaattcccttccctcgtcgtaggccgcgtttttacgtttgaat

SEQ ID NO: 11014 - DNA, 500 bp, Saccharomyces cerevisiae
tgatcaataaaatcaaaaactacttcgaaagcattcttaacaaaaaatcattgtagatagaagaataacatcagcaaccaaaaaatatagaaggaaactaagcaggagagtataaaccatattcacttttgctttttattcttgatattgctcatctttttttttttcgattcttttagcgatctctttatttttagttttagggtttgaatctaatcgtcttcactgtacattacacataagcaaatatatatatagttttttttgttacgtaaacactctttataatataatacaaactattaaactttaagaaaagtatgatatgccgctttatttcttcatcaaatataatctcaaaatatatggatcatgagtgttgataaataatccaatagcctatcatggactatctgtttgacattctaaaaaaaaaaataaattgtacgaactgcagtaaatcggtattatcatcatgacgcacgatatcaattctttgc

SEQ ID NO: 11015 - DNA, 486 bp, Saccharomyces cerevisiae
tgactggcttaacgctctattcatagcagcacgtatataccgagaagagctgccataggggcacatcaaagtcaagagcgcagaaccaaaccaaaatgtttatatccaaacaacccggcgttatagatggtcgtcaacggacaaataatatcaaggcatgtatcaatatggagtagatatagaatctacaaaaatctgtagcagaaagagtctcccgaaaagacatactgcagaacggccgcttattcctcacttcaattgcttaaataatacaaagggcaaaccacagagtaccccattgccaaaagacgtttattacattttggaagtgataatttagtatataagacagcttactatatgatgaattacagtgtagttcagcgtttatatgtggcttcgtttaaaatgatatatatttctagtaaaagcaaaaattcacaaatgataaacaaatcaaaataaacatcaaaagaaccgccaatt

SEQ ID NO: 11016 - DNA, 492 bp, Saccharomyces cerevisiae
taaattaccaaggtcttttgaaagagttcgaacaatacaaagagatggcaactcctttggaaaagttcaagttgaaccacctccgttgtctctattaatgaagaagccatgaagtatgcgaagttttaactgaatcatcttcaataattatgggatgtctgggttttaaacgtttcataatattcaattttgaaacaatgatcccaatactgctttttttttgactaggacttggatttggttgctggtgcgttagaattgttgtctgtcctgttatatttataccggtgaatgaaatcataatcccagctctgtctttacttctcatcgtcctttaactttggaggtgttactgtcgtacgttccttctaggttttgcacgcactatctgaggcgttataggttcaatttggtaattaaagatagagttgtaagatggtggataaaaataggacgttgcatgaattatcttccaaaaatttcagcagaacg

SEQ ID NO: 11017 - DNA, 409 bp, Saccharomyces cerevisiae
gggaatttgtacttggttccctgcatttatgttctttgcattttgttttcgcatttaatcatagtacgacaaacggggaaggggattgtgattttacataaggcccctcccatcattgagaaggttattaatcaatacatatataagcattttcttttatacattaattgaactgatatttattttatgacgcaataaagcctctaatgcactgctattattgttactgttagtaaatattcaactagcataaatgattgatgaggggattcattgcaaatcattggtgagttccctttacatactaaagcgcgggtaaccgttacttcttttatttttaatctaatggaaaggcgaataagctactgccctataatactaaacttgaaaagaagttgcgtttgcaacc

SEQ ID NO: 11018 - DNA, 410 bp, Saccharomyces cerevisiae
aaaaatggttccgcaaaaacctgatttccttgcatgtatcacattatatgcattgcttttcatctttcccccactataataagaataatattttctgtcgcattttttctttttcttttattatttgttataataatattttctaaaccgactaataataagaataacatcgataatactttatctcttcaattacgttaaattatctttttactattacattacaacgtgcatataacagaaattttttctttttctgtctaacatttgaattgtactatgaattaaacccgccatcttttttcttaactaccattttgcgaactcctataccgcttctgcaacaacaagaacttttattttcaattttaatgtgccattcattccattttgcttgcgctaatgtgaat

SEQ ID NO: 11019 - DNA, 414 bp, Saccharomyces cerevisiae
gatcggttctggtattttaaagaaggcggaaggaactaaactgcttctccattgtaactatattaagtgtctattagacctttctgtttttcctttttatttttctatatataatttattgggtatataattaacggtaacatatgtcatgcatgatataaattttttgttgtgtcttcctgttttctctgttgctctgtttaggttcattgggcactgttgcttacttgaacatgattgagtagcaaacacattctgtgctttgttcactttgatagtgtgacgaaattttcacaaccaaaggaaaaaagctcacgattgcgcgatcctgtcacggagaactgtccgcagcagcccgcggcttctgtccttattcgcccatttttttttgattttcgactttttcactctggc

SEQ ID NO: 11020 - DNA, 421 bp, Saccharomyces cerevisiae
aatagaaattaattgttgactcaccaaaaaattacttgggcaccaatgaataataccacttataactctatattaatccaagttcaccctaaaaacagataaaattgacaattttttttgaaggacaactgattgatcttagtgatggttaggatgaaaaaatgggtttgttcacgccatcccgcatcattcaaaaactccgcacagttttggagttcagtaagaaggggacgtaatcttactattgcatttttgaaagtctaatgaactcaagtggcaaactgtgttacgtacatcacttctaaatacaatgtctttgaattagaaactcgctgaaaaattattattgcgtattgtatgtcatttttgagattttcctgcaagattagtaatgctttaaacccaagtattgtaagcccga

SEQ ID NO: 11021 - DNA, 482 bp, Saccharomyces cerevisiae
acgacggagtaataatagcgtatggtcactaatttgtatataggtatatgtttgggccaaattcggcgggttcctgaatttgtttttatatattcgtaacttaaacactgccggtgaacaccatctgcataccaaattgctttcttccatattgaattcgcgcacatcttatcgaaggaaaaaaaaagaagaaatagttaatagaggtaagattccttcatcatactcattttattctttacaaaacataaattaaataagtcaaaatttaactacataaaatctcattaagctaagacgttgtcacctctcttttcatctttcaagttacgcaactgtttcaaaacttcttcaacagaaacagtagcatttttaccctgttgttccataacgtctctgtttctaatgttaacagatttttcattcatttcttgttcaccaacaataaaaatgaagttatattttagcatttgcccgtttct

SEQ ID NO: 11022 - DNA, 414 bp, Saccharomyces cerevisiae
aaatagcaatggtggttaacatttactacatatcataagatcttctcatggcattttgtcattattttggtatcgtcggaagtgatgtattcacttgaaggtgaaaaaaattgaaaaaaaatgaaagcttggatgaaatcaattatattgaggatttcccattagaaataagctatgggcgaaaaggaaacaaacatcagctggattttttcgccaagatggagagagagctagggatgtatggaaatgataggagtagatcaagatcacctgtacgtcgtcgtttgagcgacgacagagacaggtacgatgattataacgatagtagcagtaataatggtaatggcagtcgtcgtcagagacgcgaccgaggctcccgtttcaatgatcggtacgatcagagttatggtggca

SEQ ID NO: 11023 - DNA, 472 bp, Saccharomyces cerevisiae
ccaaggacaaatacccatagaaaatgctgcccctttttaagagagaagatggtagataccaatactcagaattcatctattcataactttttgggtttttattacatatagagtgacgttttgatacgatttacattttgaaatatatagatttttgtatattaataagttttgattttcagttttagttatgcttaatgaatttttgaatcagaaaaagaagttctgaaaaaaacataatcctgcttgatgtggtacaacaagctcataaataattttaaaaagtttgttaatccgttttcaatatcttgagctcctcaattgtatttgctgaggtctgattatttctataaccaaaagcggttattgaatctatggagaggctgtaacccgtcttatgccttccgggtactatatttcatttgcgggtgtcgatggattaaggggcggaggcggccctttttaggattta

SEQ ID NO: 11024 - DNA, 411 bp, Saccharomyces cerevisiae
atggctcacaaaagtgcattgactgttctggaatatacatgggtacgcaagagatataaaaaatttataataaacgtacgttatgcccgaagtgtgtcccgaactgcaggttaaactaaagctttttaattactagtaggttggaggtttaccataccaaaatgcgttcttctttaggccttgcattactgaagcaatactggaaaattactcttatgatgcttttaaattattacatttaacattatggcatggtgtccgcttaagcgcacggaaagattttatagtaccttagtatgactattcgtcggcattgctttatggtcgtactcggagtaagaatattttgtgagtgagctggtaagatgaggatattgtagaatagcatttgcacttatgtgtattcctggt

SEQ ID NO: 11025 - DNA, 425 bp, Saccharomyces cerevisiae
aatagactaaataatcgtatgtttgctaacaaaaagtacgcatatgcattttctcaatattgtgcattttctaaatctccattcacctttgttattaacatagtcatttaaaggtatgataattcagtattcatcttttccacagacggcgctgcatgccattcgtctgtaacttgcctagggactgcgccgcacataatcgtgacagaaatttcaaaagtgataggagccaaaagtgataggagccaaaaagaacatatataagcacgatcaaattaactgaacttgaccacttttctttcactgtcagaattggacgaaggacaaaaatgtcaaatatcattgcaagatttcacaagattcaagttcaagacggtgtaaaggtttggtaccgtgaggccggtgcagcaggtaaccccacaatt

SEQ ID NO: 11026 - DNA, 477 bp, Saccharomyces cerevisiae
tattaagtcattcttcttttcggtaaaagaatgtcttgtattttgataccctcaattccccttattattctttttcttccgctctctatttattattatacattgggattccgttatatttttctcctttcagttcattttacttcttaaaaagtttcgttgatcgctattatgctatggattcaaagattttcttttctctctcttcaaggtgtactctgcattacggttttctttagttcgtttattttttttttgttaacaaggtgtttgtatacatatatataaatatatggaaatattatagtgtttattttgttacttcctgcgagttgcaacagaactaacaagatgccatgctgttttttttcattttttggctataaaaataacagtatcctagtccttgtgttcggctttaaaatggaattgcaaaccccataattccttcttcacaccgaacaaaccgcctagtag

SEQ ID NO: 11027 - DNA, 432 bp, Saccharomyces cerevisiae
cttcgtagaatcgaacaatatctcaccataaaatttttttcacaaacaaaaaagacgctctattatacaaaaagctgctgcggcccttcttaatgactaaatcttgacaactgagctctttcacacctgtgcaaaatccaatgggagcaataaatgtaacatatttttttaacataccacggtagggcaatgaatataaatagatattggaccgtatccttttctgatcatcttgaaaacattgtcttgcctctcaacagctttatctattcttcacctctcttcgtttgactatttcagcatgtattttttcacacaatttttcttccaactattttccaatattactacgagaattccgaccacggaaaaaaacttgcgctgttccaatcagtcccattctatccatctacctgccagtggtttcgtaat

SEQ ID NO: 11028 - DNA, 480 bp, Saccharomyces cerevisiae
agtttgtaaagatggtatattcagcggattcttcctctatttttatgttttttgagatatttcgagctttctatttttttaaaatgcctgaatttccatcttcaaaaaaaacataaaaaaggtactttaccaccaaataaatgataaccacaatttactttacttatcctccactatcaagtatcttcctaccaggaaaaatgaatttcaaatgattcgaaatttacggaggctcaatatagagatagtgtgacgatgttcataagggctttaccgcttagcacgtatctacagttttcactcaataatatattctctaggaatgattgccaatagattgatatccaagagaaggttcaattaaggaatttcatttcgttctaatcttttgttgaaaataaaaatttttacttatatgttaaagcttaagattccacataaggtcgaagacaatcgtcactaatgtgtggttctgcctgc

SEQ ID NO: 11029 - DNA, 411 bp, Saccharomyces cerevisiae
aaaaaatgaaatttgactatacatattttcatcattgcaagaatattatatccatttataagtaggtaggtgcatagacgtatatacacatatattatagactaattgataaatttttttttcatcttcgaagataaggggtattccagttgggcaatgctatttcttgaccaagatcttgcttttgttccggatgcttgtagacgaaaattcttatcaatttggatggcttgtaaggtaaaccgtgcccaattatcgtgtctctaggaaatgaaattttctcttcagattgtaagcaggccaaactccatgcaaactggtatgaaaaagaacattcactatagttgaagattgcttcaatgctatttacgggttcgattctaaagagtaaccacggcttcgatatctgat

SEQ ID NO: 11030 - DNA, 490 bp, Saccharomyces cerevisiae
aataagaaactgcgagaccaccttcgctggcaagtagttgacccaactccatctttgtagcttttcttggacgaaaagggaataaaataaaactaagctacaacaatttcgcacttcgggggcctttgagtatacaattaaataactcatcatgcatatatatatatatacatacaatggcgtatgtaaaaactgttatataacattaccgttgtactattagtataaaccgattctcactattcgccaaaaaatatcgcactaattaattcttttgcgtcgtctcttttcaaaatgtgaaatccaatagtgacaccacacctctctagcaatttttccttatcctcatccgtaactttttcacctttaccctcgtacaaatctggtaaatccttttttagaactaacaatgcactaattacagtatcaaccaagatttgagtttcttctttagtaaatttggtcctagttggattggagtcatcgttca

SEQ ID NO: 11031 - DNA, 489 bp, Saccharomyces cerevisiae
tgatgacatgtatgggttgaaaatatttagaggatgctaaaagtcccgtctaaaatagaggaagtcatggattacattatcacctttattgtcctgttccgtctggctaatttgggacgaggaacgtttgtctccattcgcaaccttttgaaaccatatgaacggcggctaatctgacagatgtcttatatttctaggattgtagaaagcctcctcatcaaaccaccttgtttgaaaaaggcactagtgcggttgctttacttgatctagtattctcctaccttggagcggtcccatatcaactaaattcagttttctgactgagttaaaaactaatgtagcgacaccacttccattggtgcctccgttattttttttttgtatgttaatgctaaataatacaccgctatgtatttcagggcactacttctacacatcaacggtactaaacatttcgctcaagatcggtccgctttcacgtatttggat

SEQ ID NO: 11032 - DNA, 443 bp, Saccharomyces cerevisiae
tgttataccatagtagtagtttcaataatatattccactacttatatgtgttacccgcattagaactcttattggtggcgaaaatcgatggcaataaagaacggaaggggtttaatagttgtatgcttaacatatttcgatttaaatatataagaaacgtcggtagcacaacaattaactcattatttaggtatggcggaaatacctgatgaaaccatccagcagttcatggcattgaccaatgtgtcgcataacatagccgttcaatatctctctgaatttggagatttaaatgaagcactaaattcctattatgcttctcaaacggatgaccaaaaggatagaagagaggaagcacattggaacagacagcaggagaaggccctcaagcaagaagccttctccaccaactcttcgaataaagccataaatacggagcacgt

SEQ ID NO: 11033 - DNA, 426 bp, Saccharomyces cerevisiae
tgattggaaaaatacttatagacctgtaaattaacgggaggaacatcgttattattttcctatgattttttgaaatttattctcctcaaaaatcatatactactttttctttcagaaattatggagcttgaaaaggctgctgatataaaagtcttgcgatacatgttattttatctacctaaaaaaaaaaaaataaaagaaaattgtctatctgcgactgctctataatggagatgtaatttttgttcataaatttcttacacttttttggatgcctagtaatgaatttttaatgttcttgacattttcagctttaacatcaagttcttttaacaagttgccacattcatctttttttaattcttcatatgcttgtactaaagctttagaataacctttaaatacatcatcgcaacaactcctcaa

SEQ ID NO: 11034 - DNA, 413 bp, Saccharomyces cerevisiae
tgacagggggaataagaagagcttctccataacaggaaagctatcacagcataaaatatctatgtcattttataaagtttggtatatataacacgtaatattagcatctgaggttcgaaagctcgcatgtgtgtcttttctaaaaagttttcgtttgaacttttccaaaagcttcctcattaacgaaccaggatgttttttcaccaaataatttgttaaccaatgcggttggcaattgatcgtttttcaagtcaaagatctcatgcattatattttgtttggaactgccctcagccacaaaacacagggctttggcgtctttcaacacaggcagagtgaaggtgattctgtcacttggaggcttgggagaatcgtggcaccaagcaactcttttggttgtttcgttcagcaag

SEQ ID NO: 11035 - DNA, 479 bp, Saccharomyces cerevisiae
aaacgaggctaaaattggacggttccgtccagctctttcatgaaatattttctttgtaattgtgcatatgaccttcattttctataattttccgttcgaaaaagaaatattttcttcttttcaatactcaaaggcaatatcactgtttgcattcccctagcatttattacctaccaaatacagatgcacaagattagataaaatcttacataacacaaaaatccagtccataactaacacaatcattactattatataaaaggtattccgacaccaaccttattcttgtattctatgtattccgcgctaaagaactctatcaaatatttttcttccacacgaattctatcactgaaaaatttccaaagtacaaaaatgaaaataaccaatgataggggatttagaagcagtagctgagtgccaattgcccaccaaaagaacccaagataacttggatgtcttgaccaggagtaaacgcc

SEQ ID NO: 11036 - DNA, 448 bp, Saccharomyces cerevisiae
tttttgcaattcctttttacactagccacgaagtaaaatggaaaagtaaacccgagtttcggcaatatcgctaagcaagaagagcaagctcgtttaagtaagcctttatgaaaaaaaaacaaaatataaagcattataaaaattgaatcacatcgcaaatctgcaatatacttggaagtgtttatagcaaagtgtggtatagaaaaagaaccaaaggccggtatgtcgttaaaggataggtatctaaatctcgaattaaaattaataaataaactacaggagttgccatatgttcatcaatttatccatgatcgaataagtggtaggataactctctttttgatagtggttggtacgcttgcattttttaacgaactgtatataacgatcgaaatgagtcttctacaaaagaacacatcagaagaactagagcgtggaagaatcgatg

SEQ ID NO: 11037 - DNA, 478 bp, Saccharomyces cerevisiae
catttgcttcttgtgtattcacctttatcccaaattagcccttgtaacacttatgcttttcttaataaattaataattggactttcctttaaagtgggttgtatctgtaacaataatctctaataatatcctataaaactcagaagtcagccaacaacaattgtatacgtatacatatctatataatatgccttgtactttacgctcttgaatttagaatagctgaacacctaactgaatttaagtaaaggatcccaagcgtgagatatttaggtttactcagttttcttatcttgccttttgattatcacgttgagtgtcgaagaaacctgtattcatcctcggcttcttgtatatgattctaaaataatgtgtgaaaaaaaaaataaaataaaaaaaagaggaaaataatatagaataactattaagtttcattaaaaaaaaaccatttgaatatacgaccaaaaacgttacgctt

SEQ ID NO: 11038 - DNA, 411 bp, Saccharomyces cerevisiae
caataaaaaccaatagcatcttacgatcgttcgaggtcttataaaccgttttatataaattattcttatacacgcactcttgagtttcttttaacattccaacatgatagacatagaaaagaattatagataacacataacattactcacaagtagcccatgagtttgatttttcctcgttaattcggtgtcaagtggaatacaaaatgggtcaactgatcataactattacccggataatctacatcatgtggtacgttaacgatgtatggtttcctaaatcaccgggttccagatgcgggttgttgttgttcgatcttgcacctccacgtactccttttgaatagtacacatataccttacaggagatcggacgtgtgcgattattgttacctcgtcacctgttatcgg

SEQ ID NO: 11039 - DNA, 432 bp, Saccharomyces cerevisiae
gaggcttgagagttaaaaatagatagctaaatgtatttcgagtctccctatgtatctgcgtctctgccccatagcacctctgttaagtttttatcaatattccatcggcatatttgaaaccgcccggatggtattagagaatcactcagcctcaaactcagcaagtaaaagaggacgggacggactttcaaatatgtctttgtacgttattgtttttcatccctaaatggcttagtaaaaaagttttgccaagaattttttgacgttcaatggaaaaatcgccaagagaaatacgcacaacctccgttttcccgccttttatcaaaaaatcttagttttcccttcctttttttttttttgggtcgcagaaaagaaaaaagatagtagtggagaggattacctgaaaaaaacaggcaaaaacgtcacatcctt

SEQ ID NO: 11040 - DNA, 480 bp, Saccharomyces cerevisiae
tttagcccaccgagatttttgctttataaatattttagcatactttgcattcatatacatattcatatgtataaatattctttaaattttaacgccgacttcgaactaattagcagtcaaaacccaaatgtaatgaccttatggtgttatagcataattcttcttggtgtacaattccattctgaatagttcaacgattttagatatagttagatatgatattataataaaatatacaaatatgtatcattgttagtacaagttaaacctaaatataataaagccaaccaagacaggaaccagtagaaaaatttatacaaatgacaaagaaaaacaaacggtattttcctatttattaaaaatgcttgagcgaatggatattttaacacattagtgtcctaaaggacaattggatttgaaaataaaatgacagtaatagacaaaaagaaaactgaatgaatgaatggacgtatggattgc

SEQ ID NO: 11041 - DNA, 458 bp, Saccharomyces cerevisiae
ccttgttaatagaattgtttttctcctattatacaaacacttttcgttttgataaattacataacctctcgttgcattttatttcattatatagatacattaaaaataaaaaaaaataaatctacaattaacaatctcctcataaagaaacacgggtttttttacgtactcgcaacttcatataatgttttatttttgcgatatcagctgcatatctatatgtcatatttataaaatcgcagagatgtcagtacccataactgaataattaggtccatctgtgcgcttcgttatcaccactccaacttcgttcagtatatcccaattcctctttcactctcttcacagtggcaggatctcccatatttttacctaagttatcagaaattttgatagcgtgattaccatttacttctaatagtttgataacgatgtttaacggctcacttttaacctgg

SEQ ID NO: 11042 - DNA, 465 bp, Saccharomyces cerevisiae
cactaaacaccttcttggaacaacctttaaatattaaaagtttactcatacctcttacactctataaagaaacaagttggtgagtccaatagaacccattccagcatccgatgcaaccatagcccggttgatgcgagtcagagtggctccgcacacagaggttatgtgaccatggtaaccgtacacatttttccacggcaaggaagtggcgcgaaagaagcaccgccctccacggatcaccccatttggaaaagaacggagacataaaaaaaaattaccttcacgccagactatgtatgactcgtagaaatctagcatccgcggagctattttaagtttccgcggatgcctttcgatcctttcccagtcgtctggttccgcgcacatatgactaaatgtccgcccatttccgtttaaatccgttttctattttctttaggtctttccattgtattccctgcaacc

SEQ ID NO: 11043 - DNA, 451 bp, Saccharomyces cerevisiae
tgaatatttgggcgtttttcgctattttagcatgctgtagtgtatgtactgtgcatcgtcatgtagcactatttcagccgtatttttctttttttctttcgcaccgtctgtggttgtaaagttactgacacttttttttctagaaagttccggaaaattgcgacactcggtggagctcgagagttgtatccagttttcttgttcggcgatattccgaaccaggtcgggttgggctaacagccgcccaggatggaagaattaagaatttcatagaagccttcagttcttggcgaagtaaagtggcaaaacaaatggaagatctattgcattacatatataaaagcattagaacaatcttttctcattgacaggtattctcattgctctatatatattttcttcttcttgaaagaaatatcagtattacaatcataacaacaaccaaaagaaa

SEQ ID NO: 11044 - DNA, 490 bp, Saccharomyces cerevisiae
aaacctgcctctgagggtcattcacgacctagcataccactatatacgtgtacgattttttttttctgtgaccgcactacaccaaagtttaatgttccattggccccggaaccattcttgcaaacggcgttctttttccgctttcgggtgacacttaatttagcttcttttccctctctgacacctcttgttatctaatctgtagatccgactctttttctttttggtgtcgttcttctatgtccgtttttctgtcaacaaaaacggaaataataggtagaaattaagagccgtacgtgagtgagaggagatccgaaatgagctgacagtataactaatataagcttacaagatattcgactatttcctgggaaaaaattcattcctttgagaaatccttaataaaaacagactaactactaaaattttagaaatttaagggaaagcatctccacgagttttaagaacgatatgaccttggcacccctag

SEQ ID NO: 11045 - DNA, 432 bp, Saccharomyces cerevisiae
tggaacctatttattgtcaagtgtgtcgttttctctcgattcttgttttctctcatttctttattctgcataatacaacccaagtatatacttacgtatgcatagccttcagaacaaatgcatactttatctaatatcaaaatataaacatacattagtcaaaaaagacttgatgagctttcatgaaactaaaacaaagataattcattatttatctttgattccactaccgctgacactatttatttcttgtgtttccgtttacgacctggttgcgcccttaccacaggtatgctaccattatagtttgtttgtaatactggaaaggcccttacattgtttataggaaccttggaaaccttctttgctaagataacctcctttagtattcttttcactttgaagtataattctcgttcctccgtagtaggc

SEQ ID NO: 11046 - DNA, 478 bp, Saccharomyces cerevisiae
tgactgcaaatgatactaattcctgtatttaaatatactcatatttaacgaacaattatgatgaatgaaaaaacctgatataatagacttaactaagcgatcataaaaaaattcaaaaagttattttataaaacaattcagatgttaaactaaagagttaatgtaatatatatacaatgaactgcgtcataaattcccatagttcagctcatgggacattatctacttataaagacgtggcttggcagcatttcatatataaggctactgaatgtaaatttttcttccattgtctttcccgtgtcccgagaactcaattcaagcactgttcttgggcgtaataaaccttccggtactactaaaatcagacaaaggcaggaagcctcgatttgaccttttaacgggtaaagctctaaaagttgctctctgctccatattctcgttttccgtcatttcagtatctttttcccctgcctcc

SEQ ID NO: 11047 - DNA, 419 bp, Saccharomyces cerevisiae
aaatttggattcgagatagtcaatcaaaccttaatgtaacattagtaataaattttatcttttctatagagtataaaaggttattagacagagtttatcagctgtatagagtaatcatgccatttggaaaacttcccaaagcgatagcaacctcgataaacgagcgaaaacatttagctctctttcattgaccatctttaattgattcaattcgcttggtaatagtagttcgttctctcttcctttaacatcatctctatttgccttttttaataatgtagagttttcttgctttaatttctcctttttaaaaagtaaatttgccatattccattccaagttttgtctcatgaaattataggaatgcgtttctttgcatctaaacaaaaaaactgcccttgatgctgatctatcggctg

SEQ ID NO: 11048 - DNA, 454 bp, Saccharomyces cerevisiae
gttagtgtgctatatagtggccagattcgccttttaaaattcactatgcggtgtgatgatgtgctataccattttttccatgtttaggaaaatgaaaaatttgcaatgcttacttcagcaaaaaagtatatttgaatcaatattcatttatatatttcagcataatcaatcatttttcgtctggatatttgacacaattttgattttgacgaagacattttattctcgatggatattacagaattgttacagtgctttgcctgtactttggaccataacgctgccgtaagaactaatgcagaaacacatcttaaaaatgcaagtaaagtaccgggattcttaggcgcatgcctggatatcattgctgctgatgaagtaccagaaaacatcaaattatcagcttccttatatttcaagaataagattacatacggatggtctgctggtgcaagac

SEQ ID NO: 11049 - DNA, 454 bp, Saccharomyces cerevisiae
agttcggcagtcatataatcaaagttttgatagagaaagcatttatataacatataagcaaatgaccaattaatggtattatttagtgacgtttacagctggcgcggtcgcgttacacgggcaagaaaaaatcaaagccacatcaataagtcatcaccattagagagttgcacgacaacaaactagaacagccatgttcgggtgaagaggaagtgcagcaactcaagtttttctacagactaaattgtttttactcttgactccaaaagcccttttttttttttttggtgccatataatagacgctcttttatggatcattcaatagaagtcactttcagagtaaaaacacaacaggttataataccggaacaaaacatccggggaaatgaacttcccttacgtcggtggcagatggaactcctcatgttagatgcaacaggaaaggaagtgga

SEQ ID NO: 11050 - DNA, 500 bp, Saccharomyces cerevisiae
aataaatgatatataatacccgagcaatctacagcaaagctcagccccacctttccgcattttaataacctgcattttgttcaattccaccctcactccccttctcaagtattccaaaccaatttaagtaagtattgatatgtagttatttttaaaataaatatatgtaagtatatttggatgctttaattaggaatgttctattttttttttattttttatattatggaagaaaatggacgtgacgaatcaataaaagaaagaacagcgacgaaagaataagaagacggtgggaacaaaaaggtattatgactgaatagattcaaaataggaaggtgacaatgaaaccaagcctattcacttcttcaaattcttataatacatctttctgattaatggatgatgttccttcagttctttgtttttattggtactgtattccatatatgccatatcttcaccgccagcaagaccagacaatgaaccttcacctctaacgg

SEQ ID NO: 11051 - DNA, 431 bp, Saccharomyces cerevisiae
tattcacaagaacatttctgccatacttctaaaatttccctatattcagcttagcagtgacacgttgtggtctgtaggtcaatatgtaagtaagaaacttcaactcacatatgcacgatgcatgccaatggaaaaatgcaaggaacgaaatggcgccacggcaacaagtttttttttttcgccagcagaagtacacgaaatgcggcttcatgagcctcttcactgctttgcctaaacgggaaatgcagagaaaaaccagccatcgcgtgtgcttggagagctgacgcgactgtaatcaaagaggcgatatcaacaccttttatccagcactattcaacagtgaatgggctcccaagtaagtcttggcattgtgctttctattcttaagtattaagtagaagttttgtttactgggtttgtttattcctggc

SEQ ID NO: 11052 - DNA, 422 bp, Saccharomyces cerevisiae
acgatatatcacgatacacgactctccggcgccagcgtttttcgtcagtttttctcaaggcggtataaaaaatcgatgatattcgattgaggcacttgttaacaagcatacactgttggaggcagaacaaaacaagcataactcttttgtactgtattgtactctaccgctctgtatcacgtcggcacaccaacggtttcttttggcgggtctattatatatattatatatacttttatcaagacatcgtgtgagtaagtgaggttaaagctcaaaaacctacaagcaaaggcacaaggaaatcgaaaggaccaagaaaggaaaagaaaagaaacgatacgataagtaaagacactgtggaagaattgaacaatgtcagcacctgttcctcaattagtaaatatttctcatgccttgcaagc

SEQ ID NO: 11053 - DNA, 422 bp, Saccharomyces cerevisiae
tgatagaaaatttaaaagtgcagaatattcgaaatagattcccaaaaaaaaaaaaagggatattgtgttacccagttcacaatggaattttctagaagaaaaaacaaagaagcctcgcaacaaaccaagatggattcaaaatgcctacttaccgcattgtatgtgggagaatgaacatatctgtaattgtattatataaaagtagttagtttttttttttttttttttttttttttttttttatgtgtaatgcaaatacaaaaagaactgcaggcattttgaaagttcactcgtataggaaactttgatagagaggcaattccttactttcgttattcctttcagtcttattcttaatcgtttatagtagcaacaatatatcaatatggtcgtgaataacccaaataactggcactgggtcg

SEQ ID NO: 11054 - DNA, 444 bp, Saccharomyces cerevisiae
acatgcgagagtaagagatgccccacgaaggcataggcagatccatatagcacaatacgcgcatataaagtagcattgctgccaaagggggttgcacaaggagttgccctccttcggcacgcggctcggaacataccggagtgtccccctttgagtaatttttctcaaaagaggcacttttgcgctgggccgcaggaaatttccctttctgttcagcacctgttgtcctatattaagctgtgccaaacaaggtcatctccaaatacttaccaaaaagctagggcgtactgtactggaatctctgcttttttctttaccttacttcaatttgccttgtctgcttttttacgtgtgttttggcgtttctgcttttcttttttattactcgttgttgtaaatcattttctaagtattatacatactatatcatcgcatacccaatcg

SEQ ID NO: 11055 - DNA, 400 bp, Saccharomyces cerevisiae
aagaaaaattgaaaggcgattatcatgataaactatacaatattattagcataaacctgtatatatacatatgtaagaaaaaagggtatttaaaactctttttaacagcaaatcttttgtccttgtaaaaacataaataattaaactaagactaattatacaatgacacttttttattaagagcaaaataaacaaaaagaactcctatgcattatttttcgttttattttaacttcttaaatggaaagcttctccttgaacaaactttccaaatcatcaactgcatcctttatagcggctggtttatcacccataccttggaaaacattacctttaccaccagccttaccgccgatgatactggacacctttttggcaagcgcagaaccatcaataccct

SEQ ID NO: 11056 - DNA, 460 bp, Saccharomyces cerevisiae
agatgaaccaatgtaataaatgacaatattctataatagaaaatatatagacgcttgtaaataataaaaaaaaaaaaaaaaaaaaaaaaaagtaaaaaaaaatttactataaagatttaatagctccacagaacagttgcaggatgccttagaatgtcaagtacaacgtacacatgacacttggtcccatgcagataccgagccagaaaataacatttccgattatggttctgttcctcatgaatttagtatttgttaaagctactaatggcatttgcagcatttggaagaagaacaagtaaaacctcaatttcttgaagataacgtacattgctaattcatgaacgacggaacttaagaaaaaggtcatcaaagttgcttgactcttgttcaatttgaatgaactcattgaactatggtaaacatgtcttaacaaaaacttatgcactgggatgttcca

SEQ ID NO: 11057 - DNA, 461 bp, Saccharomyces cerevisiae
tatggcgtatttgggattgcttgctcgaaagtgtctaagtccggctggcgggcctggcgccctcgccgaagggagataggaaggggcgggggtccgggcagcggctatggtgtcagttacctagggaaggagaagggggtagaaccaaggggctagcacactcaccctggggcccccgtctagccaagcttaaatataaatactaatgtaactataaatataaggatctaccgtgtcattgcacatccacccacccgtcgattaaaaaaccaaacaaagcaaagaatacaatagcaacgcaagatcaacacaatggctctcatcgtggcatctttgtttttgccctaccaaccacaattcgagcttgacacctctctccctgagaactcgcaggtggactcatctctcgtgaacatccaggctatggccaatgaccaacagcaacaacgtgcgctttctaa

SEQ ID NO: 11058 - DNA, 468 bp, Saccharomyces cerevisiae
taatgtggccttttgaaagaaaagttagtgcttttttttcttttctcaaaccttcacctggtggtgcgtatcatttataataacatcttgatgcttttcaacgagatagtgcccattttattttgcatgtattatacttccagcacccggtgtgcattatatgtaactttagaaataatcttttgtatattattcgcgattgaatgtgcgtgctgcattatcaaccaagttttaatatatctgtttctcttatttattgttagttaagtcttcggcaaaacgatggaaaaaatcatgaactgaatagagacaagtaaaccaaattataaacaaggtttcccttctgaagagatactaaggaagaagaagaacgacccaataatatttctgaatatgcaaccatttgatagtgggcatgatgatttagttcatgatgtcgtttatgacttttacggaagacatgtggca

SEQ ID NO: 11059 - DNA, 472 bp, Saccharomyces cerevisiae
gcaacctgatataatataatttttgaatttatgatacaagaattaaaaatgcgggccagaatttaatattaaacaatactcagaagaaaacaacaaggacaatctgtttttataaataaaacaatcttatacaagactagagcaaacaaaaagcaagaaaaaaaggtaataaatgtaacaaatctattaacgttagaaaataacaaaaaaaaaaaaagaaaaagataatataatataatacctttatatatgtgatttatctagcgtcacagtatgtaatataaatatcaatgagtttcttaacatgacctccaaaactacatgatcgcttagtattacaatatgtgtttatccactattttgataccaacgtagtattgccttttatttttcagaatggcaaaggccatcggaaaatttttccaccagaaaaagcgagattcctaattataaggtgaaggcatcgatgttc

SEQ ID NO: 11060 - DNA, 478 bp, Saccharomyces cerevisiae
agtatgtatcgggaagtctccaccataaattttctacccctttaattctagcacattccctgtttcccttcaccctcatcaataattttcaattcgtcgtttcaccttttaattaattttaaatgctcatttcatttctgttttaaattttatgtctgttttgtatgctatttcatttttcatttacttctccagggaaacaagacaatattacttatatatacatttatatttatgcccattcaacatccgatttttttctataaaataagtgaaaaaaataatgaaacttaacgaatctgtcaccaagaaatgtccttattgttcattttggattttctcaagttttatctttggttgaagcagtttatgttttgtttacttggacagccaaaaagagaaaaagaaggtgaaaattttttatgtgatctcttcaaagaaattttagatactttaaatgatgccgtacgtctttgtt

SEQ ID NO: 11061 - DNA, 471 bp, Saccharomyces cerevisiae
cgaatctgagtcctttttagttagcacgttttcatctctttttgatagcacgcttaataatattcaccactagcgcagtaatatggcatctgccgcaggtgtaaaggttttcacttcgcttatattcacaatactatgcgttcaaacacggccatcagaaaagatcaaaataaggattattaattaaaaacttaaacagaaattcagtttgcaacacccttcgcaatggcgaagtttccaaaaacaaaatctccaaacaagattaacattcttcttatgtaaccacatgatatgcatattttatatagactgtacacatgaaaaacttttatcgtccaaaataattaaaagaaaatttcaatcataccatagcacactgttccagtaactgagaaaaacattgtgaagcaaccaacataatgccagattggcgccaaagtgaaccgactaaataacaacaacaggcacgca

SEQ ID NO: 11062 - DNA, 451 bp, Saccharomyces cerevisiae
tgaagaggaagcatgatatataggttaatataaattatacttgggaatacatagatagagggctagtaaatttttagtttttaattgttctttttttttgaagtattgtgtcacaaattgtcgggagttgggacatcaccgtgcataacgatacatttttttgaaaaatttgatattgaaaaaaaatcgatgagtttgaattacattacagttgtataaagcaaccgcatttcattaacgtagtttgactcgcgaagataaggcgttaaaatgaagattaagaccattaaaagaagtgctgatgactatgtccctgttaaaagtacgcaggaatctcaaatgcccaggaatttgaaccctgaattgcatccttttgaaagggcacgtgaatatactaaagctttgaatgccaccaaattggaaagaatgtttgctaaaccctttgtgggtc

SEQ ID NO: 11063 - DNA, 422 bp, Saccharomyces cerevisiae
aagctattctaggcagtaagtccaagatattgagcctttaaaagcaaggcaatagcaacatattattttgtaaactagatatataaagacaaaatgcattgatgaagcggaaagcttaaaataattcgatatataattaggtgcctttacgggcattgaaaacttctttgcgcgaagagctcatcactaaaaatttgcaaaaaacgaagagcgaaaactttcatatattgtagtaatatatacaagaatttaaactgcccacttgaaatagcacggaaagaactagccataatatattatacaggatgtcggcaggtgatatatcagccataaatatcaagtctgtcaaaaaaaacagaaggaggaagaagagaagaacagctgatgtttcatcatcagattcttcatcatcggatccatca

SEQ ID NO: 11064 - DNA, 487 bp, Saccharomyces cerevisiae
atggtttttgtgactttacctataaatagtacacaacagaccaccagtaattctacacacttcttaactgataatattattataattgtaactttttagcagcactaaatttaatgaatacatagatttttaactagcattttactattctgtactttttacttgaaattccagaagggccgaagaaaccagaattccttcacagaaaactattgaactacagaattctccaaaagatacactcatagtgttaagacgaatcaatgtctcggatttggaagtcctttatagagataattgtaggggccttttgtaatgtttcggatgttctgttttaagtccgcgggaggcctttttatttttcgcttttttagagatttcacgaataaaagcgttgcagaaatgcaacttcaaaagagactgaaggaaacacagatagaagaacagtcttcaaagcaatcaattcgtgtcggtgcagcttaagaaa

SEQ ID NO: 11065 - DNA, 408 bp, Saccharomyces cerevisiae
tttcgatagtatcttgaatctggatagcatttaattgcgattgaaacaaaaatggactactgcacactgtctagcgttcgatattttcgtgccattatcacatatgatcttcggaaaatgaagcagattataacatcggctgaattgattaaaaatgttaatagtctccggaagctgatgcgtaaagattaacattgtagtgggagagtgggtgacagggtataaaaacgcagagagaaataattattaagaacgatatgaattactgacgttttttaatttcgtgtttagaaacacaggtgaatcttcaaataataatgtaaattgcatttttttaaaagcaaatctatggatatattgggtatactgtaagttctcctcgatagtacagaaaaccataacagaaca

SEQ ID NO: 11066 - DNA, 500 bp, Saccharomyces cerevisiae
tactatttgttagcaatcgcgctaagatatgtttatatgacaaaaagaaaatcaagaaacagagccctccagttgtgaaagttgcaggggaaaaaatatccgtgaatctcaatacctttagtcgtattgggataatagctgaataataatttatagaaaactggggtgacctccacaagcacaataagattcagaaattatagaatatagctttttggggctttccaaaaatggaatagaaaattttttgaagttattctatttgcatagacgctcatcaaactatgtttaaagattaacttcatagtaatcttttgaatgctttttagcttcctaaagatgaataacgtagaaagttgaaatatttagaaacaatcgcagtatccttgctagaccctctttaatattaatagtaatcttgcaaacaataaagataagtaaagttaacgataaaagcatcattttcaacaaaactgaagggtagcgacataattgtcgga

SEQ ID NO: 11067 - DNA, 494 bp, Saccharomyces cerevisiae
aaacacaaaagtgcaggctaaaataacttttacccctattatatattcttatgatccattatttatgaaaagcccagcaaatgtcgaacaaatcggcctttgttttatttcacatagaatcctttataaaacaacactgttctcatgcatttccgaactattgttcttgttgtataggagcacggtttaccccttttgctattgacacatgtaatatcgcataaaaaagaaaccgcacttcatagtgcataagcagtacagaaatgatatcacatgtaagtgatagcgatttgactgtttgctaccgacaagactatctgaaataagaaaaaaaacgaccccagtgagggttgaactcacgatcttgcgattaacagtcgcacgccttaaccaacttggccatggagtcactttaaattctgcagaacgtgaaaggttcgatttccatgatctacacgattttaatcatctgtaagccttgccatgaagctaaa

SEQ ID NO: 11068 - DNA, 441 bp, Saccharomyces cerevisiae
acaccattaatttgatcagtccaaaaactctattattactaactaaagttcccttttttttttttttttttttttttttccttatctcctttatctttcagttatttatttccctctcattcctctcatattacttgtttaatttaatgaccattttcaaatgaccactgcataaatattttgtcaattagaatatgtaattcctacctttgtttattttatactattcatacaagcttcgttgttaatatatttattatagcttgtatataaaaaatgaaatcttgatttattaaattacacttggtgaacttctaaaaaaacactaatacatgtgacaactatatacaacgtaagaagtgcaatactaatcttcttgtcaattttccagtcgtttaatggtatcaaaaccgtaaatatcaaaaacgcgatcagaattcc

SEQ ID NO: 11069 - DNA, 463 bp, Saccharomyces cerevisiae
gacctgtagcagcagccttgcccttttacacaaaatcctacatatccattcacatacgccttctgtatactacaatatatgcatatcagttagaattctgacatctgaacgtcttcagtgcttttttttctctttctttccagatccaaatatcaccggcagcggcctcaaagtacccggttttcttttttttcacactttttttttttccaaatcatgttgtcaagcattgattgactcattttcctctgactactaccagttcaaaatgttagagaaaaatagaaaagcagaaaaaataaataaaagaaccatatttatttgttcattcactttcgagtataaaattaaatcttgtttttcttgttttcacttaagtacacatacaaattaaattgtagaaataaagcgttctaaaatggctggaaagaaaattgctggtgttttgggtgctactggttcc

SEQ ID NO: 11070 - DNA, 500 bp, Saccharomyces cerevisiae
agatacatgaatccttctcttcactgatggatccattttcttcttcctttttttcactgcataaaactttttttatcaacctttcatattttccatatttatttatatataccgccagtaaatttggcgatattcgatagacttaacagataaactttttaagatgaattaaagcacagaggattaagcttacctctttagaatcaattgatatgttcggctacatattagacactgcatataacccaaggcgggtaaaatatgaacaatttcaattgggctttgtaaatgcttacttttaaatgtaaacgaagctcatcagaagaaaaaaaacaagagatttggaaaaggctacttcgacctcaataatttctcagcctatctttctaatgtcattaccacaatggtgtccaccgcattccaccttaaaaagaaatccaactacaggagaggacgtatactgcatatgtaaaaggccagactatggggagctgatggtg

SEQ ID NO: 11071 - DNA, 425 bp, Saccharomyces cerevisiae
tttgcatgttaatacgatatacaagaattagatagcatctttatttgtaaataataaacacaccatcataaacatcaccatcaaccttgcacaggagaaaaaaggaataaaaaggataaattgattatgattattttttaaaaaaatgaatatgtaatattattttatgtcgattaggtagtatgtaatactgaaattatgccaaagttcctaactaaaattggataagcaggggataaaaagtcagatcaaggaaaatgaggcgaaactttcaaaaggtcttttttacttcttattttccatcttgaattaggcaaggtttctcaaaatttttcaattggaactttgctggtactgtttccgtgttcacagaccactgttcccaaaacagatcaatcttattttggtacgagaagcagctgtcc

SEQ ID NO: 11072 - DNA, 478 bp, Saccharomyces cerevisiae
catgaccgctatggtaggtcggcagatctttagcaggcagaataaaagtctgccgaacaacaagttcctgaattttgaaaatttttggcacattggttgactgcttttaaagcatttttttgatatgagggcacaaaaatatgacgcttcacttaaagtttctcatattctgacacacttcagtgattttttaaatcacattgcatatttataccgtaaaagttgtagagttagttttctttatgtaggccaataaaataaatttgcttgagctgcattactagcaacataattgaccaatttatacgtttagttttaacatcatcacaatggtgtataaaaaaaattggtaccgaaccatgatataacagacttctgatcagaagtacgaagtaaaaccagagaacattaccaaaaacttttatgatgtatctatattgttaaataaacgaagcctgacagtggaactgcgcttttt

SEQ ID NO: 11073 - DNA, 400 bp, Saccharomyces cerevisiae
atccactgaagagagagaacttcttaatacttataaatacgtcattgaacagctcaacttttgtaacgtcaaaagaacgcacatgaaaggagtgacattgcttttttctttgcaagtttattactgtggttatgtgtaaagaattagttcatggacattggccgcagagtgcaaaagcgttttggacaccccgcctttggtgttctcgccgccatattttgagacgttagtttccgacgaattgagctgaagcggtggacattatctcaaggtaccgcttactatgcctatacattcctgcaatttttttttttttttttttgataagtattactgggtaatgggaagtataatcactaggcatattatttttgacgcagaggagtggcagcctgtctac

SEQ ID NO: 11074 - DNA, 472 bp, Saccharomyces cerevisiae
cagcaatctttatttggctgctccccgaaaagaaagcgaaaattttttacttattttttttttttttcatttttcatataaagaagaaaaactgatattattattattcatcccaagaacgctattgtgtatattcctagcaagaaaaaaataagcaaaaaaattgtataatgagcactgcaactacaacagttactacctccgatcaggcttctcatcctaccaagatatattgctccggtttgcaatgtggtagagaaacttcgtcccaaatgaaatgccctgtttgtctaaaacaaggcatcgtttccattttctgcgacacaagctgttatgaaaacaactacaaagctcacaaagctttgcacaatgctaaggacggcttggaaggtgcttatgatcctttcccaaaattcaaatattctggtaaagtgaaggcttcatatccacttaccccaagaaggtatgtccc

SEQ ID NO: 11075 - DNA, 471 bp, Saccharomyces cerevisiae
gtttaacggaaaagagtaatgacaaaaccgcataccccccccccctccccctctttaccgcatctactctatttccgacacatgtaaataaaaaaggcatttcgtttatatatatactaaaataatatatctttgtgtattaataaattacttattgagaccaagcgtttttgatagcgccgacttaacagcagcactcttttgctttttttttccttccgctgtacctggaccatcgtttcctgtttgtgcctccacaggtaagggcggcaactcttcgtcatcttgatccgctggtgccgtcatctcacctaacgcatttaaccttctttgtctttcgaattcagtttctgattcatatgcattatcgtcgtaatcttcactatcgtccatgttataactatcacctaaatcctcctcagatgaaggttcatcttccagatctaaggaatcttgaactcctctcggtgg

SEQ ID NO: 11076 - DNA, 435 bp, Saccharomyces cerevisiae
ggttttaaaaaggaagcaaagtaatgatattttctgaactttttgttttttattctgggattcaacatcggtgatttaatttttgtgttcacatttaaaagtttatttgggtaattttttgatatcaattttattacaaagccataactcttgcattttttttattatatttttatatacacgtacattctgtattatttataacgcattcaacattcgttttctaaaatttcctatattttttgaacaaaaattttttggttgtaagtcggaccaaatgtatatgtcgaaagaataatacttttcaggatcctgctatacatcattatatcatattattcgaaaactataaaaatgtcgtctaaggggaaaaaaacagagaatgccctttttaagctgatcctacgatatcggcccacaattcttctgcttgca

SEQ ID NO: 11077 - DNA, 498 bp, Saccharomyces cerevisiae
tgcggattctctccgtagcgtaaacgttctctatacatcatctacccatgttgctccacctagcagaacatttcagaaagaaagaagtccaagtaatggccaacaaccagaaggacagctttttttatgaaggccccctactgcatattcattaagcttaagcttgatcggtgaaaaatgctataatctacgtgtactggtcacattgttgcacatctcaattaatcaacgctctattattatacggaagatataaaggcatagtaaatacacttgcctgaggtattgattgatgaattattttccacggcccatgcgttactcacttcgaaaatacatttgaattttagtgataagttttgcgatctacttttgttcaagataataatactggggtagaatatactctaagaagtctctttgaaattaaaaatatctctaaaaaaatccattatataatatacagtaatacaattagaggcaggtttttcttttgca

SEQ ID NO: 11078 - DNA, 460 bp, Saccharomyces cerevisiae
cttgagggatgattattgaaacgtttcattctgatttctgttttcctagcagggagatcttcttagcatcaatgtgctttttgtacgtggttacttgggttttatttatttttagtttcttccggttctgttcactttattaggccttttcatcttttaacatcatagacctgtttattatacatacgcaacggtttttttcttacatccttagagtatattacattcataaactttatcattcatttagaacaccttttttacatgtatatttttatatatttatttattattcttttacttattgacctgctcctctcatccatctatctaatatagttttctcacgactacttttctctagactagtcaaatagccctcaaacccagatatttgcagctaaaataacacgaataagtaaagaatcaatatacatatcctccacaagaaaatgtggaa

SEQ ID NO: 11079 - DNA, 458 bp, Saccharomyces cerevisiae
acggccaaacgcacatttacgatataaataacaaagcaaataataacaaaacaaatttctgtaaatatatactaaatccaagcattgcatcctaattcttttctttttttgatcatcaaataaatgtattattttatgttatatgcgttagacttgttatattctttcatgctattctatcgttgtgttatgaattaatttatatttacagtttttcagtacattcaattccttttttttggaggaggtaacaatttcacatctttcgattgtttgatcgccgcgttagagaaatctctcactacaatttgacaatttacctctttgcataatgccttcttctttgaaggtggtactttttgcagaagttctagcccagtacttctctctaaagcatctataggaacttcaaagtcagtcaatttcgtctcatttgatatcggttcgtttggcaatac

SEQ ID NO: 11080 - DNA, 454 bp, Saccharomyces cerevisiae
ttcttttaataaatctgttccatgcttattaccatcctttgtcattttagcgcttttagcaccgaattgaatggccctttttggttctgatgatattccatccaacttcaaatactgcgaggcaacttttcgaaggattaatttgttaaccttgaaattaatgggaatttctgctgtagataactttataacatattcatctaaaaatgggtatctcacctccacgccattatgagctatcactttatcatcacgattcaggttgcgatcataaatgttgtttatttgccttgtaagttcctccacaagttcatggggtggtttgttggcaaacttgtgatatccaccgtagagttcgtctgctcccagtccgctgaataacactatcccatggcgctgatatggcgttctttccccattcagagaagttaagaaacctctacctctcgacgca

SEQ ID NO: 11081 - DNA, 485 bp, Saccharomyces cerevisiae
attccatttactgtcgtttatactggctgacccttaattccctagcaatctttgcctgcacccgtaccaggaagcgtgatagaatcggtagctacaaaatttttagcatagttaataagtgctattgtttttcataatgtcacgtgcactatcaataatattacactcttgttcttgccaaatatacacaaaatgccacatttttttctttacaccgaagaatttggccgtcagccggacagcgctcagattaattgtgggctagattcttcacgctggaaacgagtcaccgttatgaaaactaatggaatctcccaggtttaatacataagaaggttacgagctactacattaaaaaatactttgtctgttttagctgtagattattgtaacattaaaaagtaacaaacactgatttcgggtatttcctccctaacatgtcttattcagctgccgataatttacaagattcattccaacgtgcc

SEQ ID NO: 11082 - DNA, 408 bp, Saccharomyces cerevisiae
cgataactcccaatttgcttttcattacaaagtttaatttttcagctgttaataatcgaagttttaacttcccttttcttttatttttttctttaattgtaaaagatttctatatatttgtttaattatgatcttatatattcattaatatttactttgaggtgttccctcacctatgaataaacagacacttcctggttctttaagtccatcggagtcatggctactatatggatagtgatgttacgtacggaggatatatatacatatcgtgcattattctacttcactgaataagtcactatccaaatcctctggtacatcactataatgctcatcttcactcgatgaagatccatcatcgctcattgcaccatctttcccttgaccttcaccctgttcttctgc

SEQ ID NO: 11083 - DNA, 461 bp, Saccharomyces cerevisiae
gacgtttatattctagcttgggattatttctagtatttagttcttccgtatttatgcaataactcttcacagaatatctcgtgtaagaatatggacactgttcgtggcactttacgaaattcaagtttattctctttgcaaggttcttagggtaatggcagctctgaaaggggcttgtcgagttaaaacatcattaatgattatattttatttttgttatttttctgacgtatccatcgtttcgcatctagtatgagcttactaagagcttcgtatataatgtactatcatcttcacttactcgtttgcacactaccaagttctgtccagggctccttgttttatatttttagtgtaattgcatggtctatgcaacatgattaaagcagcatcacacgcgccattatataatctaaaatagtccgttgtcgtgcgcattcttctgtggcgcgtcttatatg

SEQ ID NO: 11084 - DNA, 414 bp, Saccharomyces cerevisiae
ggtgcgctgagtggcatatagtggaggatataaagaaaaaaagagagaagggaaaataatggaaagttaccagtgtttgaacttatagcgaacgctctttctcgaacgttcaattacctttagcatacccttgttcgaagttgcccccgctagcaccacttcagattggcagttagctgccacgctactcccctccaccgttatgaatcatttttactaacctttaatgaccattcgcaatttctgcgtacattcatcgtcttctccagaaaatggctaagtctaagaaccataccgctcacaaccaaaccagaaaggctcacagaaacggtatcaagaagccaaagacctacaagtacccttctttgaaaggtgttgatccaaagtttagaagaaaccacaagcatgccctac

SEQ ID NO: 11085 - DNA, 484 bp, Saccharomyces cerevisiae
gcaatatctatatcatttctcatgtgaaaagaagaggataataagttaatgcctttatttggcattattatttacaattttcgtgattctgtgtaaaggagttggagttttttttttttttactaaggtgcgatatcccaagtagataaccactgcaaaggtaagtattccgctttatcaccatgcataccctgacatattggagcaaataaattataaatgtatatacatccgccaaacaatgacaaatagatgggatatttgaccatccaatggactcttgtcaaagtgaaatcaagcacaaatccgaaaacaagcattgcaaaatataaagcgggaacgtagtgatgtacatacgtcactctccccatcattgcaaaaggcagataatgtgtcatccaggaaatgaaaggaaaaataccctgtatcgttatttgccagatttgatcgtctgagagataaagcgtttgtctcctccaacgat

SEQ ID NO: 11086 - DNA, 405 bp, Saccharomyces cerevisiae
agccttaaaattcacacacgccacacattgagtgtgctatgaatatgcctgcgctaatattttaggtattacagcttgtaaatataccaaataaggtaagcctctcttttcctaatactaaaaggatttgcatcgaacagcccaccaaatgctttgcgcacacattatatacacccacatgattctatagacaaaatatacttatacattttcatagtcttgacaatattctacattggccgttttcttggcactattttagcttatccttaccaaaatagtctcttttttaaatactatttttgaagcggaaataggtgcgaacaaatgaatggcttcaatttagtgcgataaagacgtaaagcataaaccagtgaagatcatagcactaagaaggcgcctgta

SEQ ID NO: 11087 - DNA, 419 bp, Saccharomyces cerevisiae
tggtaaaatataaacgccgcgtgtaaataggaaccgtgcataaataataacaataatagtaatactaatgataataatatacataaaaatatacgtaaacatctcaactccaaacgctcatgtcagtattccaaatgccaaagggtcttgatgatgctggttgagaggatgaagatacgttcatgtggttagacccccatcctaaagaagaatcattcatcaagagtgatgcggacgaagacatgttcactggtgccgtcgaaaaatcctccctttgcgatggggatggtgaatgttgcggtgggtttatgttggtgccaatagagctagatgtggtggaggacatgagcagggtttggcttgctggtaggaaagatacagttggtggagaatgtagatccgagataagcgaactggac

SEQ ID NO: 11088 - DNA, 438 bp, Saccharomyces cerevisiae
gctgctcacccaactgaaacttatccagttgaaattgcagaagctgttttcaactacggtgatttcaccaccatgttgactggtattcccgccgaccaagttaccagagttatcactggtgttccatggtactccagcagattaaagccagctatctctagtgctctatccgtagacggtatctacactatcgcaaactagagtccctgctttacgaatgaaacctgtacaggtatgagaggttacgaaaaaaaatgataaatgaaaaaaaaaaagcttaataatatgaaattaatagtatgaatagttaggcgcatgtatataaatataaatttttgtatatatgtattattaatattataaatttcttattattaaaccatcctttacggaaataacggcctattcccttagtattttgttgtagctcgtggagtt

SEQ ID NO: 11089 - DNA, 489 bp, Saccharomyces cerevisiae
tttttcttttgcagtaggaggcgcattataaaacacaaaaatatcgaaagctctttcatttcggggacaacaacttcagttgaaaattacagtgaacacaacatcttccccaacagacctacattaaaacgcttcttccggacttgcccatgattaacctaatcttatacgaactgaattaaactttacggtattaccgataggaaacttctattttatgattttttcgttcggggacggaacgaacaggaaacaaaaaaaaaggtacgatccattgtattctctacccccgtatataaaactaagctgaacaagcctgttgttttgctttactattgctactatttttgacgtaaacgcattgactaatttcaggtttttatattcttgacactagctagaccatagtatcgaaggattcaaatacactaaagtatcagataatgttcagcctacaagacgtaataactacaaccaagaccaccttgg

SEQ ID NO: 11090 - DNA, 440 bp, Saccharomyces cerevisiae
acacacattataaactaaccttaaatcctacttgtatgttccttaactctatattagtggtgttgacgtaagtttagataaaatcgcgaacgctgccgcctggaagtaaatgaaaaaaaaaaaaaaaagaattcatcacctaaactcactaatctttaaaactcattcatgagaagtggagaactatattacagctatggaacaaaggaacaacggtatgcaaaatttcgatctctgggttttaataaatgcatgtagccaattttatcttactaacaatctttgtgttttctctgtgtatagtctttcaagcaaaatataatgaatacaaacaaattttggaagaattgcaaacaaaaatcatagaattaggtcatgacaaagatgaacacactatagtcataaaaacactgaaagacgctgagccgacgagaaaatgt

SEQ ID NO: 11091 - DNA, 473 bp, Saccharomyces cerevisiae
ggaagaaagtgaagagtagaaaaataaatagtgttacttataactacgacaccattcgccaagcattctttttgggcacttttttagcttctttacctcttatactaattgcatacacaataacatagcatataaataaaaaggcgaatcataaaattttaaatcaaccacgacatattgtggtgtgcacattgctcagttatcaacttcgaattttctctcgtaaacttttaacttttctttgacctgaatattttatattatctacatatgtgcataaatgcgtcaactaatatacatatacaacataatgggtatgtactcattcagtttcgttcgcaatttcttctacagaagggcatgtacatattaaattcatgtcaccataagtgtcatccagtctagcgacagtaggccagaatttattgtatctcaaaaagggtaatgggtaagcggcttcttcacgggtataa

SEQ ID NO: 11092 - DNA, 400 bp, Saccharomyces cerevisiae
taatcacttttcattgctctctagggcgtgttcgcttctctatgtaactgcatttcacatatattcatattatagcctttataacattacataaaagacatgatatacgacatactttaaagttagaatttttgttgtattaattttctcgaagggattagaatgtaagtacatttaaatagcgccgcaagaaacataacagccgttaacactagcaagatggtagattactgtgtctaagaatttaaattgttttgcttgcttttgccactataagacaataatagtaatagaaaagaaatgttagtcgaacagcaaattggtaaaagtggaaaaaattatttcgttattcattttaggccgttcagaaatatagcattttggttcttgcactgaatgg

SEQ ID NO: 11093 - DNA, 417 bp, Saccharomyces cerevisiae
gaagaggggcagatgcttaaaatatctaaaacgataatcgataaatgtccatataaaatgtatggctgctttttaatcatttcttttcacatttccatttattcttacaaatttcacacccaattttagcgcctttcattctgttatttttaaactgacgataaaaaatcattcgaagcctaagatttccaaaataaaactccatttttattctcactaataacaccacaccattaattttaattttttaattttaatttcagatttgtaccataagttttattctatttcagttcaaccgtttccggatgcatgtagcgagggtagacaaagaaaagcatcagtatcggatgttgatattatgggaaatatcataaccttagtctcttaaaaaatgctgctttcttctcatttttc

SEQ ID NO: 11094 - DNA, 490 bp, Saccharomyces cerevisiae
taagctaaggacagaaaatgaaaaaaaaaaaaaaaaaaaattcaaagaatcagcttataaaacatattcaaggaccatctgaagtatcattcattcgttttttactcgttaatctcattcattcgtttcctcattcttttttctttgttctttatttcggctattttttcactattaaaataactagagctaacaatattatttcttctgctttagttacaaaacaaggacattcatttaacttggcgttatcccatacattcgtttattatatcttcttttaaaacacaatttcttttacagttaaacttttctgatttattatatattacttaagattgttcatataactaacatttatatgcttatatgcgtgaagtgcgcttttgtagaacatgtggctgtttctgtagaagccttgtctttctctgtaatcctttaaaggccaaccgtacgtgcttaattacaagctttgttcgcattgcaagaa

SEQ ID NO: 11095 - DNA, 482 bp, Saccharomyces cerevisiae
gggcatgtgatttcattgcattaacttttatgactttatttgaagttatttttttgttttagcgctttatttacttttattttactacataactgtattcttacaaaatttttacgtactcagatgggatatataggcacttgatgttttattttcttgttcttatcatatatccgatggaataaaatgttctattttgctggctttttccaaaaatattgtttatgtgtccttctacaagatcttaagcctgtccttccaccttttaatgaactcaccaagtttcttctctcgtaatcatcatcgttttctaaatcgtagaaatactcttcgtccaatggtttgccggcggcgtccttaccatgacggtaaatgacaccgacacatttcgcgtcgctcaaaatcgaacgtaattcatctcttgaaagctcagaaatttgtgagttcacctgctgtaattggaataatggcgtctgctggac

SEQ ID NO: 11096 - DNA, 495 bp, Saccharomyces cerevisiae
aagcactcgcacgcatagttttatattttttattcttttcctctttatttttatttttttaacattctcgcataataatagtaacagcaataaaataactagtaatatacatactcacataaataggcatattttttattttgttctttcgtattcagaatggtaaatttttctaatgaaatgttttacaaaaattttttttctataattctaacaataagaaataaaacagtggaaaaacatataacttaatgtagatatatatatgtaaatatgctagcattcattttaaatgtaaggaagaaaacgcctttaactttcatctggtaaattttctaaagctctacccttagtgtaaacctcgtcttttacattctgtacagtacttttgaaccattgaatgaacagcacagttgcttggaaaaagaacgtaaatgactctaatgctatcagtagtccgaaataaatatcttgcatccttgtccatgttgggaa

SEQ ID NO: 11097 - DNA, 483 bp, Saccharomyces cerevisiae
ataaaatttgtagaatctgtgttattgacattagatgtatcctcaacatatacaaataaacttcttgatgcgtcttgttttttggtgttgaattttaactcttttccatcattatggaattcgtttttagattttaacaacaacaatatgaggggagacaaacagtagcagacgaaaacgaaaacaaaagcaagaaatatctgatctaaaatatgcagaggtttgtcagtaagtttgtttccacaccaccagtacccaaaaagtttcaagagattttcccgaagaaacgtacggttaacaaaattttattccagttagatacaaggcttacataccatgaaatgtacccgatatttctgcaggtatcacaaaatactaatgaagagaatatcccatggaggaagaaatacccctatataaggagttcagacattatgcagatgcgaaacgtcttgataactctaaggacgcagaacaaattcg

SEQ ID NO: 11098 - DNA, 488 bp, Saccharomyces cerevisiae
aattaaacttatgtggctaaacatatgcatttgtatatggtaatacagtggtttattattgctcacattgttcacaccagtgactatagtgattacaataagtaattagacaataaatgttatgagtgatccagaatgaggaatgatatgtgacttcagaattagcagggcagctaaattaaagatcttttaattcaattttagcttacgatttatatctatgaaagacatgaattgtcactttgggtaaccaatgatatcggtgactgctatttatacctatctcatattatattaagaagaccagcttttattctcggttggtagtaccacttgtctactaatcatcaacaatatattctaataaagtattatgtacatatatatatatatattaccagctcggccaggcattggaaaacagaagaaacatttctcatgattgaaatggataaacacgttaatcaacagggactatgttgcaggtg

SEQ ID NO: 11099 - DNA, 404 bp, Saccharomyces cerevisiae
actttcaataagtggctaatgatttcgcatttattactataaaaaaaatacagtcttaggattattctctatttatcctcacgccaaactttgtatacaattacaaaagattttgaatatactagtcaaagtactatctttgttgtcattgccactgttattataattctgagcttgaccttgaggctgtcctccattgttgttatattgaggatgtggttgtgcattgtactgattagtgggggcattcactgcggggccatccatctgcatttgcacaccttgcaactcaagcaccaagactcctgaatttcctttttccaaatggtttctgataccatgcttagcacagaactcctcaattgacggtttgagtttcgctataccgttttgagaatgcaacc

SEQ ID NO: 11100 - DNA, 451 bp, Saccharomyces cerevisiae
atgaacctttagttttaatccattaaacaaaaaattattaccactcctaatcactgttttagggtgggttaaaattaacattctccatttttatatagaactaataaaaaacacctacttatagacacgaccaaactttccacaacctttcatcagagagaaatgttgatcaagttgaatgcgtgaaagtagcaattcgaaacaacaactacctgtcattctgcatagtagtagttacgaaaggcacagaaaataacaaaaaaaaaaaaaaagtcaattttctacggtctccatccgtacctctttaaatccgtacattattgttttgcttaatttcaatatttcggaaaaagcgagcgccctggtaaaatgtggttcaagcctgcgagcctttgcttggtaactcaccaaatgcaattcagtcacgttccacacagtttgggtttccagc

SEQ ID NO: 11101 - DNA, 491 bp, Saccharomyces cerevisiae
ggtcttttttcataggtatcttcgagacatgcccgtcacaaactaatgatacactgtagtcaccccattaatagttgaaatgaggatatatagcataaatgcatttaacacattttttagatttctagatactatagaaacttagtatttttattttccacagtgtactcttcacgatattttgcattttagaacgcttgtttgttctcgtcacttactacgtgcgcgctttacattcgcaggtctacttattaaagagtttctgtggggaggggttcctgagtcaaaatctcagctatccgaacagcttgtacttagattacttggcacatatttatattcagtaaagtcaatagtgggtattattaatcgaaataaacagaacaagcagtaatagctcttttttcatctattttatttgtaactaggaagaagaaaaaaacttgaaggtatacaagagcaatgtatgtcacttttaatgaggctttgga

SEQ ID NO: 11102 - DNA, 444 bp, Saccharomyces cerevisiae
tgagggctaagtttttatttcttcaattctatttatcaaaatttgggtgtttacttcgaggtgtaatttatattttcttttgttttctctgataaaaaaattggtttccattctaatgccaagctaaaaggtacctatatatgtttactaattatttttctactttgcatatatacataaaaaaagtcgaataatttaacatgaacattttaagctgtccttgtaagaaggccatgatacagattcccccctgccccgaaatggggtctaggcaacattgttctataaaggaacgcaactttatgtggcaacattaaagcaaatacatatctacttgtgaagccaaagaattgtaattaaatagcactcattattatttttgtcttctagtttatagttgaatataccatcttttttagattcccaggatgcgcctatatcgtt

SEQ ID NO: 11103 - DNA, 414 bp, Saccharomyces cerevisiae
gagtaacgattttacgaatcgagcataataatgaaaaattatagtagtagtaatgataaaaacataagcaaacataagcaaacataagcaaacatatcaaacatgcattcaaaccattatccgacagtaatgtacatatatttttacgtattttacattctttctctattgttcttttatctattgctatcctaaacaaatatattgattgaccttcaaaccgtgagtaactttattaatttatatgtatagaaaaaaaaaaaaattgaattagaaatttgaacttctcaagttcattcttcttgtacctatgcgatgactttattttcggtttttacattcctcctcatttgaccgaggaatacgaatttgattgacccccactcactaaacaaagggtcggaattcttttcc

SEQ ID NO: 11104 - DNA, 425 bp, Saccharomyces cerevisiae
taaataaataaaagggggagaaaaaaatcgaatcaaaaagaatttaatcactagatgccagatttaaattaaattcgcttttaattttttgtacaatataatatatacttggtaaaccttttgctctatattgagctaattcctttgttgaaagtacatagtgggtttagaggaccgtgtatattacgtagaaaatacagtgaaaggagagtttctcttcaaaagcctcgagattaattatttctctttttctttttcttcaaagtttctaaggcgtttgtcttttcatgaccaatgatagaattatgacctctttttttgaccaagttatcagctaaattcactagcccacctgtcaaatatttctgtcttctatctttacgtataggcactgataacaattcgttcaacgtagctctcatggc

SEQ ID NO: 11105 - DNA, 500 bp, Saccharomyces cerevisiae
gaagttctgagacaagtaccacctcctctctcatcataaaacaagtaaaagttttctcgtcgcgcatattattttggtgattgattgttttttcctccgatatcatcacttattacctgtaattttatctttttctaccccatagaattcgtcttataagtctataccctcaaaactatctatcattttaatattatctgtcgctttaattgtcttatttctgaagctcactgaagaacattgctttattatgcataaaggaaaaaaaaattaccctaatttgattacttcgtttcggatgaatttgaaaaaaatcatattgaaccatgaccgatttagccatccagaaagatggaaaacaaacgcactcttaaggttcaccttcgtgtatataaaatttctcttcgacttgatgataatcaaaaatccattaaggatggttggaaaaacttatcgagacgctgttactgcgctaaactctttgcagtccaattatgcca

SEQ ID NO: 11106 - DNA, 422 bp, Saccharomyces cerevisiae
cgtttgcgttaaaggtatattaaaaaatttactattggtgctcttcgagcattgttttttttctatatttacaaacaacagcttattttttaatatttctcaaaaaatgaagttcgaatgattattttaattgagtttagtgatgaaatcgattgcaaataatataaacgttggtaagctcatctaaacaatcgaaaggagggatagaagacagtaggtgtttgtgctttggtcggtttttccattcggtgaattcatacatctcctttattaattttaatggattctttacaagggattttcggttgccaaaaacagagaacaaatgcgtagaaatactcaatgatgtcaatttttcaaaaaatgaattaaatgattgaagtcacttaatttttgtggttttttggaggtgggttgagtgt

SEQ ID NO: 11107 - DNA, 495 bp, Saccharomyces cerevisiae
cgaacgtaacttttcgtttcttgtaaatatcatatcgtatctatcacttctgtaaatcttcttttctattgttctgcgccacgtaagaactgacgcacatagtagatgcccgaaatatgcaaaactctgtgaaataaattgtaccgcctcaacagttcagtaagaatagtacacaaagagagtgaagtacgaaccgtgttttgctcaagatgtctctgacaccaactaatgaaatattgtttcattacaagtcttcagtgaaggttggtgaacttgagagatatgtaattacttatcatctttatgacggtgaggaaattccaccagatttgaatttaaattccttgtggttaaaggtgagaaatatgaatccgttatcgtatagagctgcgtacctaatgggtccattcatgctttattgcgatgtaaaaactgcccaatatcatcattcccaaaaaatagttgcttcagttgattaccccaaatttgaaccga

SEQ ID NO: 11108 - DNA, 468 bp, Saccharomyces cerevisiae
taagcataatacaatggtgcaaaattttttttaggcaggaactaatctactaataaactaacaataatgcacaggaaatattaatgatttatttatttattttactactatattacattacttttttacataaaaaatttcccatctcacgatcaaaaacaggcatgagaaaaaatcaaaatttataaaattaatttctaataaattaactgtaatgacataaaataagaggctgcgacagtcgaattttttctttttttttttttgcaaagcgacgctgtgttgtatattgctctaaaataattttctattgttttcctcatgccattaccctacctacccgtgcataattacacgagggggagagctttttcttcccaaaccagaccaggaaaaaaaaaaaggtttgataatgaaaaaaaaaaaaagtattgtatatgactgttttcctgataaaagaatgcctgc

SEQ ID NO: 11109 - DNA, 489 bp, Saccharomyces cerevisiae
tcatgaaaacataataataaacctgcagaggttcatatcaagttttaattcaaaatttggcacacgtaatagcaaactttagttcatattctgtaatattaagaaattattttcttttctgtcatcctttcatattgcttaacttgaaatactttatctcaacgtttaattatactgttaataatgatatttctatattttagagcacattttggtcgaaacattcaaagcgacccctgcaatatttagcggaggcatctcatccgccttatttttgtaaattaacgatctttagcgcatgccaagtgttcgataacaaattccgactttaagaaaaaacgggcacgagcatacaataaaaaaacttttaaaatttatacctccttgaggtgttctattttatgatagatccgtatttcagataccaaatgttatatacacttttttaagcttggatttttttctgaatacacggaccttacaaatgct

SEQ ID NO: 11110 - DNA, 417 bp, Saccharomyces cerevisiae
acgtgaccgtgcaccaatgggaagcacgttccgggcatatcggactggggcgcgcctcccctgcgcggtgcttgttataagaggcgctttgctggaaagtggcccacaccgggttttcgagattaggacctactcagtcttaagggcagtattggttggcgcttatttgcacatattgtatacacgcactcacattaacagaagcacacatatacacttacacctacacacacggataaagaaaaagaaatagaaaatgggcatgttggaactagttggtgagtactgggaacaactaaagataaccgttgtgcctgttgtggccgcggccgaagatgacgataacgagcagcatgaagaaaaggcagcagaaggagaagaaaaagaagaagaaaatggggatgaagatgaggatga

SEQ ID NO: 11111 - DNA, 471 bp, Saccharomyces cerevisiae
aaaaactcgatattcctggattttcctcttttcataggcatttttattagcatttcatttttattataccaaatcaatatatacatataaatatccggtctttattgacttataaaacaactctcagtatacagagttggagaagcgtttactcagaatagcttcagtactaccgagctttgctaacataacgggagaaagagaatttaaaacttatatacatatttacagaatagatcagtagaaagaagaaggaaggtctgttgaaaatttctcgaaattgacggtacttttttgtcttttcactacttacagatcaaggtacaaccttaatacccatactttttgcaacgccaactattgatttaacaataccttccatctccaataaactatgcctttcatcactcttttttatcttggctatttcgtaaacgtgcttcagcgataactctcctaaagcacgggttg

SEQ ID NO: 11112 - DNA, 469 bp, Saccharomyces cerevisiae
cctatctacttgatgggccttttggcttatatccctacgaacgttttggccacatacctgactttggtattgagaagtatcggtttcacaacctttcaagccaacctgctagctattcctaactttgttcttcatattctcctgctgtttggtttaacatggtcgacagaaaaatgtaataacaggctaggtttgagtctgttacaaccgttgtacactgttcctcttcttgcagttcttcgcttttggaaaggtacaatgtttaataaatggggaacttatgcaattattaccttaatattagataatccgtatatccatgcaatttgtgtatccttgtgttctagaaactcccaatcagttaaaacaagaacagtatctacttgcttgtacaatatgttcgtgcaagcaggtctcatcatatcctcaaacatttatgcgaaaagcgatgccccactctatcgtaagg

SEQ ID NO: 11113 - DNA, 401 bp, Saccharomyces cerevisiae
accgctacgtcccaggatagttactcgcacatataaagttcttaataatccaagaatatgctgctatacatctcaaaacggattgcttccatatgggcgccacttttctgtttctttgctatcaaaacagttggcaccaaaaagctactcattgcaaaggtttattgcttatgaaatattgctttgtgaacagattcaaccgaaattacccggtgaatatgactatgtaagttattagtataggttgcatttgctgtattcgttgataagacaacatcttgtatcatactagtttccgcacactagtatttcgtctactattgactttctgataaggttatctggttcctgtatttgcagtttatcgaagcgggcagaccaggtcagctcaggacaattca

SEQ ID NO: 11114 - DNA, 423 bp, Saccharomyces cerevisiae
taaaatacgcatttggcgtttatcggtatactcgtcatgagacacgaaaagtggataaaatgcattccttttgtcgttgatgaaaaaaaaatttgaaatatattaaaatgtgccgttttttacgtgttcttttcacttatttttctgtttatatcgtctattcttcttggcaaagtataagatctttgacgaaaactaaatcgacaatttccttagtacttctttctccttttttacctatctgctaatataaccaccaataatgagtatcgctgaattcgcttacaaggaaaaaccagaaactttggttttattcgatgttgatggtaccttgacaccagccagattaactgtttctgaagaagttagaaaaactttggccaagttgagaaacaagtgctgcattggttttgtcggtggttc

SEQ ID NO: 11115 - DNA, 437 bp, Saccharomyces cerevisiae
ctgaatttatagatcccccaaaaaaaaaaagtactcgcttctttccatgtccgcttcatatatatatacacatactaatcaaactctatgtatacatagaataaaaagaagaacactatatttatttcataaaaaaaaaaaaaaaataacaaaaaaagtgcaacatttatcaaaagctcagtgtgcgttatgcttccatgtgacccaacatctattgcggcggtgacagaatagttgaaaggcgcagggctcacacacaggaatggccctcccaaatttaaaagagaactaaaccagttatcctaggcaattactttatttgagtcttatatgacgtcactagaagctcagtaagagcaaccgagacctgaacatccttttttttttgcttctttatttggcagcatttttcaaaaataataaaatggaagccgcga

SEQ ID NO: 11116 - DNA, 428 bp, Saccharomyces cerevisiae
taatgcagtgttaataaaacgttagtttcaaaaatactaaatacatttctttacacaatcaattccagagcttgatagacctatcccatccgccgctcactaaaaaatgagaattattcgaaatatccaagctaataattttatcagtgtggcctgctaaacttcccatttttaaccacgtatcactactatacacattgatcaaattatcatagccacaagagacaagtttctttccgccgtcttcctttgaaaaccttacctgcgtaacgatgttacgatgcgccaatatttgatttagttggccttcatcccgttttctgatgtcccaaacattaatgattccatcaccaccaccagtggctacttgatacccgtttggtgaccaagctacggtgtaaataggctttgagtgtcctgcgagtgtc

SEQ ID NO: 11117 - DNA, 498 bp, Saccharomyces cerevisiae
aaagggaggtatataaagtacatgtataaaataggcatgcgtgaggtgatattatatcattttatgcactgacttgtaaataagattataaacgattattcatctttactacttgcgaacatttcactgtcacaccaggctatgagggcccacagccagagagtcgcagggcatagcagtaatacacaccagtagtgcaggaaagagtcattgttgcgtaaccagtaaaatgtagcaagactaattaggagtaccgagtaagtaaaccctaaaaccaaaaagccttggtcacgtggtctcatgcgcttataaattctcaatcatgtaattgaaacagtcctgttgcctagtttcaactgttctatgcttcttgatgttttcgaaactttgcgtagtgtaatcttccttgtattgtagcgaagaaaaaaggatgcgttgggaacagatatagaagacgtaaaacaacctgaagaaggtaacaggtggagtagcaatggg

SEQ ID NO: 11118 - DNA, 409 bp, Saccharomyces cerevisiae
agcagaaatcacgattcaaaaaaaaaaaaaaaaacttgaagaaacaattcaattagcatattatttcaaatcccagccttcctacacgctcttcctgttttatctctttcctttcattctcccgtccccctcattcatgtatttcttatttcattatactatttaactctttaaatattctatgtactttgtgcaaacatcattgtcatcacataaatgcattcctactattactaacttgaacttcacttcactggaagaactgggttattcaaggtaaagaaatcatttgttttgcgccaagtttcgtctgacaagaattttttattattatttcccacttttcatcgaaggaaacgcgtcaaatccattcgttactacgcgcaatctgcgttatttcctttttcgg

SEQ ID NO: 11119 - DNA, 500 bp, Saccharomyces cerevisiae
aggtgtttatagaatttatcgaactgtatctaaatatttttaatattcttgttttattactttgtggcttttgtattcagtctgcaccctgtttcgccatcgattcttataatacatacatttttatataagatcacagaaaatacgaagacgtaaaaaaagagttccgaatgaaagaagaaagaatcaagcacaggaagacaagaaacgatgttgttctactcgttcgtgtggtctgtactggccgctagtgttgctttggcaaagacacataagttaaactataccgcttcttgggtaactgccaatcctgatggattgcatgaaaaaaggatgattggttttaatggcgaatggccacttccagatatccatgttgaaaaaggagatcgtgttgagctttatttgactaacggctttcaagacaatactgctacttctctacatttccatggtcttttccagaatacgagtttggggaaccagcttcaaatggatgg

SEQ ID NO: 11120 - DNA, 498 bp, Saccharomyces cerevisiae
tacctatctcatttgacaataatatccacttatcatatgaaaaaatcagtactatctgcaatttttccatttaaaatgtctgtcgctaaaattttgcgatttgccagaccaacaaaataatgttataatatactttatgaaatttcaatctaataaacattgagcatatatatgcatatacctaccatatatattttgcattactaaaaacatcaaaaatttttctaaattgttacttattatcaatcatagcttcactccgcttgaatcacgtcttctaagcgggaacattgtttcactgcgcttacagcgagattcgcagacattttaagtaagaagacaatttcttttgccttttgtacggaattaattttaaaaattatactatatatatattagtcttttctattctcaaaatataataatattaatagtaataaaagagaaaataacgatgtttaatagagtacttatacaatcaacaaatttagatgttgg

SEQ ID NO: 11121 - DNA, 419 bp, Saccharomyces cerevisiae
gctaatgaacatttatcgacacaggtaaataggtaactatggtatttactctacatgttacggagtataatacacgtagatttgtttcttcctcatattcccatgacatgtctcagtaattgaactcaaagtaacatttagctttcttcttgatcattgcgtttggaaatgtatagttagagaaaagattctttctcatccgagtatggcgcgtgaagaaaatgaagatggagttgtcgaaacaaatggtcatcgacattagtttaattgtcatagtaacagtctgggcactcacttcgtacatcccttatacatttaagtgcaattttacctattctaaaaatagaaaaaatctcgaatgagcagttctggcagtactgaaactgagttaaaaatctatcaactggaagtaatgcggt

SEQ ID NO: 11122 - DNA, 417 bp, Saccharomyces cerevisiae
tcctgttgaagtagcatttaatcataatttttgtcacattttaatcaacttgatttttctggtttaatttttctaattttaattttaatttttttatcaatgggaactgatacactaaaaagaattaggagccaacaagaataagccgcttatttcctactagagtttgcttaaaatttcatctcgaattgtcattctaatattttatccacacacacaccttaaaatttttagattaaatggcatcaactcttagcttcacacacacacacacaccgaagctggttgttttatttgatttgatataattggtttctctggatggtactttttctttcttggttatttcctattttaaaatatgaaacgcacacaagtcataattattctaatagagcacaattcacaacacgcaca

SEQ ID NO: 11123 - DNA, 411 bp, Saccharomyces cerevisiae
gaataccaagtgaagaacattatcgccggccgccaaaaagagcaactaaactaacaattttgcgccgttcagtctcctcattcattgtttttccatacagtagggcgcttttaatagtttctagtggactgaattaataacggttatacgtattaatctttgattaccatatccaagaaacagagcgtagagcgtgggaacaaaaaatacaaggtttacttgataattgttcattctatcccactatgtataaatatttatataacgtagttgttgtttcgaacgtatcctgccctctggataccttccagggagataatcattcgtgaatatcgctgaagtaatcgctgatattgaaatgaacagattctgatatttctttaataatttcccagggaacgtttactttcc

SEQ ID NO: 11124 - DNA, 474 bp, Saccharomyces cerevisiae
gcaggtctcacctttatactcactgtattatcttatgttctaattcggtaatagcttcaccttttctttttatctttgaggtttgttttttttctagtatcctactaggatggctataagcaatggctggaacgattttcatactttttttacgaacttacgacttttcagtgtcttctttgatcaaaaggagatcactatggatatatatgtcctacataactaattacaataatgatagaatgacagaacttagtcactttttttgtttctcagcccggcgacggcgcatttgaatgggtggaaatcttcgctgataccaggttgacagtcttatgatacgattttttcgtcctttgcttcccccgcaataaccttgcctttcctctatttgccgcgttagtaaaagacctttcacagcatctgtaaagttcctttaatcgcattgcaaaataccagggcctaaatggaact

SEQ ID NO: 11125 - DNA, 446 bp, Saccharomyces cerevisiae
cttccttaaatatcacccttaccatataatatacacaattgtagaatataatattgataaatatatacatatgtagataactataaaacttggcattttattttcaaatgtatttgtaagggtttaaaattccattaggatcataatgaaccttcaaatccttcatcatcttgacctcttccgggctcttagaatagccaatgtaatttttcttttggaaacctagcccatgttcggcactaacggaaccatgttttgaggaaacaaactcgtagacaaatggttccaaagtcttttcaatgttcttgttgtactctctaactgcaacatttaagtgtagattaccatcacccacgtgaccgtatccaatggcgcccaccactggtttgggcgaatcacccactaattcagcttcagaaagtcttgcattagtggcttcaaccaaa

SEQ ID NO: 11126 - DNA, 440 bp, Saccharomyces cerevisiae
aggaccaggttctactcttcaccgctgccttagttgtccaaatcggactatatacctattgtgaatattttaatgatatatagccataatgaatcaacaaattgtattattatttccgacaacactatcgcctcttggtttttatggtaatgtactcaccatggcattgttccttggtcaccaatttctatttaccgggtgatggcggcgcgccacagcggagggcattgccacattgctgcgcgatcaaggttggtttttccaaagagacttcaagagtactaagcttttgatgtagtaatatttgtcaaagagttttaagagcaagattccattgaacagaggtgctggagtgacgagcgtgtgtgtttttagcctatctttattcgttgagcctgtagaagagccgttcttttaagtacaccctgattagatccccc

SEQ ID NO: 11127 - DNA, 434 bp, Saccharomyces cerevisiae
tgactgaaatttttgcataggttttttttttttttttttattggaagcgataacagaacacagtagttttctacagtaaaccacctttagcaacctgctctcgctgaaaatctccattcattatcgttcctgagaacgatccattttctccagccaaccacccaggaactttatcaatatttattaaatttttatcgcatagttcgtgtaatcccccaaaaatatcattaccattaaatttcaattttatggtaattattctactgtttatttcgttttttaaagtgaatccaactttttcaataggaactaaggaactgtatctagaaatgtacactggctcaccagaatcttcatttttctttccattcctaatattgtggacatgttcgttaaattctttcaaatcattatatttctgatccattacgccg

SEQ ID NO: 11128 - DNA, 422 bp, Saccharomyces cerevisiae
gaagacatgtaaatggaacaaaaaagtgtctttgcgcttagaggcgcttaaatatgtacattattcctacttttttatttagtattatgtaaagactgaggttctttgtcattggatgtgcctcacttccaatgatgaattgacaggctctctagggaatgctgtcaaggggaaacgttgctagtgctcattgaaataaagagccactttacgttttctcaaattgcttttgttttttcttctattgatgctaattgcatattttttggtaaaggaaagaaacactaaaaaataaatattctctaatacgttacaaatgattttcttttttcttgagtcttgcaatcatacccgtagctttctcttgttcttcggctattgctttaaatcaaaatgatatctgggtgtaccagcaagtttcg

SEQ ID NO: 11129 - DNA, 482 bp, Saccharomyces cerevisiae
attaataggcttcctttgtttatttccgccatttttatcgttgcataaagacattatatattcctgtgaatattttttaactaaaatgtccgaagaaattactgtatttaaagtatatatattttctaaagatacttaggtatacctgacgggcagtccttttttcatcacagaataattttcggtaaaggatcattcatttccataggtaggagaagtaatacttcaaattatttcaaaactttgcaacggtttcgtagaaagtcttgccttgaatttcgtgtacttgtaattccaaggcggaaggagatcttgaaccgtcactgcctgcaatggtacccgcaccccatggtgaaccaccgtgaacttcatccatattggtcaattcagcgaaaacattcttgtaacccaatgggacaaaaatgataccgtgatgagccaaagtagacaaagagttcataattgtggcttcattaccacca

SEQ ID NO: 11130 - DNA, 462 bp, Saccharomyces cerevisiae
tacctactatactgtagtttcagccaaaaaaaataataaaaaaagcataattggaggcagtaaagcattatagtcatacacaataataataataataataataataataataataataatagtagtagtagtaatggtaataaaaaagttagaaaagaaattagatacagatattcgtagtaaaggccacgcagtacaaaaaagacggagaatatattatataaaatcctctactcttttcgttcaggtccaaaggaaaattcttgcacgcgcaatggactgaacaggccttatattatacaaaaagcctaataacgatcaaataaaacaaaagaaagccgttgctcctatgcctgaccagagacggctacttgttgtaagtgagtcatgaaattttgtaaggaaacatcatctgttaagacaattgtagatcctccgcgcgccatgtcttgatagttatcg

SEQ ID NO: 11131 - DNA, 404 bp, Saccharomyces cerevisiae
actgtaagtttcccctcattttcctttttttcttctccttcccctcagatttcgaggtttgtcgttcttattagagttctttgcttttttctttgcctatttcaataaaatcttaccagtatgctatggaaatggacattattttattattatacaacatagtatattctgactaaaatggaattagaaattgtaacattagtatgtacttataatcatttgtatcattgtattactcgccttttgatgtaaattttgtttatatctcagaacatctccaacagcagatcagaagttacattgttcttgtaagtgcttaagaagtctgttagcaaattgaaatctttcagaagaatattccaccaaaatttcggaaaagcaataccagcggtaaaatatctgcc

SEQ ID NO: 11132 - DNA, 459 bp, Saccharomyces cerevisiae
ttttccatttcttctttccgttatattatattatactatattccctttaactaaaaatttatgcatttggctcctgtttaataaaagtttaaatcgcctcaaaagaacaattgaaaaatatgtaaaataacagcaaataaaagtcaaaattaaaacaaagtacccagagacaaaaaagaaagaaaagaaaaaagaaacagtctacaaattctatttgaatatataaaattatattctcaattttcacgtatatattcacctcacaaataatatcattcctttaaaaaaaaatatgtattattgtataatgtttcagcatagtcgttttttaagcccttttttttaaacttaaaaaacaaatcaatgagatattgtatacctatattatcgataataaagcgacgaggatggactgcaagatattggtgttaggcgcaggtggtctaggatgcgaaatcc

SEQ ID NO: 11133 - DNA, 420 bp, Saccharomyces cerevisiae
tgtgtatagttgatacaagtattttagataattattttaacgaacgtaacgaatgctttccagtcaatagcggcactggtaatatgatacaaacaatttctcaataaaacaacgacaaacttagtctgtttatatttccgtgcaatggtggaaacctgtactcgatattggagaaaacttcagagcttcccaacagttatcccggattcttaattgatgctctcgaaacgcacataaaaatgtgatttttttactcgcattaaattactgttgaatctatggttcaaacaaatgtatatttgcctacacatctttctctgtcccttctgtattgtctaaccttaaaatagaaatatttcatggttttatttcttttaagtttattatccatttttaacgtggtgagaaaacccgaaatga

SEQ ID NO: 11134 - DNA, 463 bp, Saccharomyces cerevisiae
ttctgtgtttgccattttgtagatagagaactccttaaccagaatacattcttgtacatatatatatacacgttggtacgatatgcgtttactttatgtgtactaaaatatataaaagtgaacagaagcatgttccttgtttactactatatcttaccaggaaacagacaaaaaaaaaaaagacttgctatatttaaagagaacgcacatttgtgaggggataataacacaaagcaaagtaatatagggtaaatggacctcctaaaattcagttctctagctatatcagaaattaacttcctgcacgagtcatcgtttgactcgatagaccactcttggtttttattgataggttgcaaattggatcaagatgatgaaatttacatcccaataaatggtaatgaagcagagtctcaatggtatattgaaaaagttatacgaatcccgatgcaggaaaatgata

SEQ ID NO: 11135 - DNA, 437 bp, Saccharomyces cerevisiae
aaggaatacgtatataggtgaacggtaataagagggtaatttttctacgggcaaaggcaaggaagaaaaagaaaaagaaggaaaaaaatataatgtgataaaacaaacaagcagcgaaaaagcgaaagggaagagaagtgtttctagagaagaaagtcattttaatagtaagtcagactcgtctgctaccatcatccaggtaccgctttcctttccatcatcattaaaaaaaatgaacatgcaagacgctaacaaagaagagtcgtactcgatgtacccgaaaacctcttctccaccaccacctacgccaaccaatatgcagattcctatttatcaagcgcctttgcagatgtacggctacactcaggccccatatctataccccacacaaatacctgcctattcgtttaatatggtcaaccaaaaccagccaatct

SEQ ID NO: 11136 - DNA, 412 bp, Saccharomyces cerevisiae
cctaactttacgactttacgatactgatctttttttttttttaaccaggcttatattggttttttgatttttataaatttacgaatactattatatataagtaaaacgttttacttctctggtttagtatgttggcgtaacactctgttctctgtaatataatatggcatctacttttttttcaacttctctaccgaatttgattatattgtgggcaaactggtcgtgcccgattcttccttcgaatcacccttggtgcagtaattagccttccatttcaattttatgggcttacctaaattaacagatataccctctacggaagcaatctgtttgataccatctctggagttactttggagcatattgcccgattgcggttgcagagacaatgtcgtgcctttaggtgatg

SEQ ID NO: 11137 - DNA, 435 bp, Saccharomyces cerevisiae
taatgaaatcacttcctttggttataattaatattattatttatatgggtatataaaaattaaagtaaagtaaaaaaaattgtataatagtttaataattttaatgattataagatatttactcggttgtaaaattgtgttctcgaaattacaaatggtctcatagagggaatgcgcttatgcggcaaggcagtttacttgtaagactaattataagaagaataaatagtgttgcttattaatgactcagaaaagtttccacatgatatttattagctttcgaaacttcagagcattggctcgtgtgaacaatactagatttttcctcaaattttaattcgtattgcagttgctaactattacaatttttgtttattttatgccttggagattgaaccctctgttgtgattaacttcctgtaaaaactccacgca

SEQ ID NO: 11138 - DNA, 438 bp, Saccharomyces cerevisiae
tatctagaggagaaagaaaaggaagacaaagacaatcaatagaatgtattatgtatgacatataataataataattataataataataataatagtagtagcagtaataataatattattatagtatattaaaacaacaaaaaattagtaaaaatactataaatgtttgaatatgaagatatatatgtaggaagaatttttattgaatatagaaatttaaagaaatattattaaaaaccggaaaatgaaaaagaagagttaaaaaaaaaaaaaacggaactagtaaaagatgtgaaaaaaagaagagaaaagtagaacgagaacacccactatccttgggtattattataagttgcaataccatcatccagtatgcccagattaaaccattcatggtccagagcgtcctttgcggtaatcctttttgttgggtcgaac

SEQ ID NO: 11139 - DNA, 442 bp, Saccharomyces cerevisiae
actttttccggcaacgttttcctgctcatctgtagccctatttaccagttttggttttagtattattccggggtgtaaacccagaagtctatttctccagtcggatttataaaaacaaaaccggaagcggggcggtacggcattttcactggtgatgcacgcccagcgtgtagtccgagacaatttccacagaacgcgaatgagattgcgtttaaggctgtattttcaaggcacacgaagcggccacgtgggtctgcgatggtgtgttgatgatgtcaagaatggtatcatactccgtataaggttatgtaatcggaagtcgcgattctttttcaattttttctttttatttttttccagttttttcgtctctgcgatggaaaattgttgaagttctcttgattagcaagtagttcttacatcgcaggaatcttatgttgca

SEQ ID NO: 11140 - DNA, 436 bp, Saccharomyces cerevisiae
gatacatgtgcaagtacaagttcaaaaataaaacataactaaaaaaaaaaagaaaaaaaatatagtcatcttctgacactcgagtctcattcagctaatcaaaacaactagcaatccactcgagttcttataaatgacccggaaattgatctctccacattacgcttatcacgaataagaccgagtgttcaaataaatagctcgatcttcgtactgtctaatgcggtggattagtactttaggacaaagttactttttttcggaaggaaacttcaaaaatagaattaacaaataagaaggaaaagcgaaaaacaaatctcattgcctgtgctttcttttatacttttttttttcgctcggaacctcttgcttatacacggtttttttccacggaaacctcggttacccttcaattactggaacgttagggcacaat

SEQ ID NO: 11141 - DNA, 402 bp, Saccharomyces cerevisiae
tttatatgaaaagaaatgaagcgttaacatctaaaatcgaaattatagggactcattagccatctattgttccagtataagaatgtttacataaaaaattcgaaaaaaaaagataaaataagggaaaaatatatatatattcattaagaagttttgtacacaacggagccaagatttcaccagtatttggagacaaatgtgagcacgttatggtatttacttacagattacgatctgttcaatgcatcagaaataggaagaaattcaaaataaaataaaaaaaatattaggaaggagtgaaaaagcaaataagatgatacagtaaggtggagttaatgtctttcttctccaaaatgtattcttgctaaccaaaaatctgattctctctgacctgttcgtttg

SEQ ID NO: 11142 - DNA, 477 bp, Saccharomyces cerevisiae
tttttgataaaactactacgctaaaaataaaataaaaatgtatgatttccctccatttccgaccaattgtataattttatatctgcatgacttaataatataatataatacttataaaatacgaatagaaaaatttaaaccgatgtaatgcatccttttctttgtcgtcttcggatgatctgccgtgacaggtggttcgcgcaaatcaagctggtttagagaatttaacacagaaataaaaaaggaagattcaatcttcgtttttgttttatatcttactataaaagtgtttttttttagtacgacgagaagttagagtaattataaaaggaatgcttatttaaatttatttcttagacttcttttcagacttcttagcagcctcagtttgttccttaacgaccttcttaacaatcttttgttcttcaatcaagaaagctctgacgattctttccttgacacagttggcacatctgg

SEQ ID NO: 11143 - DNA, 406 bp, Saccharomyces cerevisiae
gatgtcgtttagttgacaatcagattttcttcattaattttatatttacgcagtttcttgagccctatatatactctttttaaaatttacagttttgtttaatttattatgtctctattagttttggctatctgtacatatgtatttagatgcattgaagttccgtaaaagaatgcttgctggaataagagactgatggagaacttgccataaccgcgcagatactttaaagcacaagattgaatttgtgctccatgcagccaatgaaagaaactctgagattgctgtgtgcccttgcaccgaccagtgtgaacgttgttgtccatatggggcatgcactcattatagagaaggagacattgaaacatcagatatttgtattaatttgctactgtccgaggaaggt

SEQ ID NO: 11144 - DNA, 425 bp, Saccharomyces cerevisiae
tggaaaaattaagaccaatggatatctacagatcctgtgaatcgagtgtgagtgatataccgcaagatcggtagaaaactgtatataaagcaaagaactgatgtggtgtaaacgatgtagcgatgtaacaagagatactcggtaatgtaatcaagatgctctttttttttttttgcggcaatatggtgtacgtaaaattaaggttccgtggagtctgtgcttgcgaaaatgatattgacgcatggactgtcgaaataataaatttacaattaaacacttggtgatttgaatgtaatttgaacgtttaaaaaattccaagggaatattactgtttcgggaatataacgtttgatcgctagcgcacccagatgagaatccgcatggatgggttgttagtatttctattgtgaaaccgctttgttctg

SEQ ID NO: 11145 - DNA, 428 bp, Saccharomyces cerevisiae
ctacataagtgcaattaaagcatcggtacaccatgtaacaccagtacatttattcatgaaacattaaatttttctgcgtcgggccgagagattattttcatgatacttcggcctagctatgctcctacgcccgccaatgcagaacaaatcctgcccgggaaaactaccccgatgctagacttctccctctgtatccatgcccggcaacagagacccttggctaagcccgatgcgcaatagtacctgtagtgcactccccgagcttatgcctgagaatatgctattgcaatgggtcaatgtaggtactgcagggaaattcaatcttgggctgctgtgtaataataattaaattagcaatttagtaatcacactgtataattgcacgctatcgttatacatattatttctctttgaaaacggaaggtgaa

SEQ ID NO: 11146 - DNA, 459 bp, Saccharomyces cerevisiae
taagtcgccctcagtccgctcattttagctgaattttctaatgttatttttcatcagcaaaacttaacagaacgttaatttatctaccccttttagttcattatctcttttttatccaacattttacagagatctctcacttaagtctaagtaaagacattattttatatggtacacttatagaatatacgataataataataaaaactatgtaacataaccttcagaatttaatattagtttcctttttacctcattgcactaataaaaaaattctacagaatctccgaaaaagaaaatccagcttactctttttgttttcttcttcacacgtgagcttttccgccggcatacgttccgttccgtgtcgtcttgcataaaatttccgaatcacatgttcgtaaaacaaccggaagtgccccgaatataaagtcaattctcaccgctgttgtaactgga

SEQ ID NO: 11147 - DNA, 440 bp, Saccharomyces cerevisiae
atgcatgcgataacattagttaggaacatattgcactttttttcacatccctttctcaaagctatattcatatatatatagactctcctgattatgtaaatcacaaaccaattttctaatgtaacaatatttttaaaaataatcatcaaagtagcactttatgtacagaaaatttcacgattgagagaagcttgcgaataatactagttagcctgtgtttcaccatcgttacttaatttcttatagttcttatattctttatttttatgccacaaccaaccttcggttcctctaacgaaaccgaaggcgattaataacccaccgaagctacgtaaagttactttccaccattgtgggtttcttttttcaaattcagtcagagaaatgcctcttttggcttcttttttaccatacttgaatggtttcccagatgccaagta

SEQ ID NO: 11148 - DNA, 479 bp, Saccharomyces cerevisiae
gcggatctcttatgtctttacgatttatagttttcattatcaagtatgcctatattagtatatagcatctttagatgacagtgttcgaagtttcacgaataaaagataatattctactttttgctcccaccgcgtttgctagcacgagtgaacaccatccctcgcctgtgagttgtacccattcctctaaactgtagacatggtagcttcagcagtgttcgttatgtacggcatcctccaacaaacagtcggttatagtttgtcctgctcctctgaatcgtctccctcgatatttctcattttccttcgcatgccagcattgaaatgatcgaagttcaatgatgaaacggtaattcttctgtcatttactcatctcatctcatcaagttatataattctatacggatgtaatttttcacttttcgtcttgacgtccaccctataatttcaattattgaaccctcacaaatgatgcactg

SEQ ID NO: 11149 - DNA, 465 bp, Saccharomyces cerevisiae
tcaagccagtaagtgatagttaccttagatagaaagtatggtccaatcttgcgcggctttgttgtgttatttttttccattatgcttacaatgaataatcttatcctatttatgaatactacaatttaccatcagttacaaaggaagttttttatatattaatttggggcaggtgttactgttcttgaggtttggcccactatatcttttaatttatcgtctactgtttcaatgacaccactccttttattaccagatgcatttttgcgaagtgaggaaccccatatcgaatttgctaaaacgtttttccaagctatcacatcttccatagctttaaaatgtctataattgactaagtcagtcaatatttcaatctgcttattcaccttattaccacgggagattttggttcttttcctttctgaacgggctaaaatcctcgcgcctggcctctgcgaatttatt

SEQ ID NO: 11150 - DNA, 479 bp, Saccharomyces cerevisiae
aatacattatccaaattctcatatgcttgtatatgcccccatgctgatgcgcagattctgtcactctctctttaaattacgtgcacatatgcatacgcaacagtcacgttatattcatgcaaaaaaccgaagcaacatcattatttcagttattctcttcgacaaatttctttactttttcgacaacctcttcaatttccttatctagcataagtacaattaaaccatcgctactaatttcgtatttgatatgaccttcgttcggtatacatatttcggcatcgaacttatcaaaccaggtatttaattcgtccagttcgtcaacattaaatggaagtatcaactcgtcaacaaattcatgcatttttcccggcttacctttcaaaaatttttcatcttctttatttatcttggtgtcgtcttctagtaagacgagcatcctataagtattactcttggacatttcgtttttctctttc

SEQ ID NO: 11151 - DNA, 410 bp, Saccharomyces cerevisiae
tatttaattttatgtgtcctaatggacatttgagttccttaagatgttcaacaacttagaaaaatataggtaatgataaagaatgaatcgcatgtattgttttaatattatgtcaatactttgaacttaaaaacagagtaaagaagtggttctaaaattacacgtattaaagggattaattactacatattcattctcaatcatcactatcaccttggctcaaaacaactctagactttttgccaaaaaggcggatggcctcttcatcttcatcgctttcatcggctgcactcgcttccaaagaacgctttgtagattcttttctgctatacacctcagattggaacatattttgcgaatttgatggctgtgatgagcccaaactatttcttgattccgagttgacatcg

SEQ ID NO: 11152 - DNA, 415 bp, Saccharomyces cerevisiae
ttctgatgatgaatccacgattataatttgtgtatttgcttatctgtagtagtttctttcgcatgtggtcgctgtatgagacacttgacaccagaggacgtttattttgaagcaactcctctatgtaagagctgtttgcaagctttccgtactgtgacacttgaccatcataacgtatattaacgaactactagggttgttgtgggcttctttcaaaatgggaattgttaaaaactattgataaacgccactcactacatgcattgattgtaagatttaactatcctttttacctgatgtctcgaaaataagcgtttacaacaactactattttgccgttctagtttaaaacatggacgctataaaacactaaatatatcagaagatttcacttagacacaaaagaagggggtga

SEQ ID NO: 11153 - DNA, 446 bp, Saccharomyces cerevisiae
aaaaagtgaaaaggaaatgagagtattaatatttattaagtatggagcatatataatccgaaaaatgattatagattaatttagaatatgatttgggaataaattaacaattagtttaaagcagaaggcagccggatgaggaacaagaactgttgaatagtattaggtaattttgaatgttttctaacggaacgctattcactgattatacgctttgttcgtttggattatgagatgttttggaccgcctcattgatgggatacacttctttataccatcaatcacagaaggccaaatttttttgatgtaggttaggtagaagcccacaaacatggcggcaatgttaaagcaaacgaaaacccattcaaaaccaaaatttctccatctgtgatgataactcatattttcttgagcaaggaagtcatccccaacagtgtacatgcag

SEQ ID NO: 11154 - DNA, 420 bp, Saccharomyces cerevisiae
agtgcctgagcagaacggggcgatgtaacttagtgtaaaatgaataccacatctatatatatccatataccaatgtatttatatctatatatgtctgcacatatatattatactctattatcaaggacgaaacgtaatcacatatgtatcaacgacaaccggcgcctcatgtaatctgtacctttctctacagttacatagcatgagtatgtgtattcctatttaggaaaaaattaacgctattcttaaggtttacgaaagagcatgcatcaccccatacgatccccggagtaactcccgcaggtgggtgtgcgggcgctcagcctgctatacgatttagaaacgaggcgctgcgttaccgtctgtgacttcttaaataagatttttaggtgtcccatccttccaactgtgcctacacca

SEQ ID NO: 11155 - DNA, 406 bp, Saccharomyces cerevisiae
gatgctgttgaaagaaaaacagtccttataaattcctaggtcgatactaccttttgtagctctatcgtcagaacttctgccctcctgtatcatagtttcataaaataattgtatatttattaccagaagtacccttgtattacaaaactaatcgcacaccacaaagagtaaaagtaggtaccatagcagcagcgcttaacctattctccgtcagtatgaatgaaatatgtggatttcgattacgattcattataaatcagaacacataaagccattttactgagctatctcaactgcacaaaccataacaagtaaaaactagctagtgtaattaggagattatcgaaagtcctggtcaagcagcaagttgggcgaaagtgtatttttggtccttaaatagtcccga

SEQ ID NO: 11156 - DNA, 485 bp, Saccharomyces cerevisiae
tcacatccatttctcccaactcattgctttttttcgcttttcccacagccgtttacaaggccgcaaaaaagaaaacccgcaaagctgacggaaaaagtatcggctagctttccattggcgacaatcgcctccgagtgcgaaaacctgtatttctctgactgccgtaggtcatataggattgggtcataacggttttttggagacgaatccttcccctaatcgtgttggataacattacggatccgtgttttagctaaaggaacaaaacaaaaataaataaaggataagaagaaggattcactgataattaagagctgtatttttcattggttcggcagttagaaacagagatagcatcagttcgagtgttctttgatatagtaaacagcgtatatagaaaagaataaagtgtattgaaaggctcaagagaattatagagaaaaaaacgaaggataaatcaaaaaaagcggtgtctgatacagtgc

SEQ ID NO: 11157 - DNA, 452 bp, Saccharomyces cerevisiae
gattatgtgtatcgagaagcaaattgatttataattagagggaatggaattgatgtttaatacctgcttactatattttatctttgataattgcgcagaaagtaatatatccggtatttgaaaataggaaatttaaagaaatcccgtcacgcctggaatgaggggtgaaaccttgactgatattatattcttttcttggacatagtgtctgaaccaaatgcaaattgcactgcattgcaccaaattgatggttcaagttcgatctataaaaatacgagagaaggtctgactgtttatgtcaatactcaagaggctcaggaacagtgttaaagcttggaagttcaattcattaaagaaaagttgataacgtcaggtggaaaaccgaaagataaaaataaaagcaagtcaagatttgaagtattgctgagcgaaattttgtttgagtggtccgg

SEQ ID NO: 11158 - DNA, 405 bp, Saccharomyces cerevisiae
aacagcgaaaataaggcaactggatttcctttcttcttgatattcctgacttatatatgtatatagtattattttttcctgcataggcacatatgttaatagtaatttatgcaatttttgatacaaagaaatcaatacactatctcgatttcatattttatgtatgtatatatttacaagaagaaaattatgcatggtctattgaattttatatttggaaaaagagtccctttttatagcttttccaactctaacattccttctaaacagtcaatttttgaaattttacaattcttcacgatatctccaatcatcggataatgcatagaacttggatgcaattttaatgttcctctagcgaacgataagtctggaaaaacacatccagtaaatccgttctgcggt

SEQ ID NO: 11159 - DNA, 498 bp, Saccharomyces cerevisiae
attgcatcttggcttctagtttttttatattcaaaagggttcttaagtgtttttaaatatgatactttttttaatatcttacgatccggaagagatttttgatgtttacatatgagccgtttgatagaaattttgcaattttttatatttattaaaagaataaaagtaaagtgcagaaagaaaacaacatcataaaatatgaaagaaaaaaaaaggcaatgttagtgttatgaagggagaaacaattaccgtatactgtttgcaggtgtctatcctccacggtatagcacgttaggaccatttattcgcgctacggatatagagtttaaaatgacttaattacatgaataataccataattcttataaccgtcatcaatctaacgaaagctaggagcaattttcaacatgtatttcaagaaattagcaatagaaaaagaattgaacagatatgaagatttttgccatattttaaagagaggctggtgacttttctctg

SEQ ID NO: 11160 - DNA, 496 bp, Saccharomyces cerevisiae
taaaaagtgcaggtaacaagtcatatactcgcagcttgcgccgtgttggaactaggcgccttaatcatgtttgcatatttccactatcccagccacgtaatgatccatgacattaacatagaaaaaaaaaatcgaagcatgcacaaacctgagatttatatatgttcatgtgtacttaatatacgtttaatgattaaaactatagccgtcctcaggcaaactgagataagaaacgaaaaaatagcagtaacgtaaacgttattctatatttataaagacgtcaaaaaaaaaagtgattgtgatattgagatgtaagctatataccgaactttgagctccctcacgtggaaaatatgatagattgttgcctcatcattgcggaaccgcattttttttttgtatttttgcctccctagtttcaaaatgcaccaaattctccccttaatgctttttgttttaagtcccaaatagccatcctttcatcatcgggcaagat

SEQ ID NO: 11161 - DNA, 400 bp, Saccharomyces cerevisiae
acgcctgatgcgagctatacgttttgtgctcaccgtgcacatatggtggctacttttctactcaaacacgtttgaaaaacggcatacgattagcttacagattgaactcaaagaagtcgcaatgggaggtgcagaagatgacgtgttacttagtttataatacaatgtgttttatatatcgattcttcgtttatgcatttctggacgattgcttttcactgtaaatacgcactaatattcatgaatataaaaaaatgtaacatcatatctcaatgttcttctccgtcagtcagatagtggcaaggctgtgataggacattcttagaacgccaagaaaatcaaaaatttgaacggtatctaaattcatttgtcgaacccttgaagaaactcacagagcggg

SEQ ID NO: 11162 - DNA, 439 bp, Saccharomyces cerevisiae
aggttaaggaaatgtaaataaaaaaaataacagtgacattaatttgtatatatctcaacttcttcactttaacctgtctgagctgtttggttttgaactggaagcacgtttctcattttattgaacgataccagagccattcattattcgattgacggtaagcggtattgtgcgaaaagcaaagggaaaaaatagaaagaacaaaaaaaagaaagaaaaaagcaccgtaaaaaaaaaaatcgtttcgtgggccgagatcggtaaagtggctttcttttagtcagaattgattttcttttgattaaggcaaaaactgtgcaaattaaactgatggacctatacataatagtgaacacgactcattcaaaaaatttgttgtagtgaccagaaactctggcgcaaattaatcaagagaaagcgacccccaagaaatgaaagc

SEQ ID NO: 11163 - DNA, 405 bp, Saccharomyces cerevisiae
accgtgtaaaggcaaatttagatagataatgataatgcactataatatataataaataaaagagaataaaaagtttaatcacgttcccgcttctttttcctaaccatcaaagaatgcaatctaaagaagaagaagcgaataccctcttttaaatatatacgcgtctatatgcactgtagataagctgttacatatcaaaaaggtttggcacatttgcgcttttctgtagcgcctgtaaccggtgaagtcatcatttgccagtctgtagcatacatcaatccaccagcaccattagcagctctggcgaacacgaccccaaggtcattccttgcagtggtcaaatagtagttggttccgtcacctaatgataaaacttgcgccctaacaatatctcccggcttgaaa

SEQ ID NO: 11164 - DNA, 495 bp, Saccharomyces cerevisiae
aattacttagtattaagattctgccccttgcatgcatgcacaatatgtgcttgccaattcatttatgtacaaaagatggtgttatataaggaatatattttgttttctttgatattttccctttctcatattcttgcggtttttctgctttcattacgtcgctaattagtttgtcaaaaattataacaccgttagtttccaagcaataattatataaggtcccgttaaaaaatatcgataatcaaaaggttttcaagtagcaagcaataaatagctttccgaagactaaacaggctttcatagtgtctcagtaagcgtatggatggacaacgcagttgatgacagagaaacacaaaactatggggaaatttaaggttattgtattggcaggtactgcaggtacaggaaaatcaaccattgcaggtgaactaatccatgaatttaaagatatatacccggatttgaaattcatcgaaggtgatgatttacacccgc

SEQ ID NO: 11165 - DNA, 484 bp, Saccharomyces cerevisiae
gaaaaatttcaaagcaaagaaaagaggtgtgaggagcgcaaaagcaaaaagggggatagcatacattaacacattttttggctctttgctacttgatttggttgctatcaaggcgatttagtttcgtctgataagaaggacactatagattggttgaatgattctgggttatctaaaaaaagattgtgaccggaagaaggtatttctaaataacttgctccttctagacagttctttaaattgttcaactctttgaccatgaacataccggcttttttattcatccaatcatattgcccatatactatcaataatttcttaacatttaaatattgcagagaatccatcaaggggtcctttgctaggatacatcttgaaaataacgctttgaaaatatctgtcgtaacctccggtatacctcccttaccgtaaaacagttcaaatatgtactctttgtatgccaacgatgggactcggctatatg

SEQ ID NO: 11166 - DNA, 415 bp, Saccharomyces cerevisiae
agcagcttgagattgtcttaatcattctttgcttaacacatttcaaaacatcagttttcttcttttaatgtcactaatgaaacttaatatttaataatctaattttaatttctttatgaaatatgcaaaataaattatatacaaacacaataattaataatctaatctcatttttccaaaatcaagaaatgttcttactgcttccatgcctgaatagtctaatcgatagtaggccatttcaattctttttagttatatggagacgcaaacaccactttattttagcgtaccctaccaaaattaaacgataatatggtatttttattctcatttgttacactctattctgtatcactggatacattcgcggtaacttgttttataaagtgagatgggatttatgaccattagatgc

SEQ ID NO: 11167 - DNA, 495 bp, Saccharomyces cerevisiae
actatcagaaaaacagctagccccgaagaactcagaagcctctcaaatgattttggcactaataaaagcaccaactattattattattattttcaaggacgaaactcaccattctcacacattcctatacgttaggcgtttatgtttactctctatgactattatttatttatcattggcaatgctatgacccggtctgtatatatgtccatcataggcgacaaggtgttctagtatcttcaggtattgttgtttttaaggatgaatttatatctttgtttttgaagggccttttggcttctctcccctatttattcaatttataactatttattatattaatacacgcgtaatgcttaaggtttattattaaaggactgtttttatatttacatgcctgtagttaattatattttcgttgtgaaatttctgttaagaaactctatatgaaaggtaacgaacttaaaattgaaaagcaatgagaagagaacacca

SEQ ID NO: 11168 - DNA, 497 bp, Saccharomyces cerevisiae
tgaaattttaaagatacggaaattgcaaattgaaaaagtttaatgacactcaccagtaatgattttgaaacgaaaaggcacttctcagggtgagacgaagaaacgaaaagttttctaagcacagatacacttctctcgccgcccttttaataatttagaataaaaatattatagatttatagattatattatgctaaactaaaaagatctacatcatatattatttttagcctgttaatgatattaagttcattgcaagaggattgtaaatcacatgcatttcaaatacagaacttattttaacatacacatatatgcgtgcatgttggcaagggtaaaaagttagagctttctaccatatatctgattaacatcgtagtccgatggaaattactttgaattttacactcatggaagtgcactccttctcttctcttcatttagttcagcgactgttaaagatcgcgatctttcatgggtcctttgttttatagcgc

SEQ ID NO: 11169 - DNA, 455 bp, Saccharomyces cerevisiae
agagaagcttattaccttccccttccatctatgcacggtgtctcgtacttccatagagcaccgattagtgaatactaaaactatgtgcgtgataaatggttctcttttacagatgcggtaaatcaattattgatatactacataacatacaaacatgtttcatttccgtaatacaaattacaattgtataattaaaaaatataaaaaacttcgtgatatgaaatcacattttgctattgagtttgccacatgagcggtatacgaactattcgttattttatgactttaaaagccataccgaaagtaggcttgagaagtatgactactgtaggagtgaccactactgttaaatgcagatagccgtcttatgctcttcccttgttcttctgaattgggaatgcatagcttgaaacatcaatcttaataaggtcttgtttgtttctgcttggctttca

SEQ ID NO: 11170 - DNA, 400 bp, Saccharomyces cerevisiae
acataacgtcttcatctcctaacttcatgtataataaaaactattagcacatctattttatatatgtacgcgtatatcttacatcgtaccgttatagcatttgaattattgagcttttgtatcatctaccgctgtcatgctcgccttcacggaacttagttatgcgaaaaagaattcaggaaaccaaagctggcagggtgagtatttgtttgtaaagtcgcacctttagcagatcattagctgtagcgtatggaagaaaactaaatgaaattgtttataaaacctgaatatgataaaagaaatctaaataataaatatgattgctatataatagttatatttgaaatgaagagaaagggaagaaaataaaagtattcaaaacgccaacccttaatgaagt

SEQ ID NO: 11171 - DNA, 462 bp, Saccharomyces cerevisiae
atagccaatttcgacgaacgatgaatgttttatatttgtaaatatcacctatcttaatattctgcacgaccgtcccagaatttaagaacgcttaataatttccagaactactgttactagtaaagcaaaaaaattccctgggagaattaatcatgctttaactagactctgggccgatcatttttgctggaagaaaatgggaagtgtaaaaacgataccctttccaattttcccatgtcgatgaattcgaggcgttagagactgtcgctaaactcaagtgatagtcacactttaatattaataaattggaagatttcagtcacatatttgacagaggaaaatataaaaataagaagtaataaaagtaaatcattatatataaaaaaaattaagcattattcacacctgataaggattttctaaaagacgacgccattattagaacaggagcaattcaaatcg

SEQ ID NO: 11172 - DNA, 434 bp, Saccharomyces cerevisiae
agagcacattattttctaagcttgtaaatacatatttattcataatggagaacgttattcaaatttatctgtgaatttctttactcgaggtatacttccgcaaaggaaattctacttagcaaatcctatggtaacgtcattgttttgtagcttgtaagtggagcctaactgattcttgattttcgtagcatcagcaacggtctcgtattccacgaaagctaggttacgaacgctaactaatctgatttcaactaaagcctcattgccaagtatttgcgacaataattgctcggtagtgccgcttggcaaattttgtataagaaggactttgttcggtggattttccattgtattggacactttagcccgcttaagaggtttctgcgattgttttagattttcttgctgagacttcatgttttccaatctacggg

SEQ ID NO: 11173 - DNA, 422 bp, Saccharomyces cerevisiae
agctgatgcattgtcaaaagagccgcattaccagctttgccaaatacgcgaagacaaaaaggaaggtgaaataccaactgacttataactaagtgatagatgatatctgttttaagtgccattcctgaaccatttttacatttggttagtttctttttttgttattatttgcattagtcccttgcacgttcatagtgaaaatcccttacgctcaccactattttctaataaatacaatgaacattttaactcatactctaatatgtagacacataaatatataaatatataacatttccctgaaatactacttttattacgtggtagattttaacctgaagccgatgcagattattctagataattttatttcggtttttttttttctgttttgctaatttccaagaaccctttttcttctc

SEQ ID NO: 11174 - DNA, 402 bp, Saccharomyces cerevisiae
tggtagtatcgcttactctatcatcatatttctcgtatgtacatcgactcctacgcagactgatcttcaagcgagccaccgtgaatgtggaagcataaacagatgagaaacctttttgtttctgagatcgtgaccttagattgtagtgtgctaatctccctagtattgactactttgcgtttattcatttctttctccaatagaaatacagcataaaacatacgtagggtatatctatgtatgtggtatatttgtattataagttacttagatttactggcgcccttttttaagctattgtaattatttacggcctctgcgattctttccttgaaagtatctgttattatcgccagttggtttaacatttcatagtgattttccaacgtatcgcatttttca

SEQ ID NO: 11175 - DNA, 418 bp, Saccharomyces cerevisiae
tttagttttcaactcattaaaacggtatcacgtttaaatatgtgacaagatctgatggacatgaataatggtgatatcagcaccatcgagggattttggaccttagactttttaaagctacggaggacttaaagcatgtcgatacaaataagatatatcatggcttcatgcgctcaaaagttttattcttcaagtttgttgattataatatggttcacgtgcgcttcatcttttcataggtaatgcaccgcaacattcaattatctaaaaaactttcaggcgtgccggtcccctaatttttgcactgagatcatgagatcagtaagtaaaagctcatataggaaataatcatatagaaaaaagcagaggaatgatattcgaacattttctatacatcacccctcctatttttagatga

SEQ ID NO: 11176 - DNA, 406 bp, Saccharomyces cerevisiae
tcatatgacgccatgaatttaccactagtgcttgtaaatagttaaatattaatgccttatagatataaattgtccaatctcctttttggaagttataatatatatatatatatatatatgtatataaatgtggatgcatattctaagaattttgaacgctatactttgagagactcttcaaatatgtaaacaagaatgctgcaatgtctctatatggattagcagtgttactcaaatgcattaaaatctttactctcaagtcgtgaatgttattaacgccctttatccaaccatgctggccaatctcatcatgatgaactcgaaagaaattgttaaacgtctcttcatttatgatcccactggtgaattttattttggtattttcggccgtttccagtcgtcttag

SEQ ID NO: 11177 - DNA, 471 bp, Saccharomyces cerevisiae
acgctatagcttaacctcgattaaaattaagttcagtatgccataggtgcgtttattacatgttttttaacaacacttcaatatttctttctctgtatttttcaatagggaacaaaatgtactattttctccatgaggcctgaaatagcaaatgtactcccgcagttaataaatgtacggacagcttttcatagccaattaaaagcagtttatatctctttcctagcggatcacatctaatggttgtccaacttcccttggattaagaaataggtgaataacgggatagtttttgaggatccattattgatagaggttataattttagacaggcaaaatattctagcacttctcgagggcataggcatccctaaaagggaatcaataattttacataatgatattaccatatcttttatactttcttgagatctggagaattttgtaaaattgttgggattccatagtcga

SEQ ID NO: 11178 - DNA, 464 bp, Saccharomyces cerevisiae
atgcctttttaatcaaagccttagggcaacatgaaactatattcatccaatcaaaaaaatgagcacaagaatttctctttgatcatttttcttttacctttaataacaatcgttatcaacattttttatttccagtcctaccacagcattattgcataattaatttacaggaagattttcttgaaaaaatagaaagaaaaatacccattttttcaaggaaaataaaatttatatattacatacatttctataaaacagtttaaattcaaaaatataaacaaaaacataaaaataagaaaagttcaagtcttcgttattttctgtttgtggagtaatcgatcttattaacatatatgtggagacttttcaaatatagccacctgcaacatggaaccatagtgtacaggtatcacttaatcctccaaatcatctaattcaaagtccgatgtggagagtagctcggc

SEQ ID NO: 11179 - DNA, 443 bp, Saccharomyces cerevisiae
tttattttatgctgcaaaccttccactttaactttgtattatattacattagatggttatatttcaatgtgagctctttttgtttttgctttcttttctcggatacaagtggaaaacgaaaaaaaaaaattggctaaaatttactgtatacatcaggctaacaatctgtgattataggcacagttgtaccaaagaagggctagaatatacatcataattagatgcaattagcatggctataagattgaatccaaaagtcagaaggttcttgctggataagtgtcgacaaaaacgatatggtttcctctttttaggatgtatcttcgccatactttactgtatggggacctggccatttttcgcaaaagatattgtacatgatccaaataatttgccttattccttacaggattattcgactgacaaagacgagccatttttcc

SEQ ID NO: 11180 - DNA, 493 bp, Saccharomyces cerevisiae
taagagttattacgtacttccatttgcttcctcttcataagagttcagtgtttcctgaagttgtccctttatcatttccaatagtttgggatcctgtaacttagaccgtacatagacatccaagtcaaatttcttctcaccatcaccattatccccctccattttactacccagctttaggtagttgtccttgaccaattgtgattcaatcaatgcactggttagccctctgtttttaaatattaattcttcatcttcgttaaccatttctttaacagtactggcaactcttttccgaagcgcttgttcaaaagattcactattctcttctgtattattccatgggttagacaatatttctcttttcaacttgtcaaaatgtccctccttcttatacttgtctgatagtcttttactatcttcttgattatacgccattttttggatttgaaataagctctactctcttatactgtgtttcagcttcgctaaa

SEQ ID NO: 11181 - DNA, 431 bp, Saccharomyces cerevisiae
atgtaaaattcagggataaattcatataatattttgtaaagacagaagcttcagggttaagtcttagccgggccctccagcattgataatcatttttttcaatatcaaatgccattgaaaagtccaacgaaaattacatcgactttacaaaagagacgagccggtcacattctagtattggcgaagattggaagccatttatcaacagcaaggaggcattctggaaaaattgcagcatatttaagaaaagtgataggtttatttttatactagaaggacaggagcaacgcaagccataatgcagataataaccactacgttcattcaaaaagtaattttaggatcacaccaattacatgagcaattatctatagtggaagcccgaatgattgaatctgccatagtttcaatgctcacagaatcattttgcg

SEQ ID NO: 11182 - DNA, 458 bp, Saccharomyces cerevisiae
ccctgggtggaaacaagtcctagataatcatcttttgtattttttttcttccttttattagtatgtatacatatatattactttttatattctttatagcgcattttaaacacctttctgaaaaaatgctgagatttttgatgctaatcgaaagattaaaaaaaggtctatagaggtaagccaataacgcgatgaataacggttctggtcgatacttgctgactcccccagatgatcttcacccctatgtgccaagctcgaaacctcaggaacaagtataccctgatttcaagccttgggagcacactgcagcagaagatcaaatcctagcaaactttgtggctaagggcttttaccatacaccaatggtaaatttcgagtccatatctgcgagatcatctgttcatgaatcattagtcactcaatccaacattctttcccagcaattcgacaaaatt

SEQ ID NO: 11183 - DNA, 500 bp, Saccharomyces cerevisiae
agtctttcgaaaatatgggttatcattagggagaaaattaccgagactttttcggctacttatttattctgcatttatacatttgagacaggttcttcatattatttttagtttgtgggattgcagttttaactgtactgttttcacatctttcattcattctagtcaacgtttcatttatccttggcctattttatatgtagttatttatgctaagtatgtttgtttatcaagcgttcacttttgttattggtttttggtaaataaaaacggcctttcctttagggtgtttcagtgttgcggaaccagtcgtacggagatttacacaaatcgatgccataaatcttccctattatatcatccatgtagtaaattacgtgacctggcatgaaattcatggcaatttctaaccagctacgcttatatacaaaatacattactgcattcatgtagattgggaatatagatggtgaaacatcaatggcaccgaagaatcgtac

SEQ ID NO: 11184 - DNA, 405 bp, Saccharomyces cerevisiae
ggttaaaaaagtgaatctccattgtttatataaattttaaatttgatatgtaaagattctaaacgcaatgtgcttatttcagtaatagtaaggattctcaagtggaagccagcttgcgttgtccgttgtgctttaggaaaaaagaagagtacaagaatattagcctctttaaagattttgtcaattctcctctgaaagcaaacaacagaccttgcacaatgacaccctttgtcaattgaggaagaactcccttccaaagagattttaacccttcatttttgtacaagtatagtagcgcttcttggaaagtagtgaatttagagccagcgctttgaagcattgctttagcgacaatcaagggttgcgtaactagagtcgaaatcatcttggaaaggacacccaaaa

SEQ ID NO: 11185 - DNA, 482 bp, Saccharomyces cerevisiae
tagcgtacatagagtattcacgttttttggcagaatgccttttttgagaactgttgcatttttatcatttgcatattacctttttcttaggcccacgaagttacttaagaggaaaaaaaaaaggaacaatgtatgaatggctataagatcaggatcagttaggatatattttaatgtctctgaaaaagcagataccaataatctttgaaaacacgcattacttcatagttaataaaccacctggcataccttctcaaccaccagactgcagaacatggggcaggacacatcctaatcttgaccctactccactactagaaagattcaaggctatttattattcacatagagaagtagaattatgtcgtactgtacataggttagaccattgtgttacgggggggatgctgattgcaaagactaaagacggaagtgtaaaattctctagatttttacaaaagggcggcaacaacggttataag

SEQ ID NO: 11186 - DNA, 495 bp, Saccharomyces cerevisiae
atataaatacgaagcggtagagatcactacggcatccgcctatctgcaaaggaagctctatcgcaaacataccaccgttaatcttcgctgccacagtttccttgtagaccaatggcatgtagcaccgccgccactgcccgaaaaaaaaagaaaatgaaaattaaagaacgatcgcaattcttgataaagctcgagaaaacaaaaactcgtgagtcactgtgcatttgctgtcacattttctacaaagcgacgacatagatatatagaggtgactatataaatcgtgtatctcttttgatggttaatatttagcctttagacatatatcaaacaaagcatcttccaaagtattagaaaagggaaatatgcctcataccgataagaaacaatcaggattagctcgtcttttggggtccgcctctgcaggcataatggaaattgccgtcttccatcctgtggacaccatttccaaaagactgatgtccaaccacacca

SEQ ID NO: 11187 - DNA, 449 bp, Saccharomyces cerevisiae
attcgattaccccagaaaagaaaaattcaaactggttaacattaaatcaagtacactttaaatactctggtattccccctgcattacgtatatcgttcactttctttacttttccttcttgctttgttatttctatctacaactttgcgttacatatttttaactatttgacacttcacacagatcttctttctaaggctttttgcttatcccacttggaaatccacccttcactttctacctttggcacaatatatattttcaaagcgttatcgaacaatggtacatctggcgactctttcttcaagatatcgtgaaatgtcagtttcttaccagctttaatcaaaccacctgcctttgtttccatgaacaccaacactttctttggtgtgaagttttccttaccttcttttttgaagcgttcttgcggcccttccaaaactaggtca

SEQ ID NO: 11188 - DNA, 494 bp, Saccharomyces cerevisiae
ctccttttaaattattctcgctggattgctatttctatgcatactccttgaattacatataccaatctgcatatattataggtacatattaatatagaaatgtatcctattttacattgtttctataacttttacattatcagaacttatttttttcctgtcaaaaagaaagaaaactcattctctagacacagcgagatcttacttttcctaacggtgtgaccatattgtacgtacaatattatctatgttttatgaccagatctagttttaaacagaattttaaagggagggtgcctaattttgtattatatattaaaaaagctgggaaatgcccggctcagctaattttcttcaagccggttttacgtgcagatcttgacgaacgaaaataaccatcatccgattaatttgtttgtttattgccccgttgcccattgtgcaaatccgccttgagcaaacgcttgtagtgcgcttccaaatccagtggacgt

SEQ ID NO: 11189 - DNA, 413 bp, Saccharomyces cerevisiae
cacgaacaattgtaatagtactaggcttgctagctttgctttcccataaccaacaatacttagtgatgtatcttaaaacgactaaaaaacttctcatataaccctactgaaaaacgtctgatgagctcttcgaaaattcagacgagttatgacctatatttgtttttcattttttttaggtgaaccccgccattctgaaaatgccctattcagagctcaataaccgaaaaaacttaaaaatactgaataaaagccataatcctatgaaccccctttcttgaatgagtaaattcaatagcattgttgaatcagaatcggtgcctcgggagcataagcaacacaggacatcatagagataattttagttgccattcattttttgctattacgttttcccaagctcttgttttcgt

SEQ ID NO: 11190 - DNA, 456 bp, Saccharomyces cerevisiae
cgttagcattgcatattattgttattaccattttaaaattataccaagctgtatatagttaagtacttttcatttgtaaataaaagagaaaaatagattaataaatataataatggcataatcattatgctttaagtatttcctcaagtgtaactacccctttaaaatctgggttttcgatatttttcaggacggatttgcttacctgctgagtggatactgttggcctaatcaagtcgttcaaaagctgcagcttatttctcaatagaaatttgttaccgcagtaaagtagttcaagtgcagtatgaataaaagaccgtggtccaattgcatttctgtgctcatcgaacataaaaccgggtctcacaataataggcctgaaatatctctgcattttttctagttcaatctccgcctctcttttcgaattaatatagccactaggaatcaatggga

SEQ ID NO: 11191 - DNA, 451 bp, Saccharomyces cerevisiae
gattagcgcaatcaagaacatgatttccttcggataagcaagggaggggtacgacttctgcccgcaggggcttattgcctgtcctcttcctcgaccccacggtatttcattatatatagagtcactgtaataataattatcatgaaacctgacaagcaaaggcgtcgggcaattaccaaagggcagttcggtcgattaagtttgcttcactacagattattcacatatcatacgacaactttaaaattgaacattcaggagatttttgaatgcattgatgggcccttgcaccttaaccgggtcccaatattagagaaacgcccccttaaactgaacacaagacaatactacctggccaatagggtacaatttgcggccgtgttaaacaggcgtttcagcgtctaccgctcctaatttaaagtcacttgtttcttggtagcagcagcttcct

SEQ ID NO: 11192 - DNA, 493 bp, Saccharomyces cerevisiae
gaataattgtgctgatttttatttcttaattacgtgttgaaatcacgatactggcatccgataggggagttgtattcacaatactatcgattttgtaaaataggacgaagaactttttatatacgagcatttcctaattagtaggaagcggaaaataataatataagaaagtaaacgcaaaagataggctgactgccttcattcgactaggaggtgaggcgacatatttgtcaccattcaagttaccgagatggtagagaggtggatggctcgggtgagcttgattgtacactgcagcaacgatgctttttctacccattttatgaagtttaacatccgtacctttccacctccaaacattttttgtaacttcgtcctttgaaaaatcaagaagtaataggtgtgcagtatagggccgcttgagcgcgcaatatcggtgagtgaggtaagatccatccataccttagcaaatatggtagtgaggaggccaact

SEQ ID NO: 11193 - DNA, 444 bp, Saccharomyces cerevisiae
gcagactgagaaaaatcaaaagaatcttaatgatgaatgccgagccgatattatgaattcgattacctttttgttcaatcaaatatagggcttcatcgtgagtttctttctctatcgatccgtttgctttctattcctccatcttctactttataccgtaaagaaaatttaataatgatagaaacattgcatataaataatatactaaaaagaaacactgctctaccataaatttctttggagaaaataacgtgaaatgagaaataaggacaatttgttatcggttataactgccgatacccgtatcttttgtgtttgattcaaggaatacttatttagagtagaaagaatatatttacttagataacttaatgtataatatataaaaaaaatcaaaaaaacaggaaaaaaaaaaatcatgagtgagtggcacttttaactgca

SEQ ID NO: 11194 - DNA, 404 bp, Saccharomyces cerevisiae
atttctcagtaacataaaaagcaggctctttttattaccccccccttcggttatatgtttggacgaactcatgtttctctttttatacagaagacttcaccggatatttataaacttaatgaattaatttgcttattacatgtatcaattgtactttacgtgtaacatctacagatacatatatccgtatatactagcatatatataaatatatactctatacatatatctatttattatgcttttctttcctctttttatggcatattatattttacaaagaaaccacaaagaaaaaacttttacctcaccttgcattaggaaacctcaaattttctatcattggcttaccaattctatctataacatcatgcgcccataaaacgtccagatgggaatactca

SEQ ID NO: 11195 - DNA, 492 bp, Saccharomyces cerevisiae
taggtttgtttttcgtcctcgaaaactacatctttattgtctatttgtttcacccttattttgatttttcatttactatccattatgttatgaacgggaactatacaactaacctaagaattttgaaatcacaacaaaaataatcaacatcacagtctcgaagggattacgctcaaaaaggaacgaaaatcactatactgtattccctgttgattttcctaagaatatattcttatacaatatggagaaaacaaaaggataagaaaagaaaggggaaataaagaagatttggacctatttattactacttttttgtctcaccatcttctttttctattcataatatttgatattcctttatttatctgcatgtatttataattaacgaaactatttatcttccctcgtcctgccttatccttcttttctccaaatgttttacctaagattggcctgtatttgaatattgatgtccagaagcagaagatttca

SEQ ID NO: 11196 - DNA, 427 bp, Saccharomyces cerevisiae
aaaggaggatagatctttttttcaaaaaaatcagcatcatttttcaaatataatatcatcatatgtatgcatatataaatacatagtagcataatcagttgcaaaacagggttctaatcgaatattacgtacattttgccgaagaaatggaatgcagctgcatgacatccaacccggatgacgaccaatgatatgatttgtttctcggagttttcattacttctttcatttttctttagacctagaattactttaagatacagagtatacaaaagaaaagaataaggttttatcaatacagtattaacttatttatgattgaaagaaattacctttgatgcaaataactactgcaaaaagagtaataataaaatgtatgcagcacatgttttttagagtgttaattacattggcatacctctccctc

SEQ ID NO: 11197 - DNA, 421 bp, Saccharomyces cerevisiae
tcatcatcccttttatcaaaataagcattctctttttattttagttaagcacatgcatacataaatttacgaacaaaaaaagaaaataaattaaaaataaaagtagtgtatcttcgttacttttcattctttttggttaacccacgtctaattgccaatacactatcgacgatcacggcatctacacctgcttcaatttgtatactggcattttcgggatcattgttgtccacaccgtaagtgacacataccagcccattagacttaaccacttgcaccaaccgtggggcctttaaaatgggtgctgcagcagatacaatccccaataaattccacttcttagcaaatcttataccgttttgtaacgatgaggctctcaaatcggccatctgttcacttccaccttccgtcaggaacaaga

SEQ ID NO: 11198 - DNA, 450 bp, Saccharomyces cerevisiae
aaatcactttttttctgacactttagaattttctcaagttttacgacattaaaactcaagtagtgctttttttcgtttcatttattattaattcatatatagcatttcttaaaacaaaactgtattatttatacttcaaaagcgcatttttgtattttacctagtaatattgatacataacatttttttttctaatatctttaggaaaaaagtacgtaatacaatgatttccccaagaagaggggtggggttgtaggtgaaggaaaacaattgtgcattatgctactggtgttgcattcttaataacacgatgtatcagtctcctcctcttgaacattggatcaaataagaattcgccggtaattggcagattcaacccacgttctaccacccacctatccacatcattgtcaattttccactcaaaattaggatcaaatgaccagcctg

SEQ ID NO: 11199 - DNA, 421 bp, Saccharomyces cerevisiae
ttatgcatcgcattttgttttatttgcatatcgcaatgaaaccgtctattcgggttctataggaagtacactgcattacactatgatgtaaatagtattaataaatctatattcaatatgttgtatttttgatctcccattgctaagaatagtactcctcctctttaaaaagcctctcaataaaatcgagaacttcttcagagtatacagctgtcagtttctcaccatccagcaaaatccttttttcgtgaatttcttgctcttctttcgtcatcagaacaacattggttaaggagatttctttgttagcttcccattttgttagagctagtttcgtagagtatccgctaataggagacttgcctctaaacatttcttcaactatataaccgacctcttctaatccaagcaatgacgatcg

SEQ ID NO: 11200 - DNA, 431 bp, Saccharomyces cerevisiae
cttttacaccacatcgttattgttttccattaacgcttacgtaaatttcatctatcattctacctgtaccgttcccgatgatagtggcttacaaaacggcttgaggtacagttggttcgaactttttgcattattgttgccttctttttttagtaacaagcggcgtctttgtttcttctgcaaaaataatctcgctcgagtaattggaggcttggcaaaacttaaatctccacgcatacccggcttcctatgttcgtgaaggactcaaaaacatgaactatccttatccatctttcttttgccaaattattttagccaatctatataacactacatcattcctttgagtctttctttatcattcattcgaagggagaaatatacgagccaaattcaaagacagactattttttcgagcaggcctatctcat

SEQ ID NO: 11201 - DNA, 491 bp, Saccharomyces cerevisiae
aaaagcttcaacatggccttacaaaggttttgcactaagaatacaagtgggtctcgaagaatttgaagatttaaaaagggattttgagttaggctttgaacgtctcgcagaagaaatttctttgaatcctttacaaatctgattttttttccttttttttttggatttccaagcaatgttgtttgagaaatgaatgaaatttttgactatagcttgtcttaggcaggctggagtagacaaccatctagtagccaatgtttgcccagttaatatatggttcaattttctagctgtatcatattatggatgatgaagcagataatctttcttttttctgtatgtctgattgtaataaagaggcttaccatattgtgaatgcatttcaatgacactgcataatgaagtcattgtatttagaaaagtaataattttgtattgtataaagatagaaaaaacgtatatcgtacttattcagcggaaatgattctgct

SEQ ID NO: 11202 - DNA, 440 bp, Saccharomyces cerevisiae
cgttaggtagatctaaagacagaaaatgatatcagcctctttcttttccacagcctccatttcccatttttgctgtatctgcaagggttcctttttccatttttttttttcaaagtcttggctccgcccttttcttttgtctattttgccgagcttaggttatttataaacctgaaaatcctcgagaaacaatccttatcgaaggaagcagccataatagaacatactcaagtgcaaacattacaagcttaaataagacaaatgttacagagtatagtcctttccgtgtgcatgtttatgttgcacacagtcgctgccagtggacctcagtcgtaccaaaagttggatttcactaatgttggttttacaggctcctacgtagatgtgaataagtttaaagatatcaccaacaatgaatcgtgtacttgcgaagtgggtga

SEQ ID NO: 11203 - DNA, 493 bp, Saccharomyces cerevisiae
tgaggcaaatgcgatcatcatgcctttgcgccaagaaactcccttgtgaagaacttcaaaccgaaatgggaaaactttgagttattgacagggaatacggaggggaagatcacacttaaatccgtatgagccgcgcacataatggtattcaaatacacaagaacattcatgagctatttttcatccgtgcaaacgaatttactacaattggaccagagggcaccataactggagactttgctactgactcaacgttgatgatgcgagtagtgggtgtactgtgatttgctcatttttttttttatagaaagattcgattaatgaaagtcacaggagacatttttacatagacattccgtatatgttgcgggtatcgcggatgcggattagtgatgcctttaactacatttcatagatttctgtataccaattgaaatgagtgaagtaagctcctacagtgaaatatctgggtgctactgacgccaagccctac

SEQ ID NO: 11204 - DNA, 457 bp, Saccharomyces cerevisiae
agctctctttgaaaagttgaaattatttcctttagaattatatactacttctacacaatttttaacaccttgcatacgaatttttatctctaatcaatattcttcaagcactttttgaatactttgatgttttgatttttcggaaaagttaatatttagtaccgatactatacattattttataaacaaacgtctttctagataagttttattaactgttctatttatcaatatgaaaaagtttcggagttcatagaccaatatttttcaattccaactcaattctgctcgttgaatcaatactgttcaacaaccgtaagttttcctcgatattgttctgcaagcttggaatcttctgaatgatcaggccaccgaactttatcatctgcaatttcacattctcaatggtttccttgttacaatttattggaaaagtttgatcccatagtctccccac

SEQ ID NO: 11205 - DNA, 465 bp, Saccharomyces cerevisiae
ctcgctaaatattcttgctgcactttgcgacgcctgtattggcgaaaacaaaaagtaaagaaaaaaaaactttagatgaaatagagcaaaattccctaagacaatagaagatacaaaagcaagttgggcccttaatttcatcaaaggtatagcatctcatcaaatagtcgcttgtttatcgcaatacttgcttattgagtagttgtattataacgttatataggatcttccatatggaaagttttgaaaatttgagcataagagacagtttcactagcggaatggaacacgttgacgaggagttaggaggcctctccgacctaagtatatctaagcaggggccaactttgtcaccacagcttatcaaccgatttatgccccattttccctcgagcccatcacctctgcgaaatacattggattttagtgctgctaaagctgatgaggaagaagatgaccgaatgg

SEQ ID NO: 11206 - DNA, 425 bp, Saccharomyces cerevisiae
acacctgtcggcagtagtttacctctctattatagactactcttgtttgtatatatgtaagaatcgtgtaattattttcaagaagccttcaaattgaaggaataatctaaaactcgaataatatcaatgttaatcaataactataatcaagaccttaatgtgcctgcttgcccctttggggattttacctctattttgaaattccattcaatcaatctctcgacgatctctaaggtaagatctcgccttgatgtggctctttttcttccgcccttgcggaaaaaatctgaatgaacgtaatttacctaagagataacaaggctaaccttgatagaaccttaaaaaacagtattggtaattgcaatagcaccaaccgtaagtgagctaaactagtgaaagattttctaaatcataacgcgcggaat

SEQ ID NO: 11207 - DNA, 479 bp, Saccharomyces cerevisiae
aacctggcctaactggtcattgcatgtaagaaagaactttccagtaattttttccttctcacgtcaggaaattcgtatggttatatcttatagagaggtggccgcctttaatttggaaaagatattattagatgatattcctaattttcgaccgatactttgcatggttggacttcaattagatcatgtaatttacttccttaatatcaatagcatttcttttttggtagaagatttttcttttcttttcttttcttcaacccacatgggactataagaggagagtttatagcttgtatataaaacgctataactaaaacataagcccactctgaggtgagatgtctttacggtatgataacaagctgatgcaatgagagatcctatgaattgcttggattcttttacatcaggcataaagtttccgaagtatgcaataaaatgagtatttgcttatttattgtttgtatcgggcgatc

SEQ ID NO: 11208 - DNA, 402 bp, Saccharomyces cerevisiae
tagttcttttatcctgatgactttttctcatttgcattgattagaaaggaaaaaaagaagtgtccttttctactactactctagtcgcatccattcctttgcatttatcttttctgcggttggccaatccattcttccgagaatttggctagccatacttgatgttttcccattattggttcgtttggcaatgctaattttcttaattgccccttatatactcttccataaaatgttttttttataactaattttctgtatatcattatctaataatcttataaaatgttaaaaagacttggaaagcaacgagtgatcgtgaccacataattgcctcgctacacggcaaaaataagccagtcctaatgtgtatattaaaggctgcatgtggctacgtctatt

SEQ ID NO: 11209 - DNA, 459 bp, Saccharomyces cerevisiae
gtcttgtaaataacaggtaagtctaatttatttaaaaaaatccacgagcatatagatttataacaataataataattaatattcatcaattttttagtaaattcatatattttactcctactctatgtattttcagtaagtctactagtcgtattacccgtcggtttcaagggatattatggaggtaataaggatttttttaccgatttaaaaacccattatatccctcttagaaaaattttagtattcttagataagttgctagatttaccaatatcaaagggaagactgcaggacaacacaaaaacacaagaaaaggaggacaaaaaatgcaggttaaatcgattaaaatgagatgggagtctggtggtgttaattactgctatctattgtccgacagtaaaaataaaaaatcgtggctaatcgatccagcagagcctcctgaggttctgccagagt

SEQ ID NO: 11210 - DNA, 430 bp, Saccharomyces cerevisiae
gctgtgatgcagtaatcttgtttttgcagaattaatatcatgactaaaagtatatatattatcatcggatatatgctacatgatgaggagtttttctatttcttttttatttcattctatacactttggatcgtgttttttcttttgcacttgagtttcttttcaacattatcattcggtatatttcacgattttgacaccgatgtttacataaaagtgggtaattatattttgcattttctcgaattgagtaaaaatagtaaccttttaaagaattcttcagaaatgttaaagcatttccgattggcatcattgatgtatatgtacgtatatactcagatgatttgcccctcgttacttggcatcaggaattagcaagggctgtaaaaaataagtttaaatatatataaatggttgcgaactaagacag

SEQ ID NO: 11211 - DNA, 483 bp, Saccharomyces cerevisiae
tgatatatctcatccttcaaatttcttagtctattgtatcattactattacataatatgcatttgtcttctgcacacagatacacagcgtatgcagttaacctaacgtataacgaccgtcctctttccttcatttaatttcacttgctgcttttctaggcagcggtcgcccaaattttcaccggccacaagcgtatgactgcatatgcagaaccttggcaactgtaagaactcctatgtttctttattgcaaacagttgctaaaagcactcacatagaagaaaaattgatgaaacttgcgatgcattgaacaaatttccctttcttcatactttacggcatagtaatctttgaaccttttggtaagcaccaaattcgtaattcattatcgatattgtgtagaaaagagtaaaatataataaaacgaaaaaaaaaaggtttgaaagaacataactactaaaacgcaccgtcgtcattctgaaga

SEQ ID NO: 11212 - DNA, 436 bp, Saccharomyces cerevisiae
agagcctaaattgacaaaacaaaaaatttcggaaataaaatcaaggcatatgtattatttagcactatttagtaataataacagtattttaggatgggttctttttttttttttgtttcaccaaccgtttgaagtgtaatcaatgacttttacgaagttcgggtctgtttcatcatctgtcttatttctattctcgttaaagatgggggtaacacagtatttgacagtgtcatcaaataattcatcaatgaggttcttcaaatctttcccagtttgtttgaagtctgggaaagcgttgatctctagtaatttaacttcgtaattcgaatcaatcaaaaagtctacgccatatgtttcaaatgcgtttggtaacggttggaagtttaatctatttacatttacagcagctaagaaaacgtcgttcgttatgctatgg

SEQ ID NO: 11213 - DNA, 463 bp, Saccharomyces cerevisiae
atttttaacaggcactctaattgtcaagtgcatttttctttttttcttcataatgcaataaaggaaaaaaaattgtaatattacatacttcttttcacatcttagctaattaacaatatggcttttgaatactaatatatacccagctaccgtttcttcttttattttttattcctttttttcttcagtagaatatgttatagatgcggaggtcccctaagttcttcacgtgttctcttctcatcgcgtttgatatgaaaaatagaaaaaaatacatagtagcatgactaactaataataagctccgctatcaaagatgtcaagtacattaaggaaagcttttagataaggaaaagaacttattaataatatataatatgaaaatatgtcgcttggtataccactttcccaattaatagtagaaagtccaaagccattaagtagcggcatcacaggattagat

SEQ ID NO: 11214 - DNA, 413 bp, Saccharomyces cerevisiae
atagaatacctctttcctcttcaatcttaactacgttatttctacgtcaaaataagaatagcatgtctgtcctaccagcccttgcataggcgtcttaaaatgttgagaagcctaaacttccctcaatttcctacacaaaagggcattaagatgaacaaaatgatgatctctccgatggacttgacgcttataccaaaagagactcgatataaacaacacggttttatagtcctggattattaatccgcacgattaattttgtatggtttttttttaaaatttgaaataaaaagagtaaatatacaagaagtaaaaccgaggtagtactctttagaaattcttcatctctttttatagttgcactgggaggaaaaaaaaatatatatatactatctccattacccggagttgaa

SEQ ID NO: 11215 - DNA, 459 bp, Saccharomyces cerevisiae
atactgcgcaagaatatcgttaaaaaaacacgcatgcatttttttcatcctttatccttgtacataataaaatcataaatacacagtaaatagcacgttttggtttcaatatccttaaccttacctagctaatgtttagctggtgtaatccattataatcaaaatttctctaatgtttggctcttcgtagcgcgcgatgtgccctttcatatttttcctgaaagtaaggtggcaaaatagtaaatctgcagtaattgggtatagccatgaatataggaagtaatagggctcagattctcagtgtgtggacaaaccaattctgcctatttcctttcactcataagttatacaagaggcaatcggataaaattcaagtatttataaagtaaaaaccacaacaagaatggaggaactaggtattgtgacacctgtcgaaaaggcagtcgaagaaaaaccagc

SEQ ID NO: 11216 - DNA, 430 bp, Saccharomyces cerevisiae
attctttccttccctttcgacatagctatgtctgtatactatctaaaaactaaatatcacaataaacaaagtactaaaataaacacccatttaaataaagccagatcctgaccctccaaatccgccggatcctgaacctccaaatccgccagatccaggaccaaatggttcgtcgtacttggatccaggcatccatcctggcggcatatcttcccgtcttggggcaggtcttctatttggatcgaaaatcataccgccttggctacttggattccccagaggattgggaagccctccagaccaatccggatggcttgtgccaacaggatacagatcaccatccgcataccctcctgctgggttagcgaagctcggttcagttaccgtaagtccgggatatgggttcaacggtgctgttccctggttttgt

SEQ ID NO: 11217 - DNA, 489 bp, Saccharomyces cerevisiae
tttttcttccagaatagcccacactcttctccaaactcaattgaatttttcgtttcagtttattaaattatttatttacaagcaatcaaggccaaattaatgtcttacaacattaacttatgctactatatcgcatagaagtatgtcactgtatcatagaatctgcctggcagatagaattattataaattaatatgtatatacttatctttgtgtatggctaaaaatcatcgtcttagataaaaaaaaaaaaggcaaataaagctctgctcttacttcaatacgatcaacctggttgtcgtgcatttcgctcattctaaaatgacccataagcgctagtgcacgacttctttgtaagtctactgtttttttgaaaatcattcgtttaacatcggccccagggttgtacgagaacaaagaaaagtgtctgtcctattattttacggcacactaagcgttatgcgaaataacttcaatccagttgccacc

SEQ ID NO: 11218 - DNA, 470 bp, Saccharomyces cerevisiae
tccgcttggtaaaagtcagtaatatgcatacataactaatgatgccttaccttggtgttcttttgtaatatacctaaaccgatatcacgctagtatttatttcccgaatttttttggcgtatttcgtcatctgaaaataacataatcaatgaaagaaatagagtcagttgcaaaaagtgcaagccagcgctaaccgctcccgatttagtcgcaatattgatggcaaacagtaccaaaaactggttacccatataaattgtttggcattgttattattgttataaattattattgttattattataaattattattagtattatacaaagttttcaattctgcaacaagttgggccgcaaaatatggagaaaagcgaaagtaattctgaaggactttatctccaaaatatattaaatgttccccctccgcagcgatttattgtgctcataatacttgccctttggatctgg

SEQ ID NO: 11219 - DNA, 439 bp, Saccharomyces cerevisiae
taaatgaccgacattgactcactatccatccgtgtattatttcaaagagcgaaaagaaggcgcgtcgcgtcgacgcgcctttttaggctagaaaataaacagaaaacaaaaacaaaaacaaaaaaaggcgaaaaaacaaacgaaaaaacaaacgacagtagatagaggagaaggtttttgacaggtttgtgtaattggttatttgcttttatagattatatatacacaaacttaaaacactgttttctaagtaggctgcggagagggccaattgcagcagcgacgtacgcatagaggaaaaacaaccgttcatgtccattatgaagcagaggctaccactgggggagttttccagctcgaagatcaacaaactggcaattgccaatattgcagacgctagcgagcctagaaaccatggagaaaacaacgtcgggactgt

SEQ ID NO: 11220 - DNA, 462 bp, Saccharomyces cerevisiae
ttattctgttttatgttgtctgtatatacacatatgtacaatatttgcatttttttaatttttaattcacatgtatttgataaatgttcacgccagtcccgttaaattaaaattaccattttattagattatgaatttatatatgaatacattgtgtcgtaatggtagaagaagttgaaaaaaaaaatgtcaagggacagcatgggtacagtgtgttgagccaaaaaaaaaaagaaaaaaaaagaaaaaactttttgttctctggttcttttcttcatcttcttcatcttcattctttggtagcgggggccacaagaaattcgggcgaaagtgctcattatattgttacatccaaaattttgcccacatccagtgaggttttcacagaaaggtcttctaaaagaggaataatatctaataattcgttatcatgagtatctgagaaccaggacgaaatcggta

SEQ ID NO: 11221 - DNA, 406 bp, Saccharomyces cerevisiae
agcaaaccataaaatagttgcactattgctgttcattatctttcattatccctagtaacgccattgcagagtcaaatatgagcgataacaatataaagagcaataacatgatagttgaaattaacataaaagaagcgacataattaaaggtctcaaagagtgaagatcaagtatccggtttttacgaataatctactttctatgtgaaacccaaaaaagttcgtacaaggaaaactaaaaagtgtgtaataacttgtctagctttggcattaaaacttgtcaattattcatcaccaatatagactaatgcgttttggaacgccaaaccgcagtgacaaatagcaaatatgtagctgtcatatcggcatataataacagttttctaccaaatgctgtcctacattca

SEQ ID NO: 11222 - DNA, 497 bp, Saccharomyces cerevisiae
agacaaacgccaattttacgaacgggcttccatagacattgaaaattaacgaacaaaataaaataaataaaaaactacttttttttgatgatataaataccgtagattatataaatgtatattaatattatagacctatttgatcaatgacggtgttcgtgaagcattttatgaatatgataaacatagaaagaaacttttacattattgtagaaaaagcgtggacggtaataaagctaacagtgtatgtccaataaacaacaatgaaattggaagcgtatgacttcgcagcactttgtccttccataaaaatgagtcgctgcttcttttttcattttttggcgcgtcgcgtcgggccgtatagaatatgcgtcacttctaagaacatgattgcagatcagggcagtgcgagctacaagtcatggtatcagactctcatttagagaccctcattttttgacacgtaaaatatcaaaatttttgggttggcacagttt

SEQ ID NO: 11223 - DNA, 445 bp, Saccharomyces cerevisiae
ccagtcatgtaaatatcctttaatcgttagcttgtatatgtaaataattcattgtatgtaaccatcaaattcgttatttagcaatcttacccggaaaacttcttgtatcgtaacattaattctcccttacaaggggacctcgatgaataaataaagtgtttgtgttgaaggtacttgcaaaagggcaactcactgtcgtttataatttgatttactaatcgcatctgtatttggaaaagcatttctttttggaagaggaacaagaacgccatgtcagcagacgaaacggatgcgaaatttcatccattagaaacagatctgcaatctgatacagcggctgcaacatcaacggcagcagcttcacgcagtccctctcttcaagagaagcccatagagatgcccttggatatgggaaaagcgccttctccaagaggcgaagatcaac

SEQ ID NO: 11224 - DNA, 427 bp, Saccharomyces cerevisiae
ccaaaatgagctatcaaaaacgatagatcgattaggatgactttgaaatgactccgcagtggactggccgttaatttcaagcgtgagtaaaatagtgcatgacaaaagatgagctaggcttttgtaaaaatatcttacgttgtaaaattttagaaatcattatttccttcatatcattttgtcattgaccttcagaagaaaagagccgaccaataatataaataaataaataaaaataatattccattatttctaaacagattcaatactcattaaaaaactatatcaattaatttgaattaacttataaagtgttagtggtacggaaagtttccaaagacttggtgatcttagcacccatggtcttttcaccttctctaacccagactcttgggtcgaagaacttcttgtttggcttttctggacc

SEQ ID NO: 11225 - DNA, 491 bp, Saccharomyces cerevisiae
aacctattaaacaacaaaaagtgtttcatcgtcattcttccaatactaaccgttgcatcttttctttcatatgagtagtatgtttctaatttgaatctttaagaaaattgtttgtctgtatttgtcggaacgatttttgggatcatcgttcagtgcaggtgtatcgtttctcaaatgaagtgtgaaacttacttctcacttaggttttcaaaataatggcatataaagatggtctaacatctatacatatttttgaccaagcaggagtcaatcgttagagtaagtgagtatatcagtttagttattttaaattagacaatgtaatggaggggtgccagtgacactatataaaataaaaaaaaaatttgcatctggtgcgcaatagcgttcttgtaaccaaatttctattccggtcgaatttaaactagcaagaaaataggtaagcaagctatctggccagctaaaaagacggtgcctcaaagttttcggaa

SEQ ID NO: 11226 - DNA, 496 bp, Saccharomyces cerevisiae
acaataccgcttctgaagtatgttaatatgaaaatatgtcctattggcagtcatccattttcagacattattttctactccttttaccttttttttatctgcatctttatatatatatatcatatacttatttttctttacttctacttaaagttctataatcattgttaatcagaaatttgcatgtctccagcaagtaaatatgaaggccgagaaattaaaccaccgacataacctcctctgaaaagtcgtttcgcaaaacagtaaaaggtgaaaacacttttaagaactgtggaacacaaactgtgttttcttaccataaaatcttttaccggaggtcgaaatcgttttctttctgatttggaattcgacgctcgaaaagtgcagagatctcatattgttaacggactatcatctaactttttgcataatttatacaacatgctcagatatcatatgcaaggttttagtgggtacggtgtccagtattctccct

SEQ ID NO: 11227 - DNA, 403 bp, Saccharomyces cerevisiae
acatcatcataattaaccagacatgcatatttggggcttgtttcacgttttctgtcccaaaggaagtcttgtactttaattgtaattgcgatttgtaataagtaattttttttgtctttaccgtttatttctttatacatttttggtgcatatatttaaatatccgcattagtgggctatcagtagcactgtaatgataggtaatgtgacacatcttctcgacagatattattcttgaaaaaatcgtgcgtttcaagtgtctttatttttttgctgtcaatagaagtgttgaaatgactttgaaacgtaattaccgcatcgggaaatttacatgttaactgcaatgaaaacaaggaatatacggggaacatataaagggtcagcgtcgttgactagtctgtca

SEQ ID NO: 11228 - DNA, 481 bp, Saccharomyces cerevisiae
tctggttaacggcaaagaagacaaataagtgagttagtattttgcatacaatgatagaagtatagaaaagttcaagcatttctccgttgttagtatacatatatatatattaattttaatgaataagggtacatatattatgagcataacgagtggccgatcggcaaaggggcttacaattttacaacaccagatttccaactaacaccacaccactgagatattagtatagccaatcctctcactgcctccacagtttccttatcacaaccaatattcaaggcacctttcaaatgcccacgcaattgaggattaacatcttgtggaaccaaagaagcaattatcactaaacttgtctcttgcgcagatagtatctcatcaaaggcaaacaaagggccatatacatggaccagtgtataataccataagtctgggtacgaagagtttagattgtttaccacgcgggttgagactttgttgt

SEQ ID NO: 11229 - DNA, 421 bp, Saccharomyces cerevisiae
gcacataacataatccgttaactctttgctctatgaacaagaaccgaagttctagaaaggctgataggattcgtacaatcatttttacggtcgaacttctgtagttactcgatatataaatataaataacggacataaaaaaaaaaattgtaacattataaatcataaaatcataatcatatctatttctaacttctgactattgcgcaattcgttagagtctttccaccacgtcgattggacaaatctttatctgtctacttctaatatactgtacatcatacctgtctttttatgctgctattgtggaggaaccgtcatcttttcgcgcgaaaaaacaatatgatgcctttttgaaacatgttattatttgattttttaatggcttctattacgcgtcgtggttggtgaacctggtaca

SEQ ID NO: 11230 - DNA, 446 bp, Saccharomyces cerevisiae
acacaccaggacaaaaagtatgtgctatggtcatatgagtaatggaactacatattattttgaatgctacaggacctctctttgaatggaatagatagtggaaaaagtaaacttaactaaaagggatgatataaattgtgacaggagcagtgcactaaactgaatcctttgtgtaccccaaaaatcaagcctcttatgaaacgccgagtttttcacaagaagagatgaaaagaaaccaaagcatatttcaagataagaaaaaaattccgcaacttttgtacgttctttattttactaacaagcgtcattaaattttctattacagttacaaaatgggtatttctcgtgattctcgtcacaaaagatccgctaccggtgccaagcgtgctcaattcagaaagaagagaaagttcgaattaggccgtcaaccagccaacaccaagatc

SEQ ID NO: 11231 - DNA, 409 bp, Saccharomyces cerevisiae
ttaatcaatcaaagtctatcccttcgtagatattatggggtcttttcaataagtgactctgttaatatcgacccactcaatttgtgatttttgcctatcatctctcttgactttgaagaagtgatcagtaaatgccgctgcattcatatgacccaaaaatttctcatcatgagtgatcacgattagctggaaattcttttgatgtcttctcatattaattatattgtgtaaagattttgctaaactttcgatgttttcttcatctaaattggtggtaggttcgtctagtgcaattacgccacaatttgcgccaaatgtttcagatagagctagcctgataataatcgatgcaagaactttttgacccgcggaacatcgtcctctcatatccaattcaacatcctgcttg

SEQ ID NO: 11232 - DNA, 459 bp, Saccharomyces cerevisiae
aaataaacaaaataatgcagaaaggtgtctttaagttcatttttcaatttcttttcggttttcgtactcctttataaacgaagtaataaacaattgtaccatcatcgttaattatggccagcagtattctttcagtagatggactacataagtgagtaaatgtctggctcaagcattccaaagtgagaaaattctctttgtactgtgacatattgatgggtaatatgaactctagcgggcgtggcgatgacaagctattttcatgctctgtgtctacatcgttgctcagcttgtgaggcggacgacctctcagtaatctcaggctatttcccttccatgataaatcgtcttgtaaaatttccacttccgtccacatttggaaatagagtaaattattttttactagagatatgatatctgtcgttgccattcttattttcctcaacctcctcgacgtaa

SEQ ID NO: 11233 - DNA, 433 bp, Saccharomyces cerevisiae
tttcaccttacagttcacctttgtctttatttttttattacttttcccttctcattttgccacacaataatttatagaatataataattttttgtaataattaataaaccttttttttatctactctatatacacttttcagataactagattggattaattcgtgatcgaactagttattaaattttaaatgaaaagaaagctagcgctagccaactattttaattacggtggcagtgcatcatatccttacatttcattttaggtttcctatgttttcttctttcaaatcatttcctgccaaaaatttttttcagtttcctaccgaatttactgtgaccgtgacggtcatgcgacttatcttttatagctgcatcatcgttatgaagcttgtgtatctctccatttttatcaatgatagtcaccggaacgc

SEQ ID NO: 11234 - DNA, 411 bp, Saccharomyces cerevisiae
tacatggataactgaatctctttcaactaataagagacattatcacgaaacaattgtacatttctctccttgtctgtgctaaataaactacaaataaaaattcattttctttcattttcattcgacacgccgcggcatcttcgttttcttcaccgattaattttaatctgcgccgtgcagatattttcgcccatttcgaagtgaaatcattctaataacttctcctgcgcaatagattggtcatcctgatttttattctgaaatcgaaaatgaaaagcatttattgcactgaaatagcggaacctgcttctaataagcttaaaattcaatcataatagtgtagttaatagaaaggacagaagaacttttcgttccttggtttatcatccaggtttcagcacggcttttgtt

SEQ ID NO: 11235 - DNA, 457 bp, Saccharomyces cerevisiae
gaggatctgcatctaagaacaaataggctacacaggactctcaaaaaaaaatgtattaataaataaaagaacttaaatatagactttttattcgcatgcatataaaaataattaattaataaataactgtaaaaaactagaataataaaagtaataaatatctcctccgacgacatagcctatttggcagcctttgtcatataagtaattaaatcgtttctgtccttttccttcttcaacccggcaaacgccatcttggtaccaggaatatatttctttgggttcgtcaagtactcggacatactatcctcatcccatttgacgttcttgttgatgtttgcatctgtgtaagaataaccctttacctgacctgaatgtctaccaaaaataccatgtaaattaggtccaactttgttaggaccaccctcttctattgtatgacactgctgacacctcg

SEQ ID NO: 11236 - DNA, 433 bp, Saccharomyces cerevisiae
gccaaataattctttatttcatagtgtaatatattcaaaacggaatcctctaaatattcatgaaacaaataacattcttacgtataatttcttaatagggcaattgccgtagctttcgttcaccttatgaacagccaaatttattgttggaaaaaagaaaagataacaaagacgacgccaaaacacatcttgatgcagcgcccatgttcctcagatttattaatggaactacatttcagattaggaaatttttttgctagttcccatggttacgttaccggaggaccatctgacagcgcggaggctgcacggaagggaagagaaggcaacaggggtgcgcataaatagcgccgacaatgcgacgccaaaaacgtggctcgtatattgattaagtaaaatctttatttttcctacacaaatgtccgtagaacgc

SEQ ID NO: 11237 - DNA, 445 bp, Saccharomyces cerevisiae
ctgtcaataaccgagtgttctctttattaaagtacgttttacaggcatactcaaaagaagattctatggagtagccgggttttcatcaggagatgagagttctttaaccccagcacaatcgtaaatttttaccttttttttttttgcttcctgctcattgatactttttctgattaaacaaagcactccgaggaatttggaccatctacacaaaaatggctataaatgaaggaaaaaggacaaaagaaaaagaggcactaatcaaggcagagtatgtatttaatcctcccctcaatattaatgtgtagtgggtacataaacaattaaggggaccaagcatataaccagagctaaggtattacaaagaaaagaaaaaaaaaaattaaggttaccaggtacaacataaataaaattcaaggaattactttttgtcgtgcagctacca

SEQ ID NO: 11238 - DNA, 444 bp, Saccharomyces cerevisiae
tccgaggaataagagattatacttaaactagcactgatttttttaaggctaatggctactaatactttaatagatgatcttcatacttttttatttaacgatttttaatgatgtttttatttgtaccactcatttatctagatttttttaatactgatcaaatcttacggactcgacgttaaaaagttcctacatacgtctggtacttgaaacgctgcttcgaggtattgacactataagaatacgatccaaatacttacaccgcatgtaaaaatatgccgacaatatgaatacttgttgatgaatgatatttgattttaatccggcaatttacctcctttatataatccaataattgttgataattagtggttaggttgcagtactaataagaattaagacaaatattcttctactatataaaaggtgcaaacaaaacacacg

SEQ ID NO: 11239 - DNA, 461 bp, Saccharomyces cerevisiae
atgcctttattcactaaattctaatagctcggtatgaagaacgcacacgttccgtactagagagggaatgagtaacgattgacatattgatatagacagtagcatttcttattatcttatctacgggattttttcagtttatgagcatttcttatacctttgttcattataaaactatgttcaatactttgaacgtaggattatccgatataatataataatattaataaaaaacttattttagagttatgtgatatgacggggagataaaattacatagataaaagattaaaattaacagagaattatattatcattatttttcatcttctatttaagcagcaatacgcttttgggcggcgattctacctctttgtctagaagtcaatctaacgaccttcttttcagcagccttggcgacagcttcttccttttcagtgacaactaattcaatgtgggat

SEQ ID NO: 11240 - DNA, 470 bp, Saccharomyces cerevisiae
aacgacatttctgcattttctttcgtcattatctcatccatatttaattaacctcacattattactatatagtgtactttcgcttcttcaagataataagcaattaaacgcccgattcatttttttctttattttaatcatttttaatatacagtattataatattcttatatatacatatctgattttttctccaggtgtgtaattagccatattgctcagtttcaatcttctataatttttttctagatttgaactttggacctttcttattatgtttgccaatcttgttaccttgatttactcttcctctcattagcctactatccttttcaccatcatcatcatcgccaaattcatcagagtcctttccatttttcctgaatttcagcttgtttctttgacctcttacaggaccacttttcacagcctctagatacgcattgattccgcttgtcacagcactcaat

SEQ ID NO: 11241 - DNA, 457 bp, Saccharomyces cerevisiae
tttggtaggcactagaacaaaaataggttgccgccaccagaaaaaaaaaagagtaaccaaccacctatttcactggcatgggccacctataacaagctatagaagtagttctggtttacattactagcatcactttatgtaataatataggcattctggacgaaatcctaatggatgagcattacccgttttttccgagggccaaacgaaaattttcggaaaatttttattaattaaagatttaaacccatattcctttgtgcagattttttcttttactgtatgtaacgcaatattcaatattgcataattaaaagaagcctcatccctcgttggtcttatagtataattacaagaagcaatacgacagagtatttggaacaagagcataattcaactaactctagaaaacaataatggctaccaggactcaatttgaaaactccaatgaaatcgg

SEQ ID NO: 11242 - DNA, 481 bp, Saccharomyces cerevisiae
ctgcggtgtcatttttcatttcgtgctttgtttactatttattttttttgtattacgcatttgtatacgtgtgcaagtattgtgtattattattattattatcattatttttgtaatatctcgtcattatgtgaaatgaaggatgatataaggtacataaattgtgaaatcaactccatttaaaacaactttattggatagatggcacatggtacttttcacaataggtattggcaatatcagtccattttgttatgagcggatgtttttcttgcaagtcaaagtttggatcaaatatggacttactaagtactttgttaatgcgtaattctttttgagcatcaatatatgccttactgaggtcctcatcttcatcaccaaaacgtgttcgtaggccaagtaaaatccccataattatgccaacttgtttccctaatttagcgcccgttgggaaaccatcattgaaaccctcttgcagctt

SEQ ID NO: 11243 - DNA, 426 bp, Saccharomyces cerevisiae
gtgctctaatgacagttctactgtgtttatatcattagagtcacttgttacgaatactacatatttccgcgcagtggctaaaagcaaatttcaacattataaatctctaatagtaaactgacaatattgcggaattagaaaaaatgtaccacgcgaagttaagtgtcttgaacaactactatatgcattgaatatggctccatttaggcaggacagtattttggtacgtatttagttcatcaatggattttttaagtcttcacgaacagtttttggttaatcttttatactaacaacaattcataacagataatataccccagatctcaaactactctcgttcaatttggtttgaatgaagaaacattcactgtacctgagctggaaataccaacacagatttatcggaccacgagacaagatggt

SEQ ID NO: 11244 - DNA, 442 bp, Saccharomyces cerevisiae
attgcaaattagagatagattcccttagggataaaatgtgatacgaattagagaataacgaaaaatatacaatttttttttttttttttgatatagaaatagttaaaatacattcaaatgtataccgatattataagctttctcgattagtttcggtgcttttttgaagccgtaagtaatatgcaaatttgttatgacttcttttctattcttgcagcaaatgttgggatttaacttccaactggtgccgtgccatttttattattaactttaataatgttctattgtattgggacggaaaaagcttatttcttaaattggagcaagaatctcggagttcggtgcctatccgaaggttcgccctgacgaaatacactaggcaggaaagttttctcacaacaagaattagaaacgatattaagcctggttcagtttacacaga

SEQ ID NO: 11245 - DNA, 475 bp, Saccharomyces cerevisiae
attgtttctttactgaattgatttagtatgctatttagatactaattctaccgttaccgactcatgcatcgagcggccgctctttctcttgttgttgggcgcaatttatgtgatcatctttgaacgaaaatgcatgataaagctgtgctcttcgactgttaccattaatttcaaaaaataaaaagcatatctattattgaaaaatgaacttataatagaataacattttcttgttttgtcatcatttcctctaaatactccgtcatgaaaacgatttgcgctctgtctggtctctccttttagtattattgttgtgtgttttttactattcattttttactactgtgtttttactatatatattttggctttacttacttccttctgttctgatgtattaaaaactatttttattctaagaaaagaaactttaattcttcttattcatgctctaaatcttaaataaaaggttccg

SEQ ID NO: 11246 - DNA, 461 bp, Saccharomyces cerevisiae
atagtattagcatattcgaagtagaagcataaatcttttcataaagatagatcggatcaagccatagtaataggtatgaatctatgcgtcctattctgttttgcgttgttgagattcagtcttcgatttttacaaaattttccatcgggtcgcctctacaactacttattcacttcgtttgatttcgggtttcactttttgtttgcattgatggcgtctgtcctcatattaccgaacaatacttaaagatataattatataaaaatatatagatgtgatgattggaaacatgagaactggacttccttcataattctatgggaagccatattggatccttgaagagaataatgtatcattaatatagatgtgcatatacatatgtttgatgcttctatttagccaataacgttgttgaaagatccttcctcttccttgaccttccaaaatagttcacctac

SEQ ID NO: 11247 - DNA, 439 bp, Saccharomyces cerevisiae
tagtacaatgagataaagagacaacgcttaaagggcagtcattaatcttgtaaataaatatttaaacccttttattggttaaaaataatgtacatacgcacataatttatttttaaagaaaagattttgtaatttgaagtcatcacgtttgcccacatcaatatctgaatattctttgaactttactttatgctttcatatatacaggtcgaatataacttatttactacgtgaatagtgaaggggatatactgattaaaaaaatcacactagagaatcaaatataaaaatagagtgcatacacttggtacatttattctcttttttgtttttccaaaaattcaaaaaccctcgccccaatagcttccatgtcctcttcagttagttttggtacttctctctcagccaactcctttttttctgccaaatggctttttct

SEQ ID NO: 11248 - DNA, 462 bp, Saccharomyces cerevisiae
gaaaaacgccgcttactgccacgatgatgataccctattgacgtttctgaaatgtataatttcttttctcatcttcccctttgatattccatctataggccccagagtagtaaatttggtgctttaattttttttctcttcttccagttcgtctctattttttcattccattatatttatttatcagttttactttctcaaatattcttatataacactatttcatctacgtaaccgaaaataagtagtttaataacgataataatcataattgtgataaaaatatttacatttttcttacttgtcgcccgcttcgtttttgtatagaacgtactgtattagttgtccgttcttttcacgtctgaagaggtcgatttcttgcaatttaacatcaacgtggtattttccattatatacaatcaaagaatcatcgtccagttcgatttcgccatgaaaccaaag

SEQ ID NO: 11249 - DNA, 408 bp, Saccharomyces cerevisiae
cagtcacgatgagcagaacgtgacgtatatgctgatcattagtcagaaattgtggtgtatgggtactatgcacagccgttgagactagactattgtgtgagaaatttttttaaagcaaaacagtggcgtaaaatccacggaacaaaataacacccaaaacagttgtactgctttgtttactttcgagaaaggcatttttttctcggtttgtttccggcgaaatgatttttggcgctttagatagatccggctagtttttcggcgggggataggcggtgtttatatgggctgatttatagcatgttaaattttttttccgtacttcatttaagttaaagttattcgctgcttgctgcatctgcggaattgtaatagcgaatttaagaaagagcgtacccgtttttgttt

SEQ ID NO: 11250 - DNA, 448 bp, Saccharomyces cerevisiae
atttttattaattcatgatcacgctctaatttgtgcatttgaaatgcactctaattctgattttatatttttaatgaacccttacgatttatattgtatggcaagatgttgccaatagaagtataattttttattaattttttttcttttctaagctttgaagaaaagttaacagctttacccttcaaagttattgttttgtagcgctagaagcgaagtaggcgctctttctcgcataagctaccttaggaggaaaaaaaaagtcttctattataaacaaagtactctataattcatcaaaaaaattaattatgagccggagcttttcacaatcagtgtacatatgcagggctcacctcggtactgcgcttttctacctgaaattaaatagagtcacctcattacaatgaagctactaaactcctcaatgttaaactggcattgcgac

SEQ ID NO: 11251 - DNA, 430 bp, Saccharomyces cerevisiae
gtgagtaagtgatttttcgtttaatgaatttattatcgcatgacttgcggtatagaaaatagttataagagtgctgaaaaaaaaaagaagtacagaagttttcgtttctttgaaagtcgcgattattccgagttgtgtattatagtaggaacatactattgatttaggtttgagagctggtagtatcgacgtccagaacagtcaattcatcggaacgctttcgactcggtccacggaaaagccattcaacgatttatacggacggtgattttgattagtctaattgcctatatattataaatatattcttcctttacctatttcttctcacacattatcctctaagtaacatgagaattcagatgccggttaatcttcggctttttcgcgttgaattcaaaaaatgaaaatgatgaacaaccactgggaa

SEQ ID NO: 11252 - DNA, 447 bp, Saccharomyces cerevisiae
ttgttgttggctgttatactggagtaaatgtcacgtgccactgtggccgtgtcaggtcacgtgaagagagaaattcggccacagttgtggtcctaaacaaggactgaaaaagatcgcagaaactagcaacgtcggatagcggtatggttgaaccaaagtccagtttttagtcatagccggttgagggatgatctgccgttcagtgttctgcgttcaataatacgcatatatatatatatcaaggtatcaacacaatacttgaacaggttaggctcgtactaaagcctggaagtttttatctttctgtaacatttttctttcttgaggtgtgtgtgtgtatagattagcagggaattatctaagatatgtccagggaaggttatccaaactttgaagaggtagaaattcctgactttcaggaaactaacaacaccgttccagatcttg

SEQ ID NO: 11253 - DNA, 458 bp, Saccharomyces cerevisiae
tactagcgcattcattctccccatctcaatttatgcatgcttgtaaataaacatttaaacgtataatatataagatcgaatcttctatgatcaagaaatgtgtatatttttttccctcatgtaatcagcgattttttccctctagaaaaataaaaatgaaaaggataggcataagactatataaaagcggtctataattatcattaacatcatccaggaaatttgcaccagcaaacaacaacaaatatttaagtacatagtatggggctttgcggaagtaaaacccaaccaatgccttcacaaactacgacggtggcaactaaagcaagaacaaaaccaattaatcgtgatacagtcaagtcaaagcaagaacttcgacataaagagaagaaagataaaaagaagaagacacaactaaagagtacaactgtcccggttgtgcaaaggaaagaaggcag

SEQ ID NO: 11254 - DNA, 425 bp, Saccharomyces cerevisiae
agatcatttgaatgtttagcgtagattactgcattagatagagtatatattgattaacgttcctgcaggggcctaaaattgggttacccttctcttcccgcggcttttcccctcatggcattacgtattccatcgaagaagggagaaggctttcaagccttgaagagtgacagcgatccaagctgggggggggaaaaacaacgaggacatctgttgagcccttgaattggtacaacctattagagtgttcttatatctgcatttggtcatcttcttttgaagctttttaaagaaaaaaagtagttaacaataaaagaatacaacattaaaagaaaaaaaaatgtcgaaaaacaacacaatgacctctgcggtctctgatatgctgtcacagcaacagctaaatcttcagcacctgcataacttgc

SEQ ID NO: 11255 - DNA, 465 bp, Saccharomyces cerevisiae
tgtcacaatcatgttaagctatcgtcccctcatatcattttagcctccaggtaaaacctaaatattgtataaaagagaatggtaggcgagcatattatagaaaaatatctctaaataatttacaatttaatattcgttgctaatggtaattttttttcaattgttcttaatcctttcttaaacataaaaataactattttgaatatagataatacacatcaacgatgcaactccagtatattagctagttaaaggaatgttcagtaactctacagtattacagaaagggctgaatgaaatttcaactaatttgtctcttgtgaaatttagatttggtaactctacgcaggtgcaagccattaaatagccatataatactcttaatgttgactcatgtgcaatgatgagaatgtccttgctcgtatgctccatttctaatagtaaaggttccatacgaacggctaa

SEQ ID NO: 11256 - DNA, 410 bp, Saccharomyces cerevisiae
tattacatgaacttattcctagcacagcatgtatatatatatatatatatatatactcagatcatacatgtagcaccttatagagaacaaaaagaagtatttaattagcattttcatgtcgttaacatgttatcgcgttctgcagccttacgtataaggtcgctggcattcaaaaacgagcacatatactcattaaacttctccctatcattagcggaaattgtctccttgaatataggatccatttctacctccacttcatgggacgtgtattgatgggagttccttcgcgtggtagtaacctttgtcaaatccaagtgtaaaggcattttatcattaaaggtgtaggtggaacggcttttggttctttgtaaaataaagccattcctgaaagcggcagaagtttcgta

SEQ ID NO: 11257 - DNA, 438 bp, Saccharomyces cerevisiae
tgaactgccaccataccacgtgtgtccctcgcaagcccttgatagatatacaatagggaatgggcgtccgctccaccgtggtcaaagacaggggcaaagagctcctaggtctatatatatatctatatacatatttatatatattattagaactttacaatatagtatataccattcattgtttaagtttcgggtaatactttttttttccttgtcataaccccaaaaattttcgatgcctttgatataattgagaacaagaagagtttgcaggtgacaaaaatcgatgattataggtgttgtgacgacaaaatgaacgctaatatatgggtggctgcttcagatggtaatttggaccgagtggaacatatcctccgcgagagtaaaggcgccatgaccccgcaatccaaggacattaacggctacactccaatgcat

SEQ ID NO: 11258 - DNA, 442 bp, Saccharomyces cerevisiae
ttacgatagaacttacaagctgattttggttcttttccatctttgtttcttaacatctgctgcagttaccaacgcatttacaaaccacggtttacaaagggcatttctctttgatcataattaatttgttattttacctttatgattttgttaccttctccgtcataggagagaaaacaaaatacctgcattcttctaattccagtcgcactttttagaatttccctctttttattaaagtacatcttaatttttttttttctttcttccttttctactatcttctcttttattattatattatattatcaataaccctcatctctctctctctctctctctctctctctctctctctctctctctctctctctctctctctctcctttttttcttcttttagatttttttgcttttgtttaatttcattccagtttccccc

SEQ ID NO: 11259 - DNA, 403 bp, Saccharomyces cerevisiae
tgacataatattccaaaggaaaggacaatatactttcaagactttattttctaggacaaaattcttgtccattgtattatattttcttaatggcacccatatatttcaggtaaactacatatggttatacaaataaaataatattacttaaatttagatgtataggttcaagaaataagttttaaggtattaatatgggcggtcaactcaaaaatttaacagttcgataatttcaaatccttgaggatcctcataacaatataagatcttcttggcatatgattttaacatacgtatcttgtttccaagtacacagcggacaagttctccattttctatatgtctaatttcaataaagttactattaattgccacaatataagggtaggaacacgcgaactgt

SEQ ID NO: 11260 - DNA, 493 bp, Saccharomyces cerevisiae
gcggtctggctgtcttaaaaacgttaatttcgtttaaccaagtgctttatttgcttggaatgtaacatagttttactaacattttttttttttaattgacattgcaaaataatcaatgtatatcattattcatgcatctatatctgtatttatatattagttattaagaacacgaaagaaggattatttcaagtccttgaaattacctttattattaacaaagatatcaatggcagacatagctgcatataatctgttttctgcttcttcaaagactatggaatgctctccataaaagacatcatcactaacttcttcttgatgtcttggcagacaatgcataaatttgtagtttggatcagccacagagacaagttcttgattgatttgaaaacctttgaattgtttcagcttggcctgtttcgcaaattcttcacccatggaaacgaaagtatcggttactaatatattggcattggtggaggcctttaaa

SEQ ID NO: 11261 - DNA, 495 bp, Saccharomyces cerevisiae
tgatagcatatgacatagtaggacatactattgggttttcttcccacatttatttatttttttcgcaattgaatataactttttattttatagaaacatatttatttgtataatcttgtatattaacagttaagactcattattgttatccttcggctagttcggtttttcaatagcagatgagaaacgaaaactatgaagaatgaaaacgaggtgaagaataaaatcatataacaaaatattgaaaagaatgacggccgtaactgatatcatcgatgaattgaatgattcgagtctttcttctacaaggcttcgagagttgtgtctccagttacgaaagaagacagatactggatgtgcaattacggtgtccgatgaggtcaaccttattgaatctctctcatatcactccatatctccaggagtagacatacaaatcaacacagatgttttgcagactatagattactactttcagcgtaacaaaagtgaaca

SEQ ID NO: 11262 - DNA, 492 bp, Saccharomyces cerevisiae
aaaatacatccagcatgataccagcttgcttccgcaaacgaaacataacttaaggtaccgcaattcaaaaaggcattcatacgtacaaatattaactatatctgacattatttagactatcacaagcagtatttatttatttatttacttatttattcatttattcatttcctttttagtcttttatgccagtgagctactgtcgcgaattgaaaactgcaaaaaaataaaataggaacttggattcagaagttttgataataaaattgcatgtagatgagagccgcgaactgaatcatacaaaaaaaatatgaagtggtgtagcacatacattattatatggctcgccattatattccataagtttcagaagtccacagccactgcatcccataatatagatgatattctacagttgaaagatgacaccggtgtgataacagtgaccgctgacaactacccactgttaagccgtggtgtcccaggttactt

SEQ ID NO: 11263 - DNA, 442 bp, Saccharomyces cerevisiae
tgagccgtgaactacaaactaaaatttatttgtgttatttttatttaacttgtacatatatatatatatacatacttagcgtttatcgtttgcattatttttcattctttttaattgtttatattaagtgtctaaaataggagtgacccatggtaactaataataataattgtgttcacctctaattataaataattttgccctgtttttcaaagctttcaattaacggtagcagcggagccatttcctttctgtcaatgatcttaaactcctttgcaaaactaatgaaatgagagaaaaatgaattccaatgagcttctaatgacaagtgcacaattttgtcaaagtggtggtgataaatatgtgcgaatatcctgaacatctgtaccatgattctctgcacatctctcgaaaattgctgcgggaatggtagcccattttt

SEQ ID NO: 11264 - DNA, 440 bp, Saccharomyces cerevisiae
aaggatatttaatgctaactagcccgatatatacatctatctatcactaggcattcgagtagtgaataagaaccactacttgaaacactagatttgtaacaataacgcatgtatcatcgtacattttcggaactatttacgtaacgcggggatgaggaaaaagttactttttgcacagcaaaaaaaacaaataaagaacagttagtgaaataaagcaaaagtgcaaacggtgcctttaatcaaagactttgcaggaacataaacaagtgcactaaagaaggtccaatttaaatatgccagctaaaaaaaggactagaaagacagtgaaaaaaaccgtatcattctccgatgacacaacattaacaacgcaccaaaatcgtgagaaaaagaacgtagatcatgatcgtccacctgtgtatgtgaggaaaacccctctgatg

SEQ ID NO: 11265 - DNA, 451 bp, Saccharomyces cerevisiae
gactcgctgttcacttggttgcaccaataagtagtaacgcacatgtaaatatgaatgtaagtaaactaaaaagaaagttgggaacaaagtatattcaaaaacgaatatacaggaaataagcaatagaaagtattatgaattatactgttgatgtttattctatctacaaaacacaaataaagtagagtataaggcgagtcaataaaaaggcctcaactcaaaaaagggagagaaaatgtaggaaggaaatgaatactattatacaatggtactgtgaacagtaagaatattttcgtaaggtaaaaagaaacaataacaaacaaaaaaggtcgaaaaaactgttcaaaataaagtctctattcgaagaaaactgaaaaagtggaagtggaaataaaagataatgtaaataatcagtccaatgaatagatcggttaaagcaattaagcaaaaa

SEQ ID NO: 11266 - DNA, 486 bp, Saccharomyces cerevisiae
cgtgattatttcttctttttatgcaatttttcacataatataattatatgtctcccatttttatatattcaaaagttaatgtctataaatgccctatctgacttattgtcttatttttttgcatggtatgtatatcttagaagcttttgaaaggaaaagtaaaacaaataaaaacggttcaagaaaatgatgtgaacctgatagaataaagttgagggagaaaacatataatttactgtgtaacaagaaggttattaaacatttctattaggtgcttcttctttgccgcatgacaactttattacagctcttgtcaaattattataaggctaaattagattcagaacgaatatacaatgaatatgttcagtcgcagtatgagtttgcatctttagacaagttgaacaacaataaaggtgacccaaagaaagtagttgatgagacattatttttgcagaggcaaattgcccagctgaataaacagtt

SEQ ID NO: 11267 - DNA, 481 bp, Saccharomyces cerevisiae
ggtcgttaattgaaatgacataagtatatattaaaactacggtgcagcggcaaactttagtttagataatattggcaggtagattcatggtatgttaaattacgctcagggaggatatttttttgtacacattatcttttcacatgaaaatctaagcctggtggacaattgaaatcatcgagtgatatactgacactttgaacagtagcacaaatcgtttaatttgctgtcacgatctaagttttctgtcagctgactgtccaccaataagatcagcggattccaaaggcgtccttcgaaaaagcgatatctcccatcttggttagtagcaaataaagggaagagaaaataagacacactcaaggataaaatacttcgcttcttccaagtataaacacaggaaagaaagatatacgaagattagaatttttttcatactttttacaaaacatttttttgtacttaggcacgctaattgcgt

SEQ ID NO: 11268 - DNA, 500 bp, Saccharomyces cerevisiae
tgagcacttgatttacacgaaatagtatatatttttgaatgaacactctcatgtgattaaaatgtattactaccactaatgcttgaagggaattgatagactcgttttatagtgggggaaaaagaaaagaagaggatggtacccgaatagttactgacaaaaataaagaactcctcatagggggctcgaacccctgacatttcggtatccttgcttaagcaaatgcgcttaaaagccgaacgctctaccaactgagctaacaaggatgagttcttcggagcgtcctaaataaagatttctatagatagtgggtatttaacttaggttatttaaagtaattaactaccgaaaaggatacattgctaaactatttgataaatgttgaggtataatttttataaaggaaataattttggatagagtatgttggaataggaatcaagtattatttatcgactagcattcatattattaatatagtatcatatgcggcgtaaaaa

SEQ ID NO: 11269 - DNA, 423 bp, Saccharomyces cerevisiae
actcctcgaacaacacccaactatgcattttttttcctaaacgagcgacacctccacacccgtgcgccaatcacagtaattattattcctaaagaggtaatatgtacgcacagagtcatttcccgatgtggataaaaattgcctgtctgctcgaaggggagggatcgcatacccattacctgtgtcgctttagatagagggacccgtttattgcgtgttaacaactgtagcactcgtgtgcttcctgcagctattgactctctacttctttagaactatataatttctaacttctctattttacccataccatatataaacccacctctgttaacgaacccgaaattgtattatttattcttttcgtattctctatttttctattctgaaaacaagcaaggaatcttcaatcgcgctctcttt

SEQ ID NO: 11270 - DNA, 474 bp, Saccharomyces cerevisiae
aagatataaatataaagactgcgctgaagaaatataaacttgaaaactgtactctgccttttatttacaagggatattgagatgatttgtgtgaatgaagtagcgacagaaaaaaagcttttatttcgagttcgcatcattgtcactttcctgctttttcttggcgtactgtctatctaagatagtctttaatatagcgtcctcgccatattcttcttcctcaattttcttccatctcttttctacatcagctctctttattctactttcaatgacagcacgtttcttgttattcaaacttgcctccttgagacacttgttcaaagcatccttttcgttgttacaaaggccaaatattctcttgtaatattccttttgatggcatttatcgagtgcattgatgaagtccaaacaggctaaaatgaagaaggggagaatacaatgttagtaagtcggagcacagaaaaaggcaaa

SEQ ID NO: 11271 - DNA, 467 bp, Saccharomyces cerevisiae
gtgaagtaatttttattaacggagtcaatagataaattgttgtaattgtaactaaaaattaaggtataagattaaattatattctaggaagtatgtataaaatattcatttgttgtaaaattggagggcttaagcggccaacattttatgtttacactttttcttgttttaagaatagaaaaaaaatatacgtgaaaaaaatttgaagtcatcgcaaagtagctctttttacatagtaaaagtctgaccagccaagagttaatatcagtatagtgatatcctactacttcaaaaataacggatgaagacctgctactatgagcttttaggggtcgaaacgcatgcttctgatcttgagttaaaaaaagcttaccgtaaaaaggccctacaatatcacccagataaaaacccagataatgttgaagaagccacacaaaaatttgctgtgattcgagccgcttatgaag

SEQ ID NO: 11272 - DNA, 460 bp, Saccharomyces cerevisiae
aagcttcctcatttcgttactgctgttgcagatctattaaatcagacaatgcataagatacactaatttcctggagagccatatacttatagatattataaaaattcgtaattttaagaattctgccatttgagggatgcatatttaatttcctgggagaactgtatatttatggttgatctttggggacagttagctattttcttctttcacattatagatgtcacatagacttccttcctttttacggaataagcccactgaaatttttaaggaagctccagctcattatgctctcgttcttctgttctgagtttcgagaaatactacgaattattgagaaaatgaaaatcaactatcatttatcgatcagtacatataaggtgaaaagagaaggtaatagcattatgtaaaatattggtgtcctatattctcgaggaaaacttctagtggattccat

SEQ ID NO: 11273 - DNA, 445 bp, Saccharomyces cerevisiae
aaaaagaaacagaaacagaaatagaaaatggtgaagtaggatacaatctagtggcttattactcaaggattttttcgcaatccgtccaatccgaaaaatataacttgacgtgtaacacccagaggaacgttatacaggcaactgaggtcgaatgaaacgagattactctttaggttcaattgagcaggcatttatccgagacattacgacctagccaaatgagatacatacatattagctagaacttcgcatcacatattttttcaattttttttcaatacgcaattattgcccataattaatctgaggttttcatacttattggcaatagtaagatcaaggtaacgttgtttttggtttgactttatacaggatttattcctacgtagtcaagattatggtatattttgtgtgcattttaacaccggcgctagtaccaacatct

SEQ ID NO: 11274 - DNA, 480 bp, Saccharomyces cerevisiae
ggtataatgcgtgcacaggtaatcaaaacaatgtaacaagtaataaacattttcttcagtatatacatttcctatcagtttatagatattttaatttgcatagcttgctcaatacgcaaagtattggaagctcaatcgaccataatccatctattcctactatgtcacggatcaaaatgatggtacacgtcgagagggaatatttgtatacggcagtaaaaggtgaagaaaataatatgaccggagagacgggattcaattttcatcaaataatggaataagtagacgtacaaggatcgatgccacaataagattgataaaagggcaacgtagaaatggaaaagagaaatcatttaagtatacttaaaagctttcaataactttccggacagaaatctccagtaaattttatgtggcctacacaagggtaatcctgcatagatttaattaaagtggcggttaagtcccggttgaatggac

SEQ ID NO: 11275 - DNA, 415 bp, Saccharomyces cerevisiae
atgctattttgcctattgattttctcgggattgtattctgctcgacctaaatttcatgtgacaagtccttttaatctaaacaatatgatagtgaaaaaaaaaaactgactatgtaattaacagttatatacaacttctaaaataaaaaatatcgcctattttaacaagtgacacacaacctgaaattctgccagcatgtattcggaagcaacccgaactttagttttatagttacgattgttgcatttgtatataaaaagtacaatgtgtcattagatactgcagtgagtagaagaagaaatggtcggaagaaccacattaatgcaagaagaaataatgctttacttattttggagttccacattttcttgatggaggaggaggaggaggcggaggcggagctttagcctttctt

SEQ ID NO: 11276 - DNA, 421 bp, Saccharomyces cerevisiae
acgaagaaataaacaagcaagcaaatatatttgtatttcgtggtttaacacacaatttttattttcaattttttttcacaaattttggcgtcctttaacatcatttttttaattttacatttgattttactttctattattattttccgaaaatttcacactaatgttttatgtatagaatcaatataattatttaatatattaattattaataccatttaaaagaaaagaatttcatttctatcccactcgtgagtaatggcttaaaggcacaattgtgtgttcattatatccctatcaccttcaaaaggaagtttgatcctttgactaacatatttgaaagcttcgcagggcaataaaattgagctcgcctattatcttccaatccttttacgttaaaaaaaatgggggaaaagcaaac

SEQ ID NO: 11277 - DNA, 483 bp, Saccharomyces cerevisiae
cactgatatgaaattgcgtgcatcgttacaggaacacgtatgtataataaatatagcatggtagtgcggggaaatatactactactttatatatcaataaattctgcaaccttgcattaagcaaatgcagcacaatcctaaattccttctaatagttgcctttatttcctcatagtgcatatttcaaaacagcgaaaaatgcaaaatatgcgaaaacttgaaaaaaaatggctgatgggaattacaaataaagcgtgaatgataaggcgtttataaaagatttagcttcttaagtactgtggttttgataaaagctagaaatttgtagatcacaattggtcacaaagaacaataaaaagctgaatatcactgctatgagcgaggagtgtattgaaaatcctgaacgtattaaaattggtactgatttaatcaacatccgaaataaaatgaacttaaaagaactaatccatccaaacgaggatg

SEQ ID NO: 11278 - DNA, 408 bp, Saccharomyces cerevisiae
ttccaagattaaaagaataggaaacataaaacaaaactcgttgtctggagtaatctccttttaagttgtagagtaaacaaattgtaattatagcaacgatagaaaaataatagtaataaagacaataataatagtaacaaaaatggtaacagtaatattttgtattgttttcctttgaaaaaagaaaaaataaataacctggtatataggtaatcgcgtcactaaataattaagcattcaataaaagttttttttaattatttttttttttatgtttttggctcctagaggtgaatattttctttttctttcttcgcagctatatactaaatattagtgatataaacagcaagaactataaacctaaaagtagccaaagccatgtatatatgcgaaacccgaatcatt

SEQ ID NO: 11279 - DNA, 443 bp, Saccharomyces cerevisiae
acaaagataaataaaagaaaatcgacataatgcacctcagtataaattgtaaaatataacataaatcaaagaaaaacgagaaaacgatatgattatccgataccgacaaattctcatgtttatttttttttttttttttttttttttttaatttttcttgggcctttacattgagtacaggggcataagtgcgaggagttaccagacgacaactagcaggcggatgaaatcaacactgagtaagtattatgtaatccatccgctcgtccagcccttcaggttcttcctcttctgcacgtttctctagtaatgaactttctaaggaatttaatcggattttttgagaaaaacggagaaaaattaaaaatgtgccaagacaccagcaacaggcaaagcaaaggataaacttccggtgaacatgttagcacggaaaaattcattgc

SEQ ID NO: 11280 - DNA, 497 bp, Saccharomyces cerevisiae
agataaacaaaggcaatcatgttaacatagctgttagagaaataatatatagaaggtgtttgtatcggcttatgagctgaaatggagttttaaaagaaaaatatatatctataagattcgtacgtataatttatactcaaaacatgaattttccataaagtcatccaataaagctaacacttgttcttgtaagattcttttcggagggccgtggtgcagaatccacgtcctttaaattgagttgattttttagtttgcttaaaattaaaccgttaccatgcaaaaatttgatctctgaataggtactttcaatatcttttaagcaccaagaaacctgtctccattgtttttgctctgcccacttcttagctgctattaacctaaaaaaagctgccttgcgtcttcttgttaacccttccgataatatgtcctcgtctgtgaaatgatctgtgctatacttatgctcacctcggagatcttcggtgtctttagcgtcc

SEQ ID NO: 11281 - DNA, 494 bp, Saccharomyces cerevisiae
agatacaaattccttgatcccgcatggcactgcatactacttatattcctctactgtctatctattcatttgttcttttgttgtaaatagaaaagtaaataatgacaatattaaaagcctttttcaaaatttaacgatcaattaaaatatataagttttaaaaatactttacttaagcgttaaccttgtagacggaatgacacttaccacagtacaatctgtccttgtggttagccaagaaaacaccagcaccacaagttgggttgctacattctcttctcaatttggtaaccttaccttcagcatcgaccttgtagtaggacaagacagccaacttgaccttcttgtgcttgtgcttgatcttctttggggtggtgtagaccttcttctttctcttcttaccaccacctctcaatctcaagaccaagtgtagagtagattccttttggatgttgtagtcggacaaagttctaccatcttccaattgcttacca

SEQ ID NO: 11282 - DNA, 443 bp, Saccharomyces cerevisiae
gtgtacagtgctttgaattgatttggactggcacttccgaaaaacagaaattactttgttgtgtaacaatataacatgttcaatgagtatgcatgtattattgaacttaagcatatagaaatatttacaagaatatactttattttttagagtttattgcgcacactttgggttagtctcgattttttttatttccattggaggaaggttattatttggaaatttagtgctgcgttataaacgtctgtaaagccagtaccacaagcaacttcggtgagatttaacttttgtttattctgtatttttgtcgaggcttaaaagggtatactagttgagggcgttacagtaatcccttcatggcaagaataaagtaatagttatataataattgtcatacgcattgttataccagttgacgagtaaaaaaagacgcaccgtgactt

SEQ ID NO: 11283 - DNA, 441 bp, Saccharomyces cerevisiae
agcgttgtcttcctcgttcctcgcgcacgcgattttgcgttctgcataggaagccgaagtcgaacaagaagcaggcaaagtttagagcactgcccctccgcactcaaaaaagaaaaaactaggaggaaaataaaattctcaaccacacaaacacataaacacatacaaatacaaatacaagcttatttacttgacatcgcgcgatcttccactattcagcgccgtccgccctctctcgtgttttttgtttacgcgacaactatgcgaaatccggagcaacgggcaaccgtttggggaaagaccacacccacgcgcgatcgccatggcaacgaggtcgcacacgccccacacccagacctccctgcgagcgggcatgggtacaatgtccccgttgccacagagaccacttcgtagcacagcgcagagcgtagcgtgttgttg

SEQ ID NO: 11284 - DNA, 438 bp, Saccharomyces cerevisiae
tataacctaccataggacacactttgttgttgatgttggacaattcgttaattaagagtccctaaacggctctactagttccaacctcactttgttttttcatttttttatgttttttctagaaccttctttacgtgattctcgctcggaatccgtcaatagaatgttttcagtctccgtttcaatattctgcgcacatcaatcattttcttactacatacactaacattactcctagtttaatttaattgaatttttaactttcttttcttttcatttggcaatttggctccttgaaaacaagactatgggtctctctcataagcctcagggggggaccccaaaaaaataacgcggccatcttgcatgcaccgttgaacctgtagcttacagtaagccacaattctcttaccttcttggcaatgtggcacaaaataa

SEQ ID NO: 11285 - DNA, 498 bp, Saccharomyces cerevisiae
aaaacaatggaatgaagaagaaaggagaagaataagatgagaagggggcaaggggccctactattattaccgtctgtcgcaaaagccgttgcccggacaaaaatatcttttgcgagcatcggcacaacgttgattggtcagagcggtaaaaaggaatgaatgtgaaaaatgtaaagaatatataggcgataaaattatcatgcgaagtgatgtacatatttttgaatttaagcatcaataggacgaaagaatagatttcagactaagataaaataatcgagaataattaaaagacgataatgaaattgtttcaaaacagttacgatttcaactatccatgggaccaggtaaccgccgctaactggaaaaaatacccaaatgaaatatctacacatgtcatcgcagtggacgttttaagaagagaattgaaggatcaaggtaaggtcttagttactgaacggttgattactgtaaaacaaggtgttcccaaatggatca

SEQ ID NO: 11286 - DNA, 478 bp, Saccharomyces cerevisiae
tgattaggtgagggtcccagatctcgggtgcttttttccttgtgcggattgttctgtagactgcgcctccgcttgcccggcgcttgccttgaacgggatctattctcagaagacagcgcataaaaggcagtttttaggcacttctcgttaagaaaatacacaaataatggatttacgaagttcgtttcagtgtggtaccaaaaaatttggcatcagctaataaagatcaagaagttttggggttgtttcgagtctgtctcggccttaattgtgcaggtactaaagggattaatatataaagattgttaaggccaagtgactgaaacttgcaaacgtctttgaatcaggcttatctcttaaatacttatatatatgttcttttatagacttcataatctcttgttccaagaacagtaaagagcaattaaaaaaaggaaaataacagttaaagatgatagcggattcatcagttttgaaa

SEQ ID NO: 11287 - DNA, 400 bp, Saccharomyces cerevisiae
tacagataataaaagaccaaggctggccgtttcccaaaaactttgacgaaactttactgacggaattggtggaaaataataacattaaagaacctactgatagcaccctgtttactgacgaagatatgttcgaagaagatggcaagcctagatttaatgatgatgatgttaataaatgtacaaatattataagagagacgttgaaaagtctaaattaatatccagatgagcactagtaaatagtaaatattcattcatagatagtaatttacccataagttattaatacctacaaagttttttcataagtttatgaatatgtcttcttggcccatggttactttattacctctaataccttatttactttctcaaataaatgagcccttggatttcattt

SEQ ID NO: 11288 - DNA, 492 bp, Saccharomyces cerevisiae
taaatgtaaacgaagctttttttgactgcaaaaatgcattaaaagtaaatcgattctcatttattgtatatatattgtatatattgtatgaaatatttataatgataatgatagtaacaaaaaccattgatggctataaacaatgaaacaaaaaaaagcactacgaaaacagtagattcgtgaggaattgaaaaaaagagtgaaaaaactaataaaaacaacgagagtaaataggatagtacaaaaatactaggagtaaaaaaaggccctctagtagtagtaatagtaatagtaatagtagtagtactagtagtagtagtagtagttaaaggctatggttgaataaaaaaaaagtctggatggtagtgttttggttttacaattaattagattttttcaaatcattcttttttataccaaaagtagcatcattgtttgatgctttctctttctcatcagcaatttctcttctgagcttaactagcgaggcca

SEQ ID NO: 11289 - DNA, 406 bp, Saccharomyces cerevisiae
agcacagactaacgactatatgcacgttgcagtattgttctggccatgtaattatctctctcccaacgttttagaagaggttttcgtctccttcgtcaaagacgaccactttcccattttggtcattggaacgcgaaaaaacaaaacagacgcgagaacgcgacgcgaaaaaatatatttttccgttttttttttttttcggaacaaagataacgcgttaaaacctgtggatgtaataaggatctgaaacactgactaaaacgcgtcctcatttaaaatcaaaaaattacttcttctcctcccttacggtgccctttgatccttctcaaactttaaatatatgttgcatgattaattgaaaatcatatagagtatatcttaacagaggttccaacgctttaaatcg

SEQ ID NO: 11290 - DNA, 447 bp, Saccharomyces cerevisiae
caaataaacaactttagttttccactgtaacattatcccacgcaaacaacgagaataaggaattcctttttcaacatttgttttatattgtactactctatttcctattactacaaattttactttatttaataataatttttctttccctttttctaacttcagtctatatgtatttgcctgtatacatatacgcatgtgtgtagtcttccctccttcttgtttttgtaatatacttaagccaaattcaagtttgcctctgatgctgtgcgagctcaactgacgagcgtgatgaagccaaaaaaattaattgatttcgcccaggatcgaactggggacgttctgcgtgttaagcagatgccataaccgactagaccacgaaacctattaatctgtaaaattgatcattttaaagtggcatagttgtacgatacacaagggcgactt

SEQ ID NO: 11291 - DNA, 465 bp, Saccharomyces cerevisiae
ttaaccgtcttttgatttctttcctttccgattgtattctatttttatttctattgtttcatttcgctcttaatattgacttccacttttgggcgtaaatgatgtttttgttttgataaatattacgacttttgttatgtttttttactactgtggttacttcatgggtgtagtgtgcgaatctgcagtgataggtttctatagatttctctgtatacttcctgtattacactataatatttcatgtcctttcacttcccacgtttagcgggacaggccgcccttaaattaacaaaatttaaaaggtaaaggaatgtactaagaaaagaaaactattcaaagaaagtaacaaaagatcgtgagttaacttataatagcaatgtcctcaagatatagagtggaatatcatttgaagagccaccgcaaggatgagtttatagattgggtaaaggggctactggcctc

SEQ ID NO: 11292 - DNA, 492 bp, Saccharomyces cerevisiae
taaagagcgccaaatctgcaccttgtgcattttgttcacacattcttggcgctcctaactggagaaacgtctatcattgaggataactccggatagtcgcattctgattgaatagccgtctagctccctattgtgactagaatactattgacatcgttttctcatcaaaacctcccgataaagggaaaaaaagaattatctgaccagatcattcggaaaaatgcgtatcgtcattgatatccttcttgtcttgtctgctgctaacactatttactatggaaagagagatttccctgaaacttcttatttttatctctatagaaggggaaaagataaaagtaaaaatgtaaaaatgtttacctgcaagttcacacctgtacattttctacatccgtaaacataagagaaaaaatgccacaactatttttatgaagataaagttcgggtaacgataatgttttaattttgaaaaaaaaacttcgacgcattcgc

SEQ ID NO: 11293 - DNA, 477 bp, Saccharomyces cerevisiae
ataggactaatttcattattgtaaaacttttgaactatatatatctttacatagaataaatttgcattaatcactgataaccagaagagaaggctaaaaataggcaagtaggacacttaactcattttccaaagggagttttatgtctcatagttagcgcttacgatgctgcggaggtgcgtcgtcactctatcggatgttcattctgagggaaagggagtggttcaaatccgatttaaccttgccagcttatcgcaaagcgggtgagatcaaatgctccacagctctgcggttcgtttcacctttctgttttctgcgagcttcggccctgtcagggaaaaaaagaaagaagggggcggtggcaaagactgcatcggcccagaagcaaagaagatataaaagggaaatacttgccaccgaagtcttagactttgcataagagatattctcgcctttcccgcttgaagagttcctgac

SEQ ID NO: 11294 - DNA, 441 bp, Saccharomyces cerevisiae
ttttgcattgagtacttatccactgctctattatgtgacatattcgcaattcgtgtaaatattatgcatatgcatcttgagcatgcatggaatatataaatatgtaggtttgttgtaatactgtttctgctgtgtccttcaaatatggcctatatggtcgctggtaaaagtggcagagctattgttattgccttcactgccaacttcatattcatcgtcatcttcatcttccgcgttctcatcgtcatcttcatctgaattgaaaacgacatcctttgtcgaataaatgtatatgcctggtttgtctaatcccaaccgtttcctgaccatggcctttctctgtttggttttttcatttttcgagctgctgctattattgtggcctacgcttttctggacgatttggtctgtaaagtataaaattttatcacgcgcatagcc

SEQ ID NO: 11295 - DNA, 494 bp, Saccharomyces cerevisiae
agttcctttcatactcttttcttttctctttccatttcccactagttctgttcttttcttctcttagatacccttcttttcagggactctcgtcctactattgttgtcattctcgaaacattctctcccgtgcattttcctttccctttatatacatatatatatatatatatatatatgtctcttctacgtatttttgtatttctgtgtctttatcaaagatagtctataatacgtttgatacagctagatatcgctagcgccaacattgtccccctctcttgatcaatgctttttttcggcccgagacaaatgagaaaatgtcctaaaaatacctttcatcaagactcctatttttccttagaaaaaacatatatccaactggaacagtattaagccaattgctacgatacaaacaaaaggagatattccttccctcccatagagtcacacaggagccagtacttcttcttgaacccgcaatgtcttcagac

SEQ ID NO: 11296 - DNA, 491 bp, Saccharomyces cerevisiae
gtttggttgtaccgtgtagaggacattatgatagaatgtaacgatatttattcaaaataattattaatattattgtaaaacaaagaattttttttttttttttagttgaataagtgcctgataaattgaaaatagtaataaatattcttaatgccgtaagtgctattaagattttctcgtaataaacaataggacattaaatgaggttatttttgtaataattatgtagttatatgtccatcaaaaactatttcgttctctactacttggatttgttatatgatggaagagtgatcgtgttatacgctgacagattttcgttaagttattacgggcttggattcacagcctgggcagttatgaaggatttcatggatgaacacatcgcagtcaacacaaaattcttgtttacaatcttcacaacgatagcgagaacttgtcagtagtttaccatttttatggtttttcagtatgggaaatcttgactggca

SEQ ID NO: 11297 - DNA, 421 bp, Saccharomyces cerevisiae
agttgttttaaatggagttgatttcacaatttatgtaccttatatcatccttcatttcacataatgacgagatattacaaaaataatgataataataataataatacacaatacttgcacacgtatacaaatgcgtaatacaaaaaaaataaatagtaaacaaagcacgaaatgaaaaatgacaccgcagtcaccagaatgggcaccatccaatataatgttgacataacctttcaatagaagtggcttgttggatcagtttatcaacctgctcagggacgtctaattcattgaacctcttgatatcattgcccgttaatttatctgtaatacgtctcaaaacaagcattgctctggcgtttttggtctcattttgttgttctgcttccatatttgccgcttcttcgacagtaattgcccc

SEQ ID NO: 11298 - DNA, 445 bp, Saccharomyces cerevisiae
ctatcgtagccttgaaatctaaaaaactctaaattcactttagggccaagacatactctaacaaaaaagtatgaaaaaagtgcattttgtaaggatataaagcctgtcaaagtttatagaaagctaacctactaaggtttggaccccttcgtttcttctcctttactttgcattatttatcgtaacatatcaatgatccttatttacttcattcagtaaattggtccttttatacttgtaaatatttttaccaggtcactagtaacaataaaatgttttaaaatatcagtagcgtgaagtaaaattcaattactagatgatgttgaagtagatcccgtaataatgggcttttcccctgtgaaggtgaactttagaacatcatccacattgaaaggtttcgaaggtttgctatctcgtactagaagtgaagcgtgttcttcgctta

SEQ ID NO: 11299 - DNA, 414 bp, Saccharomyces cerevisiae
taccaaagtgtaacccaaaaggggtagtcgatcctacttttaccagttacgttaaagggaccaaaacgtggggaagggatgccgccaccaccaccgccactacccccgccaacatggcctaacttagcagtcctcgcttgtgtatctaggtccgcgtccgctaattcgcgcggcttgccacttaaccccgtccagttaatttgccaagcagcggccgcacgttggaacgttttcgccgatttatttattattatttatacatgttgacgttggtgcccttttgtttatactggagcctaaaacgtacctcaattaaatttagtgtgccatattatagtgctattaaacctttatttttatttttaattttaaaactgctttggttctctccctcccttaccgttgccaccttaa

SEQ ID NO: 11300 - DNA, 448 bp, Saccharomyces cerevisiae
gatgatagatgagccatactcaaatatatctgcgatattgctaatgttagctatttctcacatttgctttttttgattttatttatttacttttacgacaactggccttatcactcggctctctaaaagaagtcatgttcccttcgttgggttaattttttttttttttttttttgtttatatgttttttttttttttgccaggtattgttagcgccagatagcaaaaaattttattcagggatactgaacaccggggaagttaactgagtatatcggttatcattataaacacaagaatgtaagccagaaagaaaaataaacgtccacccctcgaactttcacatataagcaagtaaagaaaaagttaacaaaaggaggttcagaacatgacaattgaaagcactctagctcgggaattagaaagcttgattttacccgctgattcc

SEQ ID NO: 11301 - DNA, 478 bp, Saccharomyces cerevisiae
cgagtcaattaaagacatttttctagctacataatccttacactatatagattcattttttattattttgcatttttgaattttatcttctttatgttactgaatactacttatactgtcttcattttttttttgcttagaattataaagttcaagatcaaggccgaaaattttttagaacatgaaaaattgaaaactcatggtacctcatctcgaaaagatcctaagggccaagtcaagaattcgtgtagaaaaatgagtgctataggcgacaagaaccaatttcgtatcattgtgggctcatacgagcacaacattttgtgtttatccttagatatcccaaatcaaaaggaaaatgatgcagcaaagacaccacattttatgccaatatttcattttcaagcccattcgttgagtattaaatgtttggctgtttcaagaagatacctagtttctggatccaatgacgagcacatca

SEQ ID NO: 11302 - DNA, 442 bp, Saccharomyces cerevisiae
tgttaaagaaaaagatgtttaagtgtgctcgtcagtctgaatttgacaagtagatctgtacaactcttcggatgttttttttcttttatcccattcagcataatattatagcatttagttttttgccatagaagccgtgagaagaggaaaaaaaaatttttacctcatcgcggattgtaaatagtaaatataaactggcaatttacttagtttttgaataaataattgtataggaatattatcagtcgtataatacagacgctttagatctccgtagcatcatatcagaaacttttcaagatggcagactttaaatctttaggtctttcaaaatggcttacggaatccttaagagctatgaaaattactcagccaaccgctatccaaaaggcttgtattcccaaaatcttagaaggaagagattgtattggtggtgccaaga

SEQ ID NO: 11303 - DNA, 471 bp, Saccharomyces cerevisiae
cactaggtggtggtttatgggtaattgaaaaggcacagacagattttagcccatttcttgtgggcataggttcataaaaaaagcaagattcttacattttatgcggcatatctgcacatagaagttcatgtagttatgtggtaacatctcaaagagagaaggcgaaaactgttttagctattaactacatgtttttataatagcacctcccatatatgatgccaaatgataccttgcattccgttatgtggaagggttacacataagtacgctataacaatgcattcaattttctacatatcagagtaatatgctgcaacatcacacccatataatataattttttgaaagagttcctaactcttttttgtttttcctgtacctatatactcaaatagtccgccgcaagtagcagctctaacgacatttctgtcggtatttcaaactctggaatctcatcatcgtcctcgc

SEQ ID NO: 11304 - DNA, 421 bp, Saccharomyces cerevisiae
attgtgctatctgggacagtaacaatgcttatctacgccatcggacatctcgggaagccaactccgaagccgacaaaaattggataggcctactatataagggtgacaggacagctgactttactccagaagtatatccatggaaaatatgtaataatacaaacaagttaatataatctatattgtatagaaggccaattcaaattcacaggaattatgctatcagcaaggtgcctcaaatctatatacttcaagagatctttctcacaactgggacacatcaagccccccaagcacataagaaatgaacctgttaagccatttagaaacatagacttaaaagactgggacttactgagggcttccttgatgaaattcaaaagttcttctttagaagtgccactggtcatcaatggggaaa

SEQ ID NO: 11305 - DNA, 483 bp, Saccharomyces cerevisiae
ttaccgttttacgatgtaacgcttttttaaccttaatagatagattccctcatatatttataactatgtacccacataagtatacttttggaatgataatactaacgagataaaaaaccgttgaaaaatttctaagttttcttgaactaaaaatagccaaaattctccatccacttgttgttgcaaaatgttacgaaggcgaggttcttggaaatctggatgattatgggaaaattcgttcaacaagaacgccgagcctggacgaaatacttagtcggcatggaactagttatgaatgacttttcctatataagatctacaaccgtttccaattcaccatgagatatatatatgtttaacgaatcaggtactcgtccgaagcatttcgagtaatgcaaccccacaagtgtcccccaagaattcactgggatttttgatgaccgaaagaaagctattgcagctgctacggcgtcctttcatctc

SEQ ID NO: 11306 - DNA, 499 bp, Saccharomyces cerevisiae
ttgaatcatatgtagaaaagcttgtaaataagaaaccgtcatattctttttttttttttgaccgcgtatgaatcagtaatttatttcattttgaattacatcattataaaaagttcttagtaatatatgcattgggtatacaatcacgtgtactatcaaataaagaaatgaaaatacggatatacctctgtaattaagcccctaagagggctgtgttttcatcaggatcgtctgagtctgttaaatactcatcgctatctacttcatcatcttcggtttctttcaaaatctcagcataggtcataattttgtcccaatcgggaaataatacgtaataagcctcaactagcccaattaaaagcatggcacttccaataccaatccaaagaccatacaatttcatgtcaaagaaccaacttaggatgagagccaggggaattccaaatagatagtaagccattaaatttactatacttcctagagattgcatgccttgacc

SEQ ID NO: 11307 - DNA, 445 bp, Saccharomyces cerevisiae
tggggaaaaacagaactttgtccagacaataaatcatatttacttcattaagggttggcgttttgaatacttttattttcttccctttctcttcatttcaaatataactattatatagcaatcatatttattatttagatttcttttatcatattcaggttttataaacaatttcatttagttttcttccatacgctacagctaatgatctgctaaaggtgcgactttacaaacaaatactcaccctgccagctttggtttcctgaattctttttcgcataactaagttccgtgaaggcgagcatgacagcggtagatgatacaaaagctcaataattcaaatgctataacggtacgatgtaagatatacgcgtacatatataaaatagatgtgctaatagtttttattatacatgaagttaggagatgaagacgttatgttcaa

SEQ ID NO: 11308 - DNA, 444 bp, Saccharomyces cerevisiae
aaattgtaaaattaaagcatcatcttttaaatacggtatttaaacactcccaatgaaaaagcgtgattttgtctaactaattatagcattaataaagtgttttaaactttaattcctttcaagaatttgcaagattatagaaatttagtaagcgaaaaaaaaaaagaaaaaaaaaagaacagacaccctataaaaatagaataaacataataagccaccatttgcctgtctgatgatattcttgattctttatatctcttcaggtatgtgacacctatacatgcaacgctttttttgcgttttttctatacaatagttgtttatttaaaagcgtaggagcttcatgcaaatctgcaaggtatttcttacacaggttaaaaaactactttttgttagtcttctattttgcttgatagctcaaacatgttggcttgcacttgtacc

SEQ ID NO: 11309 - DNA, 492 bp, Saccharomyces cerevisiae
tttagcacagaatgtgcattattcaacatgtaaatactaatactgcaatatcgacttataataatgtatagtgatccgtatattaatagatctgtttcaattctttacctttttaggatatccgtcacccgtgattccgtcggaggtgagcactcgcccaaataaataacgggaaatggtggcaaaaagtagtggcgggaaaaggaaaaattttcgttctctcccatataaacgtttcattccttttcctaagtcttttacagtaatttcagaaacattcgtattttatatttgatcttttgaagctacaagaaaaactcttaccaattaccccaaaaaaatcaccatcataaagtacttacatatttatttttgtttggtcgttttctcaatataatctacatcatcatatatatataatgtctacacaatttaggaagtctaatcataatagtcatagtagtaaaaaactaaatcctgcgctaaagtcca

SEQ ID NO: 11310 - DNA, 421 bp, Saccharomyces cerevisiae
tgcaatataacattaaaacaagatataaacagtataatactctagtatgagccctaaaaaaaaccctcagaagcgggtgacccatctctcgtacgacgtataaaagcacaagtttgacccatagaatttttttttcacatcttcctttgtttgcttcttcgtcttcaatagaaaacagttgaacaaactcaaatatagcaccattgtgagtgctactgcactacaaagaggcagattaagcgaccagtaggtcccttggaagagataatatatgagttccttttttctttttccattttctttctgtgtgactcccctatgattaaaaattattaatcatataccaattgttccgactgaatagtggtttaactacatgtcgacaaccctttttcgttaagtttcagccttgtatgagggg

SEQ ID NO: 11311 - DNA, 498 bp, Saccharomyces cerevisiae
taatctaagccttaagaggctcgagtcacttctttcctcgatgagaaatcccggatttctcatcacggtttccatacaaaagtccatggaaatatgcttggcaaactcagtgaaaaatttgacaatatcatttgggtttgcctgagaaaccagaataaaaataggcttgaccagcagtgatatcaagttagaaggcattgttttgaattttagacaatttagtttcgcctgcaagccgtcaaaaacgtttaaacaatagaaaagatgctccgaagaatatgatactaactatttatacatatgtaacaggaagacaagtgacaacaaaaactatttaaactattcaatcgcatgtttcggagtttccccacgcccgtatcctttagcttcgtaataatccattggataatatttttcgctgaacatgacatctttctttagtaagacactagcctcatatggtgttaatagtggtttattgaaggcataaccccaatc

SEQ ID NO: 11312 - DNA, 488 bp, Saccharomyces cerevisiae
taattgcaatgcgatgtggccacgttatataatgcgtttaaggtgtacgaaaacccatgctgttctggcccgtcgggttttctgacaaattgtcctttagggatttttcggtttggctcgggttggcaaagtcggctggcaacaaaccaggacatatataaagggaggtaattcgtcagatcaatgccgaaccgttctcaacgggccttcccctcgttcaattgctcacaaccaaccacaactacatacacatacatacacaatggtcgctcaagttcaaaagcaagctccaacttttaagaaaactgccgtcgtcgacggtgtctttgacgaagtctccttggacaaatacaagggtaagtacgttgtcctagcctttattccattggccttcactttcgtctgtccaaccgaaatcattgctttctcagaagctgctaagaaattcgaagaacaaggcgctcaagttcttttcgcctccactgact

SEQ ID NO: 11313 - DNA, 497 bp, Saccharomyces cerevisiae
tgaggggaaaacttaaaatgaaaaaaaaataaaaataaaaaaatatcaacaacaaaaagaaaaatgtgaatttagcgggcttgttcattaaatttctatagtttagcatatttaaaagtataaaagtttctttggtttatatgacgtattcatccattcttcatttccgcttcaactattttttttcgtggaacgcaaacaacgttaccctgaacttttcacattggaaaaggaaagcatcataaaaaatcgtgtttttattttaatacacggtagccttttgatgaagggaaaagatttcaaccaccacttcaaaacaccacactctacctcctaccatactccataatgtcaagcccaactcctccaggtggtcaacgtactttgcaaaagagaaaacagggaagttcacaaaaagttgcggcatccgctccaaagaaaaacacgaacagcaataattcgattttgaagatttattctgatgaggctacgggact

SEQ ID NO: 11314 - DNA, 446 bp, Saccharomyces cerevisiae
ggcagccttttcttcttgtttgttcagctgtgatctgttttctatatagatcgccactacgcgacgtagtgttccgacaggcagccacagcacactctagtgcaatgtgaaaaactaattcgcaatggtatgtaaataagcaagctaaattggattttcaaagtgcgaataaagaattttttgtatatatctctacatacttgtatataccgaacataagaagctcttatggccgaaaactccctcctgaggtttatcaccaagaacaaagtggccatcctagcaacggtctctgcggggactgctgctgtgggtgcttatgtttactaccagcaaattaagcagcagcaacagcagcaattgaagggtacaaaagacaaccgacgtcaaagtgaggcctttgctggtcaaaatgaagacgaggcggacttaaaggacgacggcag

SEQ ID NO: 11315 - DNA, 439 bp, Saccharomyces cerevisiae
tcttttgtaacgaatttgatgaatatatttttactttttatataagctattttgtagatattgactttttacgatttatttgtaacaatgagaattactccatttctgaacttcagtaaatagcgagtgattctgtactttgcgagaaccggtggacatttggtattttgccttacaagaacaacctatacaaacgtttcaatatctaattctttgtaatccattgttttacgagacatataatgtgatatatagatgaactttacgtataaaatgatatatttaaaactagcaactgcgtgcgtaagacaaactgaaataggccatttacggaaaagaaatttaataatgtcgactggaaactgaaaccaggaggagtagaaattggttaaattgattagctaaaatttactcgttgtggacagagtttgagccaagc

SEQ ID NO: 11316 - DNA, 454 bp, Saccharomyces cerevisiae
tgatacaatataatcttcacaagcatataaacaattgtaaaataatttaaattgacttgaaagaaattttaaatctatacttgattcatgtagcacataatactacggtttgtgaacatactcctatacactttgaatggtttgtatgatatacaggtatctaaacattagtgttaccagttcgtatattaacactagttaaatttgaatcctctaaggtatcgccaacaagtaaaattttacatttaattgagaagttttttaatttttctaagaaaacattaaaaatatcacaatatgggcttcagcctaaaattatggttttttttttccctcatccttcattttattacctccgtttattgacgtgttcgacaactcacatatgaagctttaaatactttgttcactgttagtttaaataaaatttagcctttaggttaaaaatcgtgtc

SEQ ID NO: 11317 - DNA, 440 bp, Saccharomyces cerevisiae
tgatcatatcctacaatgcaattaccgatattgatagaggaccagtctgccaagggcatccggggatatatcatattttccttcttttataacggcatgtaactttacttttactttaaactatggcattacattccagcttttcaagagttattagtgattcattacttataaagtttttccgaccacattttgatactttgtacctgatatagataaaacaattaccttataaattgattctctcatatttatcttgatgagaaaacgattgaggagatttgtgtgtaatttggttctcgtaacaaataccattaaataatccttgactagtaatacataccaaacaaagaacgatttgcggatactcagccgcacgaaaatttctaaaattgaactaaatcctttaggatatataaaagggcacaaagtgagaacgt

SEQ ID NO: 11318 - DNA, 443 bp, Saccharomyces cerevisiae
atgccatttactgacggtgaagatactagaaactaaatctttcgccgttctatttatgtaataaacccattattgctcattgggagttgtaaatattaatgctcaatgtttatgtatatccctcgcacaggggctttttatttcttgagggggggactaattgtataattgtatgttttataaaaaagtatattgctcttttacgacttttggtctggtcccctatgctactaataacattttattctcttcaaacttcaacgttcaacctgctttgccgagacggcgattagtatcctacccaactgaaccttttctttttgtttcgctttttgttatacaatgcaatttcgtctcgctgtagtctttgggtatgtcctgtcaaattcgtcactacattttcaaaagttgtcttatcctttaggaggtctcgctgttgtttc

SEQ ID NO: 11319 - DNA, 487 bp, Saccharomyces cerevisiae
aagcctcaaagatgcactaaaacttgtaaactagaacaaataatacaaaaacatttttataaacttattatcaaaccccttacataatctataaatactgtcaggttacatatttattcgataatttcttttaatttcattatttcctcacatctctctgccatcctgttggctggtgccagagcagagcatatcgtcctttcttttttagttccagacgttacccgacatatcatttctcgagcctctggaaaccacgaaacgttttacaaattgcacatctaaaagaaatataaacacagatcaggtatctcataaagtacattaatcgactaagcaagcgacttgagacaatgagagaggtcattagtattaatggtatgtatgcgttcctttttttgttcaatattcgcaaccaatggcacctgtgggacagggaaagaagtttgatctgatctggtttgattcattcccaattggtcaccat

SEQ ID NO: 11320 - DNA, 493 bp, Saccharomyces cerevisiae
ctaggttctttttcttctaatttgttgaattctaaacaaaggagtttttttttattatttcttaacaactggtctttttaattaaatgaaaaaagataacagcattattgtgctaagtattgtactcttttttagaagctggagtaatctaaaaaaagctaaacaccattattactattttccttcctcaagttgttgttttgcaagactattgctattatattattattatgatcatcattattatcacctgttttcgcttttcctctttttttatattatctcctatacttcttactgtaacaaaatttatgataaacattgtataaaaacattatagacgactatatatatgtgtgtgtgtgtatgtatatgtaccgtataacgatttttaaaagtatttaattcttcacgctttttcgttataaagtccttttaatgatcctctaagcaatcagctgtgttgcagttggcagcgtcgtcgataagacaa

SEQ ID NO: 11321 - DNA, 430 bp, Saccharomyces cerevisiae
tgccgaatgattgagaatttgacaaaacaaaaacaaaacaaaacaaacgttacgtatagatgaagaatacacgtacacaaatatgcatatataccgtcatgaagtagcttaacttaaataaaagttttttttttttagagttaccaatatcgcaaacatgaaaatgagaataaaaaaaaaaaagcagaaaaaaaaaaagcataacatggagaaaaaaataataaataattgagtttagttgagacgccggtcttcgccaggccaggaattgtttcaccaggtcattctctgcaaagcctttactttaacatttagattcttcttcttggcggagccgcgaccattgcttctcttttcgtctgattgtttgctagtcgaagagacgttacagtaagtaccagctttcacgtaaacagcaatgtcgttgtcg

SEQ ID NO: 11322 - DNA, 429 bp, Saccharomyces cerevisiae
gagaacaagtaatggtgagggaaaaaatcataatatgaaatatattatgacgacgtcaattaacgtcgtccacgcctgtcgtcgtcaacccacgaaaatatgggggcggtttttataacggttattaaaacgacgggatgccgtctacggcacggacaaacccatcgctttggaaataggtgactgcgcttgaaaaacataattatttattagcataataaattcaagacagcaaatatatatgctgtcaatacgtacatattaagcctaaatattctgtggaaaaaagaaacaaactggtaattatggagaaagctttggaattagacggagaatatccggaatctctgagggatgaattcaacatccctacatttaaatccatgggactatcgtccgacgataagcctgtgacgtacttatgcggga

SEQ ID NO: 11323 - DNA, 408 bp, Saccharomyces cerevisiae
taagctttgaattggatttgagaaataaaggaagacctaattttctccggttttatgttttttaccccccctacccccttcatcctgaagtagtaaattctttttattatactatttcgactactatgtgtttacgtgtgcttgtgcaaaagtgaaatttattgtgattgtgttctttttctcttttttttatacaaaaaatggagaaaggaaattgggacctacgatttaaagaagtgttatttcctatttcaacgagttaaatgaatgtgtgtgtttcgttgacttgtaaggatagagaaagatcatccaacttttaatcatggtttcctttccttttttatagcaatcgaatgtggaaggaaaatagagcggagcttgataattgtgtgtgtgaatgtcttgctt

SEQ ID NO: 11324 - DNA, 449 bp, Saccharomyces cerevisiae
tttagtttatagataacggctcttgccgaattcataggctgcactcattccggtacggtacacatttgttgcatttattatattagagatgcgttgtccctgtttttctacctccgacatcatgctgaaacatggcatgtaattaccgtaaaaggaaattacatggcgagtgtcacataatagcgacaataacatgtatacacagccagctattctgaaacacaccacattatagttattgaatgtgtgtgttttttgataacagtataaaagtgaagagaaagcacgtcgagccttgtcatgatgaattctttaatgatcttcgcgtgatttaattctagtggttcgtatcgcctaaaatcataccaaaataaaaagagtgtctagaagggtcatataatgtctgcaattaatcatctttgtttgaaacttattttggcgagtttcgc

SEQ ID NO: 11325 - DNA, 463 bp, Saccharomyces cerevisiae
tcaacatgttcatgtcaaaagaagaaaaaaaataaagaaataaaaactgtatattatttagtctatgtcaagcgagaaaggggccctatatcttccctcctccttgcaattgaattttgtttgcattctatattatcatatagtttcatatcaattgcaaaaacttttgcagccaatgttacaaaattgttttcaatcaaagaaatacaggtgtggtgtccttcaccatcgatatattaatattaatatatcatgaataaatataaaaattcaaggtaatgtacttgtgcacttcttttagaatatagcaatttcccttagctctttttcaaattgtaattctctacaatacataaaaagaaattgatctttggttcaactttatatatcgcaataagcaattctcaacattatgaaagtttatctaaattaaacaatcttcaacaatagaatggtctcttgg

SEQ ID NO: 11326 - DNA, 479 bp, Saccharomyces cerevisiae
caaaagaaggaagataggcatagtgaattttatttctaatttcactttttatgttttttttttcgatatttaattttttcacgcattacgaatatatttctatatacaaacatatgtagtagtactagtagctgtcatcatcacctacaaatgtgtttgtcctagcattattcaatcaacttccacaaactttccaccttttgcgaatctgggatttcttggatcattgataaattccttcgtgttagaagaaaggtcagcagctttactcataccataatacactgcggcgccagccacaaagaaaggccagtatactttaaggataggggtagggaatcttttcaacatggcagtacaatccaatcaattaatctgtcgtcgtatgttaaactaacgatatctgagtcgaactcttctcaacacatctcagctgattgttccttatattttctctaggcctttttaaaccctcggag

SEQ ID NO: 11327 - DNA, 473 bp, Saccharomyces cerevisiae
ggcactttgaacggcttttaacgatgagtatgaataactaagtagaaataacatgtacacaagtgtaacttataaaaatcaaaaaataaaaaaatagaaagggagagaataagagtaggtaataatatgaattaaaagaaggataaggcgccgtggaccaggtacctaaaaagtaaagtaccagtttatattaacaaaagaagttcaagctaaaaagtagcaatatgcgaaggaaaggaaaataattgaaggaggaggcagagaacaaatttaaatcaggagtgcaatatggaaaaaataggagcagataatttctcctcaccatgtagactatctaacactagcacaaagtcatattccagaatatgagcacccacttgtctgataaggtcgcccgcagcatatgccgttccaccggtggcgagaacatcatccacgacaaccacgttggaatcaaagggaatggcttcaac

SEQ ID NO: 11328 - DNA, 487 bp, Saccharomyces cerevisiae
aaaggaagaagaaaagaacaaagcgcgtttccctttaaagggcaaaaaatgcggctgcacgttgcttattacgtgacatgaccctattgtattgtgcgagcacgcaggacgggaaaaatattggtgaaattacataacgcattttttttcccttgtggtgaaaaggaaaaacccgagaaatatgccagtaacagtggagaccggtcaagatgtattgaacgaaatccgaagttgcatatataacataaatgtcctgctaccttttgatacttaattcttcttagcacctatacgctttttttttcatttttccttatcttttctttttctcgcagaagtctatacaaagaagaaatatatatatatctatttcttttttttttcaaccgtataccaccggcaacaaacctccatgtattcataggccctgcattacatcaagaaatattagcataaacgtatagaccattttaacgccacaggcaag

SEQ ID NO: 11329 - DNA, 493 bp, Saccharomyces cerevisiae
aatcctgtcctttttcctgttaaataggcctaacttccacagggtgaaaattcattactagttacacacacgtatacatacagttattaatagagtgtttctaggtttgacaattcctttagtatcctttccaactcatcgtctgatattttattgtttaagcttggaattaaagtctttgcttcatcagctgtgtcacaggccaaagaacctagttgcgccacttcaaaaggatgtaacccagtgcttttcagaagctgtataactgccccgacggtttcttggtctctaaatcgggagaaatttgttaaatactgcatggtatttttcaaatctttattatttcctcccgttgtctgttctaacagaacgtcgatagactccaactccttctccctagtttcagaatgcataaaatcatcatcatcagcgttgacgtcatcttcatccagatcatcatcttcatcctctactgccgtagtttcatcattgg

SEQ ID NO: 11330 - DNA, 479 bp, Saccharomyces cerevisiae
tgagcgatagatactacagttttttgttctcaacaggccgtccttgcatattataaactctgatttttaggtaatcccttccacctttctatattttatgatactatccaaacatgtaaattttacgtaccatacatataacctcatctataatttttaccctgatctaactaactttggcatgcctggttcaatctacgggttacagtcatcgttgaaaacgatggaaaaacatgtcgagattcctcaatccatacaccattatagtccgttttatcagcttccactaattttttaaatctcagtttcttcttgaaatttagcatcgtgcatgggatagcggctagtaaaaaagaaaattaatatctcattaacaaagttattgtacataatccggtacaatattcttcaatgtactctctaatatcgagcacactggcaatattcatgcacacattcgcctaatgctgacgaatgct

SEQ ID NO: 11331 - DNA, 444 bp, Saccharomyces cerevisiae
aaaatacatcttttctcaagcattttttctcaagcattttttctcaaaaaaataaggatttatagcctctttgcatataactacactcagaaactcaaaaataagtgaatagattaatttgccaaaatagtttctatagcgtgtctttctctttttgcaaactcgtgtcatcttgatataaatcaaatattttctgtcatttttttttctcttttttttcagtttctagaattttttttttccactttagcgatgagatgaaaaatttccaaaaaacatgcggtacggtattttcaatgaaaaatttcagagggctagtgccctattgaagagctcaatacttgattgaagttttgacatcttaaattttgttggttcaagttacactaaggttgtgatagggaaaacgtgaagataatgaacacgaatcagtccaatccgaat

SEQ ID NO: 11332 - DNA, 497 bp, Saccharomyces cerevisiae
agttcagtaatataatacattgttctcataacccgacattattcccggctttcttttcaggtaattgaaaaaaaaagaaaaacggtaagaaaattttctaagcgatgagttcgtgaaaaatcgatgtatagaactgaattggagttcaatagtaaaaaaaaatccatatatagcattaaaaactcagtatcctagctttaagaaactgaaccagattccaacgacacaatgggtcacaagaagaacggtcacagacgccagataaaagaaagagaaaaccagaataaatttgaacgttccacatatactaataatgctaaaaataatcatactcaaacaaaggataaaaaactaagagcaggcttgaaaaaaatagacgagcaatataaaaaggcggtatcttctgctgcggcaacagattaccttttacccgagtccaatggttatttggaacctgagaatgagctagaaaagactttcaaagtgcaacaatcgga

SEQ ID NO: 11333 - DNA, 400 bp, Saccharomyces cerevisiae
taagtgatacctgtacactatggttccatgttgcaggtggctatatttgaaaagtctccacatatatgttaataagatcgattactccacaaacagaaaataacgaagacttgaacttttcttatttttatgtttttgtttatatttttgaatttaaactgttttatagaaatgtatgtaatatataaattttattttccttgaaaaaatgggtatttttctttctattttttcaagaaaatcttcctgtaaattaattatgcaataatgctgtggtaggactggaaataaaaaatgttgataacgattgttattaaaggtaaaagaaaaatgatcaaagagaaattcttgtgctcatttttttgattggatgaatatagtttcatgttgccctaaggct

SEQ ID NO: 11334 - DNA, 468 bp, Saccharomyces cerevisiae
gtgcaaaagttgcgtgaatcagaaagtttaatagaaaatttactggttacttccatttctatgtaaatagtcactcgtatgaccgcgataaggatcctgatgaagacgatttaattatacttcctattctatacaggtttcctcatcagtagtcaactgtccaaagtacacatccaatggtaaaggctcattcttgtaggtatcatcaaactcaagatccttgaaactcgttatcagcgatttgacggtatctataggtacctcacttccaactaattcttctaaaaggcttaccgagtacatatcatcaaactctagattaatgtaactagttaaatgcacgcctcgcctttcatgcagaggcgtttgtgataactgtctcattaaatacaacgaacatttactgtgataattattacaatacattgagtggataaagaagccatcagatgaattttctgccgcact

SEQ ID NO: 11335 - DNA, 400 bp, Saccharomyces cerevisiae
ttagcatgcattttccccttttcctttcttaagaacatttttacgacgcggatctgcccgtcatcgcatacgaatgttgaatcacgccagaatcaccaaagaaaaaaactcgttcagttcctaggttttatgagccaggaacaatagacttttatcgcatattatttctatacgtgcacttatatatgcacacatatgtttatatacatatacatacatacgtgtttcttttcagcctgtgtttttgtcgggtccaaaaacatacaaggcaacataatattttgacataactcaacgcaacataacagtataaaacatagtttaataaaagagaaaaaaaaaacaatatttttaagctatcgctcttgccgcaatgaacgccaactctaccacgacagca

SEQ ID NO: 11336 - DNA, 492 bp, Saccharomyces cerevisiae
aaaataataatacattaactaaacacttcggtgttgtaaattaaataaggaaaacagaattttgtacaataaaaaacggtccaatacgaaaccttgaagcgaaagacgcatatcagagttttgctgataactctacttatgtccgcttttcaacattattagagcgggagtaaacggaaaaagagtaatgcggaaatagaaacggattttagctacaactatgtcagttgaaatcgccgagattgctgacatcgtgagacgaaactaaaaacgatggaaccacgtgactcctattagaaataaataatccagaactcatttttaaccattttgtttatataggcacatttgtagcgacaattttctgttagctaattgcagtaagcaaaacaaatttgtgaatacttgattaatattctgtgaaagattttttaattatgagtaccaataagttcgttgtacgaataacgaatgcgctcttcaagtcatcac

SEQ ID NO: 11337 - DNA, 407 bp, Saccharomyces cerevisiae
ataggcccgcttgcatcatccccacctgcattactatgaactatttatcatagcttatttttcctctatcatcattgtaacttgtacaagaatgttcagtctgtaaatctcgccgctcattctctactagcactttacaacgttgacagccactgtatgtgtaatacagtgaaccgccgactcttcggatttaataacacagatttatttagaataatctacacatgtttacgtatgcaacaaattttgcaccttcatatacaaacaactgcggtcgtttaaaaagtgggaaagaaccgaaactagaatgaaaaactccaccaaaacggcttgagcctttatcttctgtaaccagagcggttgcctctcctgtttttacttactctggagcggttgtttgcattttt

SEQ ID NO: 11338 - DNA, 418 bp, Saccharomyces cerevisiae
cggaaagcggttattaaggtaaatagatagaaatacaccgctgtcatgcgattatatagacatggggcatttagacactgaaagtcttcatatctcaacatgcaactagtaatagtacaatttttagtaccctttaatctttattgttcgctccctaataacgaagccttgaactgtaaccagatcccaggttaccccttatccttaagaggtcttttatttactctacataatatatatttttcaatccattgaagaggattaaaagaagaaaaatcaataccgaacaaaaaaacaaaacgaaataaaacaaaacaaaaaattaaattaaattaaattaatattaaatgtcatcatgattcttactctgattgtcttctcttctctctttcccttgacgcaatttccttcaaatcgt

SEQ ID NO: 11339 - DNA, 448 bp, Saccharomyces cerevisiae
gcattgtaaacttactcaatgacagattgatttatttatattatatattccctttttatcgaaaaacttttagtattttctactcgtaacatatgatcttctgttctcactgaaaatttttctttcttcttttccctcttcgcaaaaagaaaatgctgaaaaaatttgaaaaattttcaaatgatgagatgtttagcttaggaaaaatataatgtaaagatagttttcagaacattttttattggtttttttttttaaagattcattatcatctggagttcgttacaacctacacagaggaccgatatacacaatgtcaaaggaggatttcgttattaagcctgaagctgcaggtgcttccactgacactagtgaatggccattacttttgaagaattttgataagttattagtcagaagtggtcattatacccctatcccagctggt

SEQ ID NO: 11340 - DNA, 495 bp, Saccharomyces cerevisiae
tgaaaagaaaggatagaactaatgaatattcttttagctgcgcttatttcagtccgtaaatgcatttatctattcgtaactatcattattttgattgcataatccaataaatacacaaacgagcatagcatatataactatatatatgaaaagacaaacgaatttgtacgtgtatgaatatgactacacggttataggcgatcactagaaccattgagcggaaagggccacctccgggtaaaagtcaaggccgcgaaaataacaaagggaataaacagtcacctttaacaagaggaggtagtaattagcgtaggaataggactgatgaagagctcggacgtgtgaggatatatgtacatatgatggctagtacatccaatgatgaagaaaagttgatatcaaccactgacaaatacttcatcgagcagaggaatatagtattgcaggagatcaatgagactatgaattcaatcttgaatggtctgaatggtctca

SEQ ID NO: 11341 - DNA, 439 bp, Saccharomyces cerevisiae
tcgttggcctcggtatcacctccccctttcctcttcctctttacatatatcctaaccacacaagcactcatttgatatgataatacttattcgtttttattcaaatagatagcgcagtcttgaagatttacctatatttttaaacttttgtataatagttgaaatagataatacagcattttttggctcctgcttcatatctttttttttaggtttttgctttatattctttcttttaactcaacttgtgcggagcagaggtaaagaggacaactataaatgctgtcaaaacgaacaatctacagatatttttacgaaaaggaaaaagcgcaagaatgaatcttaaactttctgctattgaaagttactttttccatagaagcagactaaatttgcattcatgtttttatgtcggaatcaaactcaacgaattgcccaa

SEQ ID NO: 11342 - DNA, 447 bp, Saccharomyces cerevisiae
aaaaacttcctttgtaactgatggtaaattgtagtattcataaataggataagattattcattgtaagcataatggaaaaaaataacacaacaaagccgcgcaagattggaccatactttctatctaaggtaactatcacttactggcttgatggatgcgtatttttgtcggtaccagcttctgaaatatcgatatcaaacatagctggctcaattccttccatcaattgctgggtaatttcgactggtaaaccgttatcgttagagatattagcagatgcgctatcaaaatcgagttcttgggcacctgatctcaaattgcaagaatggcaaataatatcttcataccagtataaacttttgtttgtaccacaatgtgggcaagtcctttcgaaaggaagtacgtaaattttgggtttaatagcagagtcgtgtgagtttcctggc

SEQ ID NO: 11343 - DNA, 473 bp, Saccharomyces cerevisiae
tgctaagcagttatattcagttagaagcatatatcccaccattaaataagttaacatactactgcatttttattttatgtttaagagcagatacgtcaatgtagcttgcatatgtacgtatcctcccccacctcctattttctactttgaactttatgggagtgttagtataagaaatatgtttacacctttttcagacaaatgtaaacggaaaattaaaaaacgaattcagatcgatgtgttaatcaagtagatgaaggagaataaagcatataaagcgcaccgcacacatgtttcatttagtcaagggactttacaataattggaataaaaaggaacaatattcaattctaatattaggtctagacaatgcaggcaaaacgacgttcttggagacattgaaaaaggaatactctctggcgttcaaagccttggaaaagatacagcctacggtaggacaaaatgtggcgaca

SEQ ID NO: 11344 - DNA, 491 bp, Saccharomyces cerevisiae
tacgtataacacgatgatcaaatttttttttctttccatagtaatgaaaagcgatgcctaggcaagaaacagtacaaatgcctaatggcttatggttgaacatgacaagagtgggtcaaagaggcaggagctaagatcaaatatgcgtaatcttattaccttgaataagggtaaatttaagccaacggcgtctactgcagaaggcgatgaagatgacttatctttcactttgttagactcggtatttgatacattatccgacagtataacatgtgtactcggttctacggatattggtgctattgaagtgcaacaattcatgaaggatggttccaggaatgtgttggcttcattcaacattcagacttttgacgacaaattattatcttttgttcattttgcggatattaaccaattagtctttgtctttgaacaaggtgatatcattacagccacttatgatcctgtcagtttggacccagctgaaactt

SEQ ID NO: 11345 - DNA, 464 bp, Saccharomyces cerevisiae
gcttaaattgaaaatgagaaattttgcataaaaaatttattttttaataataatattaattttcaaacgttttaatataataatgaccttaaataaccttttaaggtgattgctttgttgaagctttgatacttggaccatgggaagtacctcattataggaaaatcatatcgacttattttgaatatcacaataattttgcatgccttagtagttttggattacctaagctatgttgatcgcatccaagattattaggtcagaaggtcattaacatccaaaagcgatatgattgtgccattgaagtgagtgaaagccgtggtttcgagacaaagttacagaagtagtcaccgttgtaaataagtattgccatatcggattgatgctgggaagaagttcaaattcatattctcacttgcgctacccgtgcagctggcaatcttgaagccagcgtccagttagtc

SEQ ID NO: 11346 - DNA, 430 bp, Saccharomyces cerevisiae
tatttaatgcggtacataagaatgcctaatctagtttgccagcgaagatattttccattgtgtgctcaatggaccctgtgttcctgagatcttgcacgactttttcctgaggcacatgtggcgccatcgtcatcacgatttcaaccatgtcactattaacggctctctttcgatcactaccatgtctgtttaaccgagcaacgcgttcctccggagccgatggtactggctccggagaagggtcgttggtggcgaccgagggcgccggtttggcatcctgtacggttcgcgagggtacttgcttggcgcccctgtgtttcacggtgtaaacaaacaagcacaccatcgtcagtataaacactatagtcgatccatccatttttacttttgtgcgcgtgggtagccgtgcctcgtctgtgtgtgtgggaat

SEQ ID NO: 11347 - DNA, 551 bp, Saccharomyces cerevisiae
gtaggtctttttaaacgaacgaaattgttcacgcattgtatgttgggtttcttacatatcaatcactcagaagcccattttctacctccatcaccgtacttatagaattatttttctttcttgacacaatatactgtggctagtttaacatttcgtgccctttaaatatttttcatggtgtggacagaacaacgtcaattgtaaggagcatggaggtcaaataaacaatacctcaaactaaataatgaagaccccaagaagccttgcaatcggcagtaattatattcatggtactaattgtcactattcgtctacactctagtaaaagttcttgatgcaaatttttttatttttatgtatgagaactgccgaaaaaaaaggtttggatattaactttgttaaataaaataatacaatcaattcaaactttttactgtttcttttttcagctaactatatcatactattgtacacaattattaattaccacttacattaactgttattcgctacgctttagaatatcacatacccaatatcgcattaccaca

SEQ ID NO: 11348 - DNA, 500 bp, Saccharomyces cerevisiae
cgaggctctcctttcatcataccctctctaaataaaatttattcctagttattcctttcttcttcatatccttaatcatgcattcactgccatgtgcaaataaaggctcttgtggtagaaacttttagctcaaacgtggtaaaactatctcaacgtccttccgtagacaactggtgagcagtgcttctgtaacactgcagatctccaatgataaatcgataccgtactaactgcccgcactataatgaactctttgtatccgtaactatttaaaatattcattcatttctataagctatatgtttatatttagattagaggggttaaaagaaagtttttctcgaaagcttaattttagcttttactttgaacttctagtaattgcgaggcagtatcgacaatgcaatctctgaacttattaaattggaatcctaataaatttttggttttgcggttgtcgcacttgcagcagttttttgtcaaaaaggttgagccgctac

SEQ ID NO: 11349 - DNA, 466 bp, Saccharomyces cerevisiae
aaaaacattagaaaaaattctcgttacttttcttatagatatagatatatgtatggtttgcttatagatgaaggtatttatcgcgtcctttgtattccctattattaataaaattcttttaaaatgcattttctggtgctcttttgttgcttctgtatttttttttttttggaccactggatggaaaacctttgatgattttattacctttattttaagttactaaaatatcgagatttcaggaacaaaacatagaattttctttgtcaagaaaaataaaacgaaataaattgatgctttgactactgactgtctgtcatagagagaaccagaacagcaatgctacaattctcaacatttctagtgctcctatacatctccatatcctatgtgctaccgctatatgcaacttcacaaccagaagggtctaaacgagataatcctcgaacgattaaatctcgcatgc

SEQ ID NO: 11350 - DNA, 443 bp, Saccharomyces cerevisiae
taaagtgtgttcactcatctaatatgcacggagcctaccttttagcttttgctgccaaactaaaccaagattgaaagatatataatcgactatctttcgtctcgtaatctgtatcatgcaatttaaattaattatcaacataaaatgctctagttagcacgcgcatatccaggaaagttcaccagtaactatgtactagacaaaagcaaactgttcggagcgaccatacaccatatgttgttgaatcaacttttcttaaggctctttcgagttcatcattaaccaacctaggtattttcccgattttttggtaatatgtcaaaacagctactttgtatacatttatagacgcctggtgtcctttgagcctcacttatataaagtaaccttcacaagattttggattttggtaatacatacgctactgctatttcttgcggagc

SEQ ID NO: 11351 - DNA, 410 bp, Saccharomyces cerevisiae
ctcaaataaactgagataaatgctggtaacctaataaccgatgaaattacggcatggaaaattgttggaacaacctcctagttccttttattctttcatttcgattcgaaatagtcatcaaggccgaatactttactccgacgtggcttctgggatgaatttaaaaaggaaagccattctggaccgcgatagataaatagtaagctaggtttacaattgtgcgttttgaaaggcaacaaaacgattgaggtctatcgtatgaataacaaaatatatatggtatatgcatgaacatatatagatacatgtggtgaatttatcatggtcataatttattaaattctcgtaatctgaatgcaaggtattcagcggaagaatttaagccaaaagcagacgtggtcgggatatct

SEQ ID NO: 11352 - DNA, 419 bp, Saccharomyces cerevisiae
aaatgaatagaacaatcacatatgaccgtatttatacgtgtaattaaaaaatatacggaccatgtaaataataatattataaaatgcagacaatgatgatgagtatagtactacagtaacgtccttcattcattacctttactagcagtgataaaaagttttgaaaaaaaatgtgctccaggggaggttcgaactctcgaccttcagattatgagactgacgctcttcctactgagctactgaagctgtctgttatggaggattctagcattaaatgctttaatactcaataaaagcaacaatggagaataatttatcagcaactaaatttatagacgaagatcctacgccaaatcttagctcctttatatttaatattgaaaaacatatgaattttaggttgaatcctcaaaatggaa

SEQ ID NO: 11353 - DNA, 415 bp, Saccharomyces cerevisiae
tggtgaaacaattcctggcctggcgaagaccggcgtctcaactaaactcaattatttattatttttttctccatgttatgctttttttttttctgcttttttttttttattctcattttcatgtttgcgatattggtaactctaaaaaaaaaaaacttttatttaagttaagctacttcatgacggtatatatgcatatttgtgtacgtgtattcttcatctatacgtaacgtttgttttgttttgtttttgttttgtcaaattctcaatcattcggcactactttttatcgtttctcagacatattccttgaacatcggcccattctctgatggtcatttcgtcgatttgcgaaacaaatggctcggcgctgaacagcttttcaattagctcatttagcggaatgggttcaaag

SEQ ID NO: 11354 - DNA, 405 bp, Saccharomyces cerevisiae
tacaattcaaccgaggagcacccctcctcccatttcatgtaagataaatacaataataaaaattggaataccgcacaaatgctttagtagaggcctaatatgagcaaaaagagcaaaaagctacctttatcgtttccgggtagcgaatcaaggagggcccttttatgcttcaagaataatagtaaagaaaagtatagagaagaggaagcaatgcttcctatcggaattaattcaattcctggtactagaagcgataacatcacagttatacgttcaagatgtcacgcatgccatctagtttcgatgttacggagagggatttggatgatatgacctttggcgaaaggattatataccattgtaagaaacagccattggtacccattgggtgcttgctgactacag

SEQ ID NO: 11355 - DNA, 434 bp, Saccharomyces cerevisiae
tttcggaattacctaaaatgggtttacggcatagaagatagatagattaagaggtaggttgacttttcctttgaaatttgtaattttaataaaaattccaaaaaaaaaaaaaaaaaattcaaagtaaaaagacaaactttggtgagaatcttcgattaacaaaattactccttaatattcttaaattggaaaatgatcatggttatcagtgtattttcttttaccgtgtatatcaagttttataccccgtatagcttcaatatacgcacttttctcagatctttttctgccgtcattcctttcttccttttctttcaactagaaaaagaaacgaaatcagaccatatatctagtcgccaagcatttttcccttcttggataggaggagcaaaagaaatactaacagttattaaaatgcaccatgccctctgtac

SEQ ID NO: 11356 - DNA, 429 bp, Saccharomyces cerevisiae
tgaatgacatgtacctttcctgtatataaagaatgccaattattggctcttagaaaataaaaaccctcttgtacttattagtgggtacctaacaggtcccctactgacattttgatgcagggcctcggcctattgttcttaccagctctcagcgcgttatacgaacaggaagcaaagaagagaaatgtaaaaatattgcttttgagagaccgtgtaaggataagtgttacacccaaggcaccctcaccaggaacatgactgtcatgaatcttttcttcaggccctgtcaactgcagatgggctctggaccgttggagctcatgcttaaaaggccaacgcaattgaccacgtttatgaacaccaggcccggcggatcaacccaaattagattcatatcgggaaatttagatccagtgaaaagaagggagg

SEQ ID NO: 11357 - DNA, 410 bp, Saccharomyces cerevisiae
cccggattataatacactcccattatacaatatctgcatttttttttatttgtgttgaaggtatgtagtctctattttgcatagttcctttttttgttggttttttgccttcctggttattattaacttttgatatttaatttacttactagcttattctactactgtttagtttctacggcctgaactacaatgacaaaaatattatttcacgatacccttacctttattcaaagtgcctgttcctgtttccattttttggctagttccaagaactttgatggttttggcttgtcatcatcgatatcatcaggaaaaatgtaatccacgaattcttcttccacaccgttctgtaacctcacttttttgattactttagggaatcttttcttgacggtttcttgatcgag

SEQ ID NO: 11358 - DNA, 424 bp, Saccharomyces cerevisiae
ttacgtaaacgataatatgttcctgaactcgcatttttttaatgattttttatgacctcttatatattctttcattatataacctctatattacatcaaaagatggaaaaatataaaaaaattaaaaaaaaaaaaaagaaattttttccaaaagagtatatttatatgtatgtatacatgtagggaaaataagaaactttattaatagtaaaaaagcatatatactttattattaactcttttgtttttctcgagaagcttaattttgggtcaattcaacgacctttttagcagcaggatctaattcatcaaacgaataaatcttcacgcctgacttattgataatgtcgcggccttcttctactttggtaccttgcaaacgtgccacaatggggaccctaacttctagttctctggcggcttc

SEQ ID NO: 11359 - DNA, 435 bp, Saccharomyces cerevisiae
aaggctttttattcctttgtttactattcatatctgcatttttctttttaccaaaattccgcatgtcaaaaaaaatctggcaacgcaccgcgaataaaaataaataatatttttttatctttagttgcctaaatactatttatttcgtcaattttacaacctcttttatatacaccattcgatttcccacgaagtaaaataataattctataaacagatttatctgatatgctcaatttcccctcccattttcattattgtccttcttgctcttcctcgatgtcaaaattaaccttcagccataagctgcatgcgctacattgggttaataattgataaccagaatgactccgttccatagcgtctacattatcaatgcattcatctaacaaactctcactaaaatgaaaaccaccaacaaattgacagcgagga

SEQ ID NO: 11360 - DNA, 474 bp, Saccharomyces cerevisiae
aatcaaacgaaaagtaggtatctgactgtaaatatcttcttatataaatatatatatatacactttttcacgtacagcatgagttcaaaaagcaatggcatggtcctgcgtttattaaatgatgtatccttttcaagacgccagtaatttattcaatacagtatctcttttccgcttataatggaaaagagagaaaaaagatcaaaacgttgaaaaattttttttagtcattgaggtatcagaaataaaactcaataacaaaaaatagtcgtagaacaacgatgagcaacgacgaaactgtagagaaagtcacccaacaagtgtcggaactaaaaagcacagatgttaaagagcaagtagttacaccttgggatgtggaaggtggggttgatgaacaaggtagagcccaaaatattgattacgacaaattgatcaaacaattcggtactaagccggtcaacgaagaaaccctga

SEQ ID NO: 11361 - DNA, 433 bp, Saccharomyces cerevisiae
tttttgtcacatgtacacactcatatacatatacgaaatcatcatatcttatattcttcactgacaaagatcggtagccgcccggttttccattccgattacggcctgactcagtcgcgccgtcttcctctaataacaaaaaatcgaaaaaaaaagaggaatctcgttgctagcgatctgacgccaaccctttttccggtttttcttagttgcctgctgccccgcaccggtttttcttcttttttttatctttttttccgctcagtcagcggggaagggagagaaggaaacaatgaatcggatcttccgatggaaccagcgtcagggaccactacatctgcttgttgtttcaacacaacttacatctgcgcaagcacacggactaggagtaacaagaagtagtaaaattgaagaaagcaaggactgctgcaat

SEQ ID NO: 11362 - DNA, 440 bp, Saccharomyces cerevisiae
tatggattgtcggatattttattcttagttgtttctttgcggctgtatagtaaatgaataaatcacacatgccctagcgcggcgtcgcggattaaacaaggtaacaatggttaaaggaaaaattatttgttaaggtgggtatattatagattgctaattgtaaagtattaatagtttattaagtattaaactagagttcgcacatgcttttatttttttgttgcttttcttcacgctaccgcttcttgagactgttgtttggtagtactgatatcttgatcggttgatcccgagctgcgattacccgtggagcaaacttcttgatcctgctgtagcgtaccgtttgctaagccttcatagtaaagttcctcgtgaaactggtttctcaacacaatgacgatgatggccactggagtgcatacaaaggcaattacaacggc

SEQ ID NO: 11363 - DNA, 446 bp, Saccharomyces cerevisiae
cgattatgtctcgttgctgatatgtgtcgtcccagtactcaactctttctgatgagattttgaatatctcattttatttctcatcaaacagccatgcatgcgactgaagtggactactgcgggagaacaccgatcttatctttgaaattgttgcacaaaaatatttcactaccttggcgtttctcatctcacccattggggtgaatctcgttattgctccttattttggtccattttatattaaatcctgtatcatgtttaacatttttcatcttatacctcatacaaaaaagaaaagctatttatgaaagttagttcattacaagatgcaagcctaaaatatatgcttgatcttaaaattcatgtatagaagaaaaagaccttaccaacgttgttggttaccgtgtataactaataccaatcttgaacattaaccactcctggcg

SEQ ID NO: 11364 - DNA, 417 bp, Saccharomyces cerevisiae
tgtaccaacctgcatttctttccgtcatatacacaaaatactttcatataaacttacttggtcttacgtcataaataaatatgtatacatataaattaaaaaatttggttttatatttttacaaaaagaatcgtttacttcatttctcccttttaagcgatacaatccatgaaaaaagagaaaaagagagaacaggcttgtgccttctttaaaacatcccacacaaaatcatattgaattgaattttacatcttaagctagtgtacaacaactgctatatccaaagaaaactaacgtggaccgcttttagagttgagaaaaaggtttgaaaaaaatagcaatacaaagacttgtttcatatataaaatacagggagcacattgagctaatataacataaacactgcgaaccaattcc

SEQ ID NO: 11365 - DNA, 440 bp, Saccharomyces cerevisiae
gtagcttttccttctgtctggacagcctgcattgaaatatgcaataagttaaattggcgtgctgccctgtcataacgcatgcattcttcttttacagtagtagaaagaacaaaaaggtgtatatttcaatatacatatttacgatctatataacgttgtatacatttaattcagtgcatttttcattttcgcgttcgtcacacatgattatttatacaaaggaaaagtaaaatttttagcgatgagatgtaaaaagaaatgcgatgccataagctatactttacgattgaacacctaaggaagaggtaaagcaggcttaatatattgaaatactaaaaaatggctctcggtaatgagataaacatcacaaacaagctaaagaggcaagaaatttttgctgatataaaacatgaaaaaaataaagagcgccataccatgag

SEQ ID NO: 11366 - DNA, 409 bp, Saccharomyces cerevisiae
agttgttagagaggggaaaataaatatatataaaaaaaaagtctgggcaaattgagataaatagatcttcaaaacgggaaagatgaaagtcataatttatcgtacctagaaaggagagggagttttcattttttaccgtaatcgttgtttttcttttcttcttataatttgtaaattttttaactgcattagatcattatattatctttcaaaacgccagtcgtttttattagacctttatatacgtttcaaagtggtttgtacacgttagtttagttaaacttttgttttcatgtagaccaaaatataaacttattttatgccgaaaatcgggagatggattagttaatattgtaaataatgataaattaaaggaacattaaatttacaaagttgcaatgaggagcaa

SEQ ID NO: 11367 - DNA, 453 bp, Saccharomyces cerevisiae
cgtgcagtaattttcatttttatcacctaatttctaaaactatatcccttcctaaccttcattcgatgcatccgtccaccttacttcagttcaaaaaaaaatatatatccatatatatgctacagtgttattattacgatttctttgcctttactccttatctcatttcaatcatgaataaacaggatattgataatatatgctgtcattttggattcagtctgcttaactgtcttgtccacccccggtgttcttacccgtctgagcggtcgtaagacggaggtaataatttttcagcatcctgacctcccccccaaatctgtgcctttcaccacatttttctcgagaaaatgtgtcttggctcagatgatgtcgtatgagctactggacttttttttgttggccctgatgaaaatagtaatggcggttacagaacagataaacggcgtcacc

SEQ ID NO: 11368 - DNA, 463 bp, Saccharomyces cerevisiae
aatgacggaaaacgagaatatggagcagagagcaacttttagagctttacccgttaaaaggtcaaatcgaggcttcctgcctttgtctgattttagtagtaccggaaggtttattacgcccaagaacagtgcttgaattgagttctcgggacacgggaaagacaatggaagaaaaatttacattcagtagccttatatatgaaatgctgccaagccacgtctttataagtagataatgtcccatgagctgaactatgggaatttatgacgcagttcattgtatatatattacattaactctttagtttaacatctgaattgttttataaaataactttttgaatttttttatgatcgcttagttaagtctattatatcaggttttttcattcatcataattgttcgttaaatatgagtatatttaaatacaggaattagtatcatttgcagtcacgaaaaggg

SEQ ID NO: 11369 - DNA, 481 bp, Saccharomyces cerevisiae
acaaacggctgagacgggcaatacatatgctctacttcttttccatccaatggttggtgaaactctcgagcatacattaccttacgtgtgttagtgtactatattatatatatatatatgtatatatataaagggaggagtttttaattataattgtaatttcgtattttttctgcattatacagttttttccgattttaaacgactttatttaagtgtcgtgtaaatatgtcacattttatttttgtacgtattcacatgtcctggcgtgcggccattgctgaaaatcgcaaaacccacagagaaataaacatcgcgaaaaagtcaatgaaaaattggaaaatatttttcatttcactattatccacaagcaattttgtacaaagtgaaaaggttgaactaattatcttcgtctagaagccatgaattcactcgttactcaatatgctgctccgttgttcgagcgttatccccaacttca

SEQ ID NO: 11370 - DNA, 496 bp, Saccharomyces cerevisiae
gggtttataatcaagatgtatccgctggagaattcgcctctcttacgtgacaaagagaagacctgtgttattgaaactggaggaggaggtaatacaagcttcgaaagccattcagtaacaactactctagatgaaccaaaaaaacctacaacaaaaaagggtgaacaaacgccaacgaaaacgtgcttggctaaaaacgctaccactcgaaggtcaaatgaaagtccgtcgaatgatgaaaagaaaaaaataaaaaaaggcataatagcctgctgcttaatgtgaaaataaaaaacaagaagaacatgtatatatatgtactttattagaaagtgaaaagatctgttcattgtgacagctatctacttattatctattttataaatcccataaattctttccatattacttacgtctattataaccttccgcgtaaaaaagaaatattgacatcctttcttgtatttagcccatacattttcacccatgcaccatt

SEQ ID NO: 11371 - DNA, 486 bp, Saccharomyces cerevisiae
tcaagtcctcatgggcaaaacagtcttgtaaataacaaattccaataaaaaggaattaacaaaaggcaggaaataaaattaatatacacactaattaagtaaatttaaataaaaagatctttctgtaaatacacgaatgaaaagaaattttgaagaatatcattatctaggaggtataagtatcatccgtcttaattttatccaaaagatcctctatcttagggcccatcaagggctggcctgtccttgttctttgagtcaatttcttctttctatcttctctcctctgaaatttttccttcgaaactctgattctttccaattgctcgtttctttgcttgtttaattcatctttttgcattctctttctttgtttcttgatctccttcttctcgtctagtttcttctttccctctattgccctggcttccttaatcttccttacagattcttttgccacggtttttggttccttttctggtacgg

SEQ ID NO: 11372 - DNA, 412 bp, Saccharomyces cerevisiae
ttacataaaggtaaataccaacgtcacactaacaaagaaagaaaaccttacaaaaatgaaaggaaaagtagtaaaataacctcaattgatcacatcgtctcgccgtactaaacatttatttcttcttcgaaaggaatagtagcggaaaagcttcttctacgcattaatcaataaggtgagaatattcaggtatttcttttactttattattgaagaatttctctagcctattagcatacttgtaatacgacgtattctcgccattgtacattcggcaattgttaaacaccaatctggcatcatatatgaagtcttccatcttctgatatttgttgctctctaattttatttccatggtgctcaagtccattggctctttgataaaatcataatagtcggggacctcctcttt

SEQ ID NO: 11373 - DNA, 434 bp, Saccharomyces cerevisiae
aaaaattgaatccttagcaggcatacatgagaatttcgttgtttcaatgatttatttctatttatttacatgcattaccccgacgcttcatagtgtagtcattaaatgagtgtatacatatatatactaacctagtcatcaagatgttttaggtgtttcaattcttattattcatctataaagacagaataaatatatacggtgcgtatcagatatgctatttcaacatactatctttcgataatcggatcaaaaagctcctaacgattgccattacaaaccttcgtccatccaggccaacgttttgttaattccttcttcaataccaactcttggtgtgtagcctagcaactttttggccttagcaatgttgtgataacggtatgcacacacaatcttgactctgaatggagtcaaacctggctctttaccca

SEQ ID NO: 11374 - DNA, 488 bp, Saccharomyces cerevisiae
tgaatataaagcgggaatttttttttttctatgcatttagactggggggacatcatacaaacatctccttttttaatacattattcatctatctattcgcaatgcttttaacgacatgaggagggtatatatgctgtaatttatcgtttacagacataattgcggggctaatttttagatgcttagatagtatacgtaattttataaccggcaagaaaccatgtataataattatcaataaacatcattttcgaagagactagttacgtaaaggtaatcactgtctacatattaccattgtagaggcaaccagttgtttttactagcaatcctcttaatttcgtcatcgtcatacatctcgatgaactgctgatcaagcgccctggccttcggaaatgcgaaacgtctgtactcatcaaaaatcatcgttagcgaccaattttgtagttttcttatacaaccaatcaaacaccccgttctatgtttgc

SEQ ID NO: 11375 - DNA, 463 bp, Saccharomyces cerevisiae
acggcttcacttgcttcgtatcttcttcgacttgcctttaacctactcatgattcatgcttattttttctttttcgatttccttttctagtcatcctaaaaaaaaaaaacctacacatatacatatatacatagttctctacacatccttttgataaagaaaatatgtacgtacatctgcattaaaaaaaaaaaacaaaaccctcaatatttggggaaagaattctataatgtaaactgtatcacgcatactttttgctgtcttcgtcttcatacatataatatttttagtttaaggtgaaaggataattaaaatatcaatttctaatataactacataccacggaacgcatttttgctagctcttcttctattttcgaatctgggcttcgacctaccattgtccttcttattaccattttcttcaataccttcttcatccgatgaattatcatgacgcctgg

SEQ ID NO: 11376 - DNA, 470 bp, Saccharomyces cerevisiae
acgtaaaagaaaatcgaaacaaataatagatttgtgtctgttcaatgtgtatatcgatgagctcagtgaacacattttcacatcacgtttcttttttttcttttttccgctaagaaaaattttccagaatttttcagaggcaaaacaaaactcatcgatttcgcacgcatttctcgtagaattgatatttttttatttttttattggttttttttttttttttcacttttttttcttcctttcatgatatttataaggagaagtatttcaattgggacttaaaaaaaaattttattttggttaatgttttcattcaatggtttactactttcattttagctttttaacaattttctttctggggtctcagttgcggttagcagattaacacagaacatactatagacaaatatgattatttacaaggatatcttctctaacgacgaattgttgtctgatgcttacgacgc

SEQ ID NO: 11377 - DNA, 407 bp, Saccharomyces cerevisiae
taacgccgtatcgtgattaacgtattacataagttacaggattcatgcttatgggttagctatttcgcccaatgtgtccatctgacattactattttgcattttaatttaattagaacttgactagcgcactaccagtatatcatctcatttccgtaaataccaaatgtattatatattgaaagcttttgaccaggttattataaaagaaacttcatgctcgaaaaagatcatttcgaaaagttgcctagtttcatgaaattttaaagcagtttatataaattttaccttttgatgcggaattgactttttcttgaataatacataacttttcttaaaagaatcaaagacagataaaatttaagagatattaaatattagtgagaagccgagaattttgtaacacca

SEQ ID NO: 11378 - DNA, 465 bp, Saccharomyces cerevisiae
ttgtagtgtttttctctttctctcataaataaattattgcataatgtcatgtcaacattagttttttcgctcttctcttgcgtattcttgtacttttcatttttcatttttcataaagcgaataaaagagcaacctaaggtgtgaaaccatacccttcgggagaaaagaaacagaagtgtggcaagaaatatgaggttagctgtggttgtgaccctacttgttcactgtttcctagtgacatgctctccaggagataatttagatgagtttatagactgtacgtatgcgtgcgagtataacagaagatgtccgaattcccaaataaactacattgaccctgaaaccaacatgtttcatgatattgagtttttcgataccccgcctttgtactctaagttattgttctgggattgtatctcagattgtgattaccaatgtcagcacatcattacgcgctggagaat

SEQ ID NO: 11379 - DNA, 464 bp, Saccharomyces cerevisiae
tactaaatagacaagaacaagcattaattcatataaaaaaaaattgtatactatgaagacaaagaaaatgataaaatctacagaaaatgaataacggttatatcctctatcatatataatataaacttttaccattcatcaaagtacagcaagaatattctgttctactgatgcgtctgcattttggtccacttgtactcttgactttaaatcataagcttgcatgtcgtgagccttttcttccgtttttctattctgttgtgcagtatctgaattttttttcacatacgtaggcctatcgaattgttttttatcacgttcgtaatcccatgctttggactgtaaatgcaaattctccaaggatttcgttgtatttatttcacttttcagagcgtgtatatgtttaaggtcgctgatatcttcttcgtcacttatatcactgatgtcatcatctgaacctgcaa

SEQ ID NO: 11380 - DNA, 447 bp, Saccharomyces cerevisiae
agtacaaggggatttcgatgacctaggtttaacaagatcatgaaatattcattaacggagttttttgttttcgctttttttattttttgttcctaattttttttttttttacattttattagctatacacttggcgcaaggatattttatataccggatataatagataattaaaagactactaattaaaaatgatgtaatatggtaataggtatggaagaatcagggagttttcagaatgttctttgccctctcttgggctttctagttttgcacttttacttattcatctcctgtaaccgaaactgaaatgggggggtttggaaagttgtacaaagacatagctgttttcttttttttaaatattgaaggaacgctttcatgtattttttcaaacaatgagtgattcttctcattatatttttgaatggtggaaaagaaggacca

SEQ ID NO: 11381 - DNA, 464 bp, Saccharomyces cerevisiae
tgatcggttttgcttctcaaagctttttcctgtccttgggaagtaaacaggacacgatgattggctggctccatgcaatgtgttcactctgatcaatgaagattacctaccgctgtttagatttattttgtgaatgaaaatttttactttaagtttttcttcatttaaacattaaatatctaatgaaacgaataaaatacacaagataaacgaaatccgtatttattatatatatgctaacaggtaaagcaccaacatcacattctccttctcttaccaacggtagcttggaaaccggttttaatagaagagacggatctggtagaaccacaacttttacagaccataaagaacagtctgtttgactgttctctcttcaattcggtgttaatactcttacaagttttacaagtgacatactccaaaatgtatcttcttaagacattctccatttgtttggattg

SEQ ID NO: 11382 - DNA, 453 bp, Saccharomyces cerevisiae
gacaaagcttagactatttagcatatatattatcatgtaatcttacatcatatctacaataaccactcattactggaaacggaaaaaggcgccaccgaaaattttgagtaaaaagaatggaattaacttcaaccacaacacagacaaaaaacactagatagtgaaccaaaagaaagcacaacaccaaacatgagcagcattccagctggcactgatcctgggtcctgcggtgctaatttcaagaatgaccgcaagcgcagagataagatcaacgaccgtattcaagaactattgagtatcattcccaaagacttctttagagattattacggcaattctggtagcaatgacacgttaagtgaatccactcccggtgcgcttgggttgtccagcaaggccaaaggtacagggaccaaggacggaaagcccaacaagggccaaattctcacacag

SEQ ID NO: 11383 - DNA, 400 bp, Saccharomyces cerevisiae
aaataattgatagagggaagaactccctttaacattcttatgaccatgatacatcgcacttttttttacttggattgaggaaatatgtatatataggcacgtatgtatatatacaaatgttctttctgaaaccatgtaaacagaaaaggaaaaaaaataattatattttattgagctttatggtaccatcttcatatccaattaaacaccagttacatttcgccagcgctttaatacgtctaagttgtcctaacctcaacccatctgactgcacatcaaacgattccaaacatgtcatggctcccactttatagttatgggatttcgagctggattcggtatttgagccgctaccgtttgttaggtctcccatagagctatcactcacgaccaggttgtt

SEQ ID NO: 11384 - DNA, 463 bp, Saccharomyces cerevisiae
cgagctttctatttctcctactgtaacgaacatcctcatgtatataacctattgtaacgactctgtgtagaactttatattcagaaaaaatatcaaaagaaaaatttaattattaatcagtacttttcactctggtaatgtgcatcggtgtcaagagcatctccaagaaagaatacataaacaacaacgatggacgtgcctgcagattcccatatcaaatacgaagatgccatcgactattggacggatgtggacgccactgtggatggtgttctaggtggatacggagaaggtacagtagtacccacaatggatgtcctgggatccaataacttcctgcgtaaactgaagtcgaggatgctgcctcaggagaacaacgtgaagtacgctgtagacattggtgcggggattggacgtgtaagcaagaccatgcttcacaagcacgccgctaagatagaccttg

SEQ ID NO: 11385 - DNA, 427 bp, Saccharomyces cerevisiae
tgaagttagctagttccttttacgattgctactatctcgttcaacttggcctgcgctgttgatgaaaatagcagtgactgcagagaatagaaatgaaccgggctcatctggtctagttgccttcttttttttattttttttcattttccttttcttttcttttcttttcttgtctcactatgttggtttaatcaattcgtaatccctttaccaacgcattgtgttcaattttcctcttgtgtggggtcgcccgccttgtctcatcgtgaaaaaattgcgtaagatgaaatcatgaaaacatgaaataaaaaaaataaataaaaataactacacgattcaaaaacgccaagatctgttagtagagacagcaagcattgcaaaaccattcatcactcagttgctaggcgagtgttggtgcgatttaccc

SEQ ID NO: 11386 - DNA, 491 bp, Saccharomyces cerevisiae
cgaaaaatgattattgactgtgcaataaacgctgctggaaggggcgcttgcaacaaaagatgatcacaaaaattgatacccattaatacacataggctcacgccattactattattatatatatcatcaagtattgcatttgtaattttatgagtccttcttagtaatacatgaaggcttttttttaatattttcggaatcaacgagagtacactattctatccgatgataaccgagataaatgaagatagtaactaaccaatgaaaaaagagcgagaataaattaaagcaataatatcaagttagtcgtgggaatatatgatccacgcataataaggttacattaagcactgctttatcctctatgtctgctaagaaaaggccttcgggaaacgcagcatttgaacttccaaaacggagaagaacctaccaagcttgcatcagctgcagatcaaggaaggtgaaatgtgatcttggtccggttgataacc

SEQ ID NO: 11387 - DNA, 479 bp, Saccharomyces cerevisiae
aaattttcaggtttgcaaataaaaaaagttgatagagaggtttttttatattttagatatatgcattcataattcgatatatacatgcatgcatatctcgagtacaatattaccattgttgtaattacttgttaaatatcgcctcttctattcatgtttgaaaggaaaagaatggtgtggttacacctcggggaagatattttcacgggcatatggaactaataaattgaacgtcacggtaatactacataatacagtattggctaaacaaaatgtgcctgacgatatcaaagtttctgtagtgatattcattcctggtttgcaggcatgaaaagattaatattgtcattgagcaatgttcaattattgccttttatttaataacattctacaacctctgtatataatacatataattccatttgtatccacaattctcttcatgttgagatatatatcttgaggggtattcgtatcgc

SEQ ID NO: 11388 - DNA, 499 bp, Saccharomyces cerevisiae
tacgactgattagtgatgtgataaagatagaagatttaagtcacagaggcgtgcatctacgattttggcgtttcacattttttacacttaaattttagtgatctagccgtgaccttggcagcagtttccaaaatcattccatgaccatgtcatgcttaagaacgttagacccagaacaagtggacctgtattctaactcttcactcttgggcaaagataatagtattatcttttaccccattttttgtatgttttttcgtttattgagtttggcgtttcctatttagaaatagtacaatccggtcaatcattcgatagtgaaatatatatatttaactaggaaaattagtaaaacctcatttaaagatcattcaccttgatatatactactattgaccttttgttaatgaccattttcgtaaaaatgaactgcgattctcttctggaatttgttaccctaccttattcactaaatcagaaataataatgtgcagcgccc

SEQ ID NO: 11389 - DNA, 485 bp, Saccharomyces cerevisiae
aataataagtaataaaaaggtgaatcgtaaccttaacggcattgattgcatgtagttttaataataaagtgtagaataataaatataaaatttcaaagtcatcagaaataaaaattgaatagacatatacatatagaaattacttctatcatttaaatacatatatatacatacatgtatacgtgtatacttgtacttgtgaaggactcaatagttgtattcgtttggtttttgaccagaagtgtttgggaaaccacattccaataagatatcgttaatcaattcaggtttttcagtaatcttggagaaaacttcatcatttttggttaagatcataccacaataacctgtggagttgaaacctatcttcatttcatcagaaaaggccttcgagcgtggaacgacacagatccattccttggttaacataagattgtaggatttctttagttctggattttcgttcaaccagtcctggaaaaagg

SEQ ID NO: 11390 - DNA, 452 bp, Saccharomyces cerevisiae
gtcatgggttaattaaggttacaaattatataggagataaaagaagaaaacctcacacaaaatggaaatacatatacacatctatatatatttacaatatatatcatatatctgcattcaggaatgttcttataaatatcacatttttaaagtacctcattggacttataataagttttctattggttttcattatacttcggaaaatacacaattatattatatacttaccccccttaaggattttttatgaaaccctcattacggactttctcagcattgatcttagcagattcaggatctaggtagaattttctgataaacttaagaccattattcttatctaattcaacgactaaggggataccatttggaatatcaacattcttgatgtcatcatctgatataccctccagaattttcagtagcgatctcactgaacttccatggcc

SEQ ID NO: 11391 - DNA, 437 bp, Saccharomyces cerevisiae
tttcaagtgaataagattcgcccatcattgaaaggtatttattttcgggtaaggactatctaggtacatctcatcaaattttttatagtccaatttgatcctagtgtttgtatattagctttgtaacttctaagttatccaatagaaaaaatgcgttgcttttttgtttcccgcgagaaatttaacaatatggtgaattaagtgttgatgccacagtttgtaaaaaaaatcgacacaggtttgctatttaagcagacgtaagtgttgtaaaattatgtattcccagtttggccagaagaggagtaaatatcgcatatttatagaataagtacaacatcaaataatgtctgcctttgttactaaagctgaagagatgatcaaatctcatccatatttccagttatccgccagctggtgccccgactgcgtctatgcta

SEQ ID NO: 11392 - DNA, 450 bp, Saccharomyces cerevisiae
tgtaaaataaatagtgtcattagagaatttgtaaatagcattttttaccgttatataattactagggtgtatttttctgaaaaaataaaggcatacccttcatctaagctctttcttatagtatacaagtctcttatatcgcacgatgtaacatctacatacttcctttatcgtcttgaagagtaaacaaaagatatatatatattattttctattattttggaagagaatggtattcctacagtatgcagagacacatctggttgtcgtgtagttcttttagtgtgtgagaataaatggttatcgtttctatattcatgaccgctctcatcttttttttttcatccatcaaggaaaagaaaagttcaaaaacagccatattgaggaacacttaatctcttttttctaatgggttgtatcttaaaaacttttcaataagatcgacgtggg

SEQ ID NO: 11393 - DNA, 446 bp, Saccharomyces cerevisiae
tgactaccagtaattgtctctctgcagataatcactacctgtgtgtttcttgtctcttgaaataatactagtagctgctgaacagtggaaggtcacgaacgagattaccataatatctcgccatcaccaggttgacggtaaacgcattacgggaagaactgaaaaaaaggtgggaaaaaaaaataaaaagtaaagtgaaaaattaaatgtaatgtatatttccattttgacgcaaagtacttccctctatcagttttgtatctaactgcagagtaaagtcgtgttttgcttagttaacttatatacaagtcaaagcaaaaaagatgtccgatatcaacgaaaaactcccagagttactacaagacgctgtcttgaaagcatctgttcctattccagatgacttcgttaaggttcaaggtattgattactcaaagcctgaagccact

SEQ ID NO: 11394 - DNA, 496 bp, Saccharomyces cerevisiae
atgtttgcttgagccacacgtgtatataaaaatgtttgttttccttttggccctttttctttcttggtattttctttacttcagtgttaaattgtatttggtcttaggctgacggtgatataacagcgctttattttctttttttcattgctttttatcgttttcaagattccatgtccttttattaagtcttttttgtatcgttatagttgcgtttttccttttgattttcatttctttcaaggttattgttattcttaattcaattcaagattgtacgcttttaagcatgtttatgattttcctttattacttccatttaccttctttccatcactactcattacggcctgtcaattccttttttgcgtcaccttcattttttcttctctgttcttttctgtatttgtcgaaaattttatattgatgtatcttaattttatttttagtattattatactgtaaatgtttcttactgtgtcaagatttcccgttg

SEQ ID NO: 11395 - DNA, 441 bp, Saccharomyces cerevisiae
gtcaattaaaagcaaagtaaaagaaaaaaagatacatatttgattatttattttttttccttctctcatcttttctgtacaataatatagcaataacagataaaaataatgaatgcacattcccttctatacctatgaacgcaaaaaaaaaagacaacaaaaaaataaaaactattaattatgacttagcattatgaacttcatgtatataaaagagcgtatacagaacatggaaagtaagaacaccttttttttttctttcatctaaaccgcatagaacacgttcaaagccccatttctgcttgtagttctcttaatgctttttcatcttcatcttcttcatcctcttcctcttccccgtccttcacagagttctcactttgtttaattttattacttggaacactaggtagtgagactttgttctctgagataggcgcc

SEQ ID NO: 11396 - DNA, 403 bp, Saccharomyces cerevisiae
agcaatgttgtccttaccaagacgtcttgatgaaggataagcatacgcgaagagatttcctctcggagagcctgcagggagcggcgcacctcgccagcggagttatcacacgtaatggtactgagtgagagaccccgcccgacaccgcacggccatttgcagaaagaaaaacaaagtccactacggctaattactgcagaatgcttttttttctttttttttgtggttggtatgttcccttctaacaggattcttccttcggtagatccttgaggggtttaaggggttttctgtttgcgtaatggcgtaattgccagctatatataacattatcatcacatatatatccttatacgtagcttgcccttatatatatattgatatgcggatattcgttgaatgt

SEQ ID NO: 11397 - DNA, 408 bp, Saccharomyces cerevisiae
tcttaaaaaaaaaaaaaatagaaataataaaaaaaactattagcatctaaatttcaaagtcagaagaaatttttccctatatagaatgtatattataatttttctaataacaatttcattcctgtgtgatttaataatcttaaacatttttttcagtatccagactaacaaaacagaggccaaaagaattttcaataagagaaaaagtatctcgttggcttcatacaaaccttattctttgtcactaactttgccgtgagaaagaaatgcaaatatacatgttataatgaaactgaaaaacgcattttctcaaaattaaaaaacaattgggtaccctggattctttatcaaataacaactaatgaaataagaaaagaagtagaatagaacacatgccaaaaatgacga

SEQ ID NO: 11398 - DNA, 478 bp, Saccharomyces cerevisiae
ttactattaaaatcacggaacgaaattcatgttcctgtgacccttttgatggaagacacctattcaaagctttttgaacatgacacatcatatgttttcccgttattgtatttataattcaagcaacatatttagattttaaaaaaaaaaaaaaaaaaaaaaaaaagtttttaaacagttcctgatcataagggcactgtgatgtaaataaacatatcagcattaatcatttgcataagtgattgttcctacttgttttacttgtaaaattttgatctattgtagtcgcctaatcttgcttctcttgctgaataaatagcgctatccgctgtaccgtaccaagagtgacctacagcgtttgataggcaaaagagttaaggacagactgggtttcaatcaaaataaatgccaaaaggatttgactttatatttgataatgctcactctaaacggaaggcacatgcatcgcataattgga

SEQ ID NO: 11399 - DNA, 474 bp, Saccharomyces cerevisiae
tctaagatccgcatttatcgcggcttacggctttcggatatttcgtatattgcaaggagcaaaaaagaaaccctgcttactaaaaagctattgttttgcagtttataagttcttgccttttgaattattgatctttcctttatcgtttatttagtttcctattgtaacttggaactgtattatataatagtgcacagcactgaagttgtaactactgtacgtcatgcttttcagaaacatagaagtgggcaggcaggcagctaagctattaacgagaacctcgagtcgtttggcctggcaaagtattggggcctcaaggaatatttctaccatcagacaacaaatcagaaagactcaactatataattttaagaaaactgtgagcatccgtccattttctctctcctcccctgtttttaaaccacatgttgcttcagaatcaaaccctatagaatcacgtttgaagacctcgaa

SEQ ID NO: 11400 - DNA, 447 bp, Saccharomyces cerevisiae
tttgttatcactcctatcgacgagcagccgcagctaaaagaacgttttaattattcccaaattcacgtaagcgatcctctttatgtgctatatatacattcataacatagtcattgcattttctatcatacgattcaacttgaacaagtgtttaaccatttacgtcgtaaatgtctacagtattatctttggtcgttgttgtggattcatgcttttttcttttcgagagctcttcgttttcagaactcagctcttccttttcggacgactcccttcgactattctccgtacttgctggttcgtagttaaaaaagcattccccccacatgcaaaatattcctttcatatatccattctcctttacatataatactttacatttggcaaatggacctagtactttcctcgtagctcgagaaagctggttcaaatcagagttccttggca

SEQ ID NO: 11401 - DNA, 458 bp, Saccharomyces cerevisiae
ccggctatatcaatgcacctaaattcagaacagattatggacgtttcattggctgaaaatagttaattcatcatcataacttaaaatactttacagcgccaggacaaaaatactgttattcgtgtatgtcaaaatgtggttctcaattttctacaatgtagcgcttttataactttgctataattcactttgagtcaccacgtagcaattctttacatacctattggtttctctgaagggccatccatatacgaaagtgttgcttcagagttttggttcgaaaatcaacaagtatttaatgtgttgaagtatcgcgacgttccttccttttgggcaataacggtagaactggccgtccagcatcgaatggatacaatagaaggaaaatttggcaattcagaacagtagatatttatctaagacgacccaacagctaggacgctgcaagaagaatcgtt

SEQ ID NO: 11402 - DNA, 467 bp, Saccharomyces cerevisiae
aaactcgccctctctttcatgcaggacatatgtatatatagcattttttggttaccatactgtagactaggatttttttgcagtcatgtgaattttccgacttcaccttcaacaaagaaaaatcgcatttacaatgactaagacttcacgcatttgcgctgatctcctttaagcttgaatgacattgaaatgttacgtcgataccgataatattttgggctctcggttttgatttaaacccaggaagcgtagctctcaccttactaaggctcacatcatgtcatttatagtgtcattttggccctaactatattccacctttcttccatataatagtttcaaccttaacctcaaaatgtatcatttaatttttctcatactctatcatatttgttatataaacgtacaaagattgtaatgttaactatgctaaagtacaattattcacagcatactacaccgcgcta

SEQ ID NO: 11403 - DNA, 438 bp, Saccharomyces cerevisiae
agtaaggcatgtgttctttaactattcgaccgtaatcttgctttcgtcatcatctatgggatgtcgacctctgaagctaaactatcagtaatcggtgagaatcaggagtttatgatggaaacggcatgaattctatttgaacatatgacaaaataaagtgtttgcacccatttacagactgcattatattaataattaagccttatatttgtgtcattaatattataaaaaagacgactatgtaaatacgctgccaaagatttgctgagaataaaaatgttgacatattacagtaaagtcatcattctaaagtaagggcacatagcgcttaaatagtgttttccatagaaaagtataagatcgacaacagctgttttactcgatctgcttaaacggattttacactatggcagttagtacaacgatgcatttgagcat

SEQ ID NO: 11404 - DNA, 463 bp, Saccharomyces cerevisiae
tacacatggtggtatgcattttaaacatggttttcttttatccaattttttagcatttttctacataatacattcgtgaatacatacatcatatcatagcacatactttttcccactttatattataacacatcatcaagtaaatccaattgaggctcttcaatatctatactaactatatcccctgcttgcgtcctcgcatccggcttggcagactgtttttcgtcctctttatcacctagtagccccaattttcgtaggacattattcgtccttatatcgatatatcgtgttctgaaatccttattattttgcttcccgttggtcttcaatctctgcagtagtgcctctacctcctctgttgaactggtactttcactatcaacatatagtttacgtaatgaatcagtcagtagagtcattgtgtcatctataggttttaacgactccaaaattttctgca

SEQ ID NO: 11405 - DNA, 416 bp, Saccharomyces cerevisiae
tcattagactaaaagtgattatatatcaagaaacgacatatacgcgtccatgcatgcacatatatatatatagtaaagcgcctgtaaataaaagctctcaaagttaacagataaatgaagtgaactatcttaatcactctttgaggatacacttgaagagtcgtcaaaatcttcgtcacggttgacattcaagtaatccttatcattcacggaggcatcagatatgactgcatcagaatcaggctgtaacttttgttgtaaattctcaacttcaagacgtaatctatcaacttctttttcgaaattcttcccgtagtggtcgatatagtaggtagccccattatgagacgcccatagaaatactatagttaaaaatagggccgcagctaatttgtaacgaatccatatgccacaca

SEQ ID NO: 11406 - DNA, 409 bp, Saccharomyces cerevisiae
aatctcaattcgcaatgattctcacgaactctattaattcaatttttttctttttgattcctatggctcctagaacgtttgcattccttttttttttgttctagtaggtatttcacgtcacgtttctggcaatccacttctcagcatgcgtggaatatactttaacatatccaacgaatttgctgcatattcttatgtaatagatagccgttcctaatgtgtaatggcctgctttgttatagaaatcatatataagtagtgattgagccgtaaaatcatctcatatgcccaatggaaaaccagtcatagtattatgaagcattcgcattattatatacctccatcttcccctgttattctgtctttgtatttaaaatcatttttacgaatagtgcggttgtcttggttg

SEQ ID NO: 11407 - DNA, 483 bp, Saccharomyces cerevisiae
cgttagatcgaaattctttctcaaaaaaaaaaaaaaataaattcatatggataagcacaatggtataaagcattatagaaggctcatagatacacaggtcaataacctacaatggttaatatcttagcagtaattgtatagtaattttatttaagaaatatctctttaagaagaaaaagaggtgcggactcattattaagtcctgacaaggagaaaataagggcatccctagacagttattattcactaaaaactggaaaaaactaaaaattttttgaagcccgtatggcttattatgcgaattctgtggatcgaacacaggacctccagataacttgaccgaagttttttcttcagtctggcgctctcccaactgagctaaatccgcatatattttataggaaaatcatcaacacgtacaaaccacataaagcgtaaggataaaatcaaataacgtttgaactgacactaatcgggccaaat

SEQ ID NO: 11408 - DNA, 480 bp, Saccharomyces cerevisiae
acacgagattatcctagtcggaaagaaaagtgaaagaggttaagaaaaaattcatggtaaaagaagcgcacaaaggcattgtacatcaacatcataatttataatgtcattctgcatatatggtagctccattatattacaacaacataactacttctattcaaaatgttaacttgaatcctagtactttttaaatatatatactcaaaaaaaaaaaactcaagcaagactatcaagcgtttgttttatatcccaagcgcgatgcgaaataacgtgagcgtcaccattgactctcctcatatactcagacgaaagttcgacgccaattgagttcttaatcaattgtttcaagctgtccatcccgaagaacttatttcctaatggacgaaatttaccatccttcaaaacgttgactttcgtcaaaaactcagtcaaatccttctcaaacagttcaggtgtcgtggtatttagtaccggcaa

SEQ ID NO: 11409 - DNA, 433 bp, Saccharomyces cerevisiae
actccagcattataaagcatatctaacaataccattcgggttatactgaatagcccacgcacgggttcggggttgtaacgattatatgcatttcataacatgccactgtcagtggcgccacggaaggatagcgggactttatcaaatcattaatttctgtgcataaagtgtatagtatattcatatagatatgtatatatatcattgaatacagaaatcttcgggtgtatacaacgaacattcatcggacgccttttttactgctattgttcaacaaagtgggtaacccggcattcttgcgccaaagtttccatttttatgccaaatccagaggataaaagcactattctcatcaaaagatggaaaagctgtgaaagagtcaagttcagaagaaagcgttaagaaaaatagagtacacgggagcgttatgtca

SEQ ID NO: 11410 - DNA, 446 bp, Saccharomyces cerevisiae
ctgtgctttatctcaagaactgtctatccatcctttttacaattctacacacaaaattatataaccttgaagtaggtgaacatcacaggatgctggaatcgcaccaaagcactacatttgggggtaaggtttttcattacaaatcattccatccaaataaccaattattcaatctatttaaccaacttttcttactcttgctcgcttgttcccttttcttcaagtcagactcgatcgagctcaggacaccactgtggatcttccctctgtttctcaaaaataatgaacgaccatcctttatttcaagcctgcgtggatttttgaaggaagtagaattcttggaaaccttgaattctgcattgcgcacttttgaagtaactgcttttgccttagctttctcaaaaattccttctgtttttctataattgctgaggtcttttgagctt

SEQ ID NO: 11411 - DNA, 469 bp, Saccharomyces cerevisiae
aatctggagtagtgataataacatatgcatatgtatcaactagtgaattctatttaattataaaccgctgctgcggtttgtgggcgtactgtcagccaagctttcgttataatatatattcttttcaacatgtacatagctagaactctagaaagcacagattaataccgattctaatacagattttaatgacctcaatagttaattgatatttgataaaatattataaaaatcgtctataacagaacgcgaaaagaaaagacgcgtctctcttaataatcattatgcgataaaatgtttcaccacatcgaaaacttattaattgagacagaaaaaaggtgtaagcaaaaggaacagaggtatatccctgtgaaatatttatttagcatgacacaaattcatcagataaacgatatagatgttcatcgaattacatctggacaagttatcaccgacttaacaactgcag

SEQ ID NO: 11412 - DNA, 432 bp, Saccharomyces cerevisiae
gcgggcctgatgtcttgtttttcctctccaacttcgatttttcgatttttccgtttctttacctagcatatatatacacacatctatctacatataaatatatatatatgtatatttattatttatagcattgcgcgtgagacaaaagcgagatcttttcgtcccactccgcattgatcaaggaccgtttatattccacagactctatctcgctgggagagcaccatcctatagtacgaaagtttgtaataactcgagcgtactgagcgtcttccagttgttgttggcggcgtaaagactgcgcggctgcagatgtgacgataaatctctcggaatctgggcggctagcgggacatactgaatgcgtatgtttgtctctgggcatactgttccttcgaaagaaaatactcgaggctttggcaagaaaactga

SEQ ID NO: 11413 - DNA, 494 bp, Saccharomyces cerevisiae
tgatcgtcagcacattaggcctaatataaaatgtacgattaaaatgacagttatttgaatcattttagctgatcacagggatatagaaggtattggtagtaataataataatgataataataataatgataataataaataataaataataaagcgatagataatgctcattgattatagatgtataagcaaccgtcttggccaaatagtccaaaaacgccaactagaggcatccatccttcacctcctccaaacctttcagctaaatgcaaagctttctctaaacgatcggactctactggtttacctatgctaaaaccacgaatacataacataccctgcttcttctctatgttcaaatgagggtttgtttccgtttctaccatttttccttctaatgttgtacttagtgttccataacatacaacgttatcgtccacagattttccaaaaaccctatagtcataaaaattggtatgtgccacaggtcccat

SEQ ID NO: 11414 - DNA, 449 bp, Saccharomyces cerevisiae
ttcttattttcaaggttttaaagttgtattccgagtgtattatatagttgtttcccttccggaagttgtgtaatatatagttttgaatatatataatggtgttaaatagaaatgccaaatagtacgtagtaatattatttaaattgcatgcgtttttttcgttttaaaaagagattttagtgtgaaatgcagtcaaaaggtacttttgtctgttttatagtacttgtacatcagacaaggatgaattaatcttttttaaagcggtctcctagtctccttctgaacccaaaagtagatctcatttcatcccaaaataaaagccttaaagccttaaatttctgtcgtggagttggcttataaagatattgaaaagcagttgattggtcagtgaaaggatcttctttaataccatttactttcctatataccttgcgtacaaatctatggaa

SEQ ID NO: 11415 - DNA, 481 bp, Saccharomyces cerevisiae
aaaagaacagtaagaaagaagacaaaatttaacaaaacatattcagctcaaacgcaaaacatgaatcaatttatacatacgcgatacgttgtcgataaagcactttacatttttccctatgataatctgagattgacaggggaagaagaaaataactaagtgtcgaagaaaaatttagaaaaattaattcatcatcccattttacttctcgcagtacaccgtacgaaagaagaaggtaaagaattgagaaaaaaagtgtatatcattacattactttacaccaccttataaccacaaacgtgtatattaagaaagttttttaaaaagaaagaaataagaaaaccaaatccgtcccactaatagtttctaagttactgtactttttttttttgaatatatatcaccatacatatgtatataaatatatatttgtgtgtgtgtgtttatatctatatctctttgcatctaattcctcattacc

SEQ ID NO: 11416 - DNA, 422 bp, Saccharomyces cerevisiae
aggcctctcacacttgcaaaataaaaaatggattcgttcattgcattttacacaaaaaaccataaaaaattgaaaaacctaataattaaaaaaattaaaagttaatcatcctccagcaaagctgttttttttttgtttttttttttttttttgtttttttatccatttttttcatttgttccatcagtttaatacgaaagagaaaataaaaataaaaactttgaacaattttcatgttttgaattcattgtacattatcatcataagcaataagatacaaatatttatgtttttttttttttgtttttttttttttttaagatataaaaatactagcctcttctcacttcgttttctctctgtctaagtggctaccatcatgagatatgatattctttcttctccctgcgcaattcttaaac

SEQ ID NO: 11417 - DNA, 439 bp, Saccharomyces cerevisiae
attgctgatattgccgtaattttccatgcccttttcactctctcagaacgcaaagcggctccggctcccaagtatatagaaataagcatatagaatgaaatgtatcttttgtaaaatatctaaaaaaaaaatagtacatgtattttagtctttttggtacattaaaaaagttttcattgtcacgtatctgcaatggcattcttcacaaagcatgttagatgcggggggaggggaatgattatggacaagaagaccaatattattatttattcttcaatggaatcggaaatagaatgaagaattatgactccctgatatgcgaatagtttgaacctaaaacgcgccaggactgtttaaaaataacaaaatcgaacattgttagaatgaaactctaacatgttatctatttagtagtatgaacggaaggataaataatcga

SEQ ID NO: 11418 - DNA, 437 bp, Saccharomyces cerevisiae
tgtttatttaaattatattttggggtctgaatttggagtttttaagcgtaaatatatagtaacaataccaacaataatactaataatactataatagtagttgcagtaacaatgacaagataaagaatattcttctgaaatgtctaaagaacgaagaaaaaagcaagtactcattggaatgctatgtgtaacaactcatacatactctagagctttataataattacatagacatttttataatattatttatttatcaaattttatattgaataggtaccatcaagttatgcacacattcttcattaaaatacagtctgtaaataattgtgaatatgggcgacctgaatgatgttcttattatctcaaatatttctaattttttttaatcatttttgtttctttaagagcaattaatttacagagcggggaacagt

SEQ ID NO: 11419 - DNA, 436 bp, Saccharomyces cerevisiae
gtaatacttcgtagtcaaagtgtgcttcgtagtggtgtgaggatgttataaagcgccaaaatttagaagatcataatttggcagtaaccgtagattattcaccaaaaagctcttgacttcctcttttaatagactgtcgttaaaaggtccttagtccagaatagtatataaaaagtgttgtatggtagtggtataccaattttgctatgagtaaaaaattatcgttggaagagagactctccttggcaactaagaaaggaagaaagaaaaataaaaggtcaacgtcaaatttgtcgtctccatcgcctgtggtgctgtcaaacaatgaacaagaaagtgctcgtacatccattgatgatgcggctgccggtgtggtgtcaattgacaatgctgaaaacatagatgatcctgcggtacgatcagaaagcactgtgga

SEQ ID NO: 11420 - DNA, 434 bp, Saccharomyces cerevisiae
aggaaatggaacaacgaatttccagccaaaaattccgagtagttcatgatgaaagatttttacatgcattttatatataaatatataccgtcctatatggatttcatgccaacagggtatataatagacaattaccggtgtactgatatatcaactatcgactccaagccttttatctatcagtcaattttacatcaagatcccacttttagataggttcgaaaattcaatctaatattagtgatttaattagatggtggattgcttacccttttttttgtcgttttaggaggagattcttcggattttagggataaacggatactccatatataaaaaacaaaacttcaggcatattgattatctaaaaggaatattctaaaaccatagccatagtaatttatcaccaacatgtcaaacgacggctcaaaaat

SEQ ID NO: 11421 - DNA, 462 bp, Saccharomyces cerevisiae
aacgggctatccatattacatctgaaccaaaaaaaacttttctttgctgtttactttaaatcttgcttaatgtgaagatttttttctgtttgccctttcactaggagatttttaacctaattttaccagccgattcgttagtaggaatgcatttttccaaaatcaggaatttttacgtcatcccgctctcctttgagatccgggcaaacttcttattttagccactcgagaatttttttctttattataaaaaaagtaattatgcctccgcactaatcttaaaaagctttttaacgtaagtggtatactgcagaccaggaccattgttttacttcattgcctgaaatagtatctaggttagatattgatttttcttacacttcaataaaacaattgcattcgttatacatttttttctttccaaacatttgctataaaaaattttttgatccctcgccatac

SEQ ID NO: 11422 - DNA, 488 bp, Saccharomyces cerevisiae
gcgtttggttaaatacccgggcgctggaatggtctaagaagaaaacctacagtcgatcaaaaatcccgtacgatattaaatagagtagttaacgtacttgagcgttataaactcacattttcactcaagaagaaaatggagaatggagacatggtaagtgaaagcattaaggaagaaacacagttagcacgtatttcatcgaaagtgtttgattactttctatttggcatttaaatatacatgggaacataactagataaaatatacgccatatatagtacagctagtattttcagatgtcataaaatataattaacgagtaaaaattactttttttgggatgggggtagggtttcttcttctaggacaaccaacaaatctgatgcgtcaacactttcaccatccttaatgaaaacgtctttaacttgaccatctgctggtgaagagacaaccatttccattttcatggcactcaaaacagcaatcga

SEQ ID NO: 11423 - DNA, 495 bp, Saccharomyces cerevisiae
tgaaaaaggtacttactgcactgtaaatattaacttaagtattatatcgtattttctgcaagaggactaggaatatagtttcttttgttactaataaaaatgcatatttttcataggaaatttcctggtatgaaaccattgctttcattatcaacgatgacttgtttgtacacgctatagtctataataaagtctgagggagattgttcatgttttttttttttttccattttggtaaccactaactacagccaatttttcggcggcttcatagcccagcaaaatctttattcatcatttcccgtaaagtatgatattcccatgttacatttcctgtactcttggcattttcatcgctaacactaattgttctcttgatccgttcaattttctttgggtcgtctactttaatacggattctcttcaattcattcacatttgatgtgtgtcctatactcatcccgactttgactaacgtttcaatgcgttctgaag

SEQ ID NO: 11424 - DNA, 491 bp, Saccharomyces cerevisiae
tagcactttcatgcctgactacgtcaactattggaggcggtttataatttttatttaaagcacataggagttaattttattttactggtagggtttgtatacgaactacatggaaatgtggatggtgtgttattatagcttaatgaatattctttttctatacaagaaaaccgatatgacagctatgaatgagcagtatgccaacaaaaccaggaatgattttaagggtgaagaatctatcgtgaccatagacatattgactaaaccagtagagacatttgccaacaaaaataaaaacaacccattggagttgattgattccaagcattcggcaactttataatattccgaagaattaccgaaaattttgtcagtcaagcagtacccagtcaaaaatagtaaattataagtaatgacccacaaagtatatggtaagttagcaaaccttcttgaaacactataaggatggtattgaaaaaccaactggctga

SEQ ID NO: 11425 - DNA, 486 bp, Saccharomyces cerevisiae
taattgtgccgccgttccaatttttttttaaattgttcaagaattacttcaatttttactactggacaaaaagcattatgataaggagtagtctcccagtatcgtagaaccaatttgaaacactttagccaatatttattaattttttttacttcccatggcatagtactttgtaggaagattatttgttcatttactacatttattacatctatatttatatattctataccattcatttttttttatgttaagcttctcttgggaattgttggggtatgaatgttagcagaatgacccaactctttttctagcataactcctaattttttatcttcttcagaaacgtcacgaattaaactgtccttttcatcaccagaatagtattttacgtccacttgggaagccaaagagtgctctgtttcctgtaacgagtcgacagtagcttcgtcgattaaaacgtatgctatgttagaacccgggcaa

SEQ ID NO: 11426 - DNA, 461 bp, Saccharomyces cerevisiae
caggctttatgacgttttactgttctcttttcattgttcttttctcgaagagtttagaaaaattttttttcttctcatccacaccgaaaaaatattaataagagagttgaaaattcgatttggaatcagaaataaagaaggggccacgatcaaacaagactcatttcgaataattgtaaaaaaaaattagcacaaaacaatatgaccgttcccaggaatcgtcccatggcaccatttggcaccattatcaaatcaagaataaaacaaccccagttttattggtttataggccattttttaaccatctttaactttatacaatttcatctttcaatcacgtccaaacaaaaccaattgtcatgctatagaagatcattattttacatatccgttacatatgccatcgttctttaccagtttttcaaaagtgaccagttaaagttcaattttacgcttttgcg

SEQ ID NO: 11427 - DNA, 460 bp, Saccharomyces cerevisiae
ttaatgatactcaatatggaaagccgtatgatgggaaactatcacgtacggtttgggaaaggctctttaacacgtggcaacataggttaatttgctatttcatttttagtagttggtcatgctgtattaatgattttctgtgcgccgtttcgcttaatttatcactgtattgaagtgttaattgataaacatatctctgtttattcaattaatgaaaactttaccgtatcattttggttctgattattagtagtaacatacatagtatttagatacgtaaaccatatggcttacccagttggggccaactcaacggggacaatagcatgccataaaagcgctggagtaaaacagccagcgcaaggtaagaactgtccgatggctaggttaacgaattcctgtaaagaatgtttagggttctcattaactccttcccacttggggattgtgattcatgctt

SEQ ID NO: 11428 - DNA, 437 bp, Saccharomyces cerevisiae
ggtagacagagaaacgaaagaagtaaataaatgtcattatatgtgatgcggcgttttggagctgaacagaacgccctcttttttttttttaatgattaattgagaaaaatagtgtgcacatctaattttgcatgtgggattggttttcatacaattcgacgatctggtcagaagaggttgcatcttctacgcccttgtcttctcttatacgcaaaaatcttggaaatcttaaggatacgcctttatcaaaagttgcactacctgctttataaataggcgatagggaaaggtctgcagtcaaaacttcaaacaaagtcgtaggttcgaaccatacatctggctcagcactcgaatcgaaaacaaacgtggcttttggtccatcaatgatcgtcggggtcaacctgtcgtgcaaaagctgcaacatttcgtccgaaaat

SEQ ID NO: 11429 - DNA, 434 bp, Saccharomyces cerevisiae
ataacattaaaaaatagaaaaagaattatggattaatcttatagatatttttatagaaaaacaaacactaacaataataataataataaatagaatatagaaatacatatttttcataatagtttgatgaagttttattcataaatcattttttatcgccagtgctaaaaaattaagtgtgtggatgactgtatatatgcgtatcgaacgatcttgatgcaaatcattttgaaacattattcttgactttgatatttcctattatacatcctccttccttgagacccaataatcttaaaaatgatggagacagtgcatgccctccttttcacccttcttttatgtcgtttcttacaattttcgagattcttttgaatctgatctccttttaccttgtgactgaagattcctaatcgaattgctcctctctagcg

SEQ ID NO: 11430 - DNA, 444 bp, Saccharomyces cerevisiae
ttgtaaggctagaggaaaacgtatttgtctccatcagcacacctacacatacatatatagatagatatatactttagccattgagataagtagaataaaaaaacgttgtaatattccgatacagttagtgacatgttctctacttttgccaattttttgcgcacaaagtggtgacgtacaagttcatcatttcacgtgtgcagcatagtgtggtatattgtttttttatattttattttttatttttttttttttgcagaaaacagtgtttgtattatatgctttagatatgctaaaaaaaatgaaaaaaaatggaacaaaatatgtgtttttttatttaacgttaaaattaaagattaagttatttattcgacgtcagcatcaaaagtttgaccttcaactaactctggaatagcttcatccttcttttcagcatcagctgga

SEQ ID NO: 11431 - DNA, 429 bp, Saccharomyces cerevisiae
aaaacaaacgaatatagtttgaacactcattccatgttctatgcttattgttgtacatttattatttatatattcttaaatatatttcgagagatctatacataaacatcaatttattataattctacacaaaattacatttaaatattaatggctttcttcaaaattcaaaaatctttttgagaaaattcatactccttcagatattggtttcttatcaacgcttcaatttttttctcttgaatatatataatatcagtatcggttaaagctttagaataatccgtctccatacatgatgttttctcgaatgtaaattctgtctcttcccaatccaacatatattcataatcaaagcagtttgtaaataaataaccgtcgaaccccacaaaaattggtaatctttcaagccagctttcaactttttcg

SEQ ID NO: 11432 - DNA, 474 bp, Saccharomyces cerevisiae
aatatacgaactctaaggaaaaatacgtagcataataacgcatataactaacaatttggataactatccataaaaaaaaaaaaatagtcacataatacgaacattaatatccttttttgttacattttcttccatctgaaatatttggaggggcaaaaacaatgagatgacagttgaatgcatgaacttccgatcgcgggcgtataggtaaagtcaattgaagcaagtgtgacgacataagtatcgtaatttagtggttggatacattaaaaaaaacaagtggtatatatataagtagtagtagtaagaagtaagcgatgtctagggctaagagaattatgaaagaaatccaagctgtgaaggatgatcctgcagctcacattactcttgaatttgtgagtgaatctgatatccaccatttaaaaggcacatttttgggcccacctggaacaccttacgagggtggcaaatttg

SEQ ID NO: 11433 - DNA, 407 bp, Saccharomyces cerevisiae
ataatagtacatacaggtgcgccgaccagcgcctattcataaaaacaagaataatgtgtctctttgagtcatgttccttagcttcttttttaaaaaaactgtctcaggtattttcgcttctttgatctcccaatctccatatcccaaccacgttcatatacctcaagccgatttcaaccaaacttgaacgaaaaactcagacaggtctggtaaaatatctgcaatgaagtacgcacaactcaattggtattaattaatatagaacatattaaatgtagaggagagaaaattaaattacatgggaaaccaatcttgaaggtccaataaagtgagatgtgcatggatgaattatccatgcaaaagcaaaaacgaaaaagtcgcaacctcaatcatgccttttctctcca

SEQ ID NO: 11434 - DNA, 483 bp, Saccharomyces cerevisiae
atatactccaatttcaaagacaaaccaaaaaaccaaaaaaaaaaaaaagtatgcatacataattctgatgttctagttatacatattatatataagtaatgataataacactaatagtaaagtaaacgcacggatatcaagagttaatatacttgaaccacttaaataacaatctgttggtaaagctttcttcctattgattatgggttcgaatagtaccagatgttttgccaatcctaaatcggtaggaaagtggcttgtcgtcgtcaggcttattatcaactcttatgcacaagaaaggtactcatcttctataaactacataagacctgaatctaatcaaagggagaaagcgcagaacatcagatttaaagcggttttgcttgatacactcagccttgtctctttgtaaggattttggggtacctatgaataatacatctagtagtgttagtaaaccaacgtatgggattttgggataca

SEQ ID NO: 11435 - DNA, 476 bp, Saccharomyces cerevisiae
actgcaagcaaaacaacagcaaacgcggcatattcagcgtcttagcgaagcttgccattgaaaagaacagttcgtaacaacagctggaagaatagtactggaaattttcaattacttttgcaaaacaagcacttttttgtttcacttccattagccgcaagaaatacactttttttaggggcgggaattttcatcgccagatcgagaatcacaaggcctttacgtactatagtttgtaatttatacaaaatcagctactgttattttggtgtaccagcggcaaaaattggtgaggatctgaaaattaattagaggtgaacacatatcagtaattttgactatggacgagaatgaatttgataatcaaagggagaataaagctgtagctcgagtgatcatatcatttcttaagtatgaagagtatgccctaaaggaaatctacaatttgagagtgaaaaaatgggcatcgatctcag

SEQ ID NO: 11436 - DNA, 480 bp, Saccharomyces cerevisiae
agcaaagagtgagtttattacaactctgatactgcagcagttcaaatttaccactttcctcttcaaggtgcatagaaaaaaagttcctggatgcacgatttaaaatgtttacagcagagcaacaatcatgtgaacaatgtcaaacatttattttaacacttaataattataatataaccacaccagcggtaagtttcataaggaaaacctttcagacaaacattccagtgaatcgtatacgtaaatcagcaaaattagcttataaaatacagaatccgaagatacttgatctactcgcgttactattaatgcgggtaatgatctatattgaattttgcacgtctatagtaacttaaaagtcttgtaatatttgaagtaacaatgccgtataatactgcataatagccctatcaatcggaatataccaaaacatcctttatgtcctgttctcaaaataagacttctgtcagtctggcctgg

SEQ ID NO: 11437 - DNA, 500 bp, Saccharomyces cerevisiae
gtaagaagtactccccatcggatatttcctattgtgtttctgtgatttttagtccttttttcttttctcttactttcggtatccttacttgattacatacataaacaagcccctcttttcttccaaactcttgtagcttactatctgtggcccgtcatttgagtttgatttttttgccaattactatattgcaaaataaaggacagttactaggagagaaaataagggacatagagaacaaaataaaatatgagcagtagcaagaaattggccggtcttagggacaatttcagtttgctcggcgaaaagaataagatcttggtcgccaatagaggtgaaattccgattagaatttttagatctgctcatgagctgtctatgagaaccatcgccatatactcccatgaggaccgtctttcaatgcacaggttgaaggcggacgaagcgtatgttatcggggaggagggccagtatacacctgtgggtgcttacttggcaat

SEQ ID NO: 11438 - DNA, 487 bp, Saccharomyces cerevisiae
ctattcactcggaatgttacttgaaacaaattaaatggttacatggatgtgatttgttacttaattgttattacggatgatattattatgatagtaaaaatgacaataataaagaaacgattggggttacctgaaattgcaagtactagttcgaggacacatttgcatcatatggtagaaagagcggatcttaatatagttaattttttaaactgagactgcatttaaagaaatgagaaatctcagctgagttatttaatactttgcgtgcatcattattatactacaaggccatataatcgactaccgcatagcctttcgtatctctttttattatttattttatcatctaagcaaaatatactagtatgacaacaatgtactaaagtaacattagacgtataatttccttttgcgttatttagaaataatgttatgtagcccctcactgattttcccgtttgtatctatccaattcggccttcaa

SEQ ID NO: 11439 - DNA, 425 bp, Saccharomyces cerevisiae
tatatagtctttttgccctggtgttccttaataatttctatatttttgcataataaaccattgtattatatacattcgattttgtgtgtatatacgtaagtacatgattttgtttctcctcgtgctgtcaattatacactcattttcatttgaattcttggatgaggattataatcttcaatttcaaagtctgtcaacttgaaatcatcaatgtctttaacgtcccttttaatctttagtttcgggaatggtcttggatttctggtgatttgttctttcaaggcatcaatgtggtctttataaacatgtgcatcccccaaagtatgaatgaactcacctggctccatgtcgacaactttagcaatcattctagtcaacaaagcatatgatgcaatgttaaatggtactcccaaccccatatcaca

SEQ ID NO: 11440 - DNA, 448 bp, Saccharomyces cerevisiae
acctcttgcagcacgaatcgtaacggacccagcgcgtactttattctccctgtgcattcgtggaagttttgaaactcttaaaagtgggctcatctgtctggtattatctgtgcccctgttctacatgtactcgtgctttctttattgcttctttcggtaactcatcttgcacatgctattcttttcggagttaacgaagccaggaggaaccttaatggatttacctctagcgcgtcaaccctagaagagggactttttccacatgaatagtcaacttttaagattcgttagtagttgtatagggacatatatatgcacatatatataattatatacttatacacttgcttacaggggacatttttgaccctcaaaggaagtgaattacaggtattgaataacagaaatgtacgagatgtcaggtatagacagcctctttcatgatcga

SEQ ID NO: 11441 - DNA, 469 bp, Saccharomyces cerevisiae
ttgaaaatttataccgctttaccatatttttggatattcttcaaagcagaatttgtacaattagcatttttctttatggtttagatcggcggtgagggcgcaacagatttatgtatacatattgaaataataaaatttaaaaaagaaaaaatcttggtaaacattaaaaatcttaattctatttaaatattagtattacaataacagcatgtttctcttgtcattagctgagccttggaggtggtctttttcttgtaggagacatcgaattcttcctcgaattaaaattggaattcgaagtagtcggtagaggtggtagttttggagaattcaggcctgatggatgaggatgtgagttaggcgaagaggaatctaggcgtgagggtctatctcttcttactaacggcgtattgcgcgaacttgaataattggacatatcatctctggtcggtataggaggtaagggcgg

SEQ ID NO: 11442 - DNA, 477 bp, Saccharomyces cerevisiae
attgtgttactaaaattacgcatttatagaatatgtatcataactgttgtttagatgtttatatgactctgcacacatttcggttttgtgagcgccgacctttcaaaccatgatctgtattactatggctgttatgaaaataccgttgttccgggtgcagtgatcctaacttccgttaatggcttcttgttttaccaagttttccagtttctgcttcaattcgtcaatttccttgtcaaccttttctatgccgatctctattctgtcaatttcttcctgttctaattgcttggagtatacacaatcatcagttttgtttgaaggtaacaaatttcctggtcggctcattaaaattttgaaaaactcttcatttggctcattgaatacaatttcatcaaaatacacagaactaacttctgcatctttactattatggtctgttgtattctgctcatttccattgtcggaattcggtac

SEQ ID NO: 11443 - DNA, 493 bp, Saccharomyces cerevisiae
actgggatagtcccccatttttttttatgttcgcccatggtattccagtggccctttttctccacaatttttgtatccaattttcctccaccacttgtctatatccaaaggtttaatagtaaggaaaaataaatacacatgtatatttatataattatggttatcatttactagcattactctctttttctccactcttcagtatattgctctgctcgattagatattcacctaaaacacgtaacggatcttctggttgttgtacggctatgagcctcatgcccgctaataaatgcggtgtcacatttgtattcaggtattttctagtttgtgaaccacctaccgtcgcggcaaggttcacattttctaattttgatattttaggttcagatgactcttcaatgactgaatttgtgctactcgattcttctatttttacattttggttggtgacacttttgatgtttttcaaatctttcgttgcagaagatgg

SEQ ID NO: 11444 - DNA, 426 bp, Saccharomyces cerevisiae
cctattccaaatagacaattatatggcttcagcaactaaaacgtcctgataatattgcttttccaaaatttctaaatgattcacgggcgccaggttttgttgataagaagaacgaagtacctttaatatcttatgatcggaaaataccgactgatgacttttgagacttcgcttttgatcaaagtgataacattatgtacaatattcatactaggatttcttgatagagatttggaagtctataaaaaagaaacaacttgttataatttatttttgtagacatgactcacagaatattacataccttcataatatataagatccatgtgataatgaatgctggaagcatgatctctgacctcagctgattgttcaggggacttaatcaattagatgcgtttaaagcaggaattggtttgatacaca

SEQ ID NO: 11445 - DNA, 478 bp, Saccharomyces cerevisiae
aggtgctagcctacacagaaaaccaaaatctcacttccttactttatcatctattttatagaaaaatcaggcattcattattcatataacggttatctcatatatattatcacacggtatcagttttgtaggctgtaataattaattcatttataaattttttctcccataattggaaaattatctttaaagtgaggaataatgcattttctttctttttttgaatacataaaagaaataaagaagtatgtctatcgatgatatttaagatgcagggggttagctggctataattttgatctatgtttcaacgtttttgtttacaccagtcaaaaaccttgaaataaaccatgccatgtttaggctttttgtatttaagtctcaaggaatctagattcgtatcaggtacagcaatatcttcaactagttcactgataaaatccttaaacgctggatctgattcaatatcaatgccgcc

SEQ ID NO: 11446 - DNA, 430 bp, Saccharomyces cerevisiae
taactggcatgcagtctaaatatttgcaaagtatgtctgaaggactaatgataggtgggtcaggatatcagcttaatcctcacccatgaagaagaagatatgtcaaaagccatattcagtaattggtctatttgtctccgttgtccacgctttcatagccatagaggaaaaggcgtagaaagttctatataacagagtatttagtattatattcccgaggttttaggaaagaaagaagaagaaagagaaggaggaaaatgggaagaaacttaagattgaaagtgtgagaaaaatgaatggccctctctttatatagtgttcaaaaaattgaacagcgatttattgtcatcacagacgttgagtctctctcttttcctattaaaattaatcttagcaagtaagggcttggagggaagatagcgttgagctg

SEQ ID NO: 11447 - DNA, 454 bp, Saccharomyces cerevisiae
ggaggttcagtgggataattgtaattgaaaaaaaaaaaaaatcaataaaagtaaaaacaagaacaagaaaaagcacaaacaaacctggttatagattcttggtgagtctaacagggccatgataaaaaagtgacacatgcatatatgtacatgtatatatctacgtacgtctattcaatagaggtgtatacagataaataaaggagcattcatatacgccatattgtgactacatttgcgtcctcagaagactgggacgttcaaagtgatctaggacttttcacccagggaaaacaggatatctgtaagaatcggccataaaactcattaatagaagaacagtataacataagtgagcctgctacaataagaagatgtctaaggttgcacaacagttaaaatttttgaataaaattagcgccactaccagactaccgcagattctagtcgatcc

SEQ ID NO: 11448 - DNA, 433 bp, Saccharomyces cerevisiae
aacactcattaaagtgtgggctgtgggtgtctccacaaaatgagtaatgaaaaatttttaattttttcaggagggaaattaaagaaaagtaaagaacatgataataaaaagcaagtttaagttattgtgtatgagatagagttttttttgtatacctttgtaatccgcatatattcctaagtaccttttttttcagacagaaaaaaagagtttctttacggaaattacttctttcgtttgatattgtttttctctttcgagatttaagaacgtggttgtgtttcgtgtttctgtgcagatcatattagaaagtttttttctccattttgatagacaaaacttgttgtttctactgaacacagcatataagccaagaaaatagttttccaaaaatgtctcaagtgcaaagtcctttgacagcaacgaactctgg

SEQ ID NO: 11449 - DNA, 453 bp, Saccharomyces cerevisiae
atgtgcacactatttttctcaattaatcattaaaaaaaaaaaagagggcgttctgttcagctccaaaacgccgcatcacatataatgacatttatttacttctttcgtttctctgtctaccttacataatagcattataaaacaataagaaatctctttggcacttttcccacctttgtgggtcaaaaaacacatatgatcccctttcacttaaaccatcagcggatacaataggttccatcataggatctttggtgagccaggccttcaacgtcttgtggtatctccagttccttttcctgagttccaaatacgttagttcctggatgactgtaccagggtgtttatagaagaggaaaaatagagtttcatcttgaaaaagggcaacacgctgttggtcattttggatggaattgaagcatggtggagttacagtggattgtaatacgcccg

SEQ ID NO: 11450 - DNA, 429 bp, Saccharomyces cerevisiae
caacagatgaccaagttcgttgcatccctctttatttcgtttttttagtttgatattatagtacttgtatatatacattttttcttctttacgtctaaagatttagttatacccactccgcttccacttgagctttttggaatgtgtagtcatttctattgatggtcaccacaccatctttcagactacatttccatctcgcctttgttcttgtgactttatcatataagcacagcattaagttctcatctggcccatcctcttcaccctccgaaattagatagtcatcgtcggaatcatctagttctgaaccgacctcatccgtatctaataatgcacttcttttttccttcttcgcttgtaattttacttgttctatctgctccttttccttgcgggttttttccacgtcctcctccttttcctcgt

SEQ ID NO: 11451 - DNA, 409 bp, Saccharomyces cerevisiae
tcgatgaattaaaacggtttccttttaaaacagaaataaagatgaggtgaaattttatatttcttatatttaaagctatcatatattccttgtacatatatttattaagaaaatacattaacacgcctttatacttggtattattactgtaaaatcattacatgtaatttgttctgacttcgttgattgtttgaattatatcctccacttgtacactctttaaatttttggccaaaaattcctgctcattcaaggaaagtctcaggaaattttcacataaatcaccatcaataactttacgtacaggggcataatagcttctgtattcttggtggtctctacctaaaatggaacaggaaccctcacatattatttcatcctctataccatgccgtccttgtaacacaac

SEQ ID NO: 11452 - DNA, 477 bp, Saccharomyces cerevisiae
taattttataacccagttctatattgctgggtggtattatagcttcatggctagtcaaataagtggagttttttgctctggacgtggcctgtaaagttctcttttgcgacggccccccgctttaaccgaggcgaaatgacaagtgctttctggcaaagaaggaatagccactacaacctgcggtctccacctttctccaccgataatctatttaaacactcacttgccaatcagcaaacgtcaatacatctacatatatacgtatagattttattgcactgtgatcaaaaagaatgtctcaaccggttcaacgcgctgcagcacgctcattccttcaaaaatacatcaataaagaaactttgaaatatattttcacaacacacttctggggtcccgtatcaaatttcggtatcccaattgctgctatatatgatctgaaaaaagaccctacactaatctctggcccaatgacttttg

SEQ ID NO: 11453 - DNA, 497 bp, Saccharomyces cerevisiae
acatgaagttagcaatcatctcttgtatattaaaaattcaaaaattcacttttttttattatctgtattcaatataatataatgtatataagatcacactaatactgataattctattcttgaaagaaagacaatagaacaataaagaagtgattgaactcagtgacaatgataatttatgtgataaggaagtggttatggctggagaattatgccacacttaaatgataagctcttttacctttctgggtttaggaattttttgagattaatacagataaaaaaaaataggccgaacattaattactcatacaactcaaaaagtgcagcgtgcaattctagatcaagaacatagataatataaacaaaataacaatgaacaaaattcagcaaatcaacgataaagaactacaaagtggaattcttagcccgcatcaatcatggcataatgaatataaggataatgcttatatatatatcggaaatctcaaccgaga

SEQ ID NO: 11454 - DNA, 416 bp, Saccharomyces cerevisiae
taatacttgaacaacaaaatgtttcaacacgacagataaaacgaagaagaaatactatatacaaatctgtacttgtgtgtatgcgtaacattgtaattttaattttgcattgagaaatctattttattcatctcttttagtgttagtaaacactcgcagatgccttgagctccgcaccgtaatttagtttaatttatttctcttagtgccgtctaaataataacgatctaaaaaaaagattccgggaaaaagaaactataccttatatttagttcatgcagttaaataaatgttgttaattaagggtaaaatatgatgatgtatttatgataagtaaagagtaggggtcacctaacatttttcacaattgcatttactcttttcacaagtgcacgtggtttcgcatttgcattttt

SEQ ID NO: 11455 - DNA, 440 bp, Saccharomyces cerevisiae
cgtccccatgttttcttttatttccgtcatcattgggagaccacgccgttttcttctcatacctgcatccattcaaaactatctcatttacccccaacggttttatggttcaaatcctaatagaatatgagcgagctaatgaagaatttgggcattttcattactgggaagacgtgtctttttcaagccatcatatcgccaaattttttttctacacctaatcatgattaaataaatccataaagttttatacagtttttaaaaatatcatcatttattacccagatgtgttaatgaacatttatagtcatcattactaggctttcattactactgaggttacccgcctatggaccttccttggtaaaggaacttgttttaaaatttgccttttaacaaatttagtgatatgattatcaaaaaaggcgtggcaaaataca

SEQ ID NO: 11456 - DNA, 402 bp, Saccharomyces cerevisiae
tcgccagaataatgacatgagtttatatgatagataaaattaataaatttccacatgtataatacttttcaatctttttcgcctactatttactgcctaggctaataaattatatgtttttgtcctgggcgcgacattccaaaaaaaaaataaaaaagaagagaaaatactggcttatgaatacaaaaattacataaacgaagcaaaatgattatttcgaataaaacagtctatatataagtcaaatacaagataggaagaaaaacagaaaaaaacaaaacagaaggactggttaattgtttttgttgatcttcttcttaccactagcacttccacgtttgtaaacctcaatatagaaagagatgaacaaaaacaagtaggatgtaagaatggctgcaccag

SEQ ID NO: 11457 - DNA, 424 bp, Saccharomyces cerevisiae
gtgggctgcctcttttctccaacgtcacctaaccaacctgtatataattaaaaacaaacgagaacaacacatgtagtgctaagtaattgtcgttctcaaattccacctcgattttttcaactgcactgaaaattcccactcttttttttttttttttttttttttttcacttttttcccgtggaaaaatattcttaagatgactctaattagaggaaagaacaacaagaaactaaactggttctacagttatataaggacatcttaactgatttagaattagctaagactgtatctatgcgattattatattagtgcgacatatttatataactaagatagtaacgcactcaaaaagatgtttagatctgttgctactagattatctgcctgccgtgggttagcatctaacgctgctcgcaaat

SEQ ID NO: 11458 - DNA, 466 bp, Saccharomyces cerevisiae
tgaatcaaattaccggtttgcaacacatgaatggcgcacattgaggcacaaatacaatctgcatattatatacttaacagaagtacaatcatatacaatacaaacaacaattgacgaaacaatgaaagtatgtacatccttatacttatctatttgtgttatgggctacatacgtagaggccgatcacaatatcagtggttgctcattggaaaaggagggatgcagcaaattctgcatttccgttagtctgtttaagagcctttaccacagcatccctagggaaacctagatccataagctgtttaatcgtttgttcgggaaacgttctcccggttgccgttgtagcaccggctgtacttcttcccgtaggtgttggccccataccagtccttggagcaagcgcaggaacagcccccggttgtggtggtagagttgaactagtcttggtgggtgttaggggcttat

SEQ ID NO: 11459 - DNA, 409 bp, Saccharomyces cerevisiae
gaggagagcaactaagcaagtactattctgaagaatatcctttggattttgcggctgttgaatgcgaagattccgttaatgataaatctgatatcatacttagtatgagagctacggaaagaaacattggtaggcaactgaaaggtataagtagtcaaggggcacaaattatatcgcttgatgaggatgttttttgagcgaaaaaacaacacttaactgccaatactctgtaaaattgttttcactttacatcaatacattatctacgtgattatacatatagttatgcatttgtagctaagagggaatcaactactgatagttagtattcagtgaataacataaaaaagcattagcatacaaagataatacgcctgtgcaattttttgcctatcaaatgcgcctttct

SEQ ID NO: 11460 - DNA, 432 bp, Saccharomyces cerevisiae
caccattacaaagacaaagaagaaaatactgatttctttgttttcttatgcatatattatacatttcgcacattatatagaaaagtggacatttaattcttcaaatcttatttaaaatatctatcacaagacagctcatttacgtagcctcttgacaacattgtcgctatcaccttctgtccataatattagccttttttgtgatttgacaagctcgttgtagcctaatagtagtttttcaattccgttttgttcttgggctaacctcaaagtagtatttaatgtacctctgttttcgttccgtaaagtaccaatgttgttcagtatatcgtcctgtggtagtctagatttgatgttattgttcaaaacctcgaaaaacgacacaataccgtttctgctaattaaattcaaaccaccatcatctgctaccct

SEQ ID NO: 11461 - DNA, 430 bp, Saccharomyces cerevisiae
tacgtatacgaattccttcaacaaaggccaaggaaataaagcaaataacaataacaccattattttaattttttttctattactgtcgctaacacctgtatggttgcaaccaggtgagaatccttctgatgcatactttatgcgtttatgcgttttgcgccccttggaaaaaaattgattctcatcgtaaatgcatactacatgcgtttatgggaaaagcctccatatccaaaggtcgcgtttcttttagaaaaactaatacgtaaacctgcattaaggtaagattatatcagaaaatgtgttgcaagaaatgcattatgcaattttttgattatgacaatctctcgaaagaaatttcatatgatgagacttgaataatgcagcggcgcttgctaaaagaacttgtatataagagctgccattctcgatc

SEQ ID NO: 11462 - DNA, 441 bp, Saccharomyces cerevisiae
aactttgcccttttgcttccaatgaaagcaagatgacaaatatacatgcttcttatattcgagattgcgcaaaaattcgaagctcatttatgaaggctttttccattctgatatatgtttatgaaattgaaaaagtaacgacggtggaacattttgcgggaaaacaactcacagaatgtcttgacgttcttttcctgcagttgcgtgcgtaagatatcctaagctactgtattatttgccaaaaataataaaatgttggaggaaagcctctataaatacacaggatatatatgtttaataaacatatataatttcctcaatatttgcaaaagcattttgttgtgatgagagtcgattatcgtttaccgattagtatctatactattaatatattttcatataattagtataatctcatatacgctgccagaagataacatg

SEQ ID NO: 11463 - DNA, 464 bp, Saccharomyces cerevisiae
atagttttataccaaatacatcatgcatcttttttttttccttatagtttgtgtcatcaacatgtttttgcccgtattaatacacaataatctatcctctcaggcagggagaagaaaactaaatatacatagcaccctcacacaggatgtcaaaactatcgtcttatcctcatgccgccgattttataaatatggaagaaccgccaaaatctaaagagtttttcgatgatctttgtgccgtccctaatttactcaaaagacgttttccaaactctcgaagatcgacgcattattgtgaggctttaaattattctaggaaaaagcttcctgttgtgttgtctaaaatgacactgcaagagttgaggcacaatatgtcaacattttttttgcaggaaaaggatcaaataaatatttatgacacctgtaaggtgatagacatgggggaccgtgtcttgctcgaaact

SEQ ID NO: 11464 - DNA, 497 bp, Saccharomyces cerevisiae
ctacgcccaacccaaccaaagaattatcctcctcacaaaatatatcgctagcatgcgtgagttatggataagaagaatatttgatgagctgactgattctttatagcaatagggaggaaggcagtacacatatcagcagtgcatgggcacaacccgcattacaacgaaacatgatatatctatataaaagaagatacggacaggcggtcgaggctattactgtgccactatgcgagtcatgaatgatttttaaattagttagtacccctttatataacgtcttcaataaaagtgcgggaaaattcgggtaatattttctataactgtcatttttttttcgttatgtatggcaaaccaaattgacaagaaactggacaacggttaaagcaaaaggaggaagaaagatattgatttgtgctttgaagaataacccaagcgaacaggtcattaattgcctagaatctttacatagaatttgccttttatggaagagacgg

SEQ ID NO: 11465 - DNA, 480 bp, Saccharomyces cerevisiae
ctatgaagccgccgaaaaattggctgtagttagtggttaccaaaatggaaaaaaaaaaaaaacatgaacaatctccctcagactttattatagactatagcgtgtacaaacaagtcatcgttgataatgaaagcaatggtttcataccaggaaatttcctatgaaaaatatgcatttttattagtaacaaaagaaactatattcctagtcctcttgcagaaaatacgatataatacttaagttaatatttacagtgcagtaagtacctttttcatgacctcatattcgtttgttcctcttgcaacctgaatggaatttttttcaaaggtacttctcggcctttcttgttagattgctttccatatgttttatcggaacccaatctagcataatttatagtccttttctcctttgaaacatcaatacgatctaggaaactttgtgagagagatggtataatggattggcataaaatggaga

SEQ ID NO: 11466 - DNA, 458 bp, Saccharomyces cerevisiae
gacttttgtttgctggagaaagaaaaaaatttgaaaagcaaataaacaaacttgttcatattattgacgcgaatatgtgtactttgttacccttttttgttggtcgtgtaccaaaattagtttagatatatgactttgcatgtccttgtactatagtttttaaaagaaaaaatctacttatctatccttcattaggatgctatttttcaccttgttatcatgaatattagttaaagaagcaacagcaacaacccaattctgaatcatccatcaatttccaacctatgtcggcaaactttttcaatatctttttgttttcttcctccgatggcgcaacgtttgaggcgttactagctgcacattttccggaatacatgctcttcattaccgattcgtagcatccggtactacttgtagcacttacatagtaacgcttagcacggtcatgtgcattcttc

SEQ ID NO: 11467 - DNA, 478 bp, Saccharomyces cerevisiae
atgagatggtaagatgtgtgataatatattttccatgcacataaaatagaaataagcaagctgctagatgtatacaggcacgctcgcacactcacaccataaatgaattttttacatgtattttatattctagtaacccaagtagtcttcattatttattggcaaggtcactgttccttgcaaaagtagaaaataaaaaaagaaaaaaaaagaaactcgtaagaaaacaagattaaataaacgtcttattttatataagtgtatatatatatatatatatatatgtgaccaagatcctgaagaactatcgattttaaaaataagaaagatgaacttttttttggtaaaacatatttaatgatattatgcaaatgggaagttgttggtagagaagtcatctctcgatcatctggacttcttgcctaatggactgctaatattctcacggtaggtaataccagcaatcgcaaccatctta

SEQ ID NO: 11468 - DNA, 435 bp, Saccharomyces cerevisiae
aaatgaagcgtcaacttcaaattaaattaacttattttacacaaacattcacaatacatcaatgctgataggcgctttgtattgtaggctatcgagttacgcatctgcaatgtgcgtgatttctccgttatccatccttctcattggacaatttttatttgaatattactgaacttcaaagggcttgtcgtgtgatttaatcttttttcttacaacgtcgaatgctgcagctatttattcatagtgtcgtctaagcaaataccccgcttttaaaagctgaatagaaaatccaatcacggtgtgactggtatcacaaacacataatttatatattgcattcaagtttattcaacctatacttaaatacattaattaccaaaaaaaatgatataataaagtcttcttttatctgattaatgacacctttttcagcgg

SEQ ID NO: 11469 - DNA, 498 bp, Saccharomyces cerevisiae
agaaatatgaataagcacgagccccggcatgtaagcccatcgaatacgcagacgttacgcattttttttcatttatcctgtaaataagtaatggatacatacattttgtatacgattcaaacggaaagaaattccgctaacgaaaaagaagttatataaaattacattacaataatcaactccctcataataaagttgatatttcatttagatatgcaaaaacacatatgcatacatacatacatacgtatatgtaaaagttagaatcaaggaaaactcgtgacatacaaatgcaagcataaatgaaaaaaaaagatcgagattcagtatttcatcgaaacatcgaaatcttcataactattcttattaacgtggtaatattaaagtcttttttattgatttcttcttgggtgatattggttctccttttggtgattaatgacctccccatgtactgttaccaccatagtttgacttatttccttggttgttccaagc

SEQ ID NO: 11470 - DNA, 485 bp, Saccharomyces cerevisiae
gtacttagttattgttcggagttgtttgtttatgttatttggcgcagacttcacgctctgtgtaaagtgtatatataataaaacccaagaagaacggacaagatgatagataaaaccatattgaacttgtactcttcttcttgttgggttggaaccaattcatcatcgtatctggatctttctttaactttcaagaaaattggagtttcatttggcttcacgttaggaggtaatttatcctggtacatttcttccataaactgttcgatcttggagatttgaatgttcaattttaagaaatttggatcttgcacagccaatttagatttgatatcacgtaagtaatagtcaaaaatctcgacacagccacgcaaagtccttgatttcaaaattaaatagcaggtagtacccttacgaatctttacattgccatgtagcacttcacggttgttgaataccaaagccaaggttgcaatggccataac

SEQ ID NO: 11471 - DNA, 404 bp, Saccharomyces cerevisiae
tgcaattatgtcgttatattcacaaatttacattgactgcctccaaatttattgtcagattaatattgtggtcctttggctatgttcgtttgcatttttttttttttttttttttgatctttccttcgataaagtatatttacttattgacatattacctggagggctttttatgatcttttaccgttttttcaatcattgtttgatttttatttaatattgatattcacccacctttcatagtctcttcttcatatttcgaatctgtatataaatagttataatatgatccctattttgcccaattttttttttcctttttttatagttacttatttttattctatgtctatcaaatgctaaacgttacatttttaaatttccctggattcccaccagtcagt

SEQ ID NO: 11472 - DNA, 414 bp, Saccharomyces cerevisiae
tcattctaccatctttcatgtccctacgccattctcgttcgtataccatataaaccaattatagattttacatagaataatagttaaatttgattatagaatatcttcggattcaataaaaaaattattattatcagactctttctgtccactccttgaagtatgcaaagtgcttcgagaacgccatgacattcgacaattcaaaattgagagaggactgctaaggaaactctttgagttgattatataatcgctatttaatcttttaaagggggaatactgctaaattttcattattgtacaactggagacatgataggcctgaaatgtgccaccaaattgcatgaccttgctaatgaggtcgctgggttgcgtatgcactttttaccctgctccgcgtcgaaacagaacata

SEQ ID NO: 11473 - DNA, 411 bp, Saccharomyces cerevisiae
gaattatcgttgttagcatgatttttaagattgagcattttattcatttttaaccatataatagtgaaggtgaggactaataacaaagtacttgttgaaagggtcgggttgcttttaggttttttcttctcgttaaggatttcccacttgtctggcaaggcgtcaagcagacttggaaaataatgatattatgtcagaatttttgtgtgaggcgcttctattgcaagtttgtgacaccttataataaaagtgaaccatgtatttacatatgattagggaaagttccaccatcatcttatgatcttcatggccgttttggtcttctttttaacttgaagtccaacttggcgactgtacatatatacatatatatagcaataagtataacaaggcaacaaatcaggtcccatt

SEQ ID NO: 11474 - DNA, 407 bp, Saccharomyces cerevisiae
taaactgtaccttgtctacaaagattgtaaaaaataaaaattctttcccaatgcatattatatgtactatttgtatctatatattatctatcgattctcacttaagatgtcgttgtaatattaattataacaacaaggcttttatatatttcaggtaattatcgttttccttttctggttcatttgctatagcacgcaatagctcttgtattttatgctgggaagcttcttcagtaattttgcttgggtcatgtaaaccctcctccttcacttttctaatccactctttcagtaaagccttcaaacgaatattaccttcgttaacttcctgtaatgatagcttagcttttttcaaatcttcattattagtttttagatcgtccaattcattggctttacgtttagcc

SEQ ID NO: 11475 - DNA, 462 bp, Saccharomyces cerevisiae
atgcacagctaaaacagagacaaaactgcatgcctcttctcccctttattatcacctttaaaaaagataaaaaaagaaactggaaaaaaggtaaaaaaaaaaaaaaaattaaataaatacgaatacgttttctcatgaccattgtactagtaatcacaaccatgatacttgaataacttttctgttttgtgctgtattaagcacaaccgttattttttaatttatagcgttataccactatattattgtagtcattatagttattatcccgggtaacaaaaatttcattccaacgaggtaatagttccacttttcaggcaggaggacgaaaaacatttgccacccaagaaagagacaaagcagtaggtaaggcattcatcacacaatttgaaagggggtatagtaaaaaaaattcaattgagcaaatagaatggctagcactgcagtaatgatggacgtgga

SEQ ID NO: 11476 - DNA, 426 bp, Saccharomyces cerevisiae
ttggtttcgatgtactcttttgttttcttttccttttccttcctattccgcttgtaaataactccgttatgtctcaccttcgatccccactttttcttttggaatactgcatcaaataggaagagagaaaaaaggaaatcatatcccaatatatttgaacatacgacacgatataccttatatagtatcatctgtactaatagtactataactaatacttcttgacggacaagcttcgcaactcgttcgcaatgaccaagtttggctttcgggaagcaaagtggaaaaaaatgaaaaataaactaattgaagtggtaaaaaataagctgtgtgtgtgcatatacatcgtaagtgcgttggctgttctgtggaaaagggagacactttttatatcaggtgcaaaggcttcgtaccagcgttgaaaaa

SEQ ID NO: 11477 - DNA, 446 bp, Saccharomyces cerevisiae
aaatataaaggctctccagttgttaccactttttacattcatatttttcatctatttactgcatgttacatattacataaaacttaattgtgtgtattcttcctttttggtctttagtctctatgtaaacaatagaaaaacgcgggactcgattaacgctgtgctgcactgatgcagccgtgcgtgtaaataaaacatttaacgtgaaaacgcgcgcgaatggcttgtgaaacaaacaagaaacaaacgggaaatatttcagcatgtgatgtggctgaaaattagcaaacgattcgtcaaaataaatcagtaatggtgctttagttctattacagcttgctaatggttcagtaatattttcaaaaattttgccaaacagacctaagcacttgcaatactccagactgttagttcagtcattatctatcatcttggacgattttgca

SEQ ID NO: 11478 - DNA, 438 bp, Saccharomyces cerevisiae
ggaagcgtactagaaaatacctctatactttcttttcctgtatatagcatcaatagtaaagccattataacgttacaaaaacctattacccggaaaattactatttatagaagcattggacccatgcaccacatgcattaggacccattatttcttttttacaatttttccgttaatttttcacgaatttttcaccgtttataaacactctcgaacttataaacaaagggatgataaatagatttcgccagttgttaatacacacagggtcaaagctcacagcactactacactcgttcaacactcgttatatattatcatgcgtgccaccactttattatcttcagtcgtttctttggcattgttgtcgaaggaagtcttagcaacacctccagcttgtttattggcctgtgttgcgcaagtcggcaaatcctcttc

SEQ ID NO: 11479 - DNA, 499 bp, Saccharomyces cerevisiae
gctcatctttcatctagtggtttcctttttaaataaacttaagcctgtatatagaaacttaatttcaaactgtatatttattgtttaagacagcatcaatggtagaatacaaggagcggaaacagaaagaaaagtcgaaatagaatttttcgcttttggcttaacaaaatgaggtctttgaaatcaagagttttgcttgacaaaaaacaactatatttcaaaatattaggaaatgatattattagtacaaggacttacagaaatatacttttaatataaaaaggaaaaaataaaataaaaagagttaattctttattaattttccaacgtcctacattgatatatctgctgagatagaattaatgttagtaagaactaaatattagacgcgaactgttgtttcttacatgacagtacagcaggataataatcctttgtcctccttcttttctgcagttgtagctgctgcaggtttagtttgtctcttagccgcatcaga

SEQ ID NO: 11480 - DNA, 428 bp, Saccharomyces cerevisiae
attcgctcatgtttcttcgaggggcgcatattgtgacgctaatattatgtaccgcccttccccacacacacaaaaaaaaaaggttaaggataaagataagtaaactaatggaatatataaacaaataagtaagtagatactgtaaatagaacacacgttttttaatttatttttttttttacatatcttaatttaatataaatcaaaaagcccaagcctcaaacaagagtcttatcactccatttataacataacaattcgaaatctctaagctcgcttatagttgacaatgaccatattttctaggttctcatattttgatagtctattctcctttaaaaagcaagagccttcccccattgaaataatctattgcaatgaaaacaatggtttcataaacataaaatccttagaaagccccactgacg

SEQ ID NO: 11481 - DNA, 480 bp, Saccharomyces cerevisiae
caagagctataatcttcgtcatgtactaaaaaaaaccaatccagttattactattactttttatactatctgcatattacctacgttatctaacttgtgattcattcaagctgtacagcactttatatatatatatgtagctgcttcttaaaaattatttgctgctatttttaaccaccatgtaatgttgaagtaaaagagatgatgtcaccgtcttccaatatgtagtctttttcgccttcgagctcccaatcggtgtcgttgattaatgtgatgataccgggtcttatagaatcatcttcgatgaagatactaacgtcattagggttattgatcatagtagatacaatgtggtcaatcaaatcgcccactgtgacaggatcttctttgtccatcttaattttatgtactctttgttttccaaaaatagcatcaagtccacctagaaactccactttcacgtttaccatcccgattttg

SEQ ID NO: 11482 - DNA, 482 bp, Saccharomyces cerevisiae
tttttgtaactgtaatttcactcatgcacaagaaaaaaaaaactggattaaaagggagcccaaggaaaactcctcagcatatatttagaagtctcctcagcatatagttgtttgttttctttacacattcactgtttaataaaacttttataatatttcattatcggaactctagattctatacttgtttcccaattgttgctggtagtaaacgtatacgtcataaaagggaaaagccacatgcggaagaattttatggaaaaaaaaaaaacctcgaagttactacttctagggggcctatcaagtaaattactcctggtacactgaagtatataagggatatagaagcaaatagttgtcagtgcaatccttcaagacgattgggaaaatactgtaatataaatcgtaaaggaaaattggaaattttttaaagatgtcttcactggttactcttaataacggtctgaaaatgcccctagtcg

SEQ ID NO: 11483 - DNA, 489 bp, Saccharomyces cerevisiae
tgagctctttagaaaactgaacgcaataaattttatgcctcataacgtcttggggcgcgagaatttactgacgtaaacagatccggctcaaaaagtcgtctttacctttctatcatctcgtcgcataattattaaattaactcacaatttctcacaatttatatcatgccttttttgtcagttcgtggccttgccagtggagatataacaactacttcgtaaagggtcccgaaagaaatgaaagaattactcatttgatataaaaatttgcatggtataacagaagtgaaacgcggggacaaccatgatcttttttgagtaggataattttttatgtcggtttgatatattataaagcaagtcatatataatatcatactgattttaaccaaacgataatcaatcagaaaaagaaaataaataaaaaatctagcacatagtatttcagtacccttatggttctgacctcagaaattattcagccgcttg

SEQ ID NO: 11484 - DNA, 465 bp, Saccharomyces cerevisiae
gcactttaaatacaataaatcgtgtaataagcaagtatgtaacattgatagacagtctgtaataccatttactgatcaagaatgtcgcacaatctcaacagccaggctttgtgttagtattttgtgttttttacaacaacctctcgactattgtataccagtttcttgcatagatgctactattctctgacagtaaattatctagtcaggacttcggatttaactaaatgcaaaaaaaaaaatgattcgaatgtaaacaaaaaaaactgtctaggtagcaatggttcttctataaaagtgcaagctctataaaatcaagatcaagcatagtaccgcccactgttagagtctttggtacgcaaacatttttggctaccggatgttgcgaagagaactaaataactctatcagcaacaggtcgatagaaaatgaatcctttccttttgaaaggccgaatgtcagcta

SEQ ID NO: 11485 - DNA, 436 bp, Saccharomyces cerevisiae
tggttctgaagaataagagagaagataactatagtttagaatagtaaaccctatgtgtactgttttatgtttttaatgtctaatcatgtaaataattttgtgatatcaataacgaacgttctgaacaagaattatgataaaaaaaagtaaaatctaaagccattacaacgctatattttcagtggcagtaaaaacgcaagaacaaaaacaaaacgtgggtaaagaacaaggactacaatggctgtcaatgaatttcaagtggagtctaacatctctccaaaacaactgaataaccagtcagtgtcacttgttattcctcggttgacaagagataaaattcataattcaatgtactataaagtaaatctaagcaacgaatctttgagaggcaatacaatggtagagcttttgaaagttatgattggcgcatttggta

SEQ ID NO: 11486 - DNA, 411 bp, Saccharomyces cerevisiae
atcatccaaaacccagcatgaagaatgaaattaacaaaagaaaaaaaaaacgactgcttagtaggagtgtcatatatccctcctttaaatttttttacacttactttcctttttttattgagaatagaaaaggtgcatctctctctctctctctctctatctctatctctaaggttttattactttcataacgtatgctatccatctcttttcctttttttttgttttgttattccctttttttactcagttagattcatactactatatttacatattcttcgaagcttttatgagttaaatattttgttgctttatggggcagaaaatagtcgacgtcagtcacctccaggttattatgtaattcgctaaaacgacttttaaacatcgcgggagacggatctttgacag

SEQ ID NO: 11487 - DNA, 483 bp, Saccharomyces cerevisiae
cacatagacagatgacgagtagcttttttttagtatttgcataatgatcaccaataatagtagtaatgaaatgtaagcgtaaatagcgtatgcatcatctcccaagacttttcttttgtatggcgcactatgaagaagtttggaacccgcctgtggtgtactgagaaaaaaaaaaaatttcaagggcccgcaatctcaaaatggagtcaattgtgtcaagtcttttttttttttttcatcgttatctcactttttattgcttatcttaagataatttagctgatatactatatagaatagccgaagtgtcagtttactcagatttttgctacttttgattactttttttttacattttcaaggtaattgacgtcggttaagtagagatggggaagaaggatagacagcgcaagaaactgcgtgagtttgctaaattgaaaaacaggcagcgaaacttgagaaagagcgtgcaaacattgaaga

SEQ ID NO: 11488 - DNA, 415 bp, Saccharomyces cerevisiae
gaccaaaaataaaagcacgcttgcttaaacaccaatattataaaattacgatagaaattcctttctcctcttttgtttatgcgacatttttttctttcttagcgaagtactttaaaaaacaagcccaaaaaataacaaggccataacatagcagacaagaatacaaaaaaaaaaaagaagttggaaaaaacatacaaaaagataaaaaaaaaaaatccccactaaagaaggatgataaatcgtgatgcgcacttttcatacctttttcttttctatttcgtattattcaaaaaaaattctaattttattcctcctttatacacattaatgacgcgtggttcatagccaagaaagcacaagacatgacgaaattccgtttcagctacggacggatatgtatgccaaaaccgaaaaa

SEQ ID NO: 11489 - DNA, 403 bp, Saccharomyces cerevisiae
tgcaattactaacgataattcttctgatatatacacacacatatatacatatgggcgcaagtatattctggtgtaaagatactcatagaaagcataaagatgtaattcaatctagttgtattatattattcattgatttatattaatttgatgaacaatggaacatcttctcttcaataacggttttgcccatatacttgacgttattaggttacccgtttttataaatgtaataagttcaataatttgaaaagagcattagctatagtcacgtttcgcgttgaaacaattctttaaattatcttctcttggcagtttaatataccaaacgatagtcctaacatactgtttttcttattatttaccaatgagtaaagccaagggaacgggattttcatcaatt

SEQ ID NO: 11490 - DNA, 433 bp, Saccharomyces cerevisiae
gcttcccacagtaataataacaagtgaagaagagagggaaatgtcgaaaatacccgaaacgcatttcacaattacaaaaaggccaaaaaaaaaaaggaaagacaatacgcttatatttgtcacgtatacctactatttgatttatgtacgttttatatacaaattgcatttactatttataaaataaatcattaactataatactctaactgaatgttttaggatcttctctattaaaaatatacgtggaaaacgactatggctgcccgagagactaaaaaggaaagagcgagggatataacaatagcagtcattactggtgataataatgacataaaagaattactgaaggaggcaaagtatatactgtcaagggtataatggtgaaagtaactgcagcttgtatcataattggtgatgaagtgctgaatgg

SEQ ID NO: 11491 - DNA, 402 bp, Saccharomyces cerevisiae
ttttatatccaaaagcagcaagaatgaaaacttgataatattaaagtcatggccttgtatatacaaattaaatagtctcaacggaaaatatataaacttttaatctaatagtaacatcagcattttattttctttcctccgttaaaccgtacttaattcttgatcctgcctgctctctctaaagtgtcatcaaccaaataccagccaggatagtaattgtcatggtatttgctgaatctttccttatccaccacggaaataggtgacgtgtttatagcggaactacgttcgccttctgcgtccttgccaaatgcatgaatgatttcccattcaaaatgcaaggctggattattggagtcctttctcaagtgtgggttaggcaatgagttgttaattccgccg

SEQ ID NO: 11492 - DNA, 457 bp, Saccharomyces cerevisiae
atgtacatacacacgcaccattatctctcgttttacataagtaaatacagcaataataatacctgtaaatatctcaacatactcaatcaaatgagctgataagcatattcaatttttcttcatagcaatatttttttctgtccaagttttattttttttccataatttctgatttactaccattgaaaattataaaaggaaaaatattacgcgctaccatttaataagtagaaacaactaagttctcgaatgagatgtttgcactgatacagcgagccaaaaaataaccaaatgactgctactagcgacaaagtactaaagattcaattgcgctcagcaagcgctactgtacctaccaaaggttctgccactgccgcgggatacgacatttatgcatctcaggatattaccattccggctatgggtcaaggtatggtttccaccgacatatcgttca

SEQ ID NO: 11493 - DNA, 450 bp, Saccharomyces cerevisiae
tgcacactgaaatctaatagttggaagaaaacaattatggcatggaccgcaatgtctttgcttgctggattatttatttatatcttgtattttatttatttttatggttagtatgtttttgcatatttatttttaacacagaaaagttaggaaacaatatcaaatattcgatacgaatttgtatatttacggtatatccttaatattttattctcatgacatattaagggaaaagataaaatgcaaaagaaaaaaatgcgtttattttttttcattttctaacaacttgagtaactcctgcttttcttctctttctgaagacagctgcttgttcaattgctcgatttcttctgacagagttttattttctaaatttaattgatcaaacttattttggtacttgttttcatagccttttttcaacagtttgaccttttgttcgtgtttgga

SEQ ID NO: 11494 - DNA, 416 bp, Saccharomyces cerevisiae
caagaataaacgcaggttggccaaaacataacaaattgaaacatgttaaatgttttcataattctttttgttcttcgttgtttcatatttatttttaagttaatgtaatagtaatagttaataataataacgttaatggtaacaataataataatatatatatccagtaatttgaaagaagaggacatcatgtctgcggttcctgcgatgtacttcttgatagtatcagtgtctaatttgattgtattaattcgtaaactttttatttttatatactttatatcactatattatgttctattaaatattaattattaaggtgtttaagttggtcaagaagtaactaatgattgcagttctcaaagtctgccaccagggtattcaaatgctgaactttccaggtaatcgctggtctc

SEQ ID NO: 11495 - DNA, 429 bp, Saccharomyces cerevisiae
tgagcgcaatttgctaaaaaaggccgaactccggctctttacgtgccacaattattatttactatgggcggcgggtgtgttggtggtgcttgcggtacttgtaaaatattttctgaatataattgaataagaccttttgtgtttaaatcatactcgggtaattctctgttcaaaaagtaggtgctgaccctcttctaccttccgtgaaatattataaaggaatttttccatctctaactcaacatgttaacgcttttctataaaaatttgatcgcctaatgaatacaaaaatctcttcagctttttcgtgctaggtttgaatagtacatctaacgtagaacaactatcaaaacaatttgatatttcctcggctatagttttcttggaacaagaggtaaactacttctctattgttgctacagcagtcaa

SEQ ID NO: 11496 - DNA, 413 bp, Saccharomyces cerevisiae
gcatagatatgacgttttattacctttgatcacatttccacgccatttcgcattctcaccctcataagtcatacaccgaaaagaaagtttaagggatcaatgagcttactataatctcagtatatttatttttatcgatgattcaccacaacaatcttgctcccgaaaagaaagcagacggagtagaagcatttgaaactccttcagaccttcaagtatatatatatatatatatatatgtatatgtgtacattttcacgctaatactaatgtataattagaagataatttttactcatttttcgttatcttcacgtcacccgaacctagaaccaaatgtcattttcacgatatgtaaatagtgaaataggcaaaaacgccaaaaagtagtaagcgcaacatacactaaacca

SEQ ID NO: 11497 - DNA, 452 bp, Saccharomyces cerevisiae
cgactttccaccattttcggcaacagacgaacttcctcttgatctaaccatcactgcaggtgcttttctccggcggagttaatagatacttatccccgcttcatgtcatactatctctcttaacagggatgttgacaccatataagttaacataacatatacgtacgtaataatattaaggactatctcgcatttcaaaagagaaacaacctaatcaagccttattataagagcaaattattcaaaaaaagtctacggagaaaattattatggtggttttagacaagaagttattggaaagattgacttctcgtaaggttcccttagaagagctcgaagatatggaaaaacgatgctttttgtctacttttacatatcaagatgcctttgatttggggacttacataagaaatgcagttaaagaaaatttccccgaaaaaccagttgcaatt

SEQ ID NO: 11498 - DNA, 459 bp, Saccharomyces cerevisiae
cgcaaagaaacgcagcataggggagaagcaaatacattcacgcatcaagttcgcattagggttactaggaagatatcttatacacatatatagaaataatttaaaacttttaaagagtatactgcagtgtaatcatgccacagttactttacccctcctattatttcttagttacctgcatataagaaacgtattgtccgtatctcttgatgttttggaagcaaaaatacttggaacctttgcaagaatgcatgctcagtgacacggcttgaatccgtcccttgtcgcatgtatgcccttcgaaattttggcggttttcgcgttttctgcgtgtaagtgtggcaggatcgcgaaaaaaaagtaattagcgtagacaagaattacacgaaaagtcgtcaacacagcgccgtctgtaaggaagaaccgctctattgaaatagaagccacgaaatgctaagc

SEQ ID NO: 11499 - DNA, 418 bp, Saccharomyces cerevisiae
catgcatagtgatgataatgaatttagtatatcaccttatacgatgcgctgcagcaattaatcttagcaacatacttgcctaattgaaccacggtggtacgatacagccaagaagagctcatgaagcggctgaccatttcgaaaagtaatctgtatatatgaaggtcttttcccttgaatcatgtctcaataagtagttcatttttttttgccctcttgtttttctttttcatttttttaaatcacacttttttttcttttcaagatttataaatcttccttccaggtttgagccggacccattgtttaattaaagcatagaaggcaacgaaggagtgggttatagaattagcattgcggcaaaaacgtcatatttattaatatttatttgcgaaggtcatattcaacgcaatcgcac

SEQ ID NO: 11500 - DNA, 400 bp, Saccharomyces cerevisiae
cattacgctccttcgtattactcattcagctcttcctctgatagcagtgaattttcgagggtcacgtcgtgactcatatgctttcttgttccgtttcgtttcgagatgacaaaaaactggtcattttttccgttaagtgcaactcacagcagtatcggccgctgagaaatgcccggacaaatttttttgagccggattggtcaccgtttctttcttcggcgcggcttcccattcccgtccatccaaaaaaatctacctatataaatcgacttttcacctctaaaggcagtttattccttgtatgtcctttaagtacagttaataacgagcaatttttttttttttttttagccatctacccatcaacttgtacactcgttaccatgtcaaccacagcatc

SEQ ID NO: 11501 - DNA, 425 bp, Saccharomyces cerevisiae
taggaagggcagaccaggggagcaaagagtgattaagcttacgcacctggtatggacgtgatggaagtggggtggtgatagcaaccagaatacggtagggtctttacgcttagtgtacctatcggtattcaggctctttgccagtgattggggctgcgggatccgccatcatatctagtcacttttgtataagaatgaatgataagagcaggtgcaattttcggactttagatgtttcttgtgtttcattatttatagcacatttattttttccctctgagtgtgtgtctgcatgtatacattttagttgaattatagagagtaacgaaacacacacgcatacacgtatatacaaagacatatatacgtacggaaatagtgaataaggatgattttattaaagaggacaaaaattaggggcgtca

SEQ ID NO: 11502 - DNA, 401 bp, Saccharomyces cerevisiae
tgataaagcgatttttatacttttctctttttcctttttttttttgattggctgtttccttatgccgctctttcccaatttatgactttccaataatgtattattttgtttctctttctctctgttaccctttattttatcatctacaataattgaattccggagagggtaaagaaacaggaaaaagaagaaaatgagacatagtcagcatcgtaatcgttttccttctgtatattcctttatcaaaagactacacgcacatatatattaatcccggtatgtttttggtgtgctaaatctatcttcaagcactattatagcatttttttaagaatatccaaaataatatgtaatttatgattaatcaaggttcaagaattggagaaaccgtgagcgacttc

SEQ ID NO: 11503 - DNA, 448 bp, Saccharomyces cerevisiae
gtggcatgatagagttaaaatatgtgcataaacaaatcgcttgaacgatctgtttgattatgtgggcagcactacttttttgtaattatatatgcatatatacattttactgacactaaatgttatattttctataacatctaacattacttcacgccttctaattaaagtatagtttgtgcaaacaatatgtgagctcacgtagacaattgtctaatatatcattaatgtcccttgcatagaacttcctttttttttctcagcgtcgcaatatctctgtcgagaaacgcttacgcattataataagccaaggaaaaatagcgaaaagccgatgcagatctacaggagtgatgaaagtactaaaaagatcagaaaagggaatatttgtcaaataaccaagtcgaaatggaaaaaaaacatgtcactgtgcaaatacaaagtgctcccc

SEQ ID NO: 11504 - DNA, 432 bp, Saccharomyces cerevisiae
aagaacaaatgagggatctagtgtatatagatttctagatgatatatcatgtaaataagatcaagccagactcgggctgtatatatatatatatatagcataataaacagtaatagtgcttttaaaagcatttcagtcttacccgagcgacaaaacgatttggggagaaaaaacgcatataaccagggaaaagacggagaacttacaggtacaccagaattgaagcaggccaacaagagccatgttgtcgaggtttatgtccaacacatggtgtacgcccttgagacaggcgcagagattgttttcctccactacgacaatgcaagcgacattgaatcagattaaaagaggctccgggcctccaagacgcaagaagataagtacagctccacaactggatcagtgtccccagcggaagggtgtcgtattacg

SEQ ID NO: 11505 - DNA, 485 bp, Saccharomyces cerevisiae
aaacgttatctttgatttatattctataatatcgtggctacagcacttgctgaacataagcttaaaacgtttatgtgtgtatttatatatgataataataataataataataataataataataataataataataataataataataatggtgataaactgcaataacaaaagaaaatagtaccaatcctggatctagttttccctaaaatccaatttttacttatcagcctcacttcctaaactacctcaccttcaaaagctcgataattaaaagaaaacatgaataatatagtaaacaatgataatagtttctctataagattatctaattttcgaacagtattagctatatgcgaaatatcttcatcattggtaccttatcataaaccaaggcctgctttatatttatttgaacgaaaaaattaacttatattcttggctttccattcctgtttattttcacagcaaatgaatcagccaaa

SEQ ID NO: 11506 - DNA, 404 bp, Saccharomyces cerevisiae
tgaataagaagataaccgggacaagaacaagatcaaaccctcactaatcaacaagttggacttaatttgtgcaagcatggatgtttctcattaatattgtcatatttctttcccttaatctagcatttcctttctctccctcttctcatgcatatcttcctagatatatttctccagggtgaaagcgggacggacgtgcttgttttacctcacctggtactactagtattttcattactcttttttcatcctcccacttcccccttatatatttgttttcccatgtgtggtatatggcatcattattatataaatattctttagttgtaaaaggctgttttaattaacactatttatcgctagacaaaactagactttcattatttccttcatttcaacgcttg

SEQ ID NO: 11507 - DNA, 467 bp, Saccharomyces cerevisiae
ccagaagagttaagatgcccgcgatatcaacgaaaacaaaaaaaaataaatcattggatataataataagcatgagtcaatggtgacttatgcgtctgcatgtttttttatttactattaaataacttatataaaccttttgcatcgtgaacgaaaatcatatctgttttagaatagtattttgcctaagcagtgtcactaaactaaatcttaaacttcaatatgccctcgttcattattacatcactgtcaatccttgcgttttaggtttcattaaatttttgatagcttttgccattctttgctacatctttttacgtcatacatcataatataccagtaatatagataaagatcgatagaatagacctatttctcattccatcaggtaacggcatgtgttcggaacatatcgctgctcaattttatttgtgatgtaccataatattgagaaaacacaaggccct

SEQ ID NO: 11508 - DNA, 457 bp, Saccharomyces cerevisiae
agagcacctttcatgtataatctgtgtatattacgtaatgtttgtataaatagatacatatggacatgaatcaagcatatctaatagaagtttttatattttatctccttggctgggtggtctcatctgtgaaaggagagcctcaattatgttgagcttgtttaaaactttacactcaaaatcttcttgccttttctttatcacctcgagttcgttgtgaagataatctagacatatttccaattccatattagagtccgaccacgattgctcagcagccatttgtggaggcagtactgtctcgctgaacctatttgtacccttgtttatcttagggcttttgatgactttcccgacgtcgttatccttagacagaatcatggggattgtgtgaagagtaggcggaattccaatcgttattgaatccaggggcagcggttgtgagcctgaatgctca

SEQ ID NO: 11509 - DNA, 405 bp, Saccharomyces cerevisiae
atacaatattcacggcatgcaattatagaataagacaagaaaaagaatacaactccaatgagtagaacgtcagcagcacgttcatgcgttttcaaagttaaagtcatacattaaaatttaagcaatatatacaggtggttaattaaataatgacgacaaagctcttttgctggtttacagtcccttgattataacgttaatgaatggaaaatgggggtacttttattcttatatgaccctacttgccaaagagcatatcttattgtatcccttgtctttcagtgttctatctacacaaccatcattagccataattcttgtccccagaggttcaccggtatttttattaatcaaaacgcaagcagtatctccgaatgcaacggtggagccatcctttctgcacat

SEQ ID NO: 11510 - DNA, 461 bp, Saccharomyces cerevisiae
gaagtaatgattagggcgatcatttccccgtgcacatttcacgtcatgtatcatagatgcaatttcatgtaaactatttagacatctcatttaataaaaatagctacaaactgtattttacaatattagtaacatatcaaagataatctctatggtatatacaaaacttcaaaaatgccaagacaatttgcacggctgcgacctaattgagactttgtggcctgcatatcagtcttacaataaaagccaaaaagaaaaaaaaaaagtaagaatgcacaggtgactagtggttatgtgactatgtgaacgtaaagagaacgagatgtaacccggcaacccggctagagaggttgtttagcatgcgaggtattagactccttgtcaaaaaattaattaaaatatttattagttaatttattagttgcaaagtcattgataacagcgtgactcttcccggaaat

SEQ ID NO: 11511 - DNA, 450 bp, Saccharomyces cerevisiae
catgaagattagatttattggagaaagataacatatcatactttcccccacttttttcgaggctcttctatatcatattcataaattagcattatgtcatttctcataactactttatcacgttagaaattacttattattattaaattaatacaaaatttagtaaccaaataaatataaataaatatgtatatttaaattttaaaaaaaaaatcctatagagcaaaaggattttccattataatattagctgtacacctcttccgcattttttgagggtggttacaacaccactcattcagaggctgtcggcacagttgcttctagcatctggcgtccgtatgtatgggtgtattttaaataataaacaaagtgccacaccttcaccaattatgtctttaagaaatggacaagttccaaagagcttgcccaaggctcgacaaggatgta

SEQ ID NO: 11512 - DNA, 487 bp, Saccharomyces cerevisiae
tttgttgattgtcatcagttttagtaaaaaacgaacaaaaacacaataaaatataaatcaatatatttaggtttactgggttctttaacagttgtataatagttattttttattacaaaaatataggttttaataaaaaaaaatagggttctatttgttttacatttattgatttgtttttcctggcgataccctcgaaaaaagccaggccttgtaggaggcaagatttatggctttccatgtggttaaagaaaaattgcagcaggaagatattcattcatgagtcagttatataatcgatatatagctacatattaaacaacttgaagccgcatacgtggtaggtgtctcattttcaattcaaaatattttaaacagaaccggagatgaagaaccacttgtcaatagacttgtcaattggagcatctgcctttggagaagctggtgggatggcatcagaggcagccttggagtaggttggggtgtc

SEQ ID NO: 11513 - DNA, 432 bp, Saccharomyces cerevisiae
aagaactttatatatcatgtagccaattgctacacttccttacaccacatagtatacggcgataatcgtcaacacttccgggaaagtgcggccatcggagactttcaaacaagtcattagaattagaacaaagaacagtagtggagagcatatatgtgtttgcataccctccaaaagaaagcgattatagtaacattaatatgaaggcatcgcttacgtttagtctctccggaatatacgccccctgtagcatttctagggatatatatctcgaatacggcgataaaaaagctgaatgtttatatgggacaattagattgcctcagtacggtccaggttgcacgcctggtaaaattgtacattgtgtcctggatgattcactgcccttctgtagcattgttgtaccttccaaactttttgggtttatgccga

SEQ ID NO: 11514 - DNA, 414 bp, Saccharomyces cerevisiae
tttgaacctcattgtattttacggaaaagaatatcatactcttctttaattgcactttttttgtgcgtttgcacttttttaccactgactcactaatttgtatatatacctattaatatacatttacataaagtttcttcttatacatactctatttatttagttatttattaacttactatttatttatttatttatttatttatttattactttcaattttttatcgaggcatttccttagttctccaattttttttctcattagccagatgtgtgtttttctggccctcacaaaaaatgagcaggagaaagtcatatggcgaacgtaaatatgtaactaaaaattaagatgggcagacatttatcattttgcttatgactaaattgcgaattgctgtacaagggtgctgtc

SEQ ID NO: 11515 - DNA, 428 bp, Saccharomyces cerevisiae
gtcgaataaattgttctccggtaccaagaaaattttagttaagcctggctatccaccaacgcacgtatacttcttcactttagataaattgcatacttgatacatataaactctttgtcttttaaatcatagcccaaaggaaacgtagatctcagaaggcatgtgaaaaaaaattcgatcttaccttttttacgccattttaagctactgtttcgatacatgagcgtggctggtacattgaaggtgggcaatcgtccacttatctaaagacagcttatcagcatgaaatccaaaacgtggattttcagggatgtcttatctagtcaccgaaccaaagcgtttgatagtttactttgtaggagactccctgtatcaaaggcaacgaagcatcttcaactgggagaacatttcctgttcttcccaccatc

SEQ ID NO: 11516 - DNA, 447 bp, Saccharomyces cerevisiae
gaagtcttttccagttttcctgagatgtatacggccacttcattgcgcctaatacggtagagtgtcgacatagttattctatcaggttgtatcatgacaagaacttgtgagctttccgcttagatatggctcaaataatatactgtaaattatggtgccttttgatagcgcattgaattgggactggaaataatgtcaactattgcagagatagaaaagaaattcaagactttgttttgtattttatttaatatatatattatacataagttaaaagcgcagtatataaggtaggtaatatcgctgccatcacggtaggaacgccagtttattccatttacaataggaagatctgaaactaaaacaacggccgtgcttataaagcattaccagtatgaaagtcctaaacaagaaggaagcacctcctccaaagacgaacccacctta

SEQ ID NO: 11517 - DNA, 410 bp, Saccharomyces cerevisiae
aactttatggatgattgcgatattaacgataacgatagagacaaacacgcgattaataatataataatatgaagtttctcaattgcaacgcataattttggaatgacatattaggtacaaatgttagacctaataaatgtaatatttaacgacggttgtacgtacaggtacattattttgtgtactatactaataagagtattttatatagggcggtgatgatacccatcgagctattatcaccacacagttttcgtatctgtgatagaacggctcacaaaatcaatgagaagaaaagtgtaattataatcttagtgtatgaataaatcatgctttcgttttcctttttttgctaccaccaggtttactggtggcagtcttcctcttcgtaggtttggctttctgcttga

SEQ ID NO: 11518 - DNA, 473 bp, Saccharomyces cerevisiae
caggccttagaggcactacctttttttttttttcgagtttctacaccgtagtatctgatttcatagtggtattcgtcaaacttaacccacaagtgtcacttttcctttctttttttctttttcttgaagaactgcatggttttctagctctttttcacttttttgaggttttatttatcttgtattctttttttctattattttaaaggttcaatttctatcgacggtttttttaattatatatatatatatatatatatatgtatataatgaatgtgtaatattccaagtatacgtaccttgggtttatattttttaacttgtatattcttttacgataaaatttcttccaattaacatcccaggccttgcttcaatttatcaattggtatattaactttcaacacattttgtttttgtttttatttttgttttttttatttttttttttttttcgcgtttcgtgctttaat

SEQ ID NO: 11519 - DNA, 430 bp, Saccharomyces cerevisiae
ttaaataacgtacttgctcttcgtacatgcccaagataaaaaaaaactacacaaataaagctaataaaaatttacctaaagaaggatcatagattaagtggaaggaaacttgtacataattcgagtttattttcaactaagatatcaaggattgtttactataaaaacacttaattgggtaatttctattttttactttttttctgtgttaaaaaaatgggtcgcgccaatgcgctcacaaatctattcttatccctaacttacatctacatgtaaagcgccactaagagagctatagcttatcatacatttacatcaggtaaagtatcattttggccagtggatacgaatttaatatataatctttgctttcccttcgctcttaaattcaccaagcaagtttgttaagaaataaaggaaagggggctca

SEQ ID NO: 11520 - DNA, 414 bp, Saccharomyces cerevisiae
aagagcattgggcagagagtatttgtcctgcgtatagaggagaaaaaattgtactgatgctaattttggtgtcgttcttcttttttattttgtaagactgttttccagaaatgtttgggtttattttttaattttttgaaacatttttttcatcctttctcattttgtcatttcatttttctgtggaaaatttcactgacgcgaagaagcgatgaaatttccaacatcctcccatcatcccaatattggcatacacacacatgcagcacagcggaactgcggaggtcagaggcaatgtggcagagacgctggcgcgcctgtattgtataatagtatattttacactcaattcaattttttgatattaaattagtgtgtaaaaagcttctgaaatcaagaagcccgtaccagaag

SEQ ID NO: 11521 - DNA, 406 bp, Saccharomyces cerevisiae
aggagaagctagtgtatccaatgttatctacacattatcttttatcaaaaatgttttatcgtcctttcatctctttcgaagaatcgctctattcacattccaaatctctggcgtcggtcaatatttattcatctttatttttaccttcttctagataatatacattatcccatattggcattcaaactgacttacttgcattatggaagggggatcatacgttccagtatatgcaatggatgtcgtacttacgaacacattgtagcatttgaaggggtatttctatatatttctattattaagggttatattacaattatactttatagtttaaaatatttaaacaagttctcaaatacttaaatacttctccatgaggtggtcggccaactcaacatttccgctt

SEQ ID NO: 11522 - DNA, 500 bp, Saccharomyces cerevisiae
acttttgggtaattatgatgtgaatattctcattatgcatgctatgtactgaagaaatataactaggtccatacgcttatactgttaaacatgtgaacttttctgtaagaaaatgaatcacgtaaaatttcgcaccgaactttcgtagatgagagaacaaaaagcagaaaaagagaaagaacagtaaagtaacacttagttagcatatttaaataaaagtctaaaggaccagcaaagagttattaggtgtgatgacggatgaaaaagtgaactcagatcagaatatgaacggtaagcagggagttaacttaatttcatccttgcctacaacacaagtgccggtttcaattttgaccaacaaggagagaagaaaaagtattcacgatgaatcaaatttcgaaagatctgatagtcatgaagatcaatcaaaatccaactctaataggaggaatatttacaaaaacgattatagcacaaatttgagggatttctcttttgcc

SEQ ID NO: 11523 - DNA, 440 bp, Saccharomyces cerevisiae
gcttatccttttacttcaatcaccccctcgtgagaatttaatgtggaagcaatatactactacaccgttgacttggagattttcaagctcaattttgcgttcactcaaatctaagtcatttgaaacaaacacaacttctaaatatagcaagagaaataggtcaataacgcagacacatatttaacatttaagatactgatagatattcaaaaggaaacagtcaccacaagcgttggagattcagcaaaacccaaaaagcaagaaattacaaaatcattgtctcgctgatgaaacaccatcctttagtgtttgtatccattcagcgtaccctcttgttcttgagactggtgaatttcgtaactagttgaatattgcagggttttctttttctaaatatgtattaatggtggtgcctgtcagggcgcgatagaagtgaaaaa

SEQ ID NO: 11524 - DNA, 440 bp, Saccharomyces cerevisiae
tttgaatgagcggcatggccgggaacaatagacattactgatattcattaccccaatcctttctgttatttgtattgcttcccaacagaagttagcatgtgtgagagtttacttataatgctttgtttttaaaatgcagccagtggtgaaacaattggaacctttactatttattagggaacaagatgacattgtcaattgatatattactattgttacatatcgtgctatttatcatttcaattattagtcacatgaccgcgataagcgatccgggtcagaatgccgagataggataactttgccggcggagttcctagatcaattgaaagaatcgaagtgagattagtaattcattcatatgtaccttttaaaaaagaaactcactcttggaagtgtcctttactaaggattgttttgaacgaaaagtgtaggcgtgc

SEQ ID NO: 11525 - DNA, 453 bp, Saccharomyces cerevisiae
aatttcccacggatgggagttactttcgttttctttcttattgcttacacctgataatcatccagcatatagaaattgttctttaaatatcacatacagttccattacttgacatttgcaacataatatttctgcttttttctctattttgcatccaatatagcttctatctgcttactactgtctttttgacaatgtacaatatatatctaagatagttacgaataaaaatatttttattaattccataatatttaattacatagaggcagccaataacaaacaggtaaagagttgtgtaaagtgcatatattcgtcttttattctaagttactcattctagcactccaggttgatttgctcctccttttaagctttcacttccggctctatttcctcttcttcatcttcttcatcgttttctttgaaatctcccatgtccaaattaccacc

SEQ ID NO: 11526 - DNA, 472 bp, Saccharomyces cerevisiae
aaaagaaaatagttgtacttgatccctatattatattatatcctatttataaccaagggcttgccttcgcgaacaacaaggtatgccattttgagaggagcaaatttgcattctaaattcatgataatgatatgttctttaattattactatatataaactcacttagttttccagcctttgctcttttgttcgtatagcaaggaatgaaaaaaaaaaatcctgaataaacgtcatagtaattttcttccttagttagatacaaaggattttgaaatacagtatatgcacaatcgcaactcattaagagcataggaaagtattcaatttaaagaaaaacatgatggaaacgatgatatagaaaaaagaacggaagcaagcgttaactgtgataggaatatgcatagctttttcttcttttttgttttattattattgttgaatgctatttgctgaatcaatttacttgacga

SEQ ID NO: 11527 - DNA, 481 bp, Saccharomyces cerevisiae
aacgagcagtctaagaacctgaagtaggtgactagatggaaacataaaaaagaacaagcaaggattaagaggatggatatgttcatgcatattctctcatttttacctcttctccttttcatatatgcatgctatagaaccattatctctatgagtttcattttatttagtagttagtattgaaccaaactacataagatgacatattctaaataacctaaataattattatgtctttattcaaatatttcttttatatccaagacaatttccctctcatctcctttgtattactgattatattcagccattcaaaaagttaaaaaagaacgtttttcactgaaaagtcgcagctatattatagtaaaataataagagaggcaaaataatggttaccaacacttagtgaagaacaatggtgaccggaatatcggaggaaaatgatgatgaagagactttttcggctgttcattcttcaaca

SEQ ID NO: 11528 - DNA, 498 bp, Saccharomyces cerevisiae
tgatcgggtgcactatcaccactcagcacaatagattacttcataatagaccattgtttgtaactcatggtaaccgcaccctgttgcccgccctgcctctcttccagtttccgcaccttgaaatttccgttttgggtcaacttaaaaatgctctaatattgcattgttacgacatcctgttgtcatgcgactaaaggtatttatactgtatatatctcattcatctgattctgtgaggttgcataattgaatatttatttcaaaggagctagaagacaaagatcactccacataaatatacggggttcctttatatattagttcattttttttttcagttgtcatacccaaactattatttccttctgaactcctttaaatatatcgttcttccaagctaattgataacagtagtagcatcacaagagaaaaaaaatgcgatcttatatgcagattcttcaaaaatttgccaaatttattgggccagggatattagtc

SEQ ID NO: 11529 - DNA, 490 bp, Saccharomyces cerevisiae
aaacagaactgttcaaagaaagatgacttccttttgcttcttgtacgctcacaaataattaatattcatgtttagtactgaaaattaagaatacttgcataactacagtagataatattttttgataagaaaccagacgtaaattagatgtaatcttttacagatattacagtcaacttaatcaattacctaaaaaggtttaagattgtgcataggaaacgtttcaattaccgtatctttaggctaccgcctctttcttattttcccttacccttttttcaatctaattaattgatgatttcgcacgtgggaaaagtaatccgatgcattgaaaaattattaccagaaaacagtgtttcacaccaaaaaagcagtcagctctcagataaaggtgcagcaaaactacggtaaaggcggctattattgtgcctcgaaatgagattctcacactttctcaaatacaacgctgtccctgaatggcagaatcatt

SEQ ID NO: 11530 - DNA, 497 bp, Saccharomyces cerevisiae
tttcacgaagaagaaggccaaatcaatgtccatacctaacgaactacaacactattcaaatgacactaagaacaatttcgaaaaaaagaaaaaagaaaatttataaatgtatatatttgtatacataaataaatgcataagcattgacaggctccataattatgtaccataataatgacaaactaccttattacattgtaagcacatttcctgctctatcaataccaaatttgcatggtaaatacatgccttttttgaaataacatttcagctatctcttgcagtgattggccgttccttcaaatatagcctttgtacctggaaaaaaaaatgcgtctagtctaggatgtacagatgaggtatacatataccagcacgtaatcgagaaaaaatgccaatatataaataaacacaatatcaaatttgtagggtataaagaactcactacacatatataatgtatatgcgttacatatccgcttgatgatgatgcactt

SEQ ID NO: 11531 - DNA, 415 bp, Saccharomyces cerevisiae
tgtggtaaacaagatggcccttacggggctcttagtgggagaaagatttttaatagagcataattaacggatacataatatattataaatttaaataatcaaggatacctaataataataacaatcaactgaacacaacattaaaaatggtatttgttattgtatgttaagccctaagtgattgtgccgttataacttccattcgggtgatacctgcaatatgaggaagaaaaaagataaattttttcttcttaaagtataaaaggcggacatatttgatttaaatgcagaagttttctctcagtggtttatgttttacatatgatagaaaaaatgaagcaatagcaaagtatcgtagtgcgaaccggtctcgtaactttgataagtttatcaaaggcgttaacattttgtttcg

SEQ ID NO: 11532 - DNA, 446 bp, Saccharomyces cerevisiae
gtcacctactcttagcgcatttttattgtatataaaggcatttaatgtaatttatagagcattataaatcgtaacaactactgcagtatgagtttcatggattcatttctcaatatcttatgaatatacacaggtatatatgtatattcatgttaaacgcctttcgaattgttcgttggctttttttgtgaaattatctcgggaaaagggcgaaattatattattttgccgttgacattttgaaaaggaataaaagatcatgaaaaaaataagaaaggcaattcgacgcatttctctcagcaagctattctttacttttgaagaacaaaatattttagcaaaaaggttaagacaatatagtcggaagcagttctgcgggatctgaaggaattgcggaataatgagatttcacgatagtatacttatcttcttttctttggcatcgc

SEQ ID NO: 11533 - DNA, 426 bp, Saccharomyces cerevisiae
aaagtagaaagaaatacgaatacgaaattaccagtccattgattgggccccattaataactaatactaaataaaataaatggtcttgcccttaacgaagataatatataatatttacccctagcattaataccctttttctaaaggtacgaaatgaacaaacatctttcatgttagttcttccttttcaatagttctcatatagcgttttttttcgcctgagcggttctagagctatatctattcaaaattgccatgcttttgtattcatattgtatgtatgggatgataacctgtcgcttcctgagattttctcaaaaatattgttttgaacctagatttctttttaattattcttacaggtgcccattggaagagtgacaacattaattttgaaagctattcacttggtacatccgcggtttac

SEQ ID NO: 11534 - DNA, 413 bp, Saccharomyces cerevisiae
acgagctagtttgtaacttcaaaacttatgaaaacacttatttattcttcagatactatccgcacaaattccttaagttttttccaattttttgggctttcttccttatttaatcagtttataaaatcattacgttgtaaatagtttatttgaatttcttcaaagaagcggaccacttttctggtttattttcatggaataattgatataatgcgtcaatcaattcgacatggaatgaaccacttccttgacaacgggtggaagccaacttaccagctgatttgtataataggacagcaccaaccacagcatcaaacagttttccagtggaatctaacccaccgataaaggaagcaattgtagaaccaagtgaacatccacttgcagtgatgtcacccatgataggaattggg

SEQ ID NO: 11535 - DNA, 443 bp, Saccharomyces cerevisiae
ttagaacagaaccgggctaattgcctctttcctttcttttctcatacttatttcatgggataaataagaatcacctgtatactattatttacattacataacattacaataactattttcaagggtcctcttacattcttatcaaaggtattatataatctcagtatatgccaaacgtctgacttaggagttagagatgttcagaaacttctcaccaagtggtgatttgacaaattcacagaaatcacgaacgtcattcctggatagtatcttaaaatcaatgatttcaaaaattggcggactttggtgtattccataccataccccaatgcgaacatccagtacctgcccatttatcaatctcaaatcatctttatgggctgaaaataatctttcgctcatatacaaacgcatctcctctgcgccatttgttgaattgaggc

SEQ ID NO: 11536 - DNA, 400 bp, Saccharomyces cerevisiae
cggtaactaacatatatcttctcaaaaaaactgtgtactattatcttttcatctcgccaattaatgacagcgttatttgagaatagacctaagataataaaactatgttcgttacccggacaaattttcttggaagaatttttgagtcctagagatattataaaacggccctctattaatttgctctttctttcctcagtttaattcttctttcgaataaaaaataaaaatatcatggctcttcaacacatttcaacatgttcaagtaatttgtgttagtggatgaccatttaggggctgctggcctggttaccgggagtttttcttggatccaagctagcttttccgtctgattatccttaagcttcacaaattacaatttttcccacgcattaagaaa

SEQ ID NO: 11537 - DNA, 404 bp, Saccharomyces cerevisiae
tagttatcatgtttcttatcccctccactgtaaagtaaatgtatattattaaaaggcaaaaataagaatataatacttcagtaatgagccttttttattcggtcttgttacttcttttttacttcatttttttttttttttttggatagtaaataatgcacttttgactagatcttgagtatttagttgaattgaaattaaagatacagtgtataaaaattatacaaaaaataaaggaaacttgtatattgaaaataggattgccaatacatggattgagacagagaattttttatcttcatatccagatattcgtaggaataacaaagttttagtgacccaaggtataaattgcgaaagacctgcggagttggcggcgaacactgactttttgggcatcaaca

SEQ ID NO: 11538 - DNA, 426 bp, Saccharomyces cerevisiae
ttatgtgttgcttatggttttgacttccttgaccccatacaaattgcgttctttattttttttggttataatttattaataatggcgagtaggatcggcctatctttatggagtttacaacataatatatacattggtatcaatttgttttatagttatattttctctagtatgtgaacgataattttgttttacgaatccttatattaatgcttagctggggccggtggaataagaatacaactatgaaaatattacaacaataccttcgaacatatatatacaccacttagaaaattgatggtacggtgcctgagatcgctgctggtgaggtcatataaatagaggatgcgtttttgttatcaagagaattctccctctccgataacacgtcctgcgtatccactagcggttgctccactttct

SEQ ID NO: 11539 - DNA, 465 bp, Saccharomyces cerevisiae
gtcttttaacggaataagcttcgtatatacaatagaaaaattttccatacaatattacataatactatagagtaatcatacccacaatctccatggctgcggtatcgtgtcgaaaatgaaccgggctattaattatacgagtgtgttgaaagtaggctccattcggcctcatcgggcggaactgtttgggtgcctcgccaattttcgtagccaaattactataaaaggtgcagcatgaaactctcaactaaactttgttggtgtggtattaaaggaagacttaggccgcaaaagcaacaacaattacacaatacaaacttgcaaatgactgaactaaaaaaacaaaagaccgctgaacaaaaaaccagacctcaaaatgtcggtattaaaggtatccaaatttacatcccaactcaatgtgtcaaccaatctgagctagagaaatttgatggcgtttctcaaggt

SEQ ID NO: 11540 - DNA, 471 bp, Saccharomyces cerevisiae
tcatatccattcatatcatttagtgcttatggctacttttcattcctcaattattgtaaattgaccatcttaattatatttctgatattgagtaggtggacttcattagtatttttacaaatattatcaccttcttatgtaggattagcattacataccctctaattaaaaaaagttaacattaattacattttaaaaaaaattgtaatagtatgatagtaggacctgacagccatttgaataaggtttcgagtgctttaacgttccactgattttatgtagttcatatgggggttagtctggtttgaggaggagaatttcagggaagcagtggccgttgaatctccctgtagggcgctgattatttttatcctaataatccaaaaatgacaatgtcaataaagaaaacttaccgagttctgtgaatttctccctaaaaaattactaattatacctgggcgagttttgaac

SEQ ID NO: 11541 - DNA, 402 bp, Saccharomyces cerevisiae
ttgtatttgtatgtgtttatgtgtttgtgtggttgagaattttattttcctcctagttttttcttttttgagtgcggaggggcagtgctctaaactttgcctgcttcttgttcgacttcggcttcctatgcagaacgcaaaatcgcgtgcgcgaggaacgaggaagacaacgctttagattggctttttcgtcgcccatgcccgttgcgatagcgatatgatgagaaatcgataaaaggttgcaccagtacaccgcactttctggcgtgcttggatctggcttgcgcggcctcgtgccagtaagtagaaaagtagtaatatggcatggcgaaagagaacaaaacaagcaaagcaagcgtaatgcacagctgtggctaaaaaaagagcacagaggtgaaggga

SEQ ID NO: 11542 - DNA, 493 bp, Saccharomyces cerevisiae
aaaaaaaaaaaaaaacataaggaaattttaattaaatagtctatctacacatttcctaaaagaaaatattattgcattacttttttgaagatctataaagggcactgtcttactttttaaaatctgacccacttgaagccaacacagtatgctctcgaaattatgtagcaaacagcgcttacaaaagttgccaaaccggaaaaaataatatagtgttggtaatcggccgttgtcttgatagagataatggcacctgttatcggaatgccgactaaagtaccgaaaccgacaacgaagtacattgtagagtaacgtttaccgaactcttccgttttagatatctggccacagcaaacaggaagtaaggagaaaacgcttccagaacaaaatccatatagggcactaataacgtacatatttgtcaaattggtaccaaatggtaaccaaccaacaaacatgacgataaatagagtgagtagagttgcaattgcga

SEQ ID NO: 11543 - DNA, 441 bp, Saccharomyces cerevisiae
tctgtttatccgtcatattccctatattcatatttattctgagtcttgttacaatttcttcaagaaaccgatccttatttaacctactgtatttagaaagtaaataaataaactaaaatcaaagcaaaaataattttatacactattcttatttttattttttaatttttaattttttttataagggagcacaagtatacagacggaaaagggattaggctttttttatgcgctctgtctagtactgttttcttttacatccgtacatactcttagacccatacagcgcatgtattcttgttttcgacttttttttggttttttttttttagttctgtaaggacaaagaaaaatggtcgctagccgcgctcgggaaaaccagcgatattctcaatgtaggaagtctaccattttccctttaggctttgccataatctctgg

SEQ ID NO: 11544 - DNA, 499 bp, Saccharomyces cerevisiae
tgtcataagaagacaataagaaaagctcagaaccaattttctgcacatatgatgctgtaactatataatgatttcttgtatataacttccgtataatagttattgcttccatgcatgattctttcaaagaacaatacaaaataaaaataaaaaaaaaaaaaaaaaatgaaaaaatgaagctacaagtcgggtaacaaaaagtatttcaagatctctaaatataagtgggcaaataaagttaatgccaaaactccatgctacttttcacctgaacttattggggggagttaagtctataagtatccgtaacgtatggtagcgacatcttcaaagaggacgttggatccgaaggaggaacatttgcctgctgacaaaacatccactaattcaagcaacactataatatctgagttggcaacacaagagaaatccagctctagtggtactacactaaaattaatagctcttaatatcaagtccatatcagatgaagatgtgg

SEQ ID NO: 11545 - DNA, 479 bp, Saccharomyces cerevisiae
tgactatctctctcttcatagtcttcccatcatatgcatgtatctatatacaacctatatacactttgtaatattatccatcctcttcctctatatagattaaaactgttaatattacacatgacaaaaaagttgcgtccgtaaagaaaaagtacttaaaatgggtaggttagttatgtagggaaagatgtatgtaaggatatggcttaacaaagctgttaaatgaaaagaatataatcgctattttttatattattcaaatctttttttgtattatagtttagattttgcctgcgatagttttacagcggcgttatccaatacaatgacgtttctggtcgtatcaattgtttgaaaaacgacaaccgagccttgcttccaagctttaacctttagagtatcacctgggaaaacaacattggtaaatctcactttcaactcctcatatggaccataatgttcaaacaatgctttcgcac

SEQ ID NO: 11546 - DNA, 481 bp, Saccharomyces cerevisiae
ggagtgatgcctttacgaatgaaaatccatagacagtgaaaagtaatgaaaaaataaaataagaaactactttttttgatgatataaataccgttgattatataaatgtatattaatattatagacctatttgatcaatgacggtgttcgtgaagtatttcatgaatacgataaacataagaaagaaacttttacactattgtagaaaaagcgtggacggaaataaagctaacagagtatgcccaataaacaacaatgaaattggaagcgtatgacttcgcagcactttgtccttccataaaaatgagtcgctgcttcttttttcattttttggcgcgtcgcgtcgggccgtatagaatatgcgtcacttctaagaacaagattgcagatcagggcagtgcgagttacaagtcatggtaccagactctcatttagagaccctcatttttgacacttaaaatatcaaaatttctgggttgcg

SEQ ID NO: 11547 - DNA, 484 bp, Saccharomyces cerevisiae
tatatttaattcaaacttaactaatggaatagctcaaggtagcaccaaaaagtattgttatacacctgaactatcgaccttgaaactggctctataacttacttattgattaaagaccataacatgatcagtatccgggtaataaagtaacgtgatcagaggccagagaaaatgttcataagtagagactactcttaaatgcataataaaaaaaaaaactgataggcatcactctttcctttttgactaagattccagcatcacattgcaatatgtccactggtattacttatgatgaagatagaaagacacaattaattgcccaatacgaatctgtaagggaagttgtgaatgcagaggcaaaaaatgttcatgttaatgaaaatgcctccaaaattttattattggttgtttcgaaattgaaaccagctagcgatatacaaattctttacgaccatggtgtgagggagttcggggaaaacta

SEQ ID NO: 11548 - DNA, 437 bp, Saccharomyces cerevisiae
aagaaaaaggggaacgagagaaatagacaattcgcaagtgacgtatatacatgggcatatttattctcgatttgatttttttttcttcttttctttagttgtaatgcgtctaaggcactttcgaatacatgacatgttgaagtagtatatatattagttatttacaagttggttgtattattattattaccattatttccagctccattagaggtggggtttaatttggaatcaattttattggaaatgttttttaaatccttgttcagatatgaatccactaaagaaatatcgaaaaacttttcgtttgacaaagagcccattattgcgttgttaatttgggtttgtagggtggtgttacctgaaagtaataattttctatttccaaattgcgtgaagttagaagttacatcataggcatcagtgaattcctccgt

SEQ ID NO: 11549 - DNA, 500 bp, Saccharomyces cerevisiae
cgtaaaaatgaattcttgtcttgcattcgccgcgatataattagctttaacgagcttcatgcaaacttttcaactagcacctatgaacgcttttttcataaatatacatatatatatatatagttgtgcattacttaggacttcaagcccattgtttaaaatctcagttcacggtaacggtccatcccatgaccgttttgaactaaacttaagcattcatgttgggagcggcgaaacttggtaatgttttacaggaaaacagcaatgaccactattaatcgaaaatctgcaaaaaatgaaaaggaatgggtgttaacatcaattgttttttcaatgataattacaaattggactgatactacattgctagatgtacaaaaaacgcaaggtagctctcttagaaggatccataatatataaaaaagggcttatggtttactgatatctttttcacttcaaaaacttacatataaaaataggatgacaaatgcaaagatttt

SEQ ID NO: 11550 - DNA, 479 bp, Saccharomyces cerevisiae
tttcattactagacagatgaaacgaaatttacttcaaaagaagagcattaataaagtgattcaattatggaaccagcagggtaggttttatcatatataatatacactcagttgtcatctttattggctttttagaaacgctgcaacaaactgtactatatatatatcatattcacgtatgtagaatattaaagtattgaatatattaatattattactttatttccagttacttacaatttcctattttctatttacatgttgtaaaaaatcgttgccgtgaaaagtggacaatttcttcattacctcaaagtttgagaactgatgatcatcaaattgaagagagtcctccaattcattataagattccatagcctttctagctttttgacgttcttcctttttcaactgcttgattctctccttttctagcttgtggaacttcttaacattcaagtctcccagccctttaatctgtg

SEQ ID NO: 11551 - DNA, 414 bp, Saccharomyces cerevisiae
tagggatacttcctccccgcgtttttgtctgtgtgatttaatttcttttcctcttgttctttttgaaacttgctttattatctctctcctttctattcctcttttctctactgccctttttctatatctatacatatgattaaataaataaataaaaaaattgtattattaatatatattttatcatcatcgagtgtttttccttttatgtggccagccggccatgcattaggaacgtagaccgagtgcagctcttttcagtcaacggcaatatcagtttaaaggcgtccccttcattcaagtagtagcggaacatccgtttcattctgatgaaacccattccttcatataagtttagagccgccgaattttccacctctgtttctaacatgatctcatcgcaatgttcccttt

SEQ ID NO: 11552 - DNA, 429 bp, Saccharomyces cerevisiae
ttgctgattcttacctcatttttgcatttgccgtcatcttatgtttccttcttaccacattacttgcattttttctcagactgtccttttatgtgaaacattacaaatatattggaatgtacatactcctatctaaaaatctttttgttttcgaaaaagtgttgataaatacatatatacgttttttatctaaatcagatcgccttaattggcctcgaaaatattggtcaacttaacttagagcgtcaaagaatatgaatattcatcttcaacattttgggctatccataaaacaacgcaactcaataatatgcatacattccccaacacattgtttactcccatccccaaagttggataggtattgtaatccttgactaaaaatttgatgatcaacacgacaatggagcctgatagcccaccagctaa

SEQ ID NO: 11553 - DNA, 408 bp, Saccharomyces cerevisiae
cttttcaacgtaggtttctgttttaaataggtagatcagtcaaacggatgcgtcgcataaatggctgataaatttttccactactcgttttctctttttctgagtttctatattttgcgcctgttttacaaagaaaccagtatggtttgatcccatgggcgatgccacaaagaagctatagagaaaaaatgttaaaatattcgaaaaagcttcgaaagattttattgcggtcactcatgatcataaaaaaaacccttctcgcatttgtaacattgtattttagtttctacttcttgtagcaggccctgaagtatagattctcagacacagtgacaaaatggatgtcgatgagaggttgcatcaagatgaaaatcaaacccaccctttttcgcaaaagaagtcaagcag

SEQ ID NO: 11554 - DNA, 447 bp, Saccharomyces cerevisiae
atcatctgaggatgttttcttttttttttttttttggtttcttctccttgttaatagcttatatgtatatatatctggatatatgtcctgaatatgctgcttatctgtcatataacattctcattttctgttcccttcatctatgtgaatgaattctgtgcgtttctttcgtttcccctcttttgcgtatggctttaaatcgattttaatctgtaaaatcatcccaaaatcagatggataacatagaaaactgaaccgaaggaaagcccatgtcccacaaattaacaatcctgccatttctgattaagttcacgcccaagtttccacaatccattgatcacgacgagcatggtctaaacgtttatgcctttgatctggaccatacaattatcaaaccaaagtcccccaatataagttttagtagaagcgcaagtgattggcagttta

SEQ ID NO: 11555 - DNA, 433 bp, Saccharomyces cerevisiae
aaaatatttgcatatcaagggaaggtaaaggttcaccgtctcctttaaaactattttttctctgacagtattaatttaattcttacataaatataatatctttaatcttctttttttaaaccggctccggaacctttttcttaaatttatagttttgtctcagtaaaaggttttcttttaaactaatacaattatgaagtatttaggcatgcaagcaatcaggaatctaagaataaaaaattgtcctatactggagcatgggtgaacaaatatgacacggattcaccattgtgtagtcttcttatagcttcagcgaacgtgggactaatatcgatctggtcagcaataggtaaatccaaatctaccggaacggtatttgtgcaaacaattctagacaatctactatttcttagcttttctcttgctgaaccgg

SEQ ID NO: 11556 - DNA, 430 bp, Saccharomyces cerevisiae
tcttggctgtagcacttatacaaatttaatgattttttttcctctttgatgacatgtataaagcacactgcacctactgtattgtacttgaaacaggtaaattaacaattaatgtagcattagtaataaataatttcacttcacggcgttaaagaaatactatggcaaattcgatttgagaatttcgtcaaattctgatgatatcaattaatggcatattttttttattttttatctggagaaaaaaatgtaaaaatgacagcagcatcaacaatgaataaaagcaagtacaatagtcgtaaagatctatattaatttcatggcagcacaataatacacgttgtttaaattagttaaagtgtcactccttgcttatcgaaggaactatcgattcctaattatggcaaggcaagggaacttctacgcggtt

SEQ ID NO: 11557 - DNA, 437 bp, Saccharomyces cerevisiae
tcggtcaacaacaaagccctttgaatatttggcgtatttctgctgcctctccttatttatttattcattatcgttttcatatttatttcagtcacaaaacaaaattaaagaattcgtgacctactaacatgagaattagttaatttaatctttttagtttatttatttcattaggtagaatttttttttctttctctgatctttcagtgttactcatcggtggcaaacgtgtttacaggactaaaaatcgaaataatgattattattgttcttaatttacttagagttatttagtttttttaactatcgtaaattgccaaatgatcggctttgtggtactctatgtcttagagaccttgtagatacggaccttctcgatgcgctaagtcttttactggagctctttgtattttcgccgggcaatgggaaaatctttc

SEQ ID NO: 11558 - DNA, 429 bp, Saccharomyces cerevisiae
ttctatcatagtatgtcgcctgtaaatatggaaaaataaaagaaaaaatagtaataataaatgcattatctaaaactccttaaatttgcaaacatcgcaaagccattaaggtagagaatgagctgaccttgttatagttttccttttggcaaccgtggtttccgtcctacgtaaacatactgaacttgacaaagtatgaccaataggtgacaaattgtatcaattttacccaaaagggcgttgaattaaatggtatctcgtaaaacaatgcattggtcggtattaccagtctacctaataaatcgatagattcagccaaaaatgatatcaatgcaaactttgatgataaacctactgttgagcatcccatccagtttatactcatttgaggcacatacttgaaacatttaagcagatttgccattaccc

SEQ ID NO: 11559 - DNA, 451 bp, Saccharomyces cerevisiae
tccccataaaaacaagcatttttcaaatatttcaatatcatttttgatagatggctttatcttatgagaaaaattggtaacagattattcatgtgaatgaaactctatggattatttccttgcttttgtctatctacctccttttcctagagcaggttattgagaagatatcaatggtttgatatcacctcgcaaagaaaggcctgtttcttcgtgcttccatctgtgcggtcggatttttttatcagaattatcttacttgattttattccaggggtatgagaatcaaataccgtcatctagtttggtctttttttcacaattgtgatttatgattacttaatcagcgtaattgaaaaaaaaaaaccggtaaatagcagatatattcaataaatgtcactaaatatgatatatatgtattatttgataaaaaatcggccagagcacttta

SEQ ID NO: 11560 - DNA, 451 bp, Saccharomyces cerevisiae
caaaactgatttgtttttatctttgatttatttttaacgttatttctctttacttatttaggaacggatttaactataatgttatacaattcatccgtggtttccttcttaccagtctttatggcgtactgtgcaggatcaccgttatcatctactgctagtaatcttatgaatttttcgctttgcaaagaacctgtaaatcctttttgcacagtgaaccccttgaccagttggatgtttaaaatgacttttaagataccacgagacctcataacaatacgcgtcttctcgacgtcgtccttacttttattgattttgatgataccaacacctctttccttccagccttcttttatgttggaaagttggtacagcttcgcattgacttgatatatgcactcctcagactcttcaccagacttgacttcctgtttctgcaatttgaggggtt

SEQ ID NO: 11561 - DNA, 448 bp, Saccharomyces cerevisiae
ccaacatattaagaaatctggagtacaatttctttatagcatataaatatcaaatatatagtcatttttaatacatggaaagcataataaaaaaacaaggggagttttactgatatcattgggatatataaaacaaaatagtaatattatgcagccatcacaattttgaacaagtagcacattattcattgaataaatgctaaaaaaatctccgcgacggggaattgaaccccgatctggcacgcgacaagcgcccattctgaccattaaactatcacggaatattagatgtgatattgttgtatctcaaaatgcgatacgtcaatatgacaatacgtcatcctaaacgtccgtaaaacacatatgaaacaaccttataacaaaacgaacaacatgagataaaacccggcctcccctagctgaactaaccaaacgtataaatgcctga

SEQ ID NO: 11562 - DNA, 412 bp, Saccharomyces cerevisiae
gtgctaagtggcgccttactacataacttgtatataataaaaattcagaagatgctttaactttttctcgttaataagaccgagttatttgctattacgaacaaaagagtatatgataaagaggcttaaaaataccccttcattgactatccagaaaagcctgcgttgcagcttcaatatgataaggatatacttccctcaaaccttctgcagttgcccttgttctagcatccagcagaatttttcttaaaatggcctgaaatccacatgccaataataatttcttgttatattcttgactagactcttgatcttcattttgccgttggagaagatcttctagcttattctcctccgcatctaaactaagctgccgtagcaaataattggccaatgcttccgtatccatgga

SEQ ID NO: 11563 - DNA, 413 bp, Saccharomyces cerevisiae
agaacaacctaattttattacccaaaaaaaaaaatgcattatatatttcatccatatatagaacacacttactcacataaaagacaaatatataaaagtgaaccggttttcatatcatcaccctctgttgtcctttcaactcttaaattgtctaggaagagataaagcacggtgaagaataaaaataacgtcggaattttagtatggtacataattaaaaattttacaacctagctcctatcaagttcttattaccttcattttatcagaatctggtgaaagaagtttttttcttagattgtttcatcagcttagcctttttataagtgtgatgtctaccgtctctccaaccagaggtgctgattttttttctgggagcttcttcattggattttttctcgtcgacatccatg

SEQ ID NO: 11564 - DNA, 418 bp, Saccharomyces cerevisiae
taactagacaaggttcgtccacctatatcttcttcttccaatatctctatacatcaaaataagaatatcgttcatttctcagaagctcaaaaaaaatctcaaaatggatacttctaatgccctcatgaagaggaaagaaaataatagacacagcgaccttcctataaataacagacttgtatatagttgaatgtctaagtaattttaattcaaaaatccttaactatattaccaccttgcaataataagagtgaagtgttaaaaatgatacttgcttgccttcatcgagttaccgttgtctcccacgtttcttttttctcgttggacagaattgcttccgcgcgaacattttccacttttatttgaaagaggacattattcagatcgtgtcagtctcatctaattggcaaagtggcaa

SEQ ID NO: 11565 - DNA, 493 bp, Saccharomyces cerevisiae
atgctatataaatataataacaatcgtgtaaatactactctataagtacttcgtattcatatattgatcacaatgcacggagacgcccattaatgtgacttgaatataccacatgaaagctaaccaataagcaatttaaaaagagttaagtacagcttggagacacccaaaggcttctgcttcgacaactattgactatcgagatggcttacagtgactacagcgatggagcagacgacatgccggactttcacgacgaaggtgaatttgatgattatttgaatgacgatgaatatgatctaatgaacgaggtatttcctactctaaaggcgcagttacaggattaccaaggctgggataatctttcacttaagctagctttgtttgacaacaatttcgatttggaaagcacgctggcggaattgaagaaaactttgaagaagaagaagacaccaaagaagccaattgctgctgctaatgggagtgcgaatgt

SEQ ID NO: 11566 - DNA, 494 bp, Saccharomyces cerevisiae
acctgaccattattgtgaatataagctatttgagaattattttacctttttacagccgcccccccaggataaatatttcaagttgtggtaacggaaaagggccttacatactctagtgagcataacacgtacaatgaaactatgattaagtcttctgcgctttttagagccgatgtaaaaaaacatgcttttttataaccaatgcatgaagtataatttaggccccttttgagttaaactactcagtgtcgaacacaagtttgagatttcgcagtcaatttttgggttgactcgattatttgctttgcaaacttcttgatgagtggttcattgcaaggatgatttgtttttgttatttcttattaaggatatgtaagatggtataaataaagaaagtcgtttatgaaagagaaaagaaagaagaagaaaaatcaaatttacggcaaaaacaataaatcaatgttaaagcactagtaattgccggatgaaaaggt

SEQ ID NO: 11567 - DNA, 446 bp, Saccharomyces cerevisiae
ttgtaagaaagaggcggtacgcctttgggatagcgtatcgtttcatcgtttaaacgagcaaatttgataagtacggaatatgacagtctcattgagtaatacagaattgaggcgtttaaatggttatggttaagggttacggttacggttttttattcttagaacacatttgatatatttttatttatggttttttacatatagatttcgttcatatatgaggttttctttttatattaattatatttcttcggttgttacgttatcaattttgttattgaattattacgggttatgaacgccgtagaaaaatagcattggagtttgagagtctgtggcttttctgtcacatcattttttcgtctaacttaggttaactcagtaatcgtcgatttcttcataacaggccaggaccttttttctgtattcctccatatctgcatccc

SEQ ID NO: 11568 - DNA, 418 bp, Saccharomyces cerevisiae
gataatggaattttcttcgccacgtattccatatagtatattgtaaagtggtttagattacatagaaatattcaaaagaattaataatttgcatatcgtttaaaaaaaaaaaacctttgaaaacatagtaaagaattatcggcttttgtacaggatacgaattagtaggtataaaaggaacaaccgcagcaaataagtacgagaaacgagccactcacgtgaaaacatatagagaaaagcgaccggagataatgaagctaggacatcgtgagcaacaattctacttgtggtacttcatcgttcacattcccatcaccatattcatcgactcatcagtggttattcccgctaaatggcaactagggattgcgcaaaaggttgttagtgatcacatcgcaaagcaacacgatttcctgct

SEQ ID NO: 11569 - DNA, 410 bp, Saccharomyces cerevisiae
acacctatcatggttaaatcatacacacatctaattcactgggaactgcattgtaacgtctaatcggcattgatgttacacaagggaaaagaacgcttttgatgcatttctctacaaaataacatgtataaattacttgaatggtctcttcgttttttttttttttttcttcatctatcctgactcatcaagagagaccgttcattgtaaccacttactcttatataacgtataactaataatattaataatcaagaagtggtgcttaacctttgaaacgccttacgcaagaacctaatctgttggttggtctttggtttttcgtttctttttttgtacggggaagaaagggagaaaacgactttttttttatgtttacaattcatttttaagcgttaaggcaatcgaaa

SEQ ID NO: 11570 - DNA, 449 bp, Saccharomyces cerevisiae
gagagaacacagaaaaagcaggttaataatattcatatggcgactctaaatcaagaaaaaaataatcgtttgtgttacacccgaaatattgaaatttctaatcgtatacacaaatttaagtatgcaaaactaaatagtaatattgcccacacaaaacattcatcagtttccaccagcagaaatgcctttttatatatgtaaatgcgaaaaaaaatcactgacacacacacaaatgcacatttttatcttatgttacacacagttatacgcacatacgcattcaatctctatgtttctttttcttatcctttttatccttcttctccctcttctccctcttctccttcttctttttcttcttttcactagactcctcttcatcgtcgtgatgtgaacgcttctttggttctttcttattttctttaacttcctcagccacatggaaatct

SEQ ID NO: 11571 - DNA, 404 bp, Saccharomyces cerevisiae
agcaaatattgatatacatggaagagtacatgcaaaggtgcgtaaaaaaaaataagtcagataaaactaattactgtttagaaatcatgagtatatgaaactaattttgaagagctttaactgctaggttacttaaaacagtagttacagcagcaccaaggaacgaaccgaaaatggcaccttggtaaaatgaacccttattctctctctgtactttactttcagaagcgtcttttttcttacttttcgttcgtgattttgtggaagatgttgtcgttttgtgcttcctgactctaccaggcgacacagccttcttaatgtgttgttcattattaactaatgactttttattaagcggtccaccgtttttggctttatttataacgaacccatcagcagagttt

SEQ ID NO: 11572 - DNA, 472 bp, Saccharomyces cerevisiae
ctttatagtagcgcctttttatattccttttttctcaaacaaaaaaaaaaaatgactgggatacaagtgaaagtggaagagcaagtgaaatacgaaataaagtgaaccatttatacagaataggaaaaccaactagtgcattaaactaaactccatgtcatacaaacagtattttgatagtttgcctttgaaattgaagtcctttttccaaagataccccccttcaatcaagtattctccagtgtctacatctactaaagccattaatgccaatcctttcctgccaaataaacatccggtcacacaacgatttcatgatccgaaatattcacttagaagaatgagtgacgtatataagttggcactgcgttatggagtagaagagtttttaccaccgatcgaaaacactaagaaacttttcttcgaggagaaatacaataaaaagaccctcatgaaaggtgttctcttgccc

SEQ ID NO: 11573 - DNA, 431 bp, Saccharomyces cerevisiae
tggtgtagtaaggatactggaacccttttatgacacatttagcagtaagatacatttttggttgatgtgatcaagattttttagtttgtagatttattatatagcactgggacatcattaacatcgcactttcgagttaatgtatgtatacacaacatcgaggaacaacagcatctagggttaatgacattgtattgtatactttcgttgtgctagtggtggcgtgatgcaagaagctgatacatacctgaaaatgaaagaggacgtagctatacggtgtttgtggacgagttcacatacagtactgaaaaagatgaggatgggctgagataaagtttgaatgataatgaatattattacatcttctttcattttatataccgtcattcattatcccatgaaattatcaagcctcgcgtttcaacctctac

SEQ ID NO: 11574 - DNA, 474 bp, Saccharomyces cerevisiae
cgcgagatctaatattaacgaaaaaactgaaataaaagcaacgcttatacatatacatgcatgcattaatatatgtatatatatcggtacgtatagattgtaaaattacacttactactaaaggcagtatgaaagacgcccgcagtttttttcctactgttttcttgactgcggtgttcaaaaacataaaaatcattaaattactataaaacaaacgcatactgcgaagaaaaaaggctcggctataaatgcatatgagaaaatattatcttttgcctccctgcttaatttctgaaggcatgtactatccaaaagaaaaatcttgaaagaaaacaaatcccattattcttattattaaaacaaaaacttcgtcatcgtcatcacataaaaaagacctaccattgtcaaactgtacaacagcaacacaataataatgacgatgatgagttcctcgagaaaccctagaacggcgtt

SEQ ID NO: 11575 - DNA, 487 bp, Saccharomyces cerevisiae
tatggcctcataaaaatatttgcttcatcctaagtataaatgtttagttttatcctacatacatattcttattatagtcattagaaaaaaggcacggcgctattggcctggcagggcatttaaaatgcggtggaaacaaggaagattaatcaagtaatgatatagcatatgcacaaaaaaaaaattgaaaacggtcgcatttttgatctaaatggaccaacgatgaaggaactgctttactatacattcattgaaactgaagtgactggtgcatttttggtgtttagggaaaagactcaaaaccttgtttttgcctcgttaggtaatgataagctttttttattgggaaaggtggaaggcttcttgaagaaacatgagaaacaggatacaatgtacgatttacaggaactaaaagaggcagaaacatataagaaatcaatcgaaaattatacaatatgtttagaaaacaaaatgccattaccatcgg

SEQ ID NO: 11576 - DNA, 476 bp, Saccharomyces cerevisiae
aattagaagaatcagcatcatcaataatgatagtaacaataatcattgtataatcttgtattttatacttttcaaaacccgccatttccgttatatatacaaatgtatcaaatagcaaaaaaattatttattttcgaaaccgttctctcgagcttcagctttcaacactggtcttcaaagcataggaaacactcacatagagatatctaaaaacgaacgatagcagaatgagcaacaacgaaattgtatttgtcactggcaatgccaacaagttaaaggaagtgcagtcgattttgactcaagaggtcgacaacaacaacaaaaccatccacttaatcaatgaggccttagacctggaagaattgcaggacacggatctgaatgccattgcgttagctaagggaaagcaagctgttgcggccttgggtaagggtaagccagtgtttgtggaagacactgcgttgagatttgacgaa

SEQ ID NO: 11577 - DNA, 413 bp, Saccharomyces cerevisiae
gcttattgagccttcccttcactcatttcaagaaaaaaaaagccaaaagctttgcttggatattatacccatttttaacgacatattttttcccactactttagatagaaattcatgatattttgttttatattatatatgtatatatatatatgcacgaaaaaaaattaaagtttatcactgggagatagggtttcctatctgccagggtgaaacgtttattttactgatttctttgtctttactgacatttatcggatatctatctatcattctgagcctatgctttttgttagccgtagactaaaaaaaaaaaaaaattgaaggaaaagaaatgaaaaaagcaaatgagttgcaattttagtatattgtaaaagagtaaccacataaaaaaactaaacaagagccggtgc

SEQ ID NO: 11578 - DNA, 457 bp, Saccharomyces cerevisiae
tataattcatcttaacttcttatattgttgctttttcagtagtaaattatcttctttaattacgttattatgtacatattcattggcttatgtgctcatctggtacaaagtcttgccataattgtaaatagtgtttcttttcatccatgttcaaatctcttattgattttaaacaactattaacctcggcggcttctctcttctcaaattctttccgttcatttaagatatcttccataattttctcccagctctgcttaacacggttatatctttttaatacaatgcggtattcatcctctgccgtgcgtatcttaaggtcttcattgttactgttgttgtttcccggagatagtttgtcaagaaagtttttcttcttgtctagatccacttctatgatgcttagaattttaccaagcttcaatctttgatttaagatggattcaaatgattcgca

SEQ ID NO: 11579 - DNA, 408 bp, Saccharomyces cerevisiae
ggcttttgaattactacaactattcctgtaaataaaaacataccctccctagtttccacatacatatttatttaatcttatttaggcactcaatttagaaactagggaatgaaaaagcagtaatcttcttttaaggaataaacaaaaaaaaaaaaaataaaacataaaacataacacaaaatactcttttctaatgcatttaaacttcggttttcacgtcttcctcatcctcttcgtcttcctcgtcattgctctcatcggatgctgtttcatttagagcttcttcctcctcctcgtcctcctcatcctcttcgtcatcctcatcatcgtcgtcctcattgtcagcaccctcttgttcttcttgttcttgctctttatcaccagtttcctcgtccctagctttccgta

SEQ ID NO: 11580 - DNA, 439 bp, Saccharomyces cerevisiae
tcaatatgcgaaccatataagctaattttagtaagtatatatattccaatacaatcacacacacacacacacacacacacacacacacatacgcatatattgtggtagtgcgtagtgtcagtacgtcttatcatacgccttctatttcagggttagcgtatttttactatcaatattacaatacggatatatatacacacacctaatatatatattatacgttatattactgccagtcgaaaaaggaagatacgatgtattattttaaaattcaatttctaataaacattaatggagatatacaaaagaagaaaataattaagttgttatgaaatttataaaccttgttgagctcttcttctgtcacgttcttcagcaatagacaacttgatacccttaccctttggcaaagaaatgtaaggcttaccttgttcaccga

SEQ ID NO: 11581 - DNA, 434 bp, Saccharomyces cerevisiae
atgagcctctgagcagtataaattgtacttcaaagcactagtcatgaaaaacgcttacattagttcagtttgtcaaggttatgctattacttgtacttatttcttgctattgttagtggctccccacattgacgtattttcacgtgatgcgcctcactgcggaaggcgccacacattgcctgcaaaaaattgtggatgcactcatttgatagtaaactaagtcatgttaatcgtttggatttggcacacacccacaaatatacacattacatatatatatatattcaaaatacagctgcgtccaatagatgagcttccgcttcgttgtacaacctacctgctatcttgttcacggatatttcttgcttttaataaacaaaagtaactctagaacagtcaagtcttcgataatttttttagtcacagggtccgtc

SEQ ID NO: 11582 - DNA, 400 bp, Saccharomyces cerevisiae
atgcatatggaagtttttgttatctttttttctgaaaggtctttgcagacatcaacgaagcatagaataaaaatttccccagctgtttaattagtataggtgttaacaaaaggaaatagtcccgcttagacggctatgatggtaacatgcatggtgcaacaactacagaataggagcacaacttgaaggcgtccataaagaataaggtgtctttttgtgatggttgtttaatagcaaacatacatatatacttatagaattattgtacaggaagtttatcgaaaggtgcatttttctgtttatgagacaataccccgtagctattctgtgatatactagaaagaacgggcggtattatgatacgaattgaagggaggtaggggaaaggaaggtggaaatg

SEQ ID NO: 11583 - DNA, 408 bp, Saccharomyces cerevisiae
atagtgtttgctccccttacttttctattctcgaaccaatttatattccttttgggacatagatctcaatcgcatctgtttgaagactacataaacagccttgtatataccgcaacatatacacatacgtctacatatgtatatattgacaacgaagattctgcgaacgcttggtttggcgctatcgcgatagattaagtgcaacaagacacacatttacaaacataatatgaaccagatatgattcatggattatcgaggcaaatggtctgtgaatgaagctcacttacgctgcaataagcagcaacggcattgtagtgatcattttctacgcctcgtaatatttcagcgcagtggaaaaaaattgaaaatttttactcttctcgagtgttgaatcactgctgcgat

SEQ ID NO: 11584 - DNA, 435 bp, Saccharomyces cerevisiae
agcggaagcattttattcaccaagtatacttacttttctttaaaacgagaacaagaatcgaattcaagaacatctcgaagccagaattgagcatcatatattcgagctgtacaaacatcatggcctacaactatcgtatttgtaagtttttttagaggttttcatatttgtttaataagggttctgtcagtttttgtcacattctattgttgcgcttcgcataatgcagccaagaaaatccaaacaatagaaaaagaaaaaaaggatctcaaaaagggtttggtgttgtagttataagaataactagtgaataaaaaagctgttgtttggtccgtattacattcgtcaaaaatttagtactcaaatcgtgtatgcaatcgcaaccacaaaataaaaatattagactggatgtgttgagtggagatggtgccaatt

SEQ ID NO: 11585 - DNA, 490 bp, Saccharomyces cerevisiae
agacaaacgccaatttaatgaaggaaatgctatgaaacttagataatgaaataaaaaaaaaccctttttttttttttggtagtataaatatctttatacgtacatacgtgaacaatcacatcatatctgtcaattctcgttgtaaccataacctagcacttatttcagactttccaaaggtcgcagtatctttatgacgagccatcccatgtaaaaattgccgtgccggatatgaagtgacaaagatcagtctatatctcggaaagccaacaaatatcttcattatgaagtaacgtatagtgattgcttccacatctgttcaattcggacaattttcgttagcagtagagtcaaagcgatcgccttaattgtctccgtatcttatttattcatgaacagcatgacaattgacagtcacttgaatgaagtagaaagtttgattgtcacggtcatctgagatatactaccggcacctgatccccgctaatta

SEQ ID NO: 11586 - DNA, 454 bp, Saccharomyces cerevisiae
actattatgcattacactttccccttcaccatgtcttacatatgcatatatatatattatcaagcacagtttcatttttcatctgtccgtgtcatgtttttccgcatttgtgtcgatcttgccagcaattttgagtaattagatgacgatcgggtctgcaacgaagtgggacgttttgtgtgaagtgcgccttcttcgggtgtctttaagatgcaacggtccggtaaaccatttattagcctattcgattgaggtacgggaggagcttgattctttttttttgtattctgtcttttttgaagaatgaacttatcaaacattttatggtccgacttcggcgatactactttaggtttggcggtcattccattatgtattaatttccatagtttcattaaaactgctctctctttgcatcctatgaaaatcgtcctggaaccgtcaatttcaagga

SEQ ID NO: 11587 - DNA, 489 bp, Saccharomyces cerevisiae
ttcgctgctggtgtcgttgtcatcttcactgtcaccattactttcgctttcgctagaactactctcttcatcagagttgtatattttattccattgacatttccctaatggaataccccagatatggtcctgtgtggccaaccaatcgactaattcatcaatgtgtattatacaaagttcttcgttataggagtgagcaaagcagtctacttgtagtgggaaactttttagtttgaaataatgctgtgaatatttgtataattgtactttaaataactttatcaaatcattttcatcatcatcgtttttgttattgccattcaaataataatactgtaaccgcgcataaaccagaagcaaagcaataatatatttcgagtcaaaaccgttctcattttttacattcaataagaagttcaactgctggaaattcggtctgatttcgattaacttcattaagatgcatttaaactcaatgccaccgagaac

SEQ ID NO: 11588 - DNA, 487 bp, Saccharomyces cerevisiae
cacatgtatagcataatcttcgattccttttacccattcgtagatggcatcgacagtgtacttataatactaccgtgagaaacgatattaagaacaagacgaaaaatggtggaaaatctggaaagcaagaacgtagcacgctagagttattctagcttgtcagctcgactgtttaattattattgttattatattaacattaacgtaataaccattgaactacattaaagaaataactgtctcgcttatatctggtctattttttgttttttgcctttccttttaaattctttataaccttgaaaacaaaaaatcacattggtaaattacaatcatttattaccaaatttgtccattaactattttagcgtgactgactgataaagactgtttcactctctttatttattcataacaaaaattcagatattttgaactataaagtactaaaggcagaaaaattaatagcaaattaagcgatggcaat

SEQ ID NO: 11589 - DNA, 500 bp, Saccharomyces cerevisiae
gtctccaaatgaaaagaagaataaaaaaatcaccacgaacacacaacccgaaaaaaaaaaggcattaaatattcatttgaaagaagggacagagactaaatcatatcctttattatctctctatatatatataagcgtttgcttgaaacgtttacttcatattatttatttatctatagtctgaacttaaaattttattatgaaattcgtatattgtaatgtctagtgttataaatcgggtatctattagtatttattttttctataattatgcaggtgatggggtatcgagtggtctatatatcttaaatttattctactatttcctagtgcagaataacttggcgaaaattttgaactttctattcttcttaaaagatttttcttcatactgagttgaactgtgcttactatccttgttaatgggagcagatttttgtttcgtcggcaaaatgacacttttatcagatccactagtttcgttgtatacgtggaggggt

SEQ ID NO: 11590 - DNA, 412 bp, Saccharomyces cerevisiae
gttccgacatagtatctaatcaatttataatatcagagttttgtaaataagtatatatatatatttgatgtaaatatctaggaaatacacttgtgtatacttctcgctttccttttatttttttttttgtctacaaactctgtaaaacttcttgtcttatttgataggcatcccagaatgaagtataggaccaggtaaggtgttgggcaccctgcataaaccctgtgtatttgttaaattgttcacttagttccccgtctgttcccacgtgagctttcagcttgaccaagaatgaatcagctagttggaagattttttgtatggtttgattgaaggcaggtgtattgaactccaaaatcaaatagccttcgtcatttcccaaagtcgtgaggttggagaataccagctcgct

SEQ ID NO: 11591 - DNA, 474 bp, Saccharomyces cerevisiae
taaaacaattcatcggtccgttggcatatgctcatacatagttgcattttcgattcattaaatactattcatgttaacataattccatataatcgtactgttttgtcattattatatcggcatgacactcaccaatttctttttttgattttgtattgttcgataaggcaacgaacgagtactcgaaaaaatgtcatggaccccttaaaattactgaggggttcagaaaataccgtgcaaaagacgaaaaaagacgaatttcatttgatttatattttataaatgactgttgcattaaacaatagaccaattatttcaatttaatattctttgcaggaaactttcacaatggaataacgccacatattcattgtaaagagcatgtataacaaacactgatttttgttttgagttttaaaagatatccatttactaacattcgaggtgtacaagcacaagttttgcagtgttgcg

SEQ ID NO: 11592 - DNA, 493 bp, Saccharomyces cerevisiae
aacaaccaatatatgcatgggctgagatagaggtacaaggaatttgtaaatcagtaaaaaaaaaaattaacagtttttttttttcattttttttttttattcttatttatgtatgatactttattattatttctcttaattatttatttatttaactaacacgatgagcacttttaactgcaatggttaaactgtagcaatgttggtaaaaaagcagggaaagttcaaaaataatttatgtatttttcctcgggggtacagaaagtaaagagagagaaacgtatgagtatatataggctaatgtaatatgtagtggtaaataaagagacaaaagttagctattcttgtttgaaatgaaaaaaaaaaagcactcaagcgttgtttttttccaattcattttgcaagttttttgtacttttcttcaattcattagacaattcatcgacgttaaattcttgggtagtggaaggttcgtgttgtggaacttctggca

SEQ ID NO: 11593 - DNA, 436 bp, Saccharomyces cerevisiae
ttcggtgaaccctgttaaaataaaatgttaaacttggcttgtgatacaaaacggctcaaccgtgaaatgagcgctgcaaaattattcgagatagactcgcaatttgcacaattgtaacctgaaaaactttttttacttttccggaggtgcatctatcattacagtatgtgataaaggggcatggacttgatatcctagcctactaatctctttgctaaaacatgttgcaaccaaatagggctaccattgtacttctaatgaatactctttacggcgcactgcaatgcgtaataaagttttattgtagcgaggtttcatttttgcttatgttctttttattgtttaatacgtgcatatgtattctataagataaatgtatataactgccaacaaaataaactaaaatcaaggtatggctgtagaaaatgataccaca

SEQ ID NO: 11594 - DNA, 439 bp, Saccharomyces cerevisiae
gcccgaatcagatactcaaatttgaaaaaagatatctttctcctccgacatggccgaactcatttacataaatagcataaattaaacagaataataatacgtaaattacaacagtcagagggtgcatgaaaccgtcattagatagagacgtgatcaaaagtagaaaatgataagaaatcagggatggtcattactttacagaatttatccggtgcggaggttcacaagatactccagagtagatatgacttttgaaggaaacactcaagatatctctacttctgtcgaagaaagaatgaccactgtttttggaggacgcttaaagggtgaaccaccaagatccacaagtagagtgcttagcggcggaacgaagaaaatagcaggtgtccaagtgcctgcaaaaccacaagaacccgataactgttgcatgtcaggttgc

SEQ ID NO: 11595 - DNA, 401 bp, Saccharomyces cerevisiae
tgatattgtccttacaataaagcctggtctttttctcatccaacgaacttgcatcatattcatgaatatttatttgttttagaaacatttcggaaaaaataaggtagtaacagttcagcatatatgatagctaaaacaaacaactatatatcgtatctacaaagtttatcttacttcttctattttttaactttgcttcagattatgataatgaaaaggaggaataaaattctgtcattattcagcatcctccaatgtgtcatagggatataactggggttgaggaggtagtagtcgacaactacttagtcgtgatacaacagtatggataggtactttccacgaacattactgatgacagtcagctattcacgaattcaattgtgttggattaacaaaaa

SEQ ID NO: 11596 - DNA, 478 bp, Saccharomyces cerevisiae
ttttaaagctattgaaaaagatgcgcctcaaatttgatgcataaactcattaagctattgttctcatgggcaaaaaagaatggagttatttgaaaatgaaaggatgccgatgatcctttaaatgttattctatatagttttacttgcgtgaggttagggattggggtttgtaaccatatataatttacaagaaagctaaacaaaagatgccgttaatctgtttagtgacttctgtttcaaggctattaaaattttaggacccttctaagaggtctctaatttgtcgaaatcgcattcgcgaaaatggaaaatatatttcaattttttttttttttgttttacttttttccactctaagatctacattccaaagcacctcgttcgtttgcttcgatgaacaaagcaacgtattatttttcaaaattgcatagtagtatatctacgctttttcttcactagactgcttcctctccgtttg

SEQ ID NO: 11597 - DNA, 453 bp, Saccharomyces cerevisiae
catatctagattgcatgttttatattatacatagttttttttaaagaaaaaaactactggatgaaaaacacacacacacacacatatatatatattatacatcagcggaaattactcgatatctagaaatgcgtacacatgctacatcgatcagctacgtctgaccgaatacttttcaatagtaaaaaagggggcgagctgggaattgaacccagggcctctcgcatgctttgtccccctgttaatcaggaagtcgcccaaagcgagaatcataccactagaccacacgcccgatcttttctgagaaccatgaaaagactcagaatttataatacacatcatggccttccaaagcaactcagcctatgttgaaatgtaattctagtaccatccacttattattggtattcatgttactagtatattatcacatacggcataggaaggtgacat

SEQ ID NO: 11598 - DNA, 400 bp, Saccharomyces cerevisiae
tacataatacgcatatttaaacacacattctatccaggtacacagtgatgtacagttcagtgcatcatttaaacaaaaaggcacatattaaagggtataaggattatatccatcttcatcatcatcttcgctagagacagtgatatatgtctctccactatttctcttggccggttcactttcaggtttttcttctattttagccttcttagcaggtgggttcgttatttcataatcatcatctgttgtggtagcggtggctgtggaggtaactgtatcttcggcaaaatcttcatcatgaattattctgctacgtttcttgtgatagttttcattttcaataatagccttattcagtactagacctctttcatccttgaaatctcttgcctttccacga

SEQ ID NO: 11599 - DNA, 442 bp, Saccharomyces cerevisiae
agaacttggtgaattttgaagcattattgcgatacacatatgtatatgttgataattggtggctaagcttctagtttgtaggcttaagtaacttcactcgttggcacttacgagcttggcatttaatggaacagaaaataagccgtaaatcggccctactttaagtataagaaatatgcgaaatttgatatgatcgtttgaattactttttgaaaaagaaaataccattagtaacatacaatataagaagctcgtctcctggatttggaaatccacaaaagattatcaacaatgccacgaataacataattgcttccccctcctgttaattgctttaactcattattgcatcgttaacagttgttactaaatttgatttttgtttctcatcatatatgtaatcttcaaacgccagtataattatacgctcgcaacagctacc

SEQ ID NO: 11600 - DNA, 498 bp, Saccharomyces cerevisiae
caagagcattgaagaaatgaaaaaaaaaagtttctggaacgattatattttatttacttacttattctacatttatttgcaaaggggcattaacatcaacattttacatattataatatatacaggatattctatattacaacattaacaggatttttaacttttccttaccgtattcttttattctggttttctgtcttcagaataatagcatatttcattgtagtatttcgtcaaagcgagttaggggaggatgactacaagaaagacagcttcctctcttcagcttttagggaaaatcacaggaacaaaagctggaactaagcaaaagaagatgaatttcattaatggactgatatggttatatatgtgtgtgtggatggtacacggaaaagtgacgcagaaggatgaattgaaatggaataaaggatactcgctaccaaatttgctagaagtgacagatcagcaaaaagaactttcacaatggactttgggtga

SEQ ID NO: 11601 - DNA, 429 bp, Saccharomyces cerevisiae
aactacaacccagtaaaaaaagattaactgtatatattgcctgagagttctagatcatggcaagaaaaaagcttgaactcgtaaaagcaaaggtggtttctaccactacttacgagatgtttattatgtaaaggagtttaaatattatcaaataagaaagataccatttttttttatagagaatgtggtgcatctgatgagcacctgaatctagtagtaaccttataccgaaggtcacgaaattactttttcaaagccgtaaattttgatcataaattattattatcttcagtccagaactttctggcttcctcatcagctgccgtatcgggagtgtacatgtcgacgggttcaacttctccctctttgtaacttgcatcagcaaacggtcctatcctagtattttttgaactcgtaggtgtgggcaac

SEQ ID NO: 11602 - DNA, 446 bp, Saccharomyces cerevisiae
ttgtaaggagaacgataaagtaacaacttgttaccgttgcactaatatattatctatcttttcttctttttccttcctttttctcttcatgtgacaggaaaggatatgaaatcattagaggaactaagaaatcatttttaccatcccctaaatcttatattgttttgttctcttttcactataatgactagaatttattctttcgaaccacaagaatatgctatattgctgttaaagatgaagcagaaaaaacctttatctatttctacttcttcctttaattattgatagacagatcgctcatttttttctcatgatgtcatatcctttttaatcatcatacgaaggttaaaatttgaagtttaccaagttttcatgcaagttttgttattatttacaacctattactatattttatcttctctgttgatatcctcacttttgtc

SEQ ID NO: 11603 - DNA, 446 bp, Saccharomyces cerevisiae
cagaaagaataaaataacagactatacagtttaattatatatatatatatatatacgtgcatttttcttaaagaaatataacttttttcttgtactgcctgcaatctctattcttcattcatcacacatctattcaaacgcgttaaaatttttttgttagcctataagtaaaacgcgtcgcgtgtatccaattttactgaattaaattctttactcattggatgatatatatcttcttggtctagacaacgaacacataccaattcagactcacgagaaaaaaaactgtcttcactctgctattagaaaccaaatagtatcaaggcataaaataaacagtggaaaatgtcttctaaaagtgaaaaattagaaaaattgagaaagctgcaagccgctcgaaatggtacatccatcgatgattacgaaggtgacgaatcagatggtga

SEQ ID NO: 11604 - DNA, 495 bp, Saccharomyces cerevisiae
tctgttatttagtgttaaatgcatttctataaactactatatagaatatagataatataaaacgaaaagagcctgatgttgaaagttatgtttcctcgaaaagtaaacaatgatatgtttagcgttcctaaactttagcttaaagaaatggtggttaaagtgaaagtatgaaacagtaggtattattttaatataaatgaaaattaagtaatttctccccagtagagagaatagaatataataaaaagataatataactaaaaaaaaggaaaataacgtcatcacttcttgggtttttcggaaatcttaccgttcttcttgggtaccctggataaccaatacaagaatgttgcagcgatataatcaaaagcaatatagcagataaaaataccgtaatttctccatcttctgtaataatgagaactgaaagtggccaaaaaggcattggtggtggataccgcacagaaactacatatatctgttgcagacgggtca

SEQ ID NO: 11605 - DNA, 492 bp, Saccharomyces cerevisiae
tgaacgtcattacttacctttttattttcttgtatgtgctttcatctgaattattggtggattatgtaacaagttgttgagttttccccatataactacttcgccaaggaaatggtaggtgcgggggcggagaacgcaaaccagcgtatctatggctaaataaggaagaagcaacaacactgttgtaattatgaggcatacatagacacagattcgtacattatttccataatacgtaggaatattactcaaggacaagcggatttcaaccttaaaaggtgaggagtagctgcatgagcatcggtgacggtgatttcaccttactttttcggaatacgaatgtacacaagcggcacaataaagtttaaccaatcttgttttacgtagctatttttattactcttagttttgtgtgtatctgcaatgctacgaagcgcctccgtaaacaccaataatcggtgctggagtactcttatcacaaaaagcccgagc

SEQ ID NO: 11606 - DNA, 468 bp, Saccharomyces cerevisiae
ataactacgtatagtcctttggttcggcgatcattcgacccgcagagaaaaaaaaagacaatggaattgcaaagacgaacgtcagataaactcccacgtttattatcttttgaacaatagaggtaatccttccacagaaatccctgtagaatgcagtgagaaacaagaaaaaaaaaaaattttttttttttctctatcctgcgtgggaggaaagaaaatttttctcgatgagctgaaaagtttttatcatataaattacataaggcaaatccagtgaatacacgtgtatatttgacggtagctctaggtttaggttaggataaactgtagtccttctaacataccacgcaagaaagaaaaaaaaaaacatgtctactaactttgaaaaacatttccaagaaaacgtcgatgaatgcactctagagcaactaagggacatcttagtcaacaagtccggcaaaacagttt

SEQ ID NO: 11607 - DNA, 438 bp, Saccharomyces cerevisiae
taacccagttttcacctggcccattaaaccgcacgatacactctccgctactctcgccaacattctttttatacatacttgcacgaaactgcttttttagcaatgaaaagaaaatgtagtgaactctactatagattttgtacataagataaataaaatacactactatatgaaatttttgtttgtaaagctggtgtttgcacacatagatagtatcaacgtaggggatcaacacatgcacgactactagaagccttacccgtaacttcttgcatatctgctttgccaatatttttttttaaagttatttcttaaactactcctcgtgctgtccacatttttacccgttagttgttagacaaaaaaaaagcgcaactatctcccttttgcgcatctcccaagtcctttaccaaatatattagaagaatgacacccggc

SEQ ID NO: 11608 - DNA, 484 bp, Saccharomyces cerevisiae
aaagcaactcctggatcgttcgaacattctcactccattaattgtatgttagctcaggaattcaactggaagaaagtccaggcaagtacctgacttattttctagaggaccccccagagataagtctggtgatgtggtcctttaataatttcatagggacaattcattttgcgtttttaattttgctcggtgaacaaaggatggcagagcatgttatcgttttcttttttttttcctgttttagagaaaaaggttatatatgtaataatactctgatatatgtacacaaataataggtttaggtaaggaatttatataatcgtaaggatatcattgataagggaaatttttttttttttttttcaaacaaatactatgataattaaaatgaagaaaaaacgtcagtcatgaaaaattaagagagatgatggagcgtctcacttcaaacgcattattctagcatggccttgtaccacggtttgtc

SEQ ID NO: 11609 - DNA, 488 bp, Saccharomyces cerevisiae
gttcgtggctatatatgcacttgtatagaaaacagatatacttctcggtttcaattgtataaatctacaaatttatctcttgcatccgccattccgtatgcaccttgccatgatataggcctgacaaactttacaattggtggcgcgtttttgataactttttgagagattatccattgtaagaactgttgagaatctaatgagttgtccccctcattggccaaacaactacagtacttaatgctgcggagggctttaggcctctgcgacgcattcagtatttggaaaagtattttgaagatcggctgatcaacggatatcttgtcttggaaactggtaggagtaaaatgtaaccagttattgaccatcgactcttgatcgtttagatggaggttcgataaaagctcagcttcatcgtcgaaataaaactctccgagcgaatatacctcctgtggacgtacaatcacaccattttcatcctccattgc

SEQ ID NO: 11610 - DNA, 417 bp, Saccharomyces cerevisiae
tagaacgcttcgtcattagatatacaaatgcaggtagaaaaaaaaacatatataagctcatgtaaatagtgcaatgcaaacctttctgccaaatcccgttccacggaaaaacacgtgctgtgcgggtatccgcaaaaagaagataggtcaaaacaggaatacacagggctagtctttattactgccgctgctgctgctgccgctgctactgctgctgttgtgtgacttgaaacgcgttttatcctcctcaccttatcgtcatttctctatctttttcacttgcacagcttaataagcttttcgacctcctgtttcctattgtcttattccctcaccccgcgtccttcttcgggcagtcgcgcttttctccggcttctgcggtttttcttagtctttccgcaccaattttcacagaaa

SEQ ID NO: 11611 - DNA, 479 bp, Saccharomyces cerevisiae
atccagcaaggatcgttacccggtaaactatttatactacgcctgcctctttcgttcttcgactacatgctacagttagtaaattcaaccaaggaaaatgtatttattaacatgaactagccacctaattaacccttaccttattttttatacccttggatcatcggagtatctgtagatcatatgttaacgtatgtataatattacatctgtcacaataaacaacccgaaaaaaataccgcacggaaaatgagttactgattaagatgcactttttggtgagggtgcgtgacttgaaactaaaaattaccaatagtcaaaccctttccattttcgagggaagcaatatctgaaatttatatttttagaaatttccaagagaaagtggcttttaacgaggttcttcttcttcatccccttttttaccaatattcctttttatggttgtattcgaaataactatacttggggccaatgga

SEQ ID NO: 11612 - DNA, 489 bp, Saccharomyces cerevisiae
tacgaaaatgcatgagatagtaaggctgaaacactagccccggtcagttatctttttttgcgctgtattacgcagagccaccattttttaaaaacattgcaatttataacgttttcttccttattgagggtttcaacgctatcacctactcgatatcgcagtgcagcatatagatatttacatacatatatacatatgtttacgtacactagtaagggcaactggttgacccgcaaacttccttcttactttccgtacttttgccatctttacttgcacctccgtgctacctcttaatgtgtcacaagaagaacgtatgaagtatttgtcagcgcttcagacatcagcatgggttgcaaatgcgtgagattaaaatgaagcgttccagctcgaaagaaaatttgcttatctttcccttctatcattttttttttctcgttttttattttgcattgccttatcttttgccgccagaagaaacaaggttgc

SEQ ID NO: 11613 - DNA, 428 bp, Saccharomyces cerevisiae
ttaaaacttgcttttaatctgcatacataaaacttagatcaaataaataaaaaaaaaagtaaaacaaccatatatactatttcataagcaaaagtaatcaaattaaacaaaaaaaagaaaatacaaatattaaatttaaattaaggcaataaacatatattatacacataaaaagaataattaaagcgcagatgagaactatcttaattatcaaaattctgtagtatcccactcaactgttcaatatcttagccgcaccatttcttcgttatctaggctcactagcaattattttttctcttgattactaattgcatcctgatcgtcttcgatcgaagaaccctgtgaaaagccactaaatgtatgttccaaactatcagggctaactcccaatgatttattgtttcctgctttctgtgaaaccgaga

SEQ ID NO: 11614 - DNA, 490 bp, Saccharomyces cerevisiae
tttagtttagacgactgcataaatggccgcaaataatcaagttgttatccataatttttttgatttttaagccatgttattcttcaggataaaaaaagtggtatttatgaactcttacatatgcgtattcatgctatattataatatcgaatctaagtcaatcgtattctactccggatccatcctcatcatcttcatcgtcatcattatcaatttctatcggaatatcttcgagttctaacggctccttaaactctttgtattggagttcctgttctggttgaccatttatagaagcaaaactattatctctattcaaagcgctttggccctttttgtcttcctcttcatcgtcttcttcatcatcttcttctgcttcctctccgtcttctgcaccgtctgaggattcttggccactcccatcggaaaggtcgctctcagcttcgaaattttggtcattttcttcatcatcgtctgaaaacacacctgc

SEQ ID NO: 11615 - DNA, 489 bp, Saccharomyces cerevisiae
tagggatagataccacacatacctcaggcataacatagataaaccagtacatgtatatctatatctatatttatatatagacaaacagcattaattaactataacaaagtttctagtaacactaacggtagtagtagatttctcttttttgtcctcgttgttaaaaaacgaaagaagaatgaaaaaaaaaaaaaaaaacagaagagtaatagctagtgctttagagctttccacattttgaccgcacttgtagacagccactcttgcgttgccactcgacattacatgaacaactgttcttctccctgtagccttagcttacttcaaacttttttcgtttagcggggaaaatacatcactgaagtaatttttagatcactcgtggcgtaaaagtaagcatatcgcaataatcatactcatatcctttatcatccaaaaagtagtaatagcgctggcaaggcatgtcgaatgagagcacacgagttaccg

SEQ ID NO: 11616 - DNA, 462 bp, Saccharomyces cerevisiae
aaccatatttataggaatttcgatttgtattctctttacgtatgtacattatttttcaaagagtagatagatgaatctctaacgtactcgaaagcttttatgtcgttattttagtactgttttacgagaagcgcgagaaactctctacatatactgtccagcatctcagtaaatcatactgaaaccttattaccagtatcgctcctagacgttccgtttgaagtaataggcaagacgagaattatttatttcccatgatatacataatggttataagtagaccgcaaataaaagtatgtaaaattagctatgtttctacattgtttgtgcaatgacttttaggttcggctggtcattaataactaggtgatgctgaattcacgtatcttattagatacatttagaattcatgacttctcctttgtatgagcgtgtccctccttttcttgatggtttcagccc

SEQ ID NO: 11617 - DNA, 407 bp, Saccharomyces cerevisiae
tatctatttaattctttcaccgcatagatgatatttttccactaggatattccaccttttttttttctaatattggcacttcagttataatgtattttcttcgtctttgttcttatattgtactattattcataatatttattacgttttatatggagtttctttttgattaatggcttcctgctagtattactatatgactatagcaacaaactttgcagttagttttgttgagattgtatgctcaataagtttaagtgaacttctacaagttgtacctcatttctcggttttgaaattaagtattcttggttcaggtttgcagttctttttaatgttgttttttacaatcaaagtatgctcatcggtatatacagaagtgccagtttgggatttttgagtccctg

SEQ ID NO: 11618 - DNA, 497 bp, Saccharomyces cerevisiae
aaaatattcactgtcctctatttatgcacattcacatcatgtattccccaagtatagaactatataaagcattacatttgtatttaatatcaacaaaaaaaaatatcatcgccaatatcgatatacatcatgatgagagcgcctaatataaactgaggctaccattacgggagtcgtcctttgactgacgaggctattttccttatatataaggcatcatcgcttcagtaaaaaaaaaaataggaagggaaaaaatgaagaattgatgggatgaggaaaaaatttgacacaaatttatcgactaccgtttcatactatcatcgggagaacaattacactaagccttataaaattattgattcatcaaaaaagaagataactaaataacaatgcctatgaacaattttctagatgaattcaatttatttgattcaatcattaccatgatgaagaacgacccatgttgcgtcgaggattatgagccaatcgtcgaaaac

SEQ ID NO: 11619 - DNA, 409 bp, Saccharomyces cerevisiae
cttaaaatatatgacaaacttgccctgtaaataaaaggatacgatttgatgtatagctggattcatacagagactagactcatccgccccacagatgcattaattcatgtatatttcacatattataccatatgtagtcattaaactaagataatattactgtatttacatgtatcatcctttatacttttatactttttacgttcgggagattttcaggagattttaaggtttggattcctcattcaatggttcttttttcacatctgattgctctgcttttttcgcagcattttcctttgcgcttgaaacatttggcgctgattctattgtgttgacctttactttgtcttgaggttcctcatcatcagatgtttcctttagttgttctgcataatgctcggggtat

SEQ ID NO: 11620 - DNA, 463 bp, Saccharomyces cerevisiae
aaacatgttcgttcgatatgttcaatccaaaaaaaaaaaaaagaattagaattatttcgacatcataaatgttcgtaatatattattttgtcaattttttctcttcccatttcagcttttttttaataactgaaactggatcaacaagcacatgtttttctaattaatctttcaaacatatttatgtatatacataaggaaaattcaaaaatccgatgcaattaacagaattcttcttcatagttctcttcatccattctttcgtagaataagacgtatacctcatcgctagacatttctgttttgccggcttcaaagttgttgcgatccttgcgatgttgctgtatataatcgtcatcaaatgtaacccaaacttgtctattcagtccaatttcatggctcttttctttgttcacaacagaagtatagtgtccattgataaggttaccggaatgattcaccg

SEQ ID NO: 11621 - DNA, 489 bp, Saccharomyces cerevisiae
caaagtgataaattactgctagtctgaaataatttccttttctttggaaagagaattttaaaagtacttacatatttgcatagtgaaagatttaaataaaaatttcttaaagtgaaacggtttagcataattggtggcatgcgcttaagatagtgccaaataccaaaaggcacaggtgcagacgatacttaaacaatagtgctactacgccacttcgtgaaagctaatatctctttaccttgcatttgggcatgttgcaaacaggaggatcaaaatacaaatggaatcaagaatgctcttctggtatgatactttttgtttttcttttgagcccatgcgtacatttgagctgttgaaacagtcaaaaataaaacggcaaataaattgaacttgaacacaaaagtaaaccaaatccaagaccaaacttcaaaagtatagttgggagcaacaaaaagattgaaaataccttgattcaatgggacacggatc

SEQ ID NO: 11622 - DNA, 439 bp, Saccharomyces cerevisiae
tatacaaacacccgaagcattgatttatatcttactgtagactactacggatgtattctctaaatatttatattcagcatctcaaaataaatactgaaagcatttttctgctgtaaatgcgctttcaatattatgcacccgttgcgtctcgcattaatgtggctgagctccagtaagggaaaataaaaaacaaaaactgttcgcttattatatcatctcttgttgctaaagcacacatcaaatgataccaacgattattattattacgaagttgtattatttatattctatcaaatggcaaacactgtaggaggaattctgtcgggtgtaaatccgttccactacaactccagttcgccgcttacattatttctctttcaagcatgtctcatactactggtatgcaatttaattcacattcccttttcaatgatgaggc

SEQ ID NO: 11623 - DNA, 415 bp, Saccharomyces cerevisiae
tgaaacgaactaaaaagttatagaggattcccttaatgatatttcttatataaaacactacctttatatttccaggttaaataatgacacattaagcatgttttgtttttttgaagaattgtgcagagcagctgtttcttcctaatccacattagtgttcttaactcaaaaaaaaggtagttgttaacagctactttttgtgatccgttaaaatccttctatctacttataagccctaaattaaatgagttgtgcgtatttaaaataaatgtatattcaaccaaagatttggatatcatcgtttttaacagcctctaattcttcgtcattttctattctggcatgttgttcctcatcctcattttcattaaagttcactcgttgacctaacaatcccgcaaagaattcatcgatt

SEQ ID NO: 11624 - DNA, 437 bp, Saccharomyces cerevisiae
tttgtctaatcggggttgtattatataatatataactacttaaaataatgaacacttaatataataaacaaaaataaaataggaaaatcctaagttgatcaaaacttaataaaaattactacttgcactggaatgttagtagtaaattcaacacgtattggaagtcacttggaatgttaccaatactgcctgagaatgagtgattttaacttataatacaaaagtccgggttacagccctttaaatttttttcacggcaatttttctttacttggtgaagccatgaaaaatgtcatcggttcgaagaaataggcctaatgataaacaaaaaggtaattcaaggtttttgaactgctttgttgtttttatttgtatctttttttggtacgttagttaagttaatttttggctccttgtccagcttttccttcatctgc

SEQ ID NO: 11625 - DNA, 459 bp, Saccharomyces cerevisiae
aatctcatataaactcccttccttacagttgaaaacaaaatcaaatcacggtatggcatttctttacatattctcaatacctgactgacatagtatgcgctacatagttttgtcctattttttttacaccgcgatttgaagtctaaagccagagaatgaggaaaaacgaaacaaactgagatcatttgtataaggggagtcactgtacagctgccaataccaattttccttctgccaaatcaaaaaagtatccgcatacacatacacccctccctctacaatcttaattatttactgattcctttcgtatttgtccagtatgagcaatactaagcataccacttctcatcacatggaactcaaaaggatcattatccttacacttttattcatactcataatgttgatatttcgaaactcagtgtccttcaaaatgacatttcaagaactactgccacg

SEQ ID NO: 11626 - DNA, 490 bp, Saccharomyces cerevisiae
acgtaataactcttactaattctgtatataatatagcatatcatcacaacgacgacttttgaacttcctgcctgcacgatccacacttctgtacttgaacctatcgcctagtatactatatctcaatgccgaatcgtcgtcatctgatattgggatttcaaattgaaatactgtgcccttttttggaatgcattttatttcgtctattatattgcccttgacaatcatgataaaaaatttctgagagtcccagatcacaatgccttgaaggcctattaaagtcttatttttgctctttgtaacgcgtaacagcgcaccattatagtctgccatagatagttttaataatgctaatgatccattgaatgtttttaagttttttgtaatgttcaaaagttctttaatatagttaatccatagttccttatacatcggtacaaaatcaacgtactgcggtaatgattcgtatatcgttggatgcttctcctct

SEQ ID NO: 11627 - DNA, 477 bp, Saccharomyces cerevisiae
aaacatcagttcgatacaacttgggtgagagaggaagcccatatttccaattttgaattacttgaccgttactgcaaataataaaaattgacatgtacataaagtatatatataataaaatataaaattcattttgcatattgttattctttcacgctttgttttgatatggtgaaaattcgaagtctctagaatgtcctttaggtacctttctttaagatgtggttcatattcaaaaaatctgatcaattagaatttataccagtgttttaatatgtttatttatctgttattgatattatttaaaatgtgaaacaaaataaataaaaataactaaaaatgtagggtggtttgttgttttgcaaaaaataaaagataagattgatcacaaattcatttcatgaaatttagtaaccgaaagaagccaattgcttagcaacatcggattcagaagcagcagcagaagcagaggagacc

SEQ ID NO: 11628 - DNA, 469 bp, Saccharomyces cerevisiae
ggtccttgccttctatatctgcgccacttttaatcggctcgatgcgactaacatccgtatttacccacacaagcttattgattttttttttgcattcttggatctcgatgggcgcttttactccattagaaccatgctcacgggaagctgagttcttacttagagctggtcatagatatcacctattttgttcatcgccgtgacttctttcggcagggcgactctgctcaggagccctgactcgtgttgcctcgagtaaacggtatgtcaaaaagaataggtccaaatatcatatatatagcaccttgaacccaaacaaatccaattacagtacccgtagctcacatatgtagaaagagctttgcctggcacaagcaataatgtctataatcaaaaaaattgtgtttaagagattcaactcaactttgaaaaaaactgctcttcatgaccttcatgtgtcattaggcgg

SEQ ID NO: 11629 - DNA, 489 bp, Saccharomyces cerevisiae
gagtcctcgtaatccgggattcctactttttaaaggcgtattgtatatatttttggcagctatggcacactaatttctatttccaatttagtgtaagcagagatatagaagcatataacataatgatttactaatgggctcagtactctcaatgcttattgttatcacaaaccacgatactaatacccggaagtcgcgtgatctttttttttttcggaaaatgagaatcgccacttttctaacgaaagaatattgaaatcttaatattggtgagaagaggaataaaagtagctaagagagtcacgggactaaaaggtaaaaagttcagctattccaactttactcctttctgatattgcacctttcgtgaactggcttcgtgtatttaagtgaatatggaagagctgaatattgattttgacgtatttaagaaaaggattgaattgttgtattccaagtacaatgagtttgaaggttctccaaattcgc

SEQ ID NO: 11630 - DNA, 494 bp, Saccharomyces cerevisiae
tagtgaaagacgttgttgcttcctacttgcgtccccaatcgatccgctaaccttttttttaactacagcataacctcacatctacgtatccttacatctataatatttttaaataattgtaaattagaaaaacatcaaaattccgttctatattttgatacatttttttgcagtagtccaagatgagatcagaataagataggtgaaaattttaacaagtactaaagcgttcgttgacagctttctttgcgttgccatggctgaattaaacgattatagtacgatgatcgatattcttctctctgatatggatttggaaacggtcacaactaaaaaggttaggatggctttgaaagaagtatatgcaatcgacgttgaatcacagggaaaagcaattaacaaattgattaggaaacatctagatcttgtaaaagaaaggccgcgcttcgaaagatctcttgaggatctgctaaaggaaaatgctactttggcga

SEQ ID NO: 11631 - DNA, 493 bp, Saccharomyces cerevisiae
gcatatataatgcacatttttaacatctgattactcgcatcgtttctggaagaaaatagctaatattcgttatttatggcatcacgattattctcaccagttacccgtttatgctcttgaagagatttagcattactgccagcgcatcttcaaatacaggtttatatgagacccattactataaccctaagaagagaaaaaggagtgctttcgttttcaatcacattctagtttacagtaattgagtctcgatgatgtttaatatttaccttttcgtcacttttttttccaccattcttgcaggttccctgtcagatttggaaatcggtattatcaagagaataccggtagaagattgcttaattaaggcaatgccaggtgataaagttaaggttcattatacaggatctttattagaatcgggaactgtatttgactcaagttattcaagaggctctcctatcgcttttgaacttggcgttggcagagtaat

SEQ ID NO: 11632 - DNA, 463 bp, Saccharomyces cerevisiae
gtagaggtttcctgttttccttcgaaccctctgttttgcgacttttgtttcaattcaactagtgtcgccaagttttaacaaaaagttacaaaatcctagtgagaggccatcttatgtgcataacggtactctctatctatttacatatctaatactattcacataactatgacgaatcaatgacatgactacatttaccaatgtatagtagtaaaaaaattgccatctcctagaatcgaaccagggtttcatcggccacaacgatgtgtactaaccactatactaagatggcaggtaattattgagtgtttactcaatatctcagaattatatacataacaaataataaatgtgctgtgttggcacttgttggaatgaagctctaaaacatcatgatgattgtgtggattctgatgtaattgttgggattccatttttaataaggcaatatgttggaacgaga

SEQ ID NO: 11633 - DNA, 442 bp, Saccharomyces cerevisiae
agaaagcatacattgaacatagcctggcttcatcttcaccctgctggcaactattgaaaaattgtccagaatttattatgttatccttaaattaatgaatgccatgcacttgcttaaattttgacatcgctttcagtgcattgaagctaccaggatctttgatgagccttctagcgtatttttttgtatgccttatggcgcttttaatatgttcatctacaatttctttaaaatgtcaatggtagcttactttttaagagttatactcctgacaattttttttcacgacataagtttggtggaaaataaatgcagtattatttaattatttaattaatttccttgactgcacaattcatcaggagcgttatacaaataaaagaaatcatactgtttcatattaaacacgaataagaaattcaggttgaattacttggtgtga

SEQ ID NO: 11634 - DNA, 497 bp, Saccharomyces cerevisiae
taaacttaggcgcatcaacagttgagtaagttgattgtattattaccccattcttttctgcccgtccattttattgtctgtttaacatacactaaaacccacgccggattaatatcaatttttttttactttgtttctatttatcattcttccagacataaattattttgtaatattaaagacatttgaaaacctacatacatcgcacacctcttctttcattgtcctaaaaaccacccaaaaaaaaaaaaaagacatcaaatctcttttttttttttttgtagttctgttgccgtatgctatctactcctaaggcttttttctactacggcaatctattcacaatgtgcaattaggctaaatgctaaaaaaagaaaaaaaaatccggagcccctcgatgactcctgtttccgttttatactgtccagcgcagaccgcacttcctacgtatacttcttacggggaagggagcatacacgaaaacaaaaggacccgta

SEQ ID NO: 11635 - DNA, 499 bp, Saccharomyces cerevisiae
taaatttgcttttcgtctcttgcttctctgtaactgtagttttcctcctcccacatatatatatatatatacacttttatacacctaataatatcatcggcattatgattgcttatacattttcataatcaatattactgttcaccatttgaatcactgcagaaatatgcactgcgccttctttttctttgcctgaagcacccacacacaagaacaggaatgtgaatggcctccccatctcacttttacttaatagtattctgacaatataaggtatcagagagtaagaccattattaggcaaacaataatcttcagaatttttagtagcgcattctcaacctttctaggtgcgtttttctaatgaaatagtatcgttttccttccgcattccttgcgtagtttgttgtgtaaatatagcaataagaaaccctataaatcattatgatgtaactcccgattcttttaaataattacataaactaggaaggcaagtccga

SEQ ID NO: 11636 - DNA, 458 bp, Saccharomyces cerevisiae
attatcatttactataaaatccctgcgtttgattcggtctctagggaagcgttgtaatttcatgtatattcaaaataaggacgaggttatataccatactatattatctccttgcattctgtatcaaacactttattcagtacatatacgatacctatatattcattaaatgttcttttcgctttatttcagcaaggtatagtgctatttaaaatccataatcgttattgcgtctctttagtctgtccttcattgccattactccactacttgcgtctggtggcggcgttggcgtgctggaggtgttgaaactgttcgacgttttacttcgaccgagacttgccctgaattcttggcctgctgaaggtctagtcggccgtgatgaagctcttctcggtgtcgcgctagaggagcttgtatgattattgtatatatcttgaaacgatttactcgcaggc

SEQ ID NO: 11637 - DNA, 494 bp, Saccharomyces cerevisiae
agaaacgaataaattctgaagagatattagctaaaaattaagagtccgatttaatagtcataagctagtttacacaattctatagactctgcatatagacggtgcaaataacctacctatttatttatttatttactataaaaaacgtaatattgtttgatatataatattatacacgagatctcgactgcttcaactacggcttaactcaagggtggggggtattttgttgtcgtatatgcaatatgtatgtgttaaaaagatacaattatgtaagttaccacctttgtttcatttcattcattacttgtaaaccttgtaaacgttcttcgtacaatgcagctagcctgctaaccttgttgcttgctttaatatctgaatatcccttttgagagaatttatctgctgtctttgaagtagtttcatttttcttcttcttttcttgtagttctttgtcgaacttcttaatcttcgcgttttggacgagggttaaa

SEQ ID NO: 11638 - DNA, 404 bp, Saccharomyces cerevisiae
agctcgcaactcttttacataccaatttatatattcattatatgtttacatatataaatatatatatatactatatactatatattacttgctaataatattcgtttcttttcaacatttgtatatgcataaaaaatttgggaaatcaggggacttatgaaaatcagggtggttacactcggaacttcaaaacctaaataaagtaaatcactttcaagaaaggtgaagggacgtcaaaaaaaggaaaaaaagggcaaggtatatccctgaggacccctggttggctgtaaagacaaactaaggatgaaagccggaattgagcttataagtcacagccaggcttctcacgccacatatgctaattctatgacccttgcagaaaaggggccacaacgtttaaaaag

SEQ ID NO: 11639 - DNA, 424 bp, Saccharomyces cerevisiae
tagataatatccagataaagcaaaaaaaagcacaactaaaacaaggtattatgacaaaacaggtttcagttatagatatttatagacgttataactttggtataatagaagaattttagaattttagaatttttttttttgaaaaccaatacttaaggaagtattgaacttcacggatgccaaaatttcctcgtcaaattaaaacaattttttcataccaagtcatgcgttaccagagccaacccaggtgagactggatgctccatagattccaagatttacgtaagaattcaaaatacagcctcagttattaatagttaaagcaccgctataaaggtggtgaaaaaggccacggcacaatccacatcgacccaggaaagcatcttacacaaactttgtgaaaaacgccccggataactagagt

SEQ ID NO: 11640 - DNA, 407 bp, Saccharomyces cerevisiae
atattcttgtaaatatatgaggtcttttcaaatcaatatacataatgttacttattattttattccaagcaggtccattttttttttcactttgcacgaaattacataaacattaaaaggacccttgtgtatctgcttaatgatttgcaaaacctgcggaaacggaacgaaaaatgagcaatctcgttccggttccgagatccttttttttttttaaatcttgcgcatgtgcagattttaaaaggcgtcagatatcggatgtccctggaagtaatagctcctcgagtatttcctccgtttattattaatatgagcagttttttaagttctattattacattgatagtagttgcgtaaaaaacaaagctcataaaagtttccgatatgtcagaagtttccaaatggcc

SEQ ID NO: 11641 - DNA, 483 bp, Saccharomyces cerevisiae
caataaatctcctacgaacgaataggtgccatgagatcttgcacctttttgttatgcctaaattactacagctcaattgataatacatgtttgtgcatttacagatgcactcgagtaggttattcaatgaagatatgacatatatcataccactaacaaaacagcactattagcgtctgcactagtggaaagcaaaaaacttttttatagtatatagatggtacaaaaactatgttgatagatataatccaatctacttaaattaataaagtttcaatcttgtccttgacagcgtagatttgggtcttgatagcagaagcatcgttggtggtaatagaagcagcaataactggtctagaaacaccacaagctctacctaaagcaactctagatggaacaaagacatatggaacattcttgtcttcacatagtaatggtaaatgcaataggatttcaataggttcacagtcagcagccataatg

SEQ ID NO: 11642 - DNA, 431 bp, Saccharomyces cerevisiae
agtttttgtatcgcgatgtttgaaaatggaaagtaaggaacgtaatacaaattgacaagtagccgacatgaatgacgctcacttctcttatatatgttaggtagtatatgcattatagaatttattcattgaagcaatgtgattcctcgataagtaagctttttttctgtctggcggcgaaccattagagaacaaaagaccgagttaagaaaaagttcataaaaaacttttgaaaatggatgagtgctcgtataatggaataggaaacttatgcaaagaaataataggttaagaaatttgtttacagtgccagtaataatggctcgacaactcaaaaggaatgcattatctgcaggtcttgcttttgcaggtaatgcaacctcaaatgagtttgatgaacatttgcaaaatgaggttgaaagagagaggga

SEQ ID NO: 11643 - DNA, 458 bp, Saccharomyces cerevisiae
aatattaaaccaaaaaattatgacaacagtaataccaaaacaaacatccaaacaagcactagtacaaagaaatagtcacgaatcattaaatcacatatatatatataattttaatgtttatagatcacttatgatacactttacattcatctttactcaaatgatctctactattgcatttttgaaataattccttttattatgtgccattgtttccatgtgactacccggaacttgtatttctgcgttcgctgaagcacctttaaaacatggctctcgtttacctaagtgacaagcacagtgattcgtgcaataatatcatttgtcacttgcagctgtagcaacgttgatttccatccaaaagttgtagaaaattttgacctttagttcactgggatatattttcctttactagctgtgtttgataaaggtttcaatatggatgcttctgaggaagc

SEQ ID NO: 11644 - DNA, 486 bp, Saccharomyces cerevisiae
gttatgtgcaaagacaagtaacatacatgcacatataaatattatataactgtgatatagaactgcatttttttctttttgaatattaaatatgatggtgtcgcaaggtcgatctataatggtcatcgcgtacgaatggcttggtatgaatttaaaatatggtactataagcagtatagctccagcaagaaggaaaaccttttgaaagaagtgcccgtttacctaaagcaacttactccaaggtagcgtgtgagcaaaactatgatcagttcgtgtgttactagatgttttggtaggggtaaatgccttccagggcctgccactgcctcgatataccaaacgataagatgtatatccactaattcaaataaagctgctgaggcgccaatatttccaaagctggaagacgtgaagatgcatgagctcataggaaacaacaattttggtaaaaagacctactacgtggagagaagcaggaccggaaat

SEQ ID NO: 11645 - DNA, 405 bp, Saccharomyces cerevisiae
cccattacgcatttgattataatttgcttcttaggcaaaattaatatttacgttcttttatattctttctttttgtattcatagaacagcagccattaccaatagaaagttaaaatagccgccgatgcattttattacccgcctttctgttttctgggcacttttctttctagaaggtgaaagaacaatttttctcgttttctcgaacttccaccaagcgttgggtaatgagggaggagatttgtataaaaagagtggcatgtgaactgcctaccgtaagtgacatgaacacatgcattatattttttgtgatatattctttctcttgttttctttttcttgaaacgctacagaaccaatagaaaaatagaatcattctgaaatatggctggtgaaacttttgaa

SEQ ID NO: 11646 - DNA, 420 bp, Saccharomyces cerevisiae
agacaaacgccaattttacgaacgggtttccatagacattgaaaattaacgaacaaaataaaataaaaaaactactttttttttgatgatataaataccgtagattatataaatgtatattaatattataaacctatttgatcaatgacggtgttcgtgaagcattttatgaatatgataaacatagaaagaaattttacactattgtagaaaaagcgtggacggtaataaagctaacagagtatgtccaataaacaacaatgaaattggaagcgtatgacttcgcagcactttgtccttccataaaaatgagtcgctgcttcttttttcattttttggcgcgtcgcgtcgggccgtatagaatatgcgtcacttctaagaacaagattgcagatcagggcagtgcgagttacggagtca

SEQ ID NO: 11647 - DNA, 446 bp, Saccharomyces cerevisiae
attctttcacccatcattcaaaatgcatatgcatactatatttgtctagtttttaattatataataataataacagaaacaaaaaatcgcattcatcgtttaatcttatttttcttttttcacctttttcttgtgaaattgccaagcgcttaaaaaatcgttatttcagaactaaacatcattaagcaacgaagaagagaaaagcggaactataaccatgagtgatactacggaagtccctaggcaatcatctgagaacgaccaggataataacttggaaagaaccaactcattaaaaagtccggacgtgaccaacaatataccaagtcttttcaaattagccgccgaatggcaaatcaacaatccacaggaaaccttccaaaaccatatcctggaaaatgatgtactcaagaaaattaatgaaatcactcatttgatccgggaat

SEQ ID NO: 11648 - DNA, 454 bp, Saccharomyces cerevisiae
tctttctcagtgtttattttcttgagcactgatgctatcaatattaacaaaaactacacaaagtaatgactgagactacaccaacgtttttttttagatttaaagcggcctgtttcataaatctatatagagatgtaatattatattctttcaagggtccatttatccctgaaaccctgtacaaaaaaaaggcaagttgaaattatggtcacaaaattaattttcttttctttatttattttaaaaaaaagtcaattaggaagtgctatggaaatatatgtactcgtacaaaaaagattaagcttgaataatcttatcagtttaagctcttcttctaccagtggtcttggtgtgttgacctctaacacgcaaaccccagaagtgtctgataccacgatgagctctgattttctttaatctttccaagtcatctctcaatttggattcgacgttg

SEQ ID NO: 11649 - DNA, 425 bp, Saccharomyces cerevisiae
aatattggctcactatgtattttcaaaatgacgatcgtccgaaatttccatttttttatttttttttttcacttcttcgccagcgcgagaagggggagaaacaacaatacgagaatgtatgtatacctttacaacacactgctgcagtcagaaagggaaaaagggataattgtaccttacatcctttagaattgcacttaccttttccaattgcgatacatttcactttgatagacaactttgctttttagcgttacttaatttaatcagttttcttcttaacaatataaagagcatcattagctagctttgtttattgacatacgcaatattgctagaaagaaaataagtagagctacgcattgaaagtcaagaaaaatgactggcatcaaagctcaagtccatcccccacctgatagtaccct

SEQ ID NO: 11650 - DNA, 434 bp, Saccharomyces cerevisiae
atttatcaactaccaagcttgaaggaccgaagtgacaaaaaacattatgattttcagtgtttgcttatccgcctttttgtaaatatagattttactatcctgtgcattttagttaattgattgttcacaaaatgaaagcaatcgcgatgcatatcatcaatgaaaggaagacgagaatgtacagtataaacatattcccttgcatgtagcactaaattttaagtttcgtgtagacgaaaggtttagctacttgcgcgacaaaatagtaatatttacaggcattcttaaacattttatatgtgtacatactgtgcgtaaggaaagaaaatcaaagcttgctcaaaaaagcccgcctacttctagcaatgacttcaactttatttttggtgtaatcaaaacgtctagacacaattgacttcttcccgcttttggtt

SEQ ID NO: 11651 - DNA, 487 bp, Saccharomyces cerevisiae
attccaaaaaaaaaaaaaaaaaaaaaaagaagaaaacacagaagggggagtaaaaataagtataccgctgctattgcatatattcgagcatttcattcatgtatttattaatatgaccagataataaagaatattcaatctcaatttctttaacttcaacttcgaaatctttttgtaattgtttaatttcatcatttaatttattgattttaccactgatcagttcctcttgaatgaaaatgtccgttttgtcaatcttaggtttgatttcattttcatatttgatttgtagatccatcaatttagtatcatttaggcgcgactcttctttagtatcttgcgatagcttttccaaattcttgagttgcaaatctaactgttcttgtaagatttctaatttatacataatacctgtttccaatacattcatcaatttcagcttattgttgattaaattttgctttaatcccacaagttccgtttcagt

SEQ ID NO: 11652 - DNA, 408 bp, Saccharomyces cerevisiae
gctatgtagtgctttcctaaacttacattcaaacaacttctaatgtaaaagctttaaataaatgaaatttacgtaaaacaatcactaatattcaacgagaactccagtattcctgtaagttaatactcttacttaagatatacagcccaaacactaaaaaatccttatttattctaacatattttgtgttttccaatgaattcattattacccaactatcttcaattctgcatccggtaccccatatttttctctattttcgtaatatagtcttttcaactccgcaatatacaaatcatggaaatgattaacaacatcatctggcggatttgttattttcttttcaacgtatataggccttccaacaacaacattgataggcgctctaaatggcaacaaaccgaaatc

SEQ ID NO: 11653 - DNA, 474 bp, Saccharomyces cerevisiae
attataatcttgcaggtcttgattgtacttcaaaaatataactaaaataatagtataaaagtaagtctgtcttactatgtatggggcgcgttataattttacgtattcacaaacgagttttcatttacttcatcgtttttattttcggagatgttgccttctgcattactcaaagcgcactccagctttttccagctgtttcatcctaagtttaagtgccatataaatcaacggtgggaaccctaaaacactaacgacacttcccttataaagaatggattttttgcctaaggtggaattgcctattaggctcgaaagttgaatgagaaacccccaaacaatcgaaaattgagagacatcactgtacgtcaaagaatgaagtactttatggaggtcactcttttgtaagtcaagctctttctcttgataggtatcaagtgctggcttgaatattctattgggagcgtcatggac

SEQ ID NO: 11654 - DNA, 403 bp, Saccharomyces cerevisiae
attatgcggaaatggtgttggaagataccagattgtaagcttatttgatcgtttcaatgatggcttatacaagatcacacttaattcgtatcattcgaaacggaaaaagaaatgtggattttctttttcaatttttttttttttcatgatttttttgggcgacgcagagatgagataaaaaaatttttcaactgctattctcaatcgaattttttttgttatcctcacctatttgttacataaatttcgttattttgcacttgttacccatcgttttttctttcaagaaaccaagaaccaatatcctcattaacaatggctgaaggtgttttccaaggtgctatcggtatcgatttaggtacaacatactcttgtgttgctacttatgaatcttccgttgaaa

SEQ ID NO: 11655 - DNA, 426 bp, Saccharomyces cerevisiae
ttgatattgcctttcagtcgaatatatattcaaactagtggttaataaaaacaaagtatgtaaagaatactcagttattcattagaaggcaagacagaagagaagggtgtgaaaccacctctaccaaacacaccaagagatgaacctaaatcaaattttcacagagctaactatataaacgtttggattcgtgtgtactatctttatttacggaaataagttgtaatattaaaaaaaaaaaaaaacattttgatggacaatgaatttctctaattttaactcagctattaattaccttaaattctcctaattcgtttaggtagctttcgacttctaatttaggcttgctcagtaaaacgcaaattttatcaaatgtttcggcattcctaatagactcttcaagaataccttcttcttcgtcgctga

SEQ ID NO: 11656 - DNA, 442 bp, Saccharomyces cerevisiae
tctcttgtccacagcgaagaactcgaaaattataagtatggtaaatgtcgtttcggttgtaaagtatacagatatattcacattacaaaaaatgtaagaaagacggtagtcttgcaaaaaatgtcatttctatatttagcaacaacctaatttttggaaaaagcccttatgagaagcagctagacttgaattatcgtcatttgggtgctgttcaggagttcttaaagcagcagaaggttgttgttgtggttgataacgagcgccaaactgctgagattgagtttgcgcttgaggctgagatggaggttggcctgttgcacgtagctgttgctgttgctgttgctgctgttgcaattgttgctcttgaagttgttgctcctgaagtttttgttgctgctgtctcttttgttgttcttgcaggtatttctgctgggtttgatgc

SEQ ID NO: 11657 - DNA, 419 bp, Saccharomyces cerevisiae
tcctgtaattttaatgtacttacgcatgtatttttttttctcccttattttttatttcctaccctttgtagatcatttattgtatatgtttttatataagtttatataagtttgttatcctttttttttcataaaaaacccgtattagcatcaataataccaccatagtaacgcaagagttaaacaatgattgagaataaggttgaactggtagcagaactagtgttggagtccatcggtaaaactgaggtggtgtcacgccatacagagggaaccaaatcatgccaagtgagttttcgcattaaagattctcccagtgagaagggttcaacatcgtttctctctgagctagtggtgattcagactctggatgacaatgacaagtatactgttgttattcgtcatggtacgtcgatcac

SEQ ID NO: 11658 - DNA, 483 bp, Saccharomyces cerevisiae
atttgtgaggacaacgttaatcatgtaaatattattatttttactttatacctatagaaagttcgaaaaaattaatctatgatattcacatacaaaattttaccattatactggcagaaccctaactcccgctaatttatctactattggagcgattgctgggtgagaaagtatgggaccaattatgggcattgatctcaaaaattgtacgatgacgccaaaaaaatcaccaaagagacctataatacctagagattcaattataaagcccaaaaatgtccatttcaacagtattaagaaggcaccaactaggaaaaatagtgaaccgcgccttttgtttggcctggtaaaaaaaatatatgtcttttgtgaaccgattattaagaatactccaattaaaaacaaaatattgcccaaggccaatagggcacgatcaaaaaaagtaaatataccaaacaaaaagaagagaaaaccgccgaaagt

SEQ ID NO: 11659 - DNA, 498 bp, Saccharomyces cerevisiae
taatatttaagctgcagcgtccctgtaaatagcgataaattacagtaaacgtagactttgggagattgtactcactgaacattttatgatttaatgattttgtaatttaaaaacattcgtatgatatccaataagatgttataaagaaattacaattaatgttgataaaaaatcaattcaagtaatggatatcgatttgttatttcatctcttcatatacaaggcaaacaaaataggtataatatttacaagaaaaacctacatactgcagccacactaagattctctcacatctaggtaacatcaacttctgctcatttttttgaattactatacttgatattgtaaggttccagaatgctttcaggtatcacacttggactcttgacaaccaaatcagccccggtaatactttttgggaaggcgattacgtcccttatactctcagtttcacagatcatagcgcacatacgatcaaaaccaatagcaaatccagcg

SEQ ID NO: 11660 - DNA, 479 bp, Saccharomyces cerevisiae
tatagtacacatatttcaaacatacacatactgggcgttattaggtgtttaagtactggcgattaccgtaataaaattactatttacgtcaactttattcaataagctttttctcctactccgatgttcaattgaggcggttgcatctagcttgaagacggggtattttaatcaattaattgagatcaatgaatattgactctgtgcgattccccacgctattatactctcacggagtatttccgttatgataatgatcactatatacgtcaaatgatcggtttctatttgctaactatttcaagcatcattattatcttttagggggcggctggggaattatttattatatttagttcagtcgttcataagaaaattgagctctccattgtagatattaagaagcactttcacccagtcatccaaccaaacacgctatcaatatgttaaaccgttgcatttcccgtaataccaggctg

SEQ ID NO: 11661 - DNA, 442 bp, Saccharomyces cerevisiae
acgcttgtatttaataatttgttcacattgatgagcacgtgaaaatcttagcgagtatactaagtaaatatgattcttttatgtatagtacagcaaaatagcatttatttttattacgtttaatcttcttcactagagtcttcctcgtcgcttagtcctacaggtgccaaacccggtgtcagaccaggatatctatgatctttaacaaaatcgctctctttgatatcttccttgaattgttttcttttgaaccttcttcttttactcctgtctgtgttcgcagtggaaactgtatccttcaagatggattgctgaatgtcttcaagctcatctcgtacttcctcttctaaatcccacgacctcaaattttgagaattccttttgattaacttattcaaatacttcctctcatggtccgttaatgtgccctcatgttgatgtt

SEQ ID NO: 11662 - DNA, 404 bp, Saccharomyces cerevisiae
cttgacatttgattggtaaagagtatgtattcagatagcgtacaatcttgtatataggcaacatcgcaattcaaaacaccacataccaatttacatacttactatttaaatgtatggatacatggaaaacgttcgtatacaaaaactgaagaggttcagaaaattataaggaggaaagaagaacaaagtggttcttactgaaatcttgttctttgcttgtttttgagacgtctttctcttttctctttcattttttgatctaccttttcttgttgaccagaggccttcaattgacgtcttttggctttttccaattctaatttcttctcctttgccaattccaattcagtttctttcataaactttttgatcttgttcagttcttgctgacgcaagttggtagt

SEQ ID NO: 11663 - DNA, 457 bp, Saccharomyces cerevisiae
gtttattgaggttgtccgcgacaatagttccttcaacaaaataacgaagcgacgataacgagaaatgtcattaggttattactacctttatagaaaatatatatacttatttaatatttatatagatttatgtgtgtacatacctatgcggatgtatgcctatgtgggaattcctaaatgtctttccatcaacgactaaatatatattctcatgactgactatatgggttacgaaaacttaatttttttgtcaaagaccctggcgaattgagaaaacccgctggatagatgggctatccgaaattttgaaagatggaaaaaacattaatctcattagcaaaagaggtaagaccctgggtgaagaaaagtccgaggagggaacacaaaaaagtctaggataatggcacatgaaaagtttagtatacctgagaacttcacattagcgcagtctttgcaa

SEQ ID NO: 11664 - DNA, 409 bp, Saccharomyces cerevisiae
tcagtaaacgcaaggcacaagttttttttaacttttttctttactgtctattatagttccactgtgtaaggttgtattctttccgtacttcaacttgcgggtaacaggattgacaccttttcaattttttccgttattttggattagaaattttcggtaagctcatcgagtattgtaaaagagcaatgccctttgcttattagatgttgaggggcatatctattgttaatatagattgatacagctgtggagattatttctagatatacgatgaagtacattattgagcatatggaggaagggtttagtgaatgggtcattttagagtatagccaaatcctgagagaagtaggagctgaaaacttgattttatcatcgttaccagagagtaccacggaaaaggacatcc

SEQ ID NO: 11665 - DNA, 491 bp, Saccharomyces cerevisiae
attattcacccaacaggtatgtaaaaaaatgcatttatatatttatatatagtactattatcttcccttttctacttaaattttatatcgctcattcatacttaatcatagacctgccctttttgcgtttaaaagaatacaaaggcacatgcatctccttcttttgtctgcataatgtttctaacaaagttagtgcgatatctgtcgttttatcctttcctttttattaatttcacagtctgatcttttattgtgattagataagcggcgttggttttaatttcacgctagttaagtcaaagcagaatagagaatagctctacaagaaaaaggacaaataaggtaactgtgatagcatataaaggcgtatgagtgaaacacgagaatctaatgaaagtacagtttcgtctttacaaaccaaacttttgctcaatgacggaatatccgaaaacaacaagaaaaatgttatactgctgaatcaaatagtgccg

SEQ ID NO: 11666 - DNA, 480 bp, Saccharomyces cerevisiae
aaacgcaaaagaaatagggaagcagagcataaccatagtaaatgggacacttataactcaagaatttaattgaccccctactcatactgaggaatgtggcgtcctcgtcattatatgttcgtaagctaattgggcgaaactttagtctgtcctttctgttcggtcttcacataagatcaacgatttcttcattaattttgggcgcgctgttcaaaaaggtcctggaatgcagctgttcagtagatattatatgtaattatagcctcaacaatttttcttggatcgattggatgagctattcacccatagaggctggattttccttagtttgagaatctgcgactccttcgcgtctgacatcggtcactacgctttctctattctgctgccgttgcgttactttgataaattcatttctttttttttgtaatacagaagaatttctggtaagtttttggcctgtgcgtgttcataagggaa

SEQ ID NO: 11667 - DNA, 444 bp, Saccharomyces cerevisiae
tcgcgatatggacaaacacgttgttttgatttcttttttgcatattcctcatttgaacaaatcttgtgtccatgttatgttacgttatgttatattatgtcaagccgtttcatttcctacttatttttaattatcggtttcttctattcatgtagttcactattcaattagtatatgtagataaaaggagaagggttttatctgcaaacagacgcaagacgtatgtactaagcactaaatactcatataaccatattctttcaaaaatacatgccatttttctgtttcataataatcctggaggctacaagtatggtgatataataaatcttgaaccttgttttactggaactcctaaagtcaagccatacataatgccagaaacaggacctgcgtagataacatataacatgtaccagtcatgattacccaacgtgccgttac

SEQ ID NO: 11668 - DNA, 468 bp, Saccharomyces cerevisiae
tgacctcatatatgctagacttgactaggaaataccctctaacctgcaagatatattcatctttttctttccaaagcacaatttaataaaacttgcaagaacatcgtcatcatttcccccttttatttttgttatccccgttactgatgtaactaatacctaattctatgcttctcaatctgtatagtagttttccttttgccgaagaatttcttctggctgcttttttttttgacatatttcgcattgtccacaatggtcattgcgttaaaagctagaaattaaaaagagaatattgttcagcatatgtagtttaagttggcaaatttgttctgctcttgatgtacctagaataaataaatattaatcagaaaaataaaaaaaaaataaaagtaatgaaaaaaaatataacaaaaccaacattaaggtatatattacagcgagtagcggcaccggttatcatcaaac

SEQ ID NO: 11669 - DNA, 425 bp, Saccharomyces cerevisiae
agacaagaatgaataaattttgaattacaaaaatctaataaactgtggtactgaaattgtatatattttcctatcattcaagagcgtatactcgtaccccgaaagcagctctgtttgtgtaataatataacctaaaagaaataaaatgcttataagatggacattatttttttttttttacaatttaagcatcttcttcaacgacaacggtttgtagacccttagcagaggcaaccaaaactggttcgacgtaggaaaacaatgggttcttggcatcttcttcttcgtttctctttctggagattctcaatctcaatctgtattcaacacccttaacacctcttttccagatagcttggttcaattctggggctagacggacatcttcagtacccatgtgtaatttggcgaatttcttgatttcc

SEQ ID NO: 11670 - DNA, 487 bp, Saccharomyces cerevisiae
ataagaatagtactgcttttccgcaattcttcaatattcattaaaggcggtccggtaccctcttcatagttaatcccatcatacttataatgtgtttcattaaaatgcagttataataacaaaaaattatatttttttttgctgaaacatgccggtacaccgtatttgtaatcacttccttttgtatactaccacatagtcattatccttctttttaattcctttttttttggtttcctttatcatcactatatctgaaagttcaaggttattttagcacttctacattctcgggtgtggctagaattgggcggaatgaaaaaaaaaaactatgtccatcgctttactaattagtgatcgcaccaagaaaaacgagctgtacattgcaattgtacctcttttttttttcctacttagaatcccaatcgtaattaattcactaaattaacatccttaaaatgaaattcgacaatgacagtgagaagca

SEQ ID NO: 11671 - DNA, 411 bp, Saccharomyces cerevisiae
tgaaggaaaaaggtcttggctatatataacggcagacaaaatataagtatacacgtatatatggtggtaaacacgcatatactgtatgccatgtatttaccattacatagttatttacgcactctataaaaagttaacattgcattttaataaattccttaaattactctaattaggatggtagccctacctttttttttttttggcaacacatggtcaacttttcttctcatgctttaaaaggcgagaaaaaatgaaaattagcaaaatgacctttccctccttcccacattgaatatatacactggaagatataagcaaccagtactgtagataaaaaagatcactacgatattcgtcggactccagtcggagtgcagtgcccgattactcttaattgcacgcatcgtg

SEQ ID NO: 11672 - DNA, 492 bp, Saccharomyces cerevisiae
taataagaataatgggatttgttttctttcaagatttttcttttggatagtacatgccttcagaaattaagcagggaggcaaaagataatattttctcatatgcatttatagccgagccttttttcttcgcagtatgcgtttgttttatagtaatttaatgatttttatgtttttgaacaccgcagtcaagaaaacagtaggaaaaaaactgcgggcgtctttcatactgcctttagtagtaagtgtaattttacaatctatacgtaccgatatatatacatatattaatgcatgcatgtatatgtataagcgttgcttttatttcagttttttcgttaatattagatctcgcgggcattttcagatgtaagcatggctgcatacttgtttctcttttctgaatcctcctttaaaagctgcagtatttgatcagttattttctcaataatgctgtaagcctcgtgacaacatttcattagcgtcaacgcatc

SEQ ID NO: 11673 - DNA, 428 bp, Saccharomyces cerevisiae
aaaaataaatgaggaaacacacacatgtgtctagcgtaaatattcttcagttatatagtaattgtattatatactaaaatgaaaatcagtaagattttttttttacaggccttcttggcgttagtttttccggtttttcacttactaagatgagatgatggggcgcacggccaaagtattccccattcatcaatttagcatgctagaataaaaagattaagagcaatatctacgaccgacaaagtgatctatcaaactgctgacaaaaaatgtcgttggaagccatcgtctttgatagatcggagccagaaaatgtttcggtaaaggtacttgatcaattacttttaccatatactactaaatacgttccaattcacacaattgatgatgggtactcagtcatcaaaagtatgcaggtgagaggtgcc

SEQ ID NO: 11674 - DNA, 481 bp, Saccharomyces cerevisiae
tcacttgttactccgcaacgcttttctgaacgcccgccttcgcctttcattatcattctcatcccaaaagaactgtgcatgttatttgcaatacttcatatacgctctgtattattaatagtatcattaattacgtcaattgaaattcaaaatatcatctttgacagtaacatctatcctcttagacaactagggccattgcagtgtctcgaaaccattaatatcactgaaaagatgaaaagaaaggcaaatatatattgatcactaattttctaagctaaagaatctattccccctctgttaaatggaattgtgtgaaataaaatattataaaatcagaactttgggggggaaacataaaaaaatgagaaaaagaaaacgaactaactaatgtttaagtaaaagaacaaaaaggtagaccaatgtagcgctcttactttattaagagattttcttgataacgaaatgtcctccttctcca

SEQ ID NO: 11675 - DNA, 442 bp, Saccharomyces cerevisiae
ggtcactaaaactttgttattcctacgaatatctggatatgaagataaaaaattctctgtctcaatccatgtattggcaatcctattttcaatatacaagtttcctttattttttgtataatttttatacactgtatctttaatttcaattcaactaaatactcaagatctagtcaaaagtgcattatttactatccaaaaaaaaaaaaaaaaatgaagtaaaaaagaagtaacaagaccgaataaaaaaggctcattactgaagtattatattcttatttttgccttttaataatatacatttactttacagtggaggggataagaaacatgataactatcaattagcagcgctaggagcttcagtagaggttccggtagtagtttctgcgggagattcagtcgtttctttttctttttctttttcttcagcgcttggagt

SEQ ID NO: 11676 - DNA, 418 bp, Saccharomyces cerevisiae
gcaaagatataatcctcttatatagcatgtaaatagaaagtacgtaaaaaaaagctactattgactttattctccgtgagggcggttctttctgtagctgttggttttttccagatcttatgtgacacacctgcacaacaatgtcattctctgtcagctgcaagactcccaagaccacgaagctgctggtatcttctatttcagagagcgctgttgctcttattattattaccatacgtatacttttttccattggcaaaagcgatttcaaaaaaataatctccaaggaaataaatggtgcagaaacaatatactacagaaatataccggaaagtaaaccccaagggagttagcacaagatgaatctaagatttgaattgcagaaactattgaacgtttgctttttgtttgcatctgc

SEQ ID NO: 11677 - DNA, 447 bp, Saccharomyces cerevisiae
atgtaggaaagccaacagagtataatatacttaaaaatattcttttagcatacccttttatttcaatgtataagagtttttggaacgctactttataacattcaggtctgttcactagaactcttgtagttgtgccgtcataaaaattagtcttcgcgtggctgaaagaaaagttccaataatacgggcggctcgagtagagtaatcattgccgtcacaaaaccattttcgggtagaaataaagcaatggatatttgagctccagaattaaaatggctttccttttgcggtttactatctacttgactttggctggtatttaaacacaagtaagagaagcatcaaacatgggaaagaaaaatagaaagggaaaagaaaataatgctgctaaaacctcttttctaaaagtagagaatattaaaaacactaattcgggattggagcttc

SEQ ID NO: 11678 - DNA, 497 bp, Saccharomyces cerevisiae
tttgaaagaagaaaacataggaaacctaaaatgaaatgtaaggatatgatgcactgccaccgtaattaaaatagttggctagcgctagctttcttttcatttaaaatttaataactagttcgatcacgaattaatccaatctagttatctgaaaagtgtatatagagtagataaaaaaaaggtttattaattattacaaaaaattattatattctataaattattgtgtggcaaaatgagaagggaaaagtaataaaaaaataaagacaaaggtgaactgtaaggtgaaaaaattatgcgagtttgtccattttcgagactgcttcaagagattcacataagtaatcaacgttcgaatcattgactccgctaagcgacaatctaccatcacctgttaaatagacgaagtaattgtttctcaatatttcgacttgctttggactaaaccttgtatagtaaaacataccgtgctgttgtgcgaaatttacaagatccgg

SEQ ID NO: 11679 - DNA, 480 bp, Saccharomyces cerevisiae
ttcttctggtaaactcttatccagtggaaaacgcacccagcatattcgaaaatatatcaactgtctcccctttttatactaataattaatagcattcatattgaaataataaaaaagatacgtttaatatttacgccagctctctagttacagtttcctaacgcatacgtcatcaatttgttaagatcggcttcgctctataaaaatgtcggccgaaattagcataggattttccgcggttccgacccctatcctagaaacacggaaaaacttgcgaataattccggaatttattctatgcaactttatgaagacaaattactataaatgaaccgctcattcagaaaaactatgtctcgagctcaatggatcttactacatagtttataaaaacagtaattgtgcattgtacaactgtgctaaacagacttaaaaaagtaataattatgactactgataccactgttttcgtttctggcg

SEQ ID NO: 11680 - DNA, 466 bp, Saccharomyces cerevisiae
tagggaattggttcaaaagatgtatatatatatatatatatatatatatgtatgtatatatgtatatatgtatatatgtattacttccatactaaggaagttgtgttataaggtcatttttatgtggtagacatacttcatagatatgcacaaatctctctttttttttcctgttgtcgctattagcttatcaaatttgcatcattttcaagtaacgctgtgaccattctgtagaagtagaaaaagaatatgagaaggtaaaatcccaattttaaaaagcattcaattttgcatctacccaattttctgaaaatatccgtggcgtccagtagatgtgttttcttgtagactttacttgcgttatatgctagaacagggacattcaagagaaatacgaaccagtacccgttaaaaagaaacaatgcagaaatgaaagcttgtagaattgcctctggtacactcaacc

SEQ ID NO: 11681 - DNA, 420 bp, Saccharomyces cerevisiae
atgcatgggcagaaataaaaaaaaataggaaattgtctttacataacatggtcacaaagtaatattccgcatcgttcttccttcagcaaaccgaaggggagcgaattgagccttcaagctacatctaaaagagattccactaacaagttctgcggttattacatatttttgtactacagagaatttaattgcacccgctttatcaccctcgttatttatattcttttctggaatatttagatatgcgtcatttgattattgttgttttttttttttgtttttttactttcattacatcgctaaatataatataaaagagatgaacggctattctttctgaatatcgaaagttaaaactcggatagaaaattcacaagaacataaaagaaaacttccggatttcaaaggcggttctggtat

SEQ ID NO: 11682 - DNA, 435 bp, Saccharomyces cerevisiae
atccacctttcttcttcactttaatgatagaatattaattttccctttatatatatatatatatatatatacgcgcacatatatttacatatatattaatgttttgtaacctatattggggcgattattccctaaatgtaatgtcagggttatactgtatcaattgctaaagtagatctcattcatcgagagcataggatgaaataaaagatacaagaacgtggcggacaagaagaaattttacgaaataagatcggctaaagctttcgctaaatgcttctttgaagtgaaatttaacggcttgtacttaacttcaggttttataacgtatgcatgaagtgattgaattgcgcaattagtggtcctggaaagcaaatccccatcactgacatcactagtgattttatttttatcaagcgcaagatactcgcataa

SEQ ID NO: 11683 - DNA, 441 bp, Saccharomyces cerevisiae
cgccataccacacataatctcgcaattatgtgaagccaaaataatcaagggaaaccataagtcatatttagtgtatgctggcatatcaagccttttcgaacctctttataaatttttgtagtaccattgactcttcagactaaccatgataaaatctttttatagaaaataaaaaaaatggaaatcgtaaatgcttggtatttaaaaagtacccatttcgtgcatctaaatatactaatattcagtgaatggtgataaaggtactccacacttacttggatcactcttgtgatcaatttaagatacctatatgtgtaaccgtattatgtaattatgaagtataagtcgttgaaagacttatactttttaggcgtaatatcagatggaatcaaagaaattatagaaaacagtagatcagagatcctgcctttggaattctgt

SEQ ID NO: 11684 - DNA, 436 bp, Saccharomyces cerevisiae
aaactccaactcctttacacagaatcacgaaaattgtaaataataatgccaaataaaggcattaacttattatcctcttcttttcacatgagaaatgatatagatattgcctattcatatgctaatgagtatatacgggtggacaaatcactacttcctacacctaaaaataatttaccgtttctctttaaatgtgaccacctcaatcttgtaattttgtctgctggtgttatatcctcgtttagctgcgttattaactcaaactttcccaaagtataactgtataaataaatctcaccgttttcaagacccaccgatatcaaaattttctctcttatcatgctgtcatgtatggaaatagcagtgacagctttagtgtgtttaattgatgcttccagaacgtagtcatcagctggctccttttggtgcctccata

SEQ ID NO: 11685 - DNA, 483 bp, Saccharomyces cerevisiae
cgcttaggcataatggtggtgcattcttttctatttgttttctcaggcgtattttttccattattttttgttaaaaatagtaaaaagacagtattatttattcatttttcctcgtgttgttataacgactaagtttcctaatttctttattttgtttttttctcatgatcttttcattttgtagtttcaactattatatacaatgtgtatactataacttaattttattagttacctcttactaaggatactgattcttccccactcatttcatgaattcatcacaagtctttagtatttttcatatggaaattacatcacctatatatatcaaaatgttccggcgagtacattgtcagaatctacagtttttcctgatatgagcagtgatatggagaaagagacactaaataagaacaaaatattgccgtagatttaatgattcaatcatgtgtgtcaaatttgttctccattgcatcttcc

SEQ ID NO: 11686 - DNA, 456 bp, Saccharomyces cerevisiae
aagtaacgagcacatttaacataaacgtactgatctttcgaaacaaatagttatgccgatatttatgaataataaacttgtatatttctttttacttttgcttttcatatgtgagcattggatacttaacttacgctgtacgctattttcaattgcaatttatatatgtatatagaagacagaaaattcactgaacctttttccgaagaaatataaaataaaaagcaacgtacagcagaaaaatagaaaacatcattattactgtttctattgtctaaatttagccctttaaaccccatcatcataagtactaattaccacgaattcaataattagtaaatacattcgactattctcaccctaactttcgtcactttatcttaaaacactagctaaaagtcgtttattataacaaaactaaaaatttcgtagtatgcacgccttattgcccagtat

SEQ ID NO: 11687 - DNA, 481 bp, Saccharomyces cerevisiae
tgcggccctgtgaaaatacatttgggaatcgttgtttggagtcgaagaacagaaagtaggtcagcaatttaacgaagaaagttcaagactaaaagtgtaatatcagtatcaaaagtttggtacttttcatacaagtgcaataaatattaaaataaacaatagccttatttagtggtcttgatttttagtgaaatcaatcccaataactaaaaacagcaaaaaaggcaggcatcacattgaaccgccaccttgatgttggccaactaaacctgccatttccagtaaggcacggtcttctcccaagcttctcaggttaatttgctgtcttcttttagattctgcttcttcccattccaactgtttgatttgctcttctagttctttctcaccaccacagccccatacctcaacatcttgaatcaaaaaatgcaattcataaggggaattttcctcctttctttccatcgacaataaaccaggg

SEQ ID NO: 11688 - DNA, 470 bp, Saccharomyces cerevisiae
tgagttaggcacttacgtatcttgtatagtaggaatggctcggtttatgtatattaggagatcaaaacgagaaaaaaataccatatcgtatagtatagagagtataaatataagaaatgccgcatatgtacaactaatctagcaaatctctagaacgcaattccttcgagacttcttctttcatgaaggagataacatcgtgcgggtcagctgcagtgaaaacactggtaccagcgacaataacgttggcaccggctttggcggctttcgggatggtctccttgcccaaaccaccatcgacttggatattcaaatgggggaacttggctctcaaagtttccacttttggcatcatgtcttccatgaatttttggcctccaaacccaggttccacagtcataacaagagccatatccaaatgaggagctagttcaaataaaacgtcaacagaagtaccaggtttgatggcg

SEQ ID NO: 11689 - DNA, 443 bp, Saccharomyces cerevisiae
atttcacgaaaacaccttgtaaatactacttgtgaatatgcaaataggaaatagatatatgcatacaaataagaaacaatgaacagccttgagttctcaaatttgcatatcatttgttacgtaattccttatcaagaccttttatacaacaacacccatatacccataattattcttaacccatacatatttgtctcaagtttatttttcagatgagaatggccctgcatcagtttttttccagaaactaattcatggtaacaaacatttcgcgccctgctacggggaaggagaattctttttctcccgcccagaacgtaaagccttgtttctttctaccgtactgggcccgtctaattctgcccctttgctgggaaatctcctttgcaagctcccctaccttcgccgcaggcttagtggaggtctcactgaacccttccacc

SEQ ID NO: 11690 - DNA, 447 bp, Saccharomyces cerevisiae
tcttgtgtcttgattcatatatccgtcaataacgtagcctttctttattttcctttcgctcaccatactcttgcattagtgtattttgtcttttatatcgccaataagtgcccaactcttctacctgacccctacgtcgtcgccgccccttttctttttcttcgcctagttctatttggctatatatttcagagtgacaaatctttaagagagacaaactgagaattagcatatagaatcattcatacaactgtttacaaacaagtaagcccaagacagttcccaaccgcttaaagaagtttttcctagagggagcaaagttcgtttacatttcacacacacagttttttttcacttttttgggcctcttccttttcccgtttttttcaaaaagcttagaaatcttcttcacctcctatttttctagaatcgtgaagaatttccaga

SEQ ID NO: 11691 - DNA, 429 bp, Saccharomyces cerevisiae
aaaagttgatggagaatgccatatcaccccaaaaattacacgcacccgatgctaatgtacaggaattatagagcacatgacccatagatttatcgagcattgttgcaatttcgaaagactctttcacataataaagtatgtaaactatatagatagaagatgtcccgtgtctttttgtctactaaatgatgatctgctcatttaaagtcgccgcgactactttgacaaaaaaaaaaaacttagaaaatacgacaaatagagattattgaatgaagtacattgaaaaaagaaagaagaaaggcacatagcagcacacaatgtcgcaccaaaaccagcttattccacaagcttatatttctaactttcataacagattgacaaacgaagatgatggtatccccatctttacaatggctcaacaaacaaggc

SEQ ID NO: 11692 - DNA, 496 bp, Saccharomyces cerevisiae
atataaacgtagtatattttcatccaggcttcttcacaagctctgttagctctttttgagcacggttctaaacactgcagtgctaattcggtagaattgtgtgagcatgaatagtaaggaaactgtgcatgcaagctttctttttttatatatgtaatatccggcagataggatatcttaattacatctatctcgtctgcaagaaaaagttcacgaatgcatctaatgtttagacatcatagaaatgcataaaaatgaaaatggctaccctattccttttcataaaccactttatcgaccttcacttctccattaacgtataaataaatgtataacgtgcaggtattgccttgaatatccaagaggcagaaacttggtgaattagacccatttatatccgaatctgacatatcaacctcgtcttccttaaattggttttcaggcttaacgttgctttcattctcattctcacgttccccagcagtgccttctttag

SEQ ID NO: 11693 - DNA, 423 bp, Saccharomyces cerevisiae
acgagttaaggaaatattagcatatagattttaatttgtatctattttatagatattcaggcatacatatatatctctttctcattgtaatcgaaaaaaataatatcttctctttttattgaaaaaaggaacctgtataaatttcattttagagtgctttgcattttgatacgttttcgcgtttaactaccttcgagggcttgaaaacaaaacattgtgagatgagatgctatcaacagaaagctgactgtgagtccccagaagtccatgtcgcttgatgccttctttcaatcctgttagattcttagagttaccaattgacattagaaaagaagtttacttccatttagatggtaatttttgcggagcacatccctacccaatagatatattatacaaatctaatgatgtggagcttccagg

SEQ ID NO: 11694 - DNA, 435 bp, Saccharomyces cerevisiae
taataaaaggtttcgatacaatagggtcatgtaaatacgtcatatacataatgtaattagccactactgtatacgtttattttgttattatgattaagcttgattaagtttaattaagtttaattgaattttcttaatgaagccgaccgaacgttctggaagagttatataggaatcgggtactaaaagcgaaatttggggataaaaggagagatctacattttatttaaaatacgtcaattcgactcaccctttaaatacgaaaataagtggtctaataaatttgcaaattcggagattgataagaaatatttgagtgagagaaaataaagaaatgtttgctgcaattgcctcaggaaatccattgcaactatcggtagaagtccccaattcaaatgggttacagcatacaattgtcctttctcgaacgaaacc

SEQ ID NO: 11695 - DNA, 423 bp, Saccharomyces cerevisiae
tgggtttatttttacatagaatagtagaactttcttccttttttcacgattttttgcatgggcatttgtcacaatatatatttttattcagttatataaatatactccttttcacaaaagaaggcctaatattataggaaatcagcattaaaaacattatgtatttcttttttcagcggccgaacggtcactagaatgactcagaatggtttttatcatctcgttgccaatgagattagcctctggaagcattggctcaaagaacttttgaacactctgaaattgctttttgtatatatcaaaattggcaaaagaaacaaccgagctccattctctagccgaaataacaaattctaaatcatcttttatgaatgatttatcatggatagctgcatcaattgtctgttctaataagccaggttt

SEQ ID NO: 11696 - DNA, 489 bp, Saccharomyces cerevisiae
tcgattatgtaactacaaccgtaccattaagtgtataagtttcccaggttatattatatattctttagatcactgcctgttctttattacccgcgagctaatctttgtcttatataggcgcgtcagcggagacgcgtcaagtcaacttctctcttctatcgtcccgagtatgaaaaatcatttcagattcgaagaaatcagattggctttatatcttctttagaacaagacgtgtaatattctcacacttagagttgaccccctcaagttcgcttattagtacaggttttgactttgcaaataaacaacaggaaaagcgactcaaataaattgacaaagaaatctcaacaaccagagtgcaaaagccgtacgagcagcgtttttattaataacgatatatcactacgtattcaacagaatatgtcggatagtatttcagattcaaagtcctcagaacttttaaattctactttttattcgtcgacgtcg

SEQ ID NO: 11697 - DNA, 427 bp, Saccharomyces cerevisiae
gattcaaattaatgaaataaacactttttaaaagataaaacctaaaaaattgtatatagaagattcaaagtactataaaaggcattatataggaataaaagatggtgtgcatacaggtgaaaaagaaaactagttaaatctggaaaaaaaaaacgctcatatatatacaaaaacataaatacattcgtcaaaacaaaaagcgcttaaataaataaaagcattttttagataatctcaacgggcgccaaattgaagtcacccgacgcataaaattgtgaacacgccctattagattttacaaagaggaagtctcctcccctataaactgcaaagaataattgaaaagtgatttagcgcagataaataagaccaccataaccacatatgagtaggaaaaaatgttcaaagttccagtgggattagccag

SEQ ID NO: 11698 - DNA, 400 bp, Saccharomyces cerevisiae
tgcatccccatagatatattactgtttttctctttctattttcctgtattgttttaaccttgcctttttgttttagtttcacttcctcacctctcctaattttgtatagttatatttatatgcatgaaatgtataaagtccactcatatttcagaatggtttaagttaagtgccagaaggttcttctgtactattactattacccatttttcatcctatcacccggaatgtaccccttgtgtcattcactacgacgccacgaaccacgattctatttttttcgaaatctaaaggtttcgtcaagatcaatgaaatatacataggcgtttttttggatacgagttgcattgttgagaacacaattctttacaaataagtgcaagggaggaattgtgtgtgc

SEQ ID NO: 11699 - DNA, 436 bp, Saccharomyces cerevisiae
taagtattggcgtatataaacgggtgccagatagaagctttcagagagcataaaattgtacaggatactgcctacaacttactcttatttctgctgctcttagcaaaagtttctgcgataactcttctctggattttacctgtagcggtttttggtagcttatcaacaaagtacaccttggttggaattttgaaagaggctaggtgcttctttaagaagttcaccagttcttcgtaggtcattttttctcccttcttcaaaacaatggcggcttgaactacttggccgtacatatcgtcgggaacaccaaatgcaacggcttcatcgatctttggatgcgatagcataatgccgtcgagctcaatgggtgaaatcttttcaccacccctgttgataagctctttgattctgcctgtaaggaccaaaaacccctcag

SEQ ID NO: 11700 - DNA, 412 bp, Saccharomyces cerevisiae
ataatgctaggacaaacacatttgtaggtgatgatgacagctactagtactactacatatgtttgtatatagaaatatattcgtaatgcgtgaaaaaattaaatatcgaaaaaaaaaacataaaaagtgaaattagaaataaaattcactatgcctatcttccttcttttgtcatatttctaccgttttatcaattgcctcttggaagatcttgcccaatattgactgactttcgaggcctacgctgattctgagaagatttctctcaaccccaaatttttcagccatgtcgagttcgtggtagtatgtcatgagcgtataggggaatgcgagtgtgaaatttgtgcccaaggaaggacccttgttcagctttagattgtcataaaaggccgcagcatgatcttcgtcatgg

SEQ ID NO: 11701 - DNA, 453 bp, Saccharomyces cerevisiae
tttattgttcacgccgttcacttatacgagatagatatactgatagagtgtgagtgatattcttaagtcttgcttttcgagggtgtaagaagctatgttcttcaggcgagattattctactcctgccttacttgtttgtaatatttagttctgatggtcatgataattctatatacagttacattaagtatatacttaagcgggcagcttactaatataaattttgtggcatttttgttgggatatgagaatcatgtatcgttgatttacaaagcgaatttacgttaccaggaatagggaatactctcttgaattctaacataagcacagaaatgctgaaagaatacgtcaaaaagtaaatttacagaattaaaaaaaaaataattgttgccggaacatgaatagagtgtatcaatatacaatataaaaattcaagcattttcattaacggga

SEQ ID NO: 11702 - DNA, 414 bp, Saccharomyces cerevisiae
cacctaatatttcagttctatagggcataaggagaactctttgtgtgcgtcatattttttagtgaactaccagcacataataattgtactgataatattaataataatcataatcataatgtacttgacgatctgatgtgtaggagctagtactcactaaacatggttgtattaaagaatggtattaaaactttttataaagaagtatggagtgtataaagttatcaaacaacaacaaaaacaacaacaacgtaaaaaaaatatagaagaaatagaaatgacatattctagtttttgattaattgttcagtacgaaggaaaagattaagtaaagtgtcacatagaatcgaaatctgtgtccacataacggccatttctcagtaacgtcttgcataagcgtggcataatttcgac

SEQ ID NO: 11703 - DNA, 426 bp, Saccharomyces cerevisiae
ttcccataacaaactccgaggtttgaagtttcattcattggccaggacagttctactttactaatggtttcattacaacctttttcttcatattatgtagcattaaggataatagagcattttttatttcacattcatacacgatagttttataaacgtaattataaacatacagaacattattcacaattgtccagttccaagaattatatgctctcggatctcggagttcttatttataaaatgatcagttacagtgtaatcttgcttagaactttctttttctcaacctttgttttttcttttacttttgcttcttcgagttttttcagatagctgttatacacaaccacatctgctactaagaccaatattccaaagaacaagcacaacaaaagacgaacatggaccggaaagtttgttgaa

SEQ ID NO: 11704 - DNA, 448 bp, Saccharomyces cerevisiae
cgaaaatacctttcggcttacaaatccatctgtaacagctgaaaaaaaaacccagatctgttgatcagttgtaatcgtgtaaacgagtacaaaaggccagagacagcttctactccaagcttaagatacgtatacacaaaagatttttacttgagggagtagagccgaagcgtgtgagtatgacagcgctgcgtaaaacatcagagacgtatgtaatcttcttgtctaatccattattgtcaataactcaagctatatttacatctttagcgaagtcagaaacttattgtcatcctttcaagcctcgccgttgacatccgctgtcagcatcaccctcacctaaagtgttattacacgaagaactgattaaatacgccgagtttgggatgacctgttcttacccgttcattcctttttatggcacactacggttagtatacggcgttgg

SEQ ID NO: 11705 - DNA, 407 bp, Saccharomyces cerevisiae
aataatgatgttgcttcggttttttgcatgaatataacgtgactgttgcgtatgcatatgtgcacgtaatttaaagagagagtgacagaatctgcgcatcagcatgggggcatatacaagcatatgagaatttggataatgtattacatctaatttataaagtttgtagaacagcctctaatttatttagtctttctcccacgcccaatttcgttattagtttgtcctccttgccgattaactccagcaacattgtgggcaacaactctttgttgtaataccgacaccatagagcgtgtccgttaaattctgtatattctaacttcttcagggatgctcgatgaaagcaagccgtgcattgaaccagatcatccttctggaatttcgtgtagccgagaagcaacaga

SEQ ID NO: 11706 - DNA, 458 bp, Saccharomyces cerevisiae
tcttactgacagtctgccgacaaccatttcttgtatatataagaataggtattcacaaactatagtatatactacctgtaaatatgtgcgatgcacaattaacattacctcatcactactacaccacttctactgctagcactgtcctcttgtgcttggccccttaagagtgttctaagaccacgtgaccagaaaaggacgtatcacgtgacacaaacctaataacttttttaggaaaccctaagtcagggcacgcttgctttgtttcttttttttctggaaagaacggaaaaaaaaaaaagtctgggattagttagtgtatattaagtgaaaaagtatagaaataggtgtcgagaagaagtgctcgttgaaccatactgctcacaatactctttcattgaactctttattacgttgtcgtcaagtacaactccttcctttatcgcctgcctagccta

SEQ ID NO: 11707 - DNA, 417 bp, Saccharomyces cerevisiae
acttgaaacgcttcctggccgaaacaaataaaaaatttgcatcattatttattactccaaaatcctctagttactctttcaattctgattttatttgtatttcttcctatatcgtctagtttttctttcctccatgtgtcgtattaatatttactttaaatcgaataaaaaattcttattattttacaagtcattttcaggattagattcattataactttacaaaagtattacataaagaattatataacagatattaggataaccgtataaatagaataaactatacaaatatggcaactcggaaaaacaatagatcattaagtttgagaagagaaaactacgtttgagtttcattttgtgggttatattttgttttcagcggaatccttaggttcattgagttccatcggacct

SEQ ID NO: 11708 - DNA, 420 bp, Saccharomyces cerevisiae
aaattgagttaacgataaataatcgaggcagacacccctttgcataatatatcatccgtttaatttatcttccatttatatactcatacatataccaacggagatctgcatgtccgagaatacaaaaaatagtgaacgaaaaaaatatcacatcgcgaaagaaaagctatctgatatctgcaacacgaaaacacaacagtcgcggcatgcagatagtacaaattgagcaggccccaaaagactacataagcgacatcaaaataatcccttccaagtcactgcttttgattacgtcttgggatggctctttaacagtctacaaattcgacattcaagcaaagaatgttgaccttttacaatcgctacgatataaacatccgttattgtgctgcaatttcatcgacaataccgatctgcaaa

SEQ ID NO: 11709 - DNA, 421 bp, Saccharomyces cerevisiae
aaggatgattgaaatttaagcaattaaattcgtgtaaatactagcatgtatgaggtcatttttacataacaaatattcattacttactttgctttttatctgtgcgcattaaaatgagtttcatatataatatagttacatgtgatgaatgtatggacagtctctgtcatttgtcaaaggagtgaaaaagaccagaaaaggccttgacctcattttctactaaccaatctggtagaattcactttagacgcaaatcttaacgaattgagagtctcattaatatgagaggagcttggtgaaatgtttacaaacattaatgttttcgaatccccagtgagtgaatattgcagtaggtatgtcagttttgagttcctgaacggtatatgtcttttggtactatcaggctgacctaaagcatgaa

SEQ ID NO: 11710 - DNA, 400 bp, Saccharomyces cerevisiae
tactaagttcttgtgacaatgttttctgagaagaatctctcgtattttgtttaattgccaaaaacacatatgtttcgactcacatagagttgcctcagagcgttcttttgttacccattattgctcataaataagtcaaaacagatgtctggtcgcattatcaagggtttgtactggtagcccggtgacaatatattaatctaagcatataacatttttagtaagttcttcagccaccttttttacgatctatgttgttttgaagggtaaacctactaccatgtcatatggatctttcccctagtaaacttgtatctcaaaaggtcatttctgaataaagtgtcaaaaaatcagctaggaaacggtttagtaaagtatgcgaccccaaaattcgacaaag

SEQ ID NO: 11711 - DNA, 500 bp, Saccharomyces cerevisiae
taaagagggataatgttgcatttaaagtacatgttcctctgtagcattcacaaaacctgcatgcattaacaagggctagcattataaacttcatcaatgatgttatagtcaaataaataaataattagtgagtacgttagattacgtattaataataaataagtagtttggttttagaaaaggatggtgtgcttgtcgctgagacacatgttattgacgccaggtttggacgttgtttttcactgtctaccaatcctggtggactttatcgaaagtagttgtaacagcttttctttttggaacgttgtcaaattttaataattttgatccaccttccaagaatgagtatttctctcttctcaaagcttcgtatctggaaatgtattcttccttttgcaatgtaataccaatatcatcaagaccgttaactaggcagtgctttctgaaaggttctatttcaaaatgatcaacgagcacattgccatcggaatccaaaattt

SEQ ID NO: 11712 - DNA, 408 bp, Saccharomyces cerevisiae
tttttgacgacaaccaagaggtcaaatcaatatctaccctttcatttattacgtgttgctggcaaactaatttattccaattctctcatcattagctcaccctttccatactttttcatacttttatacatatgtatttgtagttatcactttaacagattttttcatgtttttcttttctgatacgcctttccctccgcaggaaatgaaagatgaaccacccattacattcgattttttttttaattatatttttgactattatttaatcattaaaaacacatatatttcataaattcgtaaggtcgttagttctatcgtaaaagtgaaaaagttttgagccagttttcaaaaacccgcaggatcccactatgtatggctttaaataatggtttttcacgtgcatca

SEQ ID NO: 11713 - DNA, 430 bp, Saccharomyces cerevisiae
tttaacctatacattaagaccaagcgacttaaagaatgccattatatttgttgtttgtacctacacttatatcaatatacatttaactagtttatgcctccaaacttctatcttcagattttctgtgtcgattccaaaggttttcaagcatgtaagtcacactaatcacaacaccaagagaagcgagcccaactcccagatatacagctgctcggtaacctttcaacaaatcattgccgcttttattaatttggtgttcaacagtgcctcccatacctaaacatagagacgctgaataattaataacggtgtttactaatgatccagccataccttgatactgcattggaagcccgtcactcaatataatggatgatgccgggaaggacaggtccataccaaaacataagatagcctgcatcgcaaagtt

SEQ ID NO: 11714 - DNA, 469 bp, Saccharomyces cerevisiae
tcccacccccaatatttctatctttcattttcattctccttcattgtgtatataataatattattgtcttcgtatatcttccacattaccttttcacttccgctttagttctgtacgtataattagatagaatatcatataaaacctgattttattagtatcgattgcaattctactgcggccattaactgtaaccgaattgaagaaaataaaagaaaaaaagagaacatgcataaatgggaaaaagaaggcgaagcataccagcatctaccagagagacacgagcactgaaagtcgccataaaatgaatctacagaacaacgttttaaatcagatacaccagattctgctgcctacgaatcctactctcgataaacctaatgctgaggctacaaaggaagaattttcgtctgcagaaaatagagatgaaaaagactatcttaccaaccagcagccgaaaaatctgagt

SEQ ID NO: 11715 - DNA, 466 bp, Saccharomyces cerevisiae
taggtgacccctactctttacttatcataaatacatcatcatattttacccttaattaacaacatttatttaactgcatgaactaaatataaggtatagtttctttttcccggaatcttttttttagatcgttattatttagacggcactaagagaaataaattaaactaaattacggtgcggagctcaaggcatctgcgagtgtttactaacactaaaagagatgaataaaatagatttctcaatgcaaaattaaaattacaatgttacgcatacacacaagtacagatttgtatatagtatttcttcttcgttttatctgtcgtgttgaaacattttgttgttcaagtattaaaagtctcctgcgttgttaaaatccatatcatgtgaattgttggtgccgctcatgaggccgttttgatgtggaatattatattgaatgttatgcaatggttgttgttgtcgt

SEQ ID NO: 11716 - DNA, 416 bp, Saccharomyces cerevisiae
tagatgagtaccacttacgatcttgtatataaatgtttttagttgtcctttcttctacattaaaagcatcacaaagaacaatctgacgcgtttttccactgtctctttctcgcgttttattcttttccgtttgagacaaaaaaagaggagctttgtagtgtaatactactagttacttaagggaacacatcaagcattcggtgtctcacaggctactatgaaatataatatagtgcatggaatttgcctattatttgctattacccaagctgtaggggctgtccatttttatgcgaagtccggggaaaccaaatgcttctatgaacacttatcccggggaaacctactgattggggatttagacctatatgtagaaaaggatggtctgtttgaagaggaccctgaatccagtctga

SEQ ID NO: 11717 - DNA, 497 bp, Saccharomyces cerevisiae
tgaagtgtagataatgaacggacaattatcggatatataaattgatgttttattggagaaattttacaaattgcgtatttatacaaattaatttatgttaaataggattttttcgaagtgtatttttaagttttaaggcatatttaacaaatgacgccgatgagaaattgttttgcggtttttcttatttttgcatacgacgaagaagttcctttgtgtatataacaatttttcatgcttccagcttttaagaaagctcaggcgcctcacatcatttgtatttgctgcctcgttgcctattcgtaataatttcacaatgtaggaagatgataaatcgagtattgatacagaaaacgtaagtttgtagtcaatttatgaaaaatcaaaatcgtcgatttggtttctgtatctcaacaaggttttcttgatcttagagttgtccacccaagtaacgtagtcctccatatttctcgttacgaggtaggctggatcgttga

SEQ ID NO: 11718 - DNA, 432 bp, Saccharomyces cerevisiae
ggatcagaataagcttctcttttatttagaatataccgatataaccaaaggaaagttttaataccctggatttttcatcgaccgtcacgtgacgagctgaggttaaatgcccgcaaaagtgcttcagaagagagtccatcttactcggttatttgagcacgaaacactagagaataactaactggttgataaattgttgattgagtaaatattggtacataaaacggttacaaagagaggtagattaggaagggtgaaaataatcaaaggataacttgatgatactcgacaaagaatagaagagaaaaataaaatagaggtgggatattccttgaacaaaagtggaatattattttttttaggcatacatgacgtcttcctcagtatgatattcatacaaggaatcgtcctttggaaggacgctcgtattct

SEQ ID NO: 11719 - DNA, 475 bp, Saccharomyces cerevisiae
ctataaaacttggttcactttataaaaaatggaaagttctcaggcagtgggtcgtgacatgaatattcaaaagtaaaattatatataggaaagtgtttatttgcataaaaagggaaaaatagttcagacttttgtatttttacgtatttatacaaaaaaaggttggtaccggaggctgaggaagccagtacagttggatccggtacatggaattgagcaatcaaccgtaaatatgagcgctttctcaagatattaaattattataaaacaatttatttatccaatttatacatgatttggatcctcctttggctatgtatgttacctctcctttccttcttccttttttgttttaacttttttgttcaagcttttattgtttcttagtaaatttgatgatgctgaactagatggttgggaaaatagtggtaatctcttactagtctcctgccctgtaggtgatgtgattcgctgc

SEQ ID NO: 11720 - DNA, 417 bp, Saccharomyces cerevisiae
acggaatagtcgcgcattttgtacaataaaataggaatgttattaaaatatacagcatagatagatataattcatcacttgtgcgaaacatctcattctcaatctgactgatcatctattacggaattttttcgttatcaatgacgcatcccacaattcctacccttatagcttatctcagaatatgggccgcctttagttgtatagagttagtacggattagtcagtggcgtacctagtggcaacaatcggcagtgactaaaaatcttgcttttgttattgaaagaataataaacaggagttctcgttcctttgcgtcattttcaaccccatacaaactagttggcttgtaccagaactcattaatacttttgtctaactctttcctatttctgattttccaacagctcataccca

SEQ ID NO: 11721 - DNA, 429 bp, Saccharomyces cerevisiae
attgttcaagatcagaaatagagtgaaaaatagggaaaaaaaaaaaaaaattctactaataagaacggaagactactcgccatcatgagattacgacatcttttttatttaattctttgttatatttagccaattgaaaggaaggaaactgccaaaaatcaactagagaaaaattcatgctattcgttgctcctacacctttttttcttccgtagacgaggaaaaacaaaaatgattaaataggcgcgcgcggtgtgatggtgatgataatgatgatgatgatgataatgatgaataaacgtttcggtttacgagtttctttaaatatacatatatgatataaaaaaaaaaatacgtaccacttacaatttgcaaatatagatgatcgaaactgccatttatggtaagacagtggatgaccaatctcga

SEQ ID NO: 11722 - DNA, 474 bp, Saccharomyces cerevisiae
atatatgcccctacatatcaatgcattcaacgtaacaattgcgctaacacacgcgtctttcttgcgcagtaattgttttcctttttcattctttcttcttttgcatctctatcaacaaaatttcggtatctaagcttttcctaaaatatcccttaaatgcaaacctatcgaaaagtaggggaactaccgaatttataattaacgcttcaactttcgacctattgcaaggccaactatttaagatatttcaaactaaagtactgtgtcaatgttactgaaaaacttacacagtctcttacaactaccaattttttcgaatggagcagataagggtatagaaccaaactgccctataaacattccattatcatgttccaataaaactgatatagacaactcgtgttgttttgaatatccaggtggaatatttttacaaacccaattctggaattactttccaagcaaaaacgattt

SEQ ID NO: 11723 - DNA, 439 bp, Saccharomyces cerevisiae
aaagtatttgtcctaccaaaaaaggttggagataaaattaatgcatttttcattagatatatatatatattcatatatattgtttaagttaccattttgtatgtttttctttgaccttactatgcaaccaatgcaggtggtggaggtatatcagggacaaggcctagttcaaacttgtttgctctgaatattttcagtgtttcctctgcgagatcggccaattctagaataccgtccttttcagaagataacccttgaacaaatctaatttttccggtggccgtattagcgttgacattagtagcattcatctgttgttgtccaaatccaaaagaggttgcgttaccattgctcttcaaacttatgttcggatctgtgtttggcattgtttgcccaaatgaagggttcgattgcgagactttgttggcatcgttttgtg

SEQ ID NO: 11724 - DNA, 433 bp, Saccharomyces cerevisiae
aaggaagaaataaagaagataattgccattccgaaaatatcgttggttttcccctgtatataaaaaagcatatctgtttgtacatatgtaggtatgcacacattctgaacattattgatgcgtatatgcttgctacattaattggcaattcattttttagactgttttacacccgtacatttcacagtttttttttgaagttaaattccaactgaatggaagcctccgctcctatgaaatttatttgaaatcagagatttcaggatgttgaacagtatagtactgatttacaagtatcaaagaaacaagaaagacagcaaacacaataagaaatgaccgttaagacaggtatgtgagacataaacaaggaactgaacgggttatgacgattttcgaacttataaaggggtttaccccaaatacgagaagaaca

SEQ ID NO: 11725 - DNA, 467 bp, Saccharomyces cerevisiae
acggactaagagcctgatttctggctcatctaactctctagaggataattttatgtgataaaacttttcctacaagcggctacaataaagacagtacaagggacctcaccctattcgccatcactgcacatcacagtgggtcttgtacttatcatttcacatacatagatataggttcttccgaataagttttgtatatagtcatttacggcaagaatactcatctaagtttaatacgcatttctctcttcgttcgcagttcctaacactgagcgttcttgtttggagggctcgtttaaaaaaaagtctaacaaatgtgacagatttgcttgaacagggtccaaactcatcttgtatatcataacactacatcactgggagacaaaatcgaagtgcccacgtgctgctcattctctaaacggtctgtcgcgggcccttttcgtccttcggtttccctccctttagac

SEQ ID NO: 11726 - DNA, 463 bp, Saccharomyces cerevisiae
cattgagtttgtacattacttttcgtatttctataaacaaaaaaaagaagtataaagcatctgcatagcaattaataaaaaggtgaccatcccatatatataacactcaaatttgatggatccgtggcttgctgaatcaaatcttgtacgctagactctacacttagtccattacccataagcttctcttctacacctttaagggccctataagactcttggttttcgttcctgtcgttgttacttatgaacttgctgacgttatcgaaatttgtaatttcatgttcttcttcaaataagtgttcgtattttttaactggtgacattacccaggaataaaggggatcccattttaagatattcaaaacacacatcaccttgacataatcttttcttaatactgcgtaaactctttcacaactccgcctgaataggccatccacgcctgtgactccaaatccat

SEQ ID NO: 11727 - DNA, 472 bp, Saccharomyces cerevisiae
tccaaccaaaccgtaaataaataatcaataccacaaatacctgtatatactaaacaaacagtagtaataactgtaataaagagtaaaaacaacaacaaagacaatcgtacgtaaaaacaccaagcggacaccagcacttgcctgctgcggactgttgtctgcggactggcgggggtcgagcaagaaccgacgaagtaaccgacggaaggcgggcggagacggagacgcagccgagatctatttttactcagcggtaatattagatcatggctagggggatctggaagtacaatgatgtgctctccccctctcaaacacaacaccaggatgaactaagggctcatctcgaaagtcgaaggtgcctcattcaggttattagtggtgcctgttgtgtcttccatgaacaaggagcacttaattacttgttgttgcatgagatatcatttttttttttccctctttcttggggtct

SEQ ID NO: 11728 - DNA, 437 bp, Saccharomyces cerevisiae
acgatatatcctgtaaatagaaacagctacactgcttgaaagccttaacatgatacatttctggtatgatgccattgttgtgccctgccgggtttatcgtttcctaacaggcacgtcacttataacgaggtgcctgtcgtttaccgcccaagccggttttttcgctggagagtacggtactactagcccaccacacgttcgtggccaggttgataggccaccgttgagcaaagggcagtaaaatatataaaagaggaacaagcgcttccattaagagcactgctaagcctactcgttttctagttctctgaaaaaaggtagcctaaaacaagcgccatatcatatatatttatacagattagacgtactcaaaatgtctcagaacgtttacattgtatcgactgccagaaccccaattggttcattccagggttctc

SEQ ID NO: 11729 - DNA, 428 bp, Saccharomyces cerevisiae
taaattagaaaagttaaagcagcatgttttcatttgaaacaaatactaatgcaataataggtacaccatctactacataattaattgatagtttccttttccgttaagtgcatgcataggacgcccataattttttaagttaaaaaagcatgtatttacctattcgggaaatttacatgacatggatgccataaggaacgaaaatgaaacatgcatgtcagaggaaaaagaacaaagcgagaggaaaaagctgttgcattaccacgtaattttgtatataaatatctgataaataaccattttatttccatccacttcttctgtcgttcatccgttcattgacatcactagagacaccagcgagctatcatcttcatacaacaataactaccaaccttaatgcaaccgatcaccactgcttccacaca

SEQ ID NO: 11730 - DNA, 447 bp, Saccharomyces cerevisiae
aagagaccgaactatcacaaaaaaattgaacgatttaaatgcataagtacatcgattttttttaaatcatatatacacataaaaaaatagataaaatgagagcgtagtcttcacaagaccaaaaaaaaaaatggttcgaacttcctcttttttacacctgttcgatttttctttttagtgtattagaatgttcttcggcgttagcagtttcaattgtttcagccgtagcctcatcaccaggttgatcactcgaaactatacattccttcacgtccgctggtatttccttttctgctttctttagctcttctataacatcaacagttgctccctcgtctagaaccttctccagtaccttactccacaccttctcgtctctttcagtaaaatccgttaattggaacacattatttttttcaagagaccagtcctgctgttgcaaacgta

SEQ ID NO: 11731 - DNA, 418 bp, Saccharomyces cerevisiae
tgattcgataaatagagcacatataaaatcatatacatacattgttacatatagaggcgcagacaatccgtatatcttcctcaaaaactaaattgatagaacaatagtaactcaaatcatatgcattaagcatatcgtgcgagatgacgtttactcctgacgcgcttaacgagaagcggttaagtgaagagtaatagtgctcgcaatttgacagaaatgacaccattttaaaagtactagagataaagagtgtagaaaccggaagaacaaaggtggaacatatcataaggggaagaaatgacacaacataaaagctcgatggtgtacatacccaccactaaggaagctaaaagacgtaatgggaaatcagaaggcatactaaatactattgaagaagtggtggaaaagctttattgga

SEQ ID NO: 11732 - DNA, 448 bp, Saccharomyces cerevisiae
aataaatagcatattgttaatctgcacagaatgtataaaaacaaaataaacaatttaataaagatagaacttaaaggtaattgaagtagaaaaaattaagtattaaaatattgtaattaaatatagaattgttaagaagaacaaggagaaatagtgacatatgataaacatctcttcacacattctggtgactcaattttctgagtacatcaggatatgccctaaaaatctcatcaaacctatgagggtaagaatgatggaagacctccgggtcattaccaagagcaacaaagaaagttgcagtaccggatctaatggcttctgttgcaatgttgcaaatctgtaaagcaataacaaatgagaatgccattagggcgccgttgtaagcgccgttcgaattgtattgaggcgaggtaaaccttagatacaagaacgtgaacaaagcggt

SEQ ID NO: 11733 - DNA, 492 bp, Saccharomyces cerevisiae
gactaattgcaagtcggatgcatatgcacggaaataaaactcatcgcgaaaaaagaaaaaaaaaataaaatctgtgaaaaaatatcaatggtgcaattggttattggtcactcatcaagtaatttgttagtttttatagagttacaattgtataaagataagaacatttagttaagttccccacttattagatcccaaagttaaagttatcatgtgcagtaggatactcttgtccggtttagtcggactgggtgctggtactggcttaacctatcttcttttgaacaaacattctccaacgcaaatcattgagacaccttatccacctacccagaaacctaatagtaatattcaatctcactctttcaacgtcgatccttccgggttcttcaagtatggttttcctggtccgattcatgatctgcagaaccgcgaagagtttatctcatgttacaacagacaaactcaaaatccttattgggtcctcgaaca

SEQ ID NO: 11734 - DNA, 456 bp, Saccharomyces cerevisiae
ggaaaaactggccattaataattttttttcggcaaccttcatgccttatgaaagttgaataataataaagttgttacaatgttcattgtataatccaatatatctaaaataggaaaaagaaatgaacaaatgcattaagctgtgttttactaagtattatgggaaaacgtatacattaaagtggatgcttacatatataacacattgtaataaaggttctttgaacatgttaccagcctcttcagagatcgatccggttctgttgagccaaatactcacttatccaaggataactttcgtcccgcgaggagcagtggttttggaggaggtttaggctttaaatgtgaaggcttaggtggtggggtaggttttgtttttttgtcttttgaaatcgggccacttgatttcagcattgttggcttatctatctcccctttctcatgcagcttgaccttg

SEQ ID NO: 11735 - DNA, 425 bp, Saccharomyces cerevisiae
cactgaaaggaaaagcttcataattttttcttttcactgcatatttctttatcatttattgttattgtatatactttataactattttttaacgcagataatgacaaattctatacatatttttaaaaaaacactgaacgagcgaatacatatctttgcacacagtaggcactaattgactaatcttccatcattatttattttcagctcccactctttaatacacacttctttccgtttcaagattgattgataacgtctagagagagcttgattaaagcaaatttctttacaaaccataacgaacaattgaacccagcccggttgcaatctttcagcttcttgtaaagtatctttaaattccaattcaattaatttaacttcagtttcaaatctcttccagtaatcctccccaatagagccat

SEQ ID NO: 11736 - DNA, 416 bp, Saccharomyces cerevisiae
aaccaggattttgtgtattcccttgtaaatatatagatgacaattgaaagaacagcgctaacaatgtgcgtattctaatatagtgtttttttttttttccaactagagaaaaaaatgaaaaatgtaagagaaacaaaacagaagaaacaagagagaatagcgtcaggatagctcgctcgatgtgatcaggctaacacaatgaacaacgagactagtggtaaagaaacggcgtctgcacctctgtgttcgcccaagttacctgtagaaaaagtgcagagaatagccaagaatgatccagaatatatggacacttcggatgacgcattcgtagccacagcgtttgctacagaattcttcgtccaggtgctgacacatgagtccctacataggcaacagcagcagcaacaacaacaggt

SEQ ID NO: 11737 - DNA, 417 bp, Saccharomyces cerevisiae
aagcccttctgagaaacaatacataatacatcctttcacccaaaaggataatgacaagtaaatgtataaaaatgtgtattaatatgaaaatttttttcccgattatcactcctctttccgctatttttggtagaaggatgcctaacttcaaggattgatatatcttccttattataaagttaaaatgaacaaagcaaaaaggttgaatggtcctcaatagcttggcgatgacttgactaagcgacaccaaccggccttctttatgttagtcaatcttgttttttttatatcctagtttatttgaaacactatacctttaaatattatagacagtataagagatgagcaattaatctctgatcttggcataaccctttgaaataatagtctgaacgctgttgcgcctattttcgagag

SEQ ID NO: 11738 - DNA, 419 bp, Saccharomyces cerevisiae
taagtacgagaacaaaacctgcatgttttatttccttcaatatagctttctacataatgatcacttacatatagcgtaatgtaatatgaaatggcccataatattctcttacattgtcctcctacctacattccttttcttgcatgcagctctcacattccccgattcgcttgaaaaatttaaacttgtagaaaagtaggtgaatgtcccgccggcggtttctctgctgcatgtagaaagatggatatacagaaaaggagataagagtagctatctcaagtttgttccactgactgctaatacgcatagagttgttatttattgtacatattcgaaaaaaagcaagaaatcactacggtgacctcagtagaacgaactaataagtcaaaccaaattaaccgtttccaggctgataggag

SEQ ID NO: 11739 - DNA, 459 bp, Saccharomyces cerevisiae
ccagagatataatggataccacggtatacattatattacaagttagtaataccctatcctatataaaatctagaaaaagcaaaaccttatatattttcttctatattctccaaaaaattattttaacttggattatctgctcatacaccccctaacatgagcagaaccaatctgtaaaattctttggtgttggcttcgattattttgatgtgacttgaaggcttcatctcctttttagtgattaagcctccaagagggtcataatttccacatcatcgttgacggagttatcttacgattctttataattgcaagaaggatatatatcgttatccgctgttgttcggtcattttggacattaacaatactcaggagatcaacattgtaagtccttagttgtatatccgcgtttttaatttagtcgtaatcatcaagcttcagtgaggtgggtgcatcta

SEQ ID NO: 11740 - DNA, 422 bp, Saccharomyces cerevisiae
atatgaaaggtcctaggaatacacgattcttgtacgcattcttcttttttctatcttctttcattctttgtacattagataacatggttttagcttagttttattttattttttatatatctggatgtatactattattgaaaaacttcattaatagttacaactttttcaatatcaagttgattaagaaaaagaaaattattatgggttagctgaaaaccgtgtgatgcatgtcgtttaaggattgtgtaaaaaagtgaacggcaacgcatttctaatatagataacggccacacaaagtagtactatgaaattttctgcgtatttatggtggctgtttttgaatctagcgttggtgaaaggcacttcattgctatccaacgttacattagcggaagattctttctgggagcattttcagg

SEQ ID NO: 11741 - DNA, 459 bp, Saccharomyces cerevisiae
gaataatgcgtttgaagtgagacgctccatcatctctcttaatttttcatgactgacgttttttcttcattttaattatcatagtatttgtttgaaaaaaaaaaaaaaaaatttcccttatcaatgatatccttacgattatataaattccttacctaaacctattatttgtgtacatatatcagagtattattacatatataacctttttctctaaaacaggaaaaaaaaaagaaaacgataacatgctctgccatcctttgttcaccgagcaaaattaaaaacgcaaaatgaattgtccctatgaaattattaaaggaccacatcaccagacttatctctggggggtcctctagaaaataagtcaggtacttgcctggactttcttccagttgaattcctgagctaacatacaattaatggagtgagaatgttcgaacgatccaggagttgcttttt

SEQ ID NO: 11742 - DNA, 418 bp, Saccharomyces cerevisiae
gaacaatcctaatttcttaagtgattatataaccgtaagaaatatttaactttgaaactcctgtatactaatgtttaatatagctggcttatgattttagttctcttctcctattataaatagatacattgattaggtatttttataatatacttgggattaacagatgctatatgaatttttttttccgccgcaagccctcgctagggcggggcagatgctgaagaaaaaattttctgttccattgggttatgtttaaaaatcaacgatattcgaacataatcgatgaccttgatgattagcgaagttctgctctaaagaaattagctttaaaaacagctccattattagtgtaaactgctacttcaactctttactcgaaaagttgaaacaagtgtctattccgcacatctctgca

SEQ ID NO: 11743 - DNA, 424 bp, Saccharomyces cerevisiae
ctataaaagacaatatgcgtaatgaaatttcacttttcatgtgtaataacaataataataataaacattgataataaacattaataatattaatagtaatcataacaattataataatgatataatataataataactgtactcttgacaaaaatttatatatcatggaagaataaatgaaggagagaaatagtaacgtgacaaatagcttatgctaacgatatcaaactaaatctcagggactactaaactgaaatatgctcccatttgaagcctgtctctcatacatcagcgcagaatagtccgattgcagtatttgggcggtgctggacgaagatatgggtctgatttcatttacttcacttcgtagcaatgtaaagctaaattcatcctctatttcatctcctgcttgatcattcctctg

SEQ ID NO: 11744 - DNA, 496 bp, Saccharomyces cerevisiae
gcggttgttctaaccactatttaaagccgcaattagtaatgcaaaaagttggccggaattagccgcgcaagttggtggggtcccttaatccgaaaaaggacggctttaacaaatataaactccgaaaatccccacagtgacagaattggagaaacaaccagttttgatatcgccatacatataaagagatgtagaaagcattcttcactgtaatgtccaaatcgtacatttgaatttcttgtaggtttatttaaaaggtaagttaaataaatataatagtacttacaaataaatttggaaccctagaagatgtcgaaattgggacaagaaaaaaatgaagtaaattactctgatgtaagagaggatagagttgtgacaaactccactggtaatccaatcaatgaaccatttgtcacccaacgtattggggaacatggccctttgcttttgcaagattataacttaattgattctttggctcatttcaacagggaaa

SEQ ID NO: 11745 - DNA, 430 bp, Saccharomyces cerevisiae
agaaagcactagtatcttcaaaatctgtatattataattgatagtgcgctgcttttttgcacttccagtaagaaatagcaacaaaattagataaatctcggtggagttatccaaaatatgtaatatatatcaagaaagttacgtattaaacattggacttctagaggagatcttcaatatagatttaaaaggtgggcaatgcatcgctacgtgaagatttttacttttcttcaacatgtgtattttttatgtttcatatttttatattttgtgtttgctaaggtctaatcgttcagctaagttaaagctaagtataagaagcaaaaaatactaaattatactaaattataaattttcgtacataaataatcatgaggtagatgtttaaatatgtaaatagtttcttttttcttctttgtgattgtcaaaa

SEQ ID NO: 11746 - DNA, 500 bp, Saccharomyces cerevisiae
cgcggctaattaaacaagaaaatataaaagaaaaatgaaagaagtttatattcatattgatgatttgcaatcctaaaaaaaatgtagcactgtaaatactgcttactattgagtattttcattttgttcattccattccctatataatattcatacgtaatcaaatctattgctttttttttctcttttatttcgttgttttagctctgacgttgtgacgctcagccaagaacgtcacaaaaaaaggatgaaaatcaaaaaacaaaatattcaataagtgtaatatgagaagagaaaaaagaaagaacaagtacagtttctaacattatactttaaaaattattaagcacaatgacagcaatgaaagctattgtctggagacttcccaagatgccgaaaatcaaaattacaaaaacttatgaagttacgaaaattacggcgatattgacactagtaggatttataatgggccttgaggtgccgtcattggcaacttttct

SEQ ID NO: 11747 - DNA, 493 bp, Saccharomyces cerevisiae
accctgcacattcgtttcagtaaatgacgtcaattggtctactttggtgaaggtgaatttttttagatgcattgatcgattgactttggtaggttactaattttaccaaaaagagttggtagtttttatttttttaaatagaagaaaacaggtactcattataccgtgattaccaatttcccaacccattatttaacccgttatgtatattgcatatattttgtaaaagcgtttaagctattaataaatctatcataacagtacagctcaaaggcaggaaaagatattccatagtagtctttcatgcgtacttttctaacgttttagtaaccgcatcaaatacatcattcacgatcaaggtaggcttacattcctttaagtcatcaccttcgttatacacacctgtcttcaccaaacaactgttccaaccgtaattttgagctccaatgatgtcacttgcaggattatcacctaccataaaaaccgcatggaa

SEQ ID NO: 11748 - DNA, 462 bp, Saccharomyces cerevisiae
tgatgatcgaacgaaactttgtatataagaacataccttaaggcagtcgttttgaaaatcactgcagctctatttccccctccttacctttttaatgaattccattttacagaaagtactattgataaatattcgtaataaaataaaacagtgttaataataaatgttcgagattccggttaaagataatatgaaatggtgaatgtaatatcattttatttctacggacgtaatcataatacatactttacggctaaataatcgtcttcattaagtctgtcctttagaggctcgatatgtttgtaaccttcgttcaatttgtgcaattcctgttcattaaattttattccggaagatatcaggtgagagagaaaagacagaactctatctatgatgttcaagttactctcgtcagacaagcactcaatcgtactttcaattactccatcctttctcagcaca

SEQ ID NO: 11749 - DNA, 410 bp, Saccharomyces cerevisiae
caagttgaatcgtatgatagaaaatgcaatgactatgttatgaatgtatatatagcacataaagaggatcgcttacgtgaatttgggaataattaaaacgttcttttagctgcggctgctcgtcgataggagtgataacaaattaagaattagaagggatgtcttttttttctaccagcaagttgccacgcgcttcagactttagaagaggtagtagcaatcccttcgaatgaggttcgattatatctctcaccattccacgatttatcacggaaataccattcaaaaataaataaggcgactgaatggattccaaggcagcactagtatcgatatttagtttattttgtttgatatacttttctaattcatagccatgagagtgtttttccaaatcaacagtggccaat

SEQ ID NO: 11750 - DNA, 487 bp, Saccharomyces cerevisiae
aaatttcaaataaagggtgaagaataaagagaaaatgaagaaggtcatagtgtcgcattattctatattctatatgtaaatagtttttatatgtttttagtaaaagaagaaatatacaagcattaaggatcaggctggtggtaaaaaagctgcaaataggatagtctgtaaaggtatccagaatgccaaccagtatatgtaaaacttgactatcttatcgtcacctttcggattttccattttttttggatcagaagttttaaccaatctatcagccaaataccaaaggtgcaagggtaaaaaggaggctatacgattcagaatttggacatgggcaaaaaagcatactatgacgaccagtgctctggtgatccatacgagagccttcaagttataggagggataaattttgctgaaatatatggaggaatagattaaaataataatatttgggacagcaaacaaaaagtttgggatgttgtttggg

SEQ ID NO: 11751 - DNA, 407 bp, Saccharomyces cerevisiae
taaatggcgcaagttttccgctttgtaatatatatttatacccctttcttctctcccctgcaatataatagtttaattctaatattaataatatcctatattttcttcatttaccggcgcactctcgcccgaacgacctcaaaatgtctgctacattcataataaccaaaagctcataacttttttttttgaacctgaatatatatacatcacatatcactgctggtccttgccgaccagcgtatacaatctcgatagttggtttcccgttctttccactcccgtcatggactacaacaagagatcttcggtctcaaccgtgcctaatgcagctcccataagagtcggattcgtcggtctcaacgcagccaaaggatgggcaatcaagacacattaccccgccatac

SEQ ID NO: 11752 - DNA, 405 bp, Saccharomyces cerevisiae
ttttaaatgtcgaaattatgcctggcctgcgtttcttcatggcactttcggaaaaggcggaagaacacaggtaaatgttcttacgaccgaggtcctacagcctcccttttttcttattttacatattaatatacataaatataccataatgcattctttttctaatgatttagctctcctttttttgacaaatttgaaaataaatataaaaagggccataaaatattgagttaaaattgacgattttttttatagaaatgacttgaatttacgatttaaaataaaaatatacctggcatataactaactatacaaatcatcatcttcctccgcattagaaccaaatgcagcacctgctccacttggagcactattattactgttagcattgtccgtagccgtagt

SEQ ID NO: 11753 - DNA, 465 bp, Saccharomyces cerevisiae
agaaaataatgatagatagatgtaatagagtttctttttaaaattgtttatttaaactggtaaacatgatgtactttacgtagcgttaatataccggcaactatacgttggaagcaatagcttgcttgatagcagctgggttggcaccgacgactctggtaacctccttaccgcccttgtagaagattagggtaggcatggaagaaacttcagctttttgagcaacatctgagacttcatcaacatccaacttgtaaaaagcagcgtcagaatattgttctgcaaacttttcaatcattggtgcaatcattttacatggcccacaccatgtggcaaaaaagtcaacaacgactaacttgtcgccagatgctaaagcactgtcgtattcagaagcggattttaattgagtgaccattattgatgtgttatttaaagatatcgtagactctcgtgtatgtgtgcgtg

SEQ ID NO: 11754 - DNA, 438 bp, Saccharomyces cerevisiae
atggcttttattctattaaaatgatctatcatagacacattcataggttaaataggacgttctccaaaatatgtaacaatactatatagaataatatatgtgttttattctgcttttaatatttccagattttaaagttttgatacaaaatatgaaattagggacttcaaaaattctaatttagcctcgaaattgagaaatgaaattagatcataaattaactctaacaaaggagaatatatatacgtacatatatatatatatatatataagttattgtaattgagaaaaaaataaacatcatataaaacttccgttttaatgaacgggggaaaatccatgattattctcagatttgctttcaagcaaagtttttattcagttattttttttaattatctttatcttaaaatttatcagtgcgtttcatcagaatcg

SEQ ID NO: 11755 - DNA, 405 bp, Saccharomyces cerevisiae
tggaaagattaatcaataagcaattttttgcgaacatgattaagtttattttactttatttcgcattttccataaaaaaattttcctccatacaagattcatacccaggatagcctaactaaaatgtatggctttatacagcttgacgacaaacttaatttgaatatatagatatattaatttaatcagcaggattagcatttaatgtcttacatgtctttgtatttggcatacgtattcagtgatattttaatacctcgcaacgcaatttccagcgagtttacgtttgaagcaaacgtaactcccatgagttatacataacgcctgctgcagctgaaccagaacaatataccgtggtattaccgtaagcatttgaaaacaataataagtttccaagtgccgctt

SEQ ID NO: 11756 - DNA, 447 bp, Saccharomyces cerevisiae
gcttagcgatcgccctgtaaaatatccgaaaagttttacttttgctttcctctgtattttttaatttttttacgataaactaaatcatataatattttatatagaaatgataaaaaaagaataagaacaataataaaaaaatcaataatattattcaattgtacttatgaataaaaaaaaaaataatagtgacttgaagactaggaatatcggtcattttcccctataaataaaaaataaaaagagctctttaataataaaaacttgataatatcaacagtatacaatgtgtatatacgcctatttattttaccaaatctatattattaaaacttttttttataattttcaaaatacctttattcatctataccgtcgaaaccaatttcatttattcataacattctaatactcgtaaagttctattcgtaagggcgtcaaatccta

SEQ ID NO: 11757 - DNA, 425 bp, Saccharomyces cerevisiae
aaacccattatactgcatcttaccagcattaattttggtttatatctaaatatggtatagaaaatacttcatcgcgatctcgatggtgattggtcagagtccgcttctcgatgcaaagggaaaaaaaagagctttttaggagcaagtccccccatagagcacataactcgttagcattgaataaggccaggtgacttcaaataataatttataactacgacaatgggtgctgcttatcatttcatggggaaagctatccctccacaccaactagccattgggacattaggactgctaggtttattggttgttccaaatccttttaaaagcgcaaagccaaaaacagtcgacatcaaaacagacaacaaagacgaggaaaaattcattgaaaactacttaaagaaacattcggaaaagcaagatgc

SEQ ID NO: 11758 - DNA, 446 bp, Saccharomyces cerevisiae
gaaacgaaagagcatagaaggaaagtagcgagattcgcgatgttttttcaacccttataatgatgcatgtatatatggtatgtttatttatatatagaactcacggttacttctatcttaaccatttcaacacataataaatacctatgatcaagagaattaacgcgatccaaaagactagtttatctttgaacacccgtttattgatagaggtgatagtttgttccgaaacacccaatgttcttaggccatttgacattctatcttgtaccttggataaaattttgttttgttccactatattttcgaatgattgttggcccatttctagaatgtaatctaattgagcgttacccctttcgaaaacagactgttccttttgtagcccttggtacaacggtagtcccccaccgttgctagagccctctttaccatttgcactcgca

SEQ ID NO: 11759 - DNA, 417 bp, Saccharomyces cerevisiae
tgctaagtcgaggcaatctcgcggcgcgactactttgaagcctttttttagttcttttttatgatcaaaatgtttatataattacccagattatcaacccacttcgatgatgggccgcacctgacagaaaaaaatgaatcaactggctactaaagatggtacaaaagttcactttattcagatatagaattgctgaatcgctgcttaccgccatacgcttgactacttttacacccgtacaccacacatacaaccgtacgactacttttcatgcaacagcgtgcgtttcgacatgtcttacacacgagtagatcatcccactggaaaaatggcttgtcacctgaggcagattttggcaagcccactgtttttcgcaaattatgtactacatgcagccattcactacccttcgagcga

SEQ ID NO: 11760 - DNA, 401 bp, Saccharomyces cerevisiae
cacgcggtttaatttttataagggcattttcgaacttatcatcattatatattatctacttgcatgaacactttaatcacgcttatttaattaagattaaaagatcagaggtgcaattgtgctttgttttatatagtggatttgtgtgaaagggtttgctcccacaagatatggagatactctaaaacagcatatccaaagtacagcataaacataaacccgctagacagcccgctagacagtcttcatttccagaactggccggttgttgttggacataaatgggctgctgtgggtgttgttggtaatattggggctgctgttgctgatagtattgaggttgttgctgatactgctgctgctgctgttgaggtggataatagttctgttggctttgcgat

SEQ ID NO: 11761 - DNA, 428 bp, Saccharomyces cerevisiae
atttttaggtgtcatttcgattttgcattttggattccgtttgggtgctcactatctttttcttctacattgaggtaatgcatattttattaatacatatttataatatttactttggtttttttatttccaaacaaatgtaaaaagaactacaggtttaaaatcaatctcccttcacttctcaatattctattcttcttgtaaagtttccttttcttcctctggtttttgttcagtatgaacagcatctgaagtttcgggcgtatcagctgcacggttttcatcttgtttattttcttcatcttgttcattctctttttcctgtttgatttcttcatccttctcattttctccttcttgctcagaaccttctgtttttgaatcgccttccgattctttcttaacgtcttctggttgctcctcgtctt

SEQ ID NO: 11762 - DNA, 451 bp, Saccharomyces cerevisiae
aggagagtgtttctttatcttccatttctccctattttcttggtagaggaaaacattataaacaataaaatgaaatacagaaagaaaaaaagttattctcttatgtctatgtatataacaaaccctgaatgagcatctatataaaaacaaaaatatataaacaactttatgtcattatcataattgtcaatgggaggggggagaaaaagaggaataaggacatacgtaccctgtgtctttgtccatgcaccgtagaaattgctttttttatatatttttcagacattacgtcagccttattgtataatcatcaccactttgcgtgatatatcttacccatgggtaactcttatactgcaatttgggttcgttaattttaagataacgtacttgaatacctgaagtagtaaagtagggtatttgaaatttgatttggacaggtcccttcaag

SEQ ID NO: 11763 - DNA, 463 bp, Saccharomyces cerevisiae
acagactgatcgttcgttgtacgtacatttacaacaacaccaattctactcaccgccataaataacactttaattttaatatatacttttatatgcatataaccaactgacttccatacaattctgaccagagcacttgggcagagccccacccaggccttgtcggaaaaaatcggaatatcccacacgatccaccggagaatatcgggacgctgacgggtgaatggagatctggatttcctaatttggatacatctctttcttttttgactcacaataggaaaaaaccgagcttcctttcatccggcgcggctgtgttctacatatcactgaagctccgggtattttaagttatacaagggaaagatgccggctagactagcaagttttaggctgcttaacattatggataggcggataaagggcccaaacaggattgtaaagcttagacgcttctggttgg

SEQ ID NO: 11764 - DNA, 495 bp, Saccharomyces cerevisiae
ctgatatttattggtggtaaaaaaatgcatatgtggcacattccactttttatatctatttattatgcattgtgtagaatagtaatactggaataattagaaaaaaatcatttaaaggttatgtaagttatatacacaattggctttcttttggataagttgagtgagatgggtgattggcggggataattataacatcataatgcttctaatctatcatttatttcttgagaagttaattttctaaatctagggcctttatcggttggaataccagtgtagcctagcaagtcagggttctcatcgccaataatagccagttcaatggtgtcaccattgaattcgccctctaccgactccttcagcgttagtaaggcaatatgaatggcgtcttctagttccagttcatcattccatcttttctctaaaaacgtttttgccgccacagaaccttttcctatagcggtggctttccaagggaagtaggaaccggaa

SEQ ID NO: 11765 - DNA, 458 bp, Saccharomyces cerevisiae
ggtaaaacgggaacctaaaatgagttattgcaattgcatatatgcctaatacaagtggtataaacctcgaaccgtgttcaatcacatgccgtttaggagattaaaatacttcgggcaatcaaatgtttgtatagataagtcttgtaaataacacggaaagctatgtattttagtttaaataacgtatacgccctctgtgattagcgatgaaccgcaacgatcacaattcttgcttacatgggtaatataatgcttgaaacaatcaacatgccaaatttgagacagactattctctccagtttcctcattctcttctcggcatgattcgttgccgcacctgacaccttgaattgccagcttgtggcaattttggcaagtgttcaaattgtacatggatgttagatactcttctagttctgctatacagcgaagatcaataccgaatttcccttcctgag

SEQ ID NO: 11766 - DNA, 441 bp, Saccharomyces cerevisiae
tagtcgccatgctaaacgcgcggaacaaggccatatttatatatttaatgcttttaactattattagtttttctcacccagggctggtttctttaccctgtgtgatgaaagtgcgcgcctaaagttatgtatgagctactgttagtatatttattattcaatatttaattaaacaatacttactactgatgaaagataccgtacacctgctggcgaataagtcactatacacgagcaattatatttctcaggtcattgcgacaattgaaaaatcggatcgactgattatcattaaggcgtgtgacggctcagaataaggaagttctattttaaagggcagcaaaaatttggcacaatttaaaaagaaagttggtctctggtagggttggatccggtttttcataacttgcgtttcatttatggttgcgtatttctcgcagt

SEQ ID NO: 11767 - DNA, 491 bp, Saccharomyces cerevisiae
tgatagtaatagaatccaaaaaaaaaaaaaatatacatgctttttcatatcctctctcaccctatctttttttttcttctaattttggctccgttcatatcttattcaaaattaattcagcggtaatcttatctttattgttagacttcgcagaaatttcctttagcttcgatgcagatagtttgatcaagtcattttgtttattacgtcccagttcgcgagaaatgatgttaaccaatgcccacccttttaggtatagttcgctaagttcaacgctcctcaaagcattctttaatgccttttccaagagctcggtcttggtttgtttcttgctacgtagagcctcataatacagagtctcacttagcctaccaaaacaagcgtaattgaatggtgtaatacataggacctgttccaaacaataacaggctttttcaaattggcccatttcgaaataaatctcgctggcataccaccacaattctgcatca

SEQ ID NO: 11768 - DNA, 424 bp, Saccharomyces cerevisiae
tgcatatagatatataaacgtacctacatagttttgcatttgtatagatacccagaccacttgtaataacgataaaaataaaataataataaaggatatttacagacaaatagcaccatacttgctattaaattggtgtcttggtattttcagctagcaaatcgatcttttggccagcggcagtgacgctccattcatgaatcaaaaactcttcgtcgtgagtgttcctatcggcaaccagtctaacggttccagtaacgtttttgtcccccttgatataaaacgtaatgttaatcctacccttcacagagttcagttcaccgtagacccaagggatgataccatcaaattctatgctctcacccagtatgtttttagttgctggagaccgtcttatataatacagcgtgttggagataatggg

SEQ ID NO: 11769 - DNA, 472 bp, Saccharomyces cerevisiae
gtcgaataactggataagaaatcctgattttgaaaatatttggaattcaactagcatatttatcagaccttgttccttggggtactggaacagcatatacctaatagactttcggcagagagcagaccaacttcataaatatttgagtcaccaaagttggctagcaatctgcttttcctttacagatgtgcttggtcaggaacaatttatttaattacattcgtacttcttttatagaggaaatagtagctaacatttcactattgcggtcatgcctgttgttcttcagctaccgtttatgcaaaggtgtttaattaggtgtgagacttaagtgggccttttagtaccactgtgggttctggacctttatataatatttcattttttcaaaggttttttcatatgccgttaaaagaggtcaaaacatagacccgaggaacatatcttgtaaatcgctgcgttatgtatgcat

SEQ ID NO: 11770 - DNA, 413 bp, Saccharomyces cerevisiae
tatttcttataacacgacggcatgccctccctaactcgacgaataaaaataattttcacaataaaaaaaagactacaaaaatcagaaactttttcattacgccatttgctacgatacgatacacaacaagcacattctaagagcattccatttactatggtcaaaatgaccaaataaaaaattaaaaaaaaaaagaaggaatgagaactagtaactacatattcaacaattgcagttttcttttcctttttgtccttgtcctttctttcctatttatatatatatatatatatatatataatactactatgttatattacattatattattatcacaataattattacgttcatcgtgccgaaacgtcacctcccacggtttggatctattgaaagagggtggaatccctgat

SEQ ID NO: 11771 - DNA, 474 bp, Saccharomyces cerevisiae
agaaaataagagacattatgaatttggttttttttacaatttacgcatacacaatatatacattcctactagcttttttttcttcaattcgatagtttagatgggtttatatctaaatatatatatatagtattttatttcatattcaatctcctagtatacatgaaatatttaacgcttttttttgcccttgtttttattttttttcttttttgaagctgcagagttaccattgttattttgcacagcattagctttttgcttcggttctgtagcagttttcttagccgcaggatcgctcttttcgacatctgtgttgacaattaaggtggctaaaccaacaatgtcttggatgctcttaccttttatttttttactcgattcttttattttgttatttttcttcttcgactgtgctattttttcaattttacctggagttatagatacgcctcgtgggcctaatgcactaag

SEQ ID NO: 11772 - DNA, 454 bp, Saccharomyces cerevisiae
caatgaaaaatgcgtaaaacgtttattcatcttgcatttctattaggtacgcgattactgaaaaaacgaatgtatttttttgttgtagcgcaaattacgcaccatcatatattcacatataacctaacttcatcgtcagaatacaatactagtaacttagcattaaaagccaccatcaaagggaagaagtgaacaatataatgagtgactattccctgaagcattcggtcactcagtatttggaagaaattcctcaacaagttcaaaataggctttatacctcaccagctacatgtctggctatctatagaattttaccaccactagctaaattttttatcatggcaatggttttcaacgaaaatgaagtacctttgttggatttagataaatgggttaactctaatggtaaattgcagtttcagaatgcaatcaaatcgatgaagtctttgca

SEQ ID NO: 11773 - DNA, 475 bp, Saccharomyces cerevisiae
tacgacgactaaaaagtttgcattcaaaaaattaatctactaatttataatcaacgagaaatgttgtgtagctcacaattcattcattatgttgtggatacatatataaataaagaaaaggctaaaaaaaaaggtgggtaacgtgaattaggttatttttcatatatgcacatgtaaatatatgcgtatataaatatattattatttgtatcattacatacttaaaatctattattgcttaaaaggttttcccgatgagcatatgtaataatattgggaattaaggtgcattttcgtatccttcattgtgtatctacaatctcttcaagaaattcccttatttgctttaaaacggtttcccttgttgaatccgataccatttctagaaaaaaaaattccactgttagtaacgttctcttttcaataaatttagtgataaaatattcacatacctaatgctttgggttctacggtg

SEQ ID NO: 11774 - DNA, 405 bp, Saccharomyces cerevisiae
aataaaagaaaaaatcaaaaaaaaatcggatacttctgcatatgtaacattacacagtcatacatttatatatacatatatatacatattaatgtatttgaaaaagcaaaagaaccattctatccttagttaaagggcgaatcagtagcagcgctaccactattgttattgttttcgtttgctgtcatggtatcgtggtggtaaataatactttcttgaagtgataatgttgatgacgatgctgctgaagggctacccatatctaaagatttgaacagctggagtgggcgttccaataacccatttgaatgttcattgtatacctgtaatcttgtcatatgacttttccagacggagctattatctgctaataaaattatcctgtcacgggcaacatgttcaata

SEQ ID NO: 11775 - DNA, 476 bp, Saccharomyces cerevisiae
gaattctttaccagttccatgaaataacaaaaaaacagtaaaaaaaaaatgaaaatgaaaaaagaatacatattttgttttaatgaaagtttgttaccaagttttgctttaagtttatcatctctgaataattattttgtcttttttgtcaccacttttttcttgtcacatttttttcttcttttcatattcatttcatatattagcccgttcaatatatttcaaaagacccagtatttttcacattttacccttccgattctttgtgtagtatatacaaattacaaaaacacacactgagaaaaacatgcactaataaaaaataagatattatgtactaacgtaggaaagcaggtacaaaacctctgctgtaatttcacgattttctttattgatcattaattttcttcttttttttttttgtattatgtataaatgaaaataacaataaaaaaggaagtagatgcacgctgcac

SEQ ID NO: 11776 - DNA, 479 bp, Saccharomyces cerevisiae
gtaagcatccatagatatttaaaagtttatttttgcatataaatataccttcatagagatcaacaaaactaaaataaagaacagacctaataaaacgctatatgattctgtgcatttgaggagcatctagcttctaaatagataattaatgcaacttacttacttattgaagtatgtacagtggaaataggagctttctctatttgctatcattctttgcatcatgttcatgtactttctgccaaactttttcgtagtacttcttattttcgtttttcagttcgtctagtgaaggcggtaatttttcattaattaaatcgtgctttcttgccctttcaaaggtagacagggcttcatctaaaccctttacaccattagataaagcgccacgtggcaacacgcctgaattgtgatcttttaaaaactgaactttattggtttcttctctgagaacagaatacattctggaaactttggcg

SEQ ID NO: 11777 - DNA, 423 bp, Saccharomyces cerevisiae
tttttatgcatcttttataattgcgacttccacgtgttcgcaggtggagcaatgttacacacgctgtcccaacatattagctctccaaaaaaacgaccaagtttatttaagtgacaaataataatttgctgttgctctagctgaaatttagaccagtgctgtcattatcgactcgtagtgttcttttaatagtaaatttcgtcaaaacgtttctaattcacttaatagcgccaactgaataagagaattatttttagaacgtgcacattatattaaaaagagagcgttggctgacagaagtaaaaaataaattattgtcttacaaagtgagactattaaagagtttaagttttgcaattagtgcttcattgaacaataaggcaacggtagcaaaaaatttaaacccaactaagaagggaaccc

SEQ ID NO: 11778 - DNA, 425 bp, Saccharomyces cerevisiae
cttacataattgtatctttttaacacatacatattgcatatacgacaacaaaataccccccacccttgagttaagccgtagttgaagcagtcgagatctcgtgtataatattatatatcaaacaatattacgttttttatagtaaataaataaataaataggtaggttatttgcaccgtctatatgcagagtctatagaattgtgtaaactagcttatgactattaaatcggactcttaatttttagctaatatctcttcagaatttattcgtttcttcgtatattaccaatataattgattgctgaaccagctttgaaaaaatcgatttgatctttagacatagtatgttttgccttgatggtgaacgattcaccgtttggtttagtaattttaacatcaatttcaccaccgttattaccatcc

SEQ ID NO: 11779 - DNA, 468 bp, Saccharomyces cerevisiae
cgctaacgctgatggagtattttttttccgtggatgatacctttaaatgcatattaatcttcgtacataaagtaaagaaacacgatacacttaaataaattttaatctaataattaatgaacgctaacaatgagcctatcatttgttgccgatatactataacgtatctcttcgaaagaacaaaacggagtgagtgcctgttaagggtaactactccaaactgagtggacctcggcggctaaagctatactttttctgttatttaagggacctaaaaatacacacagagtagattaagatttggtgcacttttctcaatttatcaacttataaagaacaggctgcctttcaaacataggacgtttctgttgaccataatgaaaatgcccagtattattcagattcagtttgtagccctaaaaaggcttttggtagaaaccaaagaacagatgtgcttcgcagtgaaaa

SEQ ID NO: 11780 - DNA, 469 bp, Saccharomyces cerevisiae
cattgtttgttttataagagtcagtgttttcttttagacactattaggaagaattattttatccggcctaaaaaaaatattttacatgcaaacttgcatatattttgccattgacaccaattagaatgtgtaattttcctggtttatacgtttctcaagatatggtcgaatcttcttttctgctcaattgtaagaagcgaagaaaaaaaggaagctccattgatctatcttgggctcagaatgatcttaagcaaaacaaagaaacctaaaagcatgaataagccaatatatttcagcaagtttcttgtaactgaacaagttttctatgtatgcactctcatatgtttttttgtaccccattcgcaccattgcgttactaactatatggagaccttataatctctgcttctttacagaagtcaaaatatacgtatgcattggtaaacttgaaaccaattgtacccggaca

SEQ ID NO: 11781 - DNA, 418 bp, Saccharomyces cerevisiae
ccaatgcatttacaatggacatgcaaacatttatatcatctctttttttctatattcctaaaccaaaaagttttcccccttaaaagtatacatttaatatcataatgagatagacactgtttatataataagaaataataggtaggatggtgccatcgtgagcatatacatacctataaatatttaccttatttttattttatttttctcttcctctcaggaacaaaagaaatacaaccgttattaatgttattgtcgtgggacagctcccctttttttttatttacttaccacagatagaaaaacatgaaagcagcacttacaaatagtataatagtgaaagttaataacgtaatatttttgaccttctgccaccacattatttcttttatattgaccgctttgcgcctaaatttat

SEQ ID NO: 11782 - DNA, 429 bp, Saccharomyces cerevisiae
aaaaagaaaaatgaaggttctttttttttttttatattctacaaatcacaataaccaccaacttgtattaaaccatattttatcatcttcaggaactacttatgcacaatattcgttcgccagtctttacttgcggttcaattttatcccatataaatttgtattttattatcatactacatactttattgaaatcatatattaaccttttcacttttctcaaatagaacgagcaacaggtcatatgaacgctgactaaatctctcaattttcttcaaagcatattatagttcaaaatcgcgatgcggtaccgtgaaagttttgtcatcaaagtaggtcatccaaagcatcattctcagattctgttacttcaacgatactcggcaagttgctctcttcgtcattaatatgggtattactgccgtcatc

SEQ ID NO: 11783 - DNA, 417 bp, Saccharomyces cerevisiae
agacaaacgccaattttacgaacgggtttccatagacattgaaaatgaacgaacaaaataaaataaataaaaaactacttttttttgatgatataaataccgtagattatataaatgtatattaatattataaacctatttgatcaatgacagtgttcgtgaagcattttatgaatacgatgaacataagaaagaaacttttacactattgtagaaaaagcgtggacggtaataaagctaacagagtatttccaataaacaataatgaaattggaaacgtatgacttcgcagcactttgtctttccataaaaatgtgtcgctgcttcttttttcattttttggcgcgtcgcgtcgggccgtatagaatatgcgtcacttctaagaacaagactgcagatcagggcagtgcgagttac

SEQ ID NO: 11784 - DNA, 408 bp, Saccharomyces cerevisiae
aagtgaatttatagtgttgatcagtcgaccgttatttattttaagtatattatttgcatagaagtaataaaagtgaattttttttaatggtttgttaagccattttagacgagggactaagatatttcaacctaaatatccctcaggctttgcgctcttgaaagcgatgtgactgtaattcaaatttcttgaaatatttttgcgggaaaaagatgaaaaatttttcacctcatcgcataagaagcaaataaaaaaaaaatattaataatagataggcaacaatatagcagctcagagatatagcttaacttcattttacagccttttaacgaaagcataagtattaacagtttgatatataggggattaaaatgacaaaggaagaaatcgcagacaagaagagaaagg

SEQ ID NO: 11785 - DNA, 462 bp, Saccharomyces cerevisiae
tcagcgaatcagttttgtcttgttggacttttttaattgtatatatatatatactggtgcattttctttctttttatataaaatcatgtacatacaaagtaaccgtctttttaaagtggaataaagtaactgctcttttatttttgaataatagtgaaagtgtatgttgcataatcattagatacctatgtacaagaagtattcaaatttatctgaatagtatgtgaaatttcaatgagacaaaaaccacctacctttgagcttcctccttttcaatatcttagagccctgtttgctcttggccctagccaagaaaccaaaagttctcttccgtttcaatgtactaggttgataggtgttaccccttgatttccatcttctttgacctattaagccaaatcccaacggtgtgaaggacggagtcttcaatggtgaactgtttaagagcataccggtttgtgg

SEQ ID NO: 11786 - DNA, 426 bp, Saccharomyces cerevisiae
taacagtatgccgttttaccacactggcgaataaatcttcaatgactttgtaagctcgaatatgcgcaagatttgactttgatattttgcactttttcgtcctcactttctaccttttttttttatgccttagttgaaaagatacgcgtatctaattatgtactaatagtcttaattttacattacttaattaatcgaaatgcagcctgtaaggagtttcacaatcttcacgttcgttgaaagctagttgtctaagtgcgctgccttttaactctaccatcatcaaaagaagaatcattgtcgttgtcatcataaatatcagcttcgtcgtcttcttcatcatcgacatattcctcgctatcatattccgtattatagtttacagtctgtcgctgtatccttctcaactgtctcttgcctggcttc

SEQ ID NO: 11787 - DNA, 460 bp, Saccharomyces cerevisiae
ggtcctttcttcataatcaatgctttcttttacttaatattttacttgcattcagtgaattttaatacatattcctctagtcttgcaaaatcgatttagaatcaagataccagcctaaaaatgtccaataactcattcactaacttcaaactggccactgaattgccagcctggtctaagttgcaaaaaatttatgaatctcaaggtaagactttgtctgtcaagcaagaattccaaaaagatgccaagcgttttgaaaaattgaacaagactttcaccaactatgatggttccaaaatcttgttcgactactcaaagaacttggtcaacgatgaaatcattgctgcattgattgaactggccaaggaggctaacgtcaccggtttgagagatgctatgttcaaaggtgaacacatcaactccactgaagatcgtgctgtctaccacgtcgcattgagaa

SEQ ID NO: 11788 - DNA, 459 bp, Saccharomyces cerevisiae
cttgtataaattggaagcaacaatagtatatatatatatgcgcttgcgcagagtacgttctattcattttttatcattcattatctatccctgtaaataaactaatataaaaattcaaaaaaataatgatttcgcccaggatcgaactggggacgttctgcgtgttaagcagatgccataaccgactagaccacgaaaccacttaattgaaatatacaaccccaagataagatacttgcttcatagtttagttgtaaaattgaagttcagtacaacatggcactagtataaaaaaaagtttaccagccattactgcgcacttacctacattagtcactcttagcgtatattctaaatacgcttagagacgtctccttactatttttcatacgtataactctcaaaggacagtatagacatatccctgggggcttttagagtgcagcctctggaggtcta

SEQ ID NO: 11789 - DNA, 431 bp, Saccharomyces cerevisiae
tgtgatggcaagtttgaatgcaatggcttcgatgagggtaatagtgtttttataccaactctcaattctgggtgactgctcaacaattgacagtttacgagaccttatgatctcacaaattgttctcgcatataattgcattagtgtgcatgtaaatatgtatatatctacaaacggaagtgaggcatcgattgcttctcgtatgagtacactggaaagctgcctttttttgataacgatgaataaagggtcagcgtcgtttgggaaacgtcgatttttttatagagatttggcttgatgtgcatctaagcgagtattatcggtctgcgcggcttagccgcgggaacaaaaagtggcacagaaacgagctcaagaaaagctcctcagaggtgtcatcagaaacacctcattcatccctacttcatggcaca

SEQ ID NO: 11790 - DNA, 420 bp, Saccharomyces cerevisiae
aacgaatgatttactaatggcttaatgattttcacctttttcaatgaatattaacggtaaagaagaaaatttcaattttttgaacacatactttatatacttaatagatccatatttcgacatattagcaaacgattgcataggtttctgagtcttttttttttttttttcataaggaggagaatattttggttaatcgcagtatcttcttcataagtgctgtttctaattatatctaattcacgaatttttcccaaattagcgtatccccgaattcagattacctaccccgagttttttattatatttccctcgagaaatctgtaaaatggccgtcatccttagatttataaataaaatgataaaattcagccaaagtgctcctaaaccagaattgttcaactgggtcaaattatcgcg

SEQ ID NO: 11791 - DNA, 473 bp, Saccharomyces cerevisiae
tgggtttaacaatatgtatcgaggccacaccttttcatgcgtctccggatgggggctggaaaaaacaatgcgaacagtctataaataaacacattttcgcagggacagagtttacgcagacacgccatttacataagcttgattacgcggattgccgtggtgcactttcgtgcactcgcacatatatatgcacgtacataagggcctcatcttcctctcctttttttcccccatctacctatcgctgttattgaacggaagcatcttctttttttattatgctcagagggccctacatgacagcttttttttccccaatgagctgctacggtgccagatctgcttatgttcattattttggatggtaaccgttataaatttaaagcgtttcttcgctaggatggtgaatattagtatttatcagccgtctcgtaatcgtttagttcgttactagcggcaaattttgtttgatt

SEQ ID NO: 11792 - DNA, 435 bp, Saccharomyces cerevisiae
ggaaaataacctagttacaatcatcgtgtatataaataaaagaaaattgattaacgcttcggtacagagaggtgagagtagaggggcccctgattatacaccaacgaaatggaaatggtttgaattcctgaaaagccaggaagacattgagattttaacatatttattatgtgacatttgctttcttttagatggtagatatgcttatttatgtatatagagaacagttaaaaggaagaccaaatgatcattaacctgctacctgctttcagaatcctaatgatttcaaaatggataactttacctgtctctcaaattcaggtctattatctctccacaagatgcaagcatcaatgttggcaccactttcgatattgggctcactcaacatgctcataacacttaatagaattttttctacactttgcactggcg

SEQ ID NO: 11793 - DNA, 415 bp, Saccharomyces cerevisiae
gggatgaagaataagaataaacgcacgtacaatgcatatacaaccgtttctatgtaccataaatataattatcatataatgaaaaatgagaataaaaaacaatgataacaatgaaaaaaaaaaaattcaattaaagagaaaattaaacttattttcttaagtagtcccttaaataactaccgagtttttcagcaccctgttctacaacgtctctcaacatctgcaattcatcatctgcggaggcattaaaatcgatgaaaccgttattagaattacggccatcaaaattccctgctccacttccactactattgatgggattaccaaattcatccacttctttatcttctccaaagtatgaagaagaggaaattgatgtagcattgtcaaatgttttcaacttgtcatgcgcttc

SEQ ID NO: 11794 - DNA, 409 bp, Saccharomyces cerevisiae
cacacgtttaatcaacctatccattttttcaatgcagtattatgtatatatatattcatcgcactgtaaatagtgacatattatgagtcaaatatgccgaataaactttaaaagtgagaaaagccgtcaccgatgagtaggttagcgtcacctagtggcggtggtaaatattattacataaacatatcaaagttttattaatacattttttaatcctttaaattttctggaaactaatacataatgaaactcggaaaaattaaatttaataaaaccaaattaaatcaaacaaaaaattgacaattaattatttcttttcgaaatagtccgccatttccttgtccagatcttcaagacttttcttagcaggcttttctctctttggtttgttttgggattttgccatagc

SEQ ID NO: 11795 - DNA, 491 bp, Saccharomyces cerevisiae
agacagactatataatggtaggtcgttaaacatttgactatattccacacaaaataagaaatcataaagatcattttacataaaaatatactttatacgctccatgtcttatacaatcgttacattcatcaatttctggtgaaagcttcaactaaagttttgaaatgattttcggtctctctgattattagtggtacgcttgaatcattatcgtcgtcattcgcaactttcgtaccaacattttcagcagaatcaaaattgtagttttgtgcatccgagtcatttatatttaaatgtagatgcaattgctgtaggttattgtataaatacatgtaatttgtagccagaaatctttctggtgatttcgtctttttactgcactttgtcatgactgtttcgaaatcatttcttaatctaatgatggaattgtataagggttcagatctttcgtctatggactgcttatgtgttattgccaacgtcaagaagct

SEQ ID NO: 11796 - DNA, 500 bp, Saccharomyces cerevisiae
cccgggcctttttttttttcatcagcttctcttttaggccgtcggccccgttcgatgttcacccgtcctggacagcttgctctccccccttcctcgtgctgcgcgactgtttacgttattggcttattgtattgttttcgcatctagaacgttcaggttcaatttacgcaacggtgtttcactcgaagcatctggctgtacaagcaaatgctgcgttctcattctcctttatataacaagcttctgccttaaagcgttcatatgtacatacatatacaccactcaggcactcgcataatcgcacttaaatacgcaaaatatacaagatagccctacaactgctccatggactccaaggacacgcaaaagttgcttaaggagcaccgaatcccctgcatcgacgttggatggttggtcaggcccagtgcctccaccagcaagagctccagaccagggaaatccgagtccaaggccaacagtgtggctcctgacatccagat

SEQ ID NO: 11797 - DNA, 485 bp, Saccharomyces cerevisiae
actaggtgattgggccttcccgtgtctgtgttgcagtatataccactcttatacagtatgcacgatattcttttaaaccaacaacgggatgatagatttcacgcttgatgactttttttttagacggctgaagggacgacatccccatcgctcaaaacacaaatatggaaaggacaaatcgtctttcacagtttgcatagtaaaagcaaagtttatactacttcagcaaagttgaagttgtttggcacttgtttcgtgctttctcaaatatcttagatcaccgtctgtctagagcatatatctattgtttgacgcaccccttttacaaaaaaaaaaaaaagaaacagatctattaagtaataaaaaagttatttaggaaataaggtgcagtaagcttcctgaggcataatcattatacttttaaaatctatatttttgggttattgttgaaatattttcttacaaagcccatttctcgtttttga

SEQ ID NO: 11798 - DNA, 479 bp, Saccharomyces cerevisiae
tagggactctcggcagaaattctctccttgtacaagttatgtattttattctttttcgtgctcgttcaacttctgaacgatggcttccatgcactgtaacatataaaggattttttaataatgaataatcaagaaatctccattttatatgcttttttttttttgccgtttccactgcaatcaatggcgatataatcggatgaacaataaatattcgtgttcctattcgtgttcctatacgtgttcctagcagcaaacaataacagaagagaagcatttgattttcgtaaaaacttcaggtgtgggtgtttcttattaacggttaaactttacgaattgaatcccctatgtataatggtccataatacatcttaaaccaccaagccatcttcgtaattttgaactgggaaaattgggaaaactgcagacattcataatcatgacaggatctttaaacagacactcacttttgaacgggg

SEQ ID NO: 11799 - DNA, 425 bp, Saccharomyces cerevisiae
gtatatcgtgaaaaccaagaagaggaggtttactacacgaatcaaaggaacaaaaaaatcatggaactgaaaaaaaaaaaaaaaaactactgtaaaaaactactgtaaactataaattattaattagactgaacgtatacctatataaacctgatataaaaatgattcaagttattagtcctttgcattttctgttagcaatcctttgtcaattagccctaagaaatattattcccatatgggtaaccaactctctttttttttttttttgaagggatcaatacttcagtcagatatttaaagagaaaaattttcttcaagatgcaagtttcccattcagttctataggaagttaaaacaaaagagctgtttgagagctcgtaggctttggttgttaagagaacggactaaataacaccaggagg

SEQ ID NO: 11800 - DNA, 466 bp, Saccharomyces cerevisiae
tcgtatttccgtcttcaaaccactttttgttacttttctttgttttgttttcgtatttgagtttctaatgtgataagtgacttttaattttgtaatttgttttcacggatatttttcttaggtaagtgtattctattaatctttatgtaaaatattataaccattcgctgtttcaatatggttttataagtggagtttgtactttttttacatatcatttactgtatcttacatcatacctttttgagaaactttggaagatattgcttgtcataaaaaaaaagggcgaaatgcacatgaaatctgtattatgtttcgttaagattaaacgcatttttacaaattaaaaaatccttctgttcctcttccttgggcaagtgttgtatggttaaaggtttaaataaaagacgttctaaaatacttggttacatggcgctataaatttacacgaaaaatgatcaggcaa

SEQ ID NO: 11801 - DNA, 401 bp, Saccharomyces cerevisiae
ttcagctttgtattacttggcgtgcaatatacgtacctttatagtaaatatccttgttgccttatatggtaccgacgcttccccggatttcaattaaggcaaaaacaggcgataatcagatcagatcaaacatttatctctgacctaatacaaaaaagaaacacaaacaagaacagtattgatcggtttaaaggcgtgcacaactgttttaaagatgtccaattttttacttgtgatccctgaagacgtgatcaagggctgctccaaggcagataaactagttgttacaggagaattcgataactggagacattccgattatgttctgcagtatgacggcagcacacagaactacagggtgcaaattcccagaagaaagggccaacgtagcaccatgttca

SEQ ID NO: 11802 - DNA, 425 bp, Saccharomyces cerevisiae
acgtgatttcttttatttcgttgaattaaaatgaagacgttttttacagtaagcgaccttaatctttgtttctattatctacacttttacgtttagtatattcatttcataggcagtaggcattcttttaagaaaaacatagcgcgcatatcttctcctcttttgtttcgcaactcccaaacaagatatcaatttcccaccactctaacgaatgcgaatagtaaccccatatttaaataatactataagggtattcgtacgaggtaggattttcagtagaccaaatagccttcaacgacatcataagtacacactgagtctaagcattgaactttcatatgaatatatgggactataagagatgggtgtgaagagaaagacaaatttgggttgaagagttataattagccttatgcaggtctcgc

SEQ ID NO: 11803 - DNA, 449 bp, Saccharomyces cerevisiae
agagcgtgagaaaatactgcatgttttttatgcccgtagcctccacatttcttccctagtaggtgactagctttaaaacctttgcgtaatgttcgtatttgtaatcaattgcatgtgccaaggatgatctttggtagatataaaagtacatattattaatttgttttacagaattggcatgtctgaatatagtttttttaagaaagtacaaaaactagaagtttttcttacatgtaagagatatgaaattttgtaatgtccgatgaaaaaataaaataggcaataagcaaattgccattccgataaatcttcatgcgatgagctggtcaaatctgtttaccagaacaatttgtagggttgttttttttttttttattttagtttgcgatgagatggaatgtcgttatgaatactggactgatacttgttcgggatcaaagaattccctt

SEQ ID NO: 11804 - DNA, 458 bp, Saccharomyces cerevisiae
tgaagggaaagatatgagctatacagcggaatttccatatcactcagattttgttatctaattttttccttcccacgtccgcgggaatctgtgtatattactgcatctagatatatgttatcttatcttggcgcgtacatttaattttcaacgtattctataagaaattgcgggagtttttttcatgtagatgatactgactgcacgcaaatataggcatgatttataggcatgatttgatggctgtaccgataggaacgctaagagtaacttcagaatcgttatcctggcggaaaaaattcatttgtaaactttaaaaaaaaaagccaatatccccaaaattattaagagcgcctccattattaactaaaatttcactcagcatccacaatgtatcaggtatctactacagatattacatgtggcgaaaaagacaagaacaatgcaatagcgcatca

SEQ ID NO: 11805 - DNA, 472 bp, Saccharomyces cerevisiae
gaaacgacataaaagaagggtgaaaaggagggcatgcactgtctccatcatttttaagattattgggtctcaaggaaggaggatgtataataggaaatatcaaagtcaagaataatgtttcaaaatgatttgcatcaagatcgttcgatacgcatatatacagtcatccacacacttaattttttagcactggcgataaaaaatgatttatgaataaaacttcatcaaactattatgaaaaatatgtatttctatattctatttattattattattattgttagtgtttgtttttctataaaaatatctataagattaatccataattctttttctattttttaatgttatttattcgatatgtttttcatgaatttgggcatatctaccagaaggatcttcagcacaaccccagtcggcctttggaatccatctcataacggtgtcagccacggtcttttgagggaacaaa

SEQ ID NO: 11806 - DNA, 460 bp, Saccharomyces cerevisiae
attgtataattttatgcttgaacgaatttagttctgtaagcccagctccttcaagaaagcatccttagaaggttccctacccaaaaattctttcagattatcattaatatcataaaggccaccacgagccaacacaatatcacggtattgtatcccattcttggcatttaacggatccttagcgaatttggtgtgatacatatcagttgcaaagacttccgcccatagataaccgtaataaccggcagagtaagagtctgacattatatggccaaatgaatcataacccttggataacgtaccaccattagaaatcaaagaaatatcctgtctcaattggttccaggtatcgcaaattgacaggttttgcaagtctttacaagtatgtactttcatatcaaataacccaaaatgtaattgtcttagagtgaataaagcaccatttacgtgtttagttttg

SEQ ID NO: 11807 - DNA, 479 bp, Saccharomyces cerevisiae
ctacagcttataagggagagaggataggaaccgtcaaacattaagctgcaccttttttttttattacagaagtcggcttggaaggcttgtatagtacattacgataaacacatcttatttttatttattacttatttattttacatattttcaaaaaaattcacatatcatttattattaaccgaagtgttttatactttttgttctttccttaaaaatgcctccaacagaaaaggaaaaatggcttgatatgcttcaaaatatgcattgagattcatattcggttatcaattaacgatattacttccttaagtgatattaaatcaagcttgccggattctgcagtcagaattatacataatagtatttgtgctctcgtaaatcctttcagaattacaccatagtagtctttgtgaatgttctacttattagaatagattattgctagtttatctcacttttcattccccatatccctt

SEQ ID NO: 11808 - DNA, 413 bp, Saccharomyces cerevisiae
agtgatctgggctgtcaggctagaagtttttcatttatgtctgaaacagataacgtcagttgtaccactatctttggttttattctttttattttctcttccatatatctttacagaacttaagtaataatgaaaaagaatgaaaaaaaaaaaaaaaaaagaaaaactagtcaaaattattgccatgaaaaaacaggaagaagagagagaagaacattaaaaaaaaaactatcaatattagattaacaaaccaatcaaaatggaggactctaataatgaagccagcgatgacttcaacaacttattaaacaaagaaattgagtctgcaaaggaagtgaagttaagaaaattcgcgaacaggaataataataggaacgaaaacagttccaaagtcaaagatgcgagtggattca

SEQ ID NO: 11809 - DNA, 491 bp, Saccharomyces cerevisiae
ttggagtgaaaaagatcggaaaaaaaaaaaaaaagaaaaagaaaggaaagcaaaggaacgtgttttaattgatgcgaggtgtatatgtatatgttgtatatatgttttacttggcgcttttatatctatcagacttgtaaataatacatctatggccaaccagaaaatggagaatgagacttgaaatggaataaattaaattcttaatcgaatgtgaagaaaagagaaagtgtaatagaatttcattaagatagtgtcattataggtcatgtattgtgtgctcctgactgttcggcactatttaccttttaagacgcaataaatctctttttagcttcaatgattcatttggtaaaatagaggattcttcagtggacacgtttgctgtaggtaaacgagtactagctaagggggacgatatgatattgctacgttgtctcgatagcagagctatgttaaaattaaatgcggaatctgttgtaggcgttggc

SEQ ID NO: 11810 - DNA, 495 bp, Saccharomyces cerevisiae
gaatgaaaatattaggaaaaaggagtttatcctgagtgtatatatctacataagtgaagctgggttttgataatggaaagggaggatgacaagctcaaaatatactttatagatgaatgaggacaggtatcattggtcttcaaatgtcaaactcttatcaagcctagctttttctgctcttcttgctgtatcatattcctgtacctcattgtacagattgctggtagaagtaattaaattttcgtaaaatgctgtgccggcacttaaattttctttcacctcatcaagcagtttgaaggaatatctcagatcttcaatatatagctctctgggatctattcttaccattttctttggttcaatcccgcttctgccggggttattcttcttacttaggtttacttcctcaataagtttgatattttcttcctttgtactattaacgtatcttaaatcttcgtcaaagtattttaaatggcctatgaaaatgggttc

SEQ ID NO: 11811 - DNA, 483 bp, Saccharomyces cerevisiae
taatgatcacggctaaaacggtcgaatgtaagcatatatctttcgattgtataattgttcccaaatactacagcatctcaaggaaaaaaaaacaaaaacttccaaaaaaatcgaatccctgaggaatctttaatacattttcaatctatttaagttttataaacgtgtatatgagatgtcatgagcatgaattattaataataaaaactaaatcattaaagtaacttaaggagttaaatttaagccttggcaacgtgttcaaccaagtcgacaactctggtagagtaaccgtattcgttgtcgtaccaggaaaccaacttgacgaactttggagacaattggataccagcggcagcatcgaagatggaagagttagagtcacccaagaagtcagaggagacaacagcgtcttcagtgtaacccaagacacccttcaacttaccttcagcggcagccttgacaaccttcttgatttcatcgtag

SEQ ID NO: 11812 - DNA, 402 bp, Saccharomyces cerevisiae
gattagcatatgcctcttcttcttagaagggcgttctgcccgttatgtatacgttaaatattacattattttcgcatttttgtatttatattcagtgaaatattaggcttggtcgagtaacatttcccatagctcgtcggtttctttgaagtcgtgatgaacaattgagacaagacagtagtctttatgcactagtcttagaagaatattggctggggtgttccttggaaataacttggcccactcggaccagatactaaacgcttcatctctccatgccttgaatgactcttcttcaatgattgtagtctgtttgaccggactgttgggaaaaacaccccatgttacaacgctagagctgtgcgggtctaggttcgtttcaaatgaaccagatgaatcgcc

SEQ ID NO: 11813 - DNA, 401 bp, Saccharomyces cerevisiae
tgcatatatagtacatcagaaccttcggcggaacttaaagagaccaaaatagtacctcttatgacggtcaaacctagctttcttgcgtttttagaaatcagttcagtgttgttttcatcatcaggattagacatatattctactgtatcatcaagtaccaagttcatcagttgatcatagccttttaggacacctataactaatttaccacccattaatttgacgcgaattttagaatctttatacttcgctaaatccagaatagcttctcttttagggccttcgaattttttcctttgctgttgtggtttgttctctgatttcttagttcaaaaaggaaacatagttattataatgttagtataaataagtcaaaaggaaggttattgccacggaagaaa

SEQ ID NO: 11814 - DNA, 458 bp, Saccharomyces cerevisiae
ggaatttcgtaacgtgtatagaatcaaaaaatcataaatcttgtacataaaaagttcattttatataataataaataccaaattattgataagtttgttgcttcctctaaagtaaactagctggcttctttagctaaagagaacagtgactttattctttgccatgtggaatttgtataagctcctacgatgaaactctttacaaaattccaagccttagcattgttacgaatagggtagtctaatggttttggaatttgagtggagacaaaaggcaaagtatcaaaacagacacttttggcattgcacaaacccaaaagaccttcttcaccaccaaatttaccgtaacctgaaccattgataccaccaaatggtaattgacaaacatagaatgtagcaaaatcattaatggctacattaccagtttgtaggctatttgcgacgtaattgcattcctt

SEQ ID NO: 11815 - DNA, 480 bp, Saccharomyces cerevisiae
gcagtgaattgctcatgttttctctgcatcctcatttaatgacaattagccatgtaataacatcttgaggcagttaaatattcgttaccctgcaggtggcaaaaaatttatagaataaaagcataaaaagatggatatctatgtaataaggaaacattggcagagcgaagagaacagactgctttctataaaaagttttcgatcagtctctattttaataattgattattggatatagttagtagtgttaaacatgggttccagaagatacgattccaggacaacaattttctcccctgagggacgtctatatcaggttgaatacgcgctagaatccatttcacatgcaggtaccgcaattgggattatggcatctgatgggattgttcttgcagcagaacgcaaagtcacaagtactttactagaacaagacacctctaccgaaaaactttataagttaaacgataaaattgcggttgc

SEQ ID NO: 11816 - DNA, 430 bp, Saccharomyces cerevisiae
ctccatgctggacttactcgtcgaagatttcctgctactctctatataattagacacccatgttatagatttcagaaaacaatgtaataatatatggtagcctcctgaaactaccaagggaaaaatctcaacaccaagagctcatattcgttggaatagcgataatatctctttacctcaatcttatatgcatgttatttgctcttataattggtctctatttagggaaaaaagtcggtttgagagcttctcgcgatgtgaaatctcaatttgaactgcacgccaaagctagcccatttcacgaacaccagaaagaagaaatccccaaggatcgcatgacagagtatgctctctcatatcgttgagtatgaatgccaatacactgatcagctttacaagaaacgtaaaatctggcacgatggtagactga

SEQ ID NO: 11817 - DNA, 486 bp, Saccharomyces cerevisiae
taacacaccatccacatttccatgtagttcgtatacaaaccctaccagtaaaataaaattaactcctatgtgctttaaataaaaattataaaccgcctccaatagttgacgtagtcaggcatgaaagtgctactaatcgatgactatgatttcaccgttgtttaattttgacttttttttcgcacgtgacagctgagaaaatatatccatttgacttgatgcaggttcattcttcacctttttggaaaatttctgtgtctttttcattgctgcgtcagccaaaaacttagcattggagattattggacgattgtcaactgtagtgtcatccggattatgtaataactcagcagctgttgtatttctgctgtcatcttcctcaaattcactcttcaaatctatcacttcctccaccttaaccttgtcacctctcttagactttctatttcgagtttttggttttatttttttcgtctttttcgagcc

SEQ ID NO: 11818 - DNA, 433 bp, Saccharomyces cerevisiae
cctcaggtttgatggtctaaaattgtagaaatataacgttgccagtaaacctccattgatttaatgatagaaagagggcgagatgtatagaggcttctttctttcaacgatatatttgtaataataaaaaaatgtcaggctgataaagcttatagagtgactgtctttttattcctcaaatgttatttacaataccatataataaaattagtatattgtcaaataaaataagagaaaaaaactaacttcttgaccaaatggtcgaagagctgagataaagaaggaaaaaaattaaaattactaactatacaaggaaatataaaaatagaaaaattgtgttactaaatacaaaaaagtaatatatgcgtcacttctttagtgggttcaagacaacattatatatgcattggtatcaccatcttccaccacttct

SEQ ID NO: 11819 - DNA, 480 bp, Saccharomyces cerevisiae
tgagggcgttttcaagataaaaaaaggttttttgatctctgaaggatagtggccttctccactgatttatatgcatctataggtatatacttgcatgcctacttcatgacttatgtaatacagttttcttacatccatttaatttacgttcgaagaagttttcaacatttgtttatatggacattccctttttttggttcctcgcaatgtaaacctccctttgcgattccaccctcttcacaataagctctttagtcaagtattcactgaattttccggcagcagtgaggacagccgtgccaatatgatacttctcgcagttatactgagacattgaggtggcgtcagcatcgataataacggcatcaacatatttacaacttaaaacgctcaagacgcgttccttcatcgtcataatggtactcgagtaatcgcttgtggtaataccaacaatcaatttcttatcggggtgaagatcca

SEQ ID NO: 11820 - DNA, 498 bp, Saccharomyces cerevisiae
aacagaagataggcttctatttttatatatatttggaatttttcattccacagcactgtcactattatattcattaaacttttttttatctttatagtatttaaatcggcatacagtttcaatttttcgctttagaggcactaagaatgcaagtctgcaacattcaggtaaaataatgggttgattttaggtcgagctaaaaccctgttctccgcagatgtatgcgaatttcgtcataattcatctcaactaatggggctttaaaacatatgaatatctcatgcattcccaaaaaagaagaaagaaaagacttcaagtaccccccttaatttttatataatggtagtagtaggtttgttcgtaacttatcggcaatagtaatatgttcccattataacacatctgttaatggtattcaggttaataaccatagcaaaaaatataaacaactttgtacattttccataaaaaagaatgactttacgaaaacattggatg

SEQ ID NO: 11821 - DNA, 405 bp, Saccharomyces cerevisiae
tggttttgaacaactttagcagtactttattacttttattttggagatttcaagataggaaaaagactttatttccgctgcttatctattgaatcggttattttctttattttatgtaccacctttaagactactatcgaaggatacggggtgaaagagttcatgccacttagtatataacgctcgtgtcgtctttttctgttaataatgcatattctcattctgtatatacaaaacatctcatcattatttttttaaataaaggatataaagtcttccaaatttttaaaaaaaagttcgttaactgaaaattttactctgtgcattgttactatcaatatttttcgagcctatcatggtagattcataacggcttttccagaattcaatttcttgggccatttc

SEQ ID NO: 11822 - DNA, 412 bp, Saccharomyces cerevisiae
acaaccaagaatagtaagagaaatcaaaagcttgcgcgtaataccaccgctacgcgttgacttatatgcataatatacaaatatacttaaaaaaaaaaaaacaacattatagattccaaagttatgaaactaagaaaagtatattgttttcttaagtatattgtatgaattaatattatgattttaacagtaggtatgataaaagaagatgtacattaaagtatacagtaaataaatgtatagattgattgggcgaaacagatcattttaacttcttctttggacgcaattggttggtgtgaccacactttctctttctacagttggtagctcttggtggcaatctagcataacacttacggcaaacagatttgtcacagttgtacttggaagccaaagctttcaaagatgg

SEQ ID NO: 11823 - DNA, 415 bp, Saccharomyces cerevisiae
aaaatacaatgcactaatgccgaagagcttcaatcgaagatatactgggcatatataaaatacatgcattctgaatacataagtgatacggatattaatgctacaagggtttggatatgatttatatgttggtttttctggatcgtcaacaactcgtgcatatttttttgtttcgaagtagaggaaccacaaatattattaaagcgtgttatttttttttcttactcttctgtaaacttctaaatgctgctgaggcacccctactagcaatttccctatcaaagtttgtttggctgttattaagggtatgtaagacctcgtatctgctgctactgatcaccatgttagaaggagcagaatacttttctctcgtagttgggaattccatttgcggaagtggaggtgaaggtgttgg

SEQ ID NO: 11824 - DNA, 468 bp, Saccharomyces cerevisiae
ttttatacgccatgtatcttagacaaaaagaaaataaagggaaaaacataaataatcgtgcagaatcatgctactgccaaaaaaagaaatggcaaagatgcccaatacgtaaactcttccggaagcaatagcgccgcattattaccgctgctctatttcactttatcatgaaagacgagacggctggtacttttttttccccaaatcggagctacttttccgcacttcaagtccggtgggaatttttactactaccccttaatcaatgcactccccccgcaatgacgtacaggggtaacatgtctaacatttaaggttacggctgttagcatattgggggttatttgaattataggaacgccaagaaaaaggacagagggtaaaaacattctcggtgctgccggattgcttattaagacgtatccgttaaacaatctccgcttttttttttgtctaacagccggctct

SEQ ID NO: 11825 - DNA, 488 bp, Saccharomyces cerevisiae
atgtttgtatggcaacctgtcgatttagcggcaatcatacggcggtgaaaaagtatgtaactatgcatagttgtcataaaatttatttgattcagatctttgcaaaaagtatttttttttggaatttggagtttttattatcttattgtgctataaaataaacaaagttgttactaactaataataaagatttagatattattatattaactaatgagtttcacttggaatttcgaaaacaatttgcttaccagtcaatttgttgtaaacagcttggaaagattccaatttgtagtcgatttgttggacatcctttgagtctaacaaaaccttttggatcttgttaccaccaaccaaatatctaactctcttaccaacgatttcagttgggaagactaagtcttccaagatcttgtcatgaacagcagtcaaggttctggatcttggtctcttttggacttgtctagatgttctagatggctttggca

SEQ ID NO: 11826 - DNA, 464 bp, Saccharomyces cerevisiae
aagtagtacattcttcatttgctcaagcaaaatatacatttatattcatttatatggggtcttctttgtatttgttttaggttattcctttttttatgttacatattatgtcagcatcgttttatgaaatatattcatatataatttttcaagtaaatagcaataaagtgataaaattttgttagacgcacaaaagggcagtgtcacaaatgggaagcgtgaactcatcaccgaatgaagagtttgaaactgtgccagattcacaaatttcagggtttgattctcctttgataccgactagtgtgggaagttactttcgcgatgacgatgacgatgagaaggtgcatcccaactttattagtgatcctgagaacgacagtttgaatagcgacgaagagttttctagcctagagaacagcgatttgaatctttctggtgccaaggcggagtctggagacgatttt

SEQ ID NO: 11827 - DNA, 433 bp, Saccharomyces cerevisiae
ggaaccaataaaaccactgcaaagacaaaaatttcataattaatctgaaagaaagtgaagataagaaacgggctaggaggaagggaaactgacacttctggttattgcaatatgctcatatacattgatgcgtaatgacattgatgatctttattctctttttataacgttttctttctttttttttccttcttacatagtattcaactgtatatttaacatgttttacgtatttttaagaaaaaattactaaacgcgataatattaagcaaatatttatctcatagttctcgaactcatttatttcccattgatgccatgaaaacctctcaaacctttatcgtctagttacaccagtagtcaataaactgcctttctttttttacacccaacatactctacactaaatcttatcggtggtttgtacatggag

SEQ ID NO: 11828 - DNA, 416 bp, Saccharomyces cerevisiae
gactaacaagtaagagcgcgatgttgctgtccacttaggcatcactatatggggccaggaatggcaaatttacttgataaacttcaggcgattggattttggtgctcagaatatttttttctcgggccgaaagcgtctttaactattccgagctaaagcttccgagtcctttattcggtctttttttatttttcaagattaactgtatataaatagagatggtatgattaaaagctctttttaatagatgctccttcttgaaatttactcccactgtgctgcaagaggttagacgcttcacgcacatttttgctacaatgacaagtgccgctactgttactgcttcgttcaacgatacttttagcgtatccgataatgtcgccgttattgttcctgaaacggacactcaggtgacc

SEQ ID NO: 11829 - DNA, 402 bp, Saccharomyces cerevisiae
agttagttctgctaagtttatctgcatttattggtttttttgtctttactacaaagatggtccaattttatatacaatatacactacctttctcagtcatcgttattcgtactcaacttttattattttaaggaacacagtcgcatttttgagtttcatgtataaacattactatacgcatatttcgtatttaactttctataaatcccccaaaacgttttattaaattttcaacggtacgctcgaataaccgatttagtttgaacaggaggaaccattttcgctcatgcgtatggcttaaaagaccatcgagtcatttttagtagggaggtaatggttatttagttatatatctaaatcactatcactttcacttctatcatgatttgtagaagcgaagcg

SEQ ID NO: 11830 - DNA, 432 bp, Saccharomyces cerevisiae
ggaaaatttgatttttgattcagggtatgcgactattcaaacacgtattttcatatacgaatgagtagtttataatttatataaatatatattacataaggaaatggctatgacttcatgatttttacgctttgagtcccctatgcctaccggttatgttatatacttggcaaatgatatcaatgaatagaaaacaaaatgctcttaaattcctgcaaagcgctttcaaatcgaattgtggtgggctggcgcgctgatttagcagtaaaatctagcctgtagtcgatatactacgtcaaggtgtaactaacgtttatatgtatatgaacctgcagaagaagcaaaatgacaaggttaatgcatctttatctgtcctagagtagaagatacactaaaaagttgataaagcgaatataatatggtcatgtgaaa

SEQ ID NO: 11831 - DNA, 488 bp, Saccharomyces cerevisiae
tatttcattgaatacttactgtcctactacacctttattttcaaaatcccacttttcttacttatttacatataaatacataatgcattcactttgaaactttttgccttagcatgtatacgctatagacttgcggtatcaacgaatatacgtaacgttgtcacgtccacagaagatgctatgtcaacagttccctgcagatatctgcgatgcggcgaaacattctatacacagtttcaaaactacaaaaaatacaaacctttagcctgtttatcaaattagttagctataaaatgcccattttcttagcaatatcgatcaattgattgtcatcttccaaagtttcaataaaatttgtggcagtatagtaatcccttctcaatatgtccaatttcttatcacagtcatctataaattcgcgcttaatagattgcacttttaggttcacccaattgttgaatgtcatgtccaactcttctgcaggcatt

SEQ ID NO: 11832 - DNA, 478 bp, Saccharomyces cerevisiae
ttgggttgtgttcgcacatattacaatttgtacattaatatcatccccgctttcatcatgtgaacatctatagaacatcatttataaaaacaaaaaatctatgtactgacgatataatagcgtacattatcatattattcttactatttatcatactcatcgcatctactgttctcgagaacgtgtaaagtgatttatgccattgaatgaaaaattttgttaaggaacaactagaaatataatagtgtcttggtggatgtggcaaatgaggtgtgcgtgataaagagctacaaactcaaagtaataacagctatcatccatttttatagcaatatttgaaaatggctgctcgtccacaacaacctcctatggaaatgccggatctgtcgaacgccattgtggcacaagacgagatgggtagaccctttattatcgtgaaggatcaaggtaacaagaagagacagcacggattagaggc

SEQ ID NO: 11833 - DNA, 477 bp, Saccharomyces cerevisiae
cttttttttttttatttagaactaatatattcaatggtgtcattaattattatttagagaataagttactggtggggggtgcacctaaaataaagtcacataatatagagcatggcagatattttaccgctggtattgcttttccgaaattttggtggaatattcttctgaaagatttcaatttgctaacagacttcttaagcacttacaagaacaatgtaacttctgatctgctgttggagatgttctgagatataaacaaaatttacatcaaaaggcgagtaatacaatgatacaaatgattataagtacatactaatgttacaatttctaattccattttagtcagaatatactatgttgtataataataaaataatgtccatttccatagcatactggtaagattttattgaaataggcaaagaaaaaagcaaagaactctaataagaacgacaaacctcgaaatctgagggg

SEQ ID NO: 11834 - DNA, 459 bp, Saccharomyces cerevisiae
aacgctcaagtaacaaatgagtggcgttgtttccacgacaattatttatgatagtgtgtatttttaacacattttatttattacaatttatgtattttgttatgaattatttatttatacgactaataggtgatgctcatattctcgtgttagaaagttaaaaaaattatcatttcacacataggaaagctcgtcgcgccggggaaaaagctgaggaatctctattattaggggtaaagttcaacacattcagtatgagataagtgtgtcttcaagagagatgcagcactgagtagggaaccaagaaacgatgtctgaattactagatagctttgagacagagtttgcgaaattttataccgacagcaatctggaagagacaaaccttcaaaaatgtcttgatcatactcatgaattcaagagtcaattaaagaagttgaaagcgcacttaaacaagca

SEQ ID NO: 11835 - DNA, 424 bp, Saccharomyces cerevisiae
ggcaagtgattatactctccacatataaacaaattaaagccacgttcatattcttaatggctaagctttatgtcgtaatacatatatccatcaagcatcttcaatgcacgagtatattttgtgttgtcactccctgtatataatgtatttgttaattatataatgaatgaatatcaaagctagatcatatttcgtaatccttcgaaaatgagctccaatcacgtaattccattaaatgtctcattgttggacgtccatggggacaattccaaggcttatcaagttcactgagattatgaacgactctggtcatagtcttcttattcagcggtttacctatcattatactacttctacatgctctcatagcaaacatagaacgaatcttggaacatctgatgttgtctcttcgtaacccaccgtc

SEQ ID NO: 11836 - DNA, 432 bp, Saccharomyces cerevisiae
gatagttgacttgaacaggaatggtggatgagcgttaagtatttatcgatgttgtattttattgagcacagttcttaccggtgatctctcgttgttgtaaacattcgatatcatatgcatcataaaagtttacatttagtctttatttgcatcaacgcaaaccagggaagtacaataaaataagcattctatgaactcggagagctgacgaaaaaattttatattttatatgttgcggatgaattattaatgccattatataaaaataggttatcaataggaacgtaatggtgtgtgataagctttatagcctcttgaaccactgcacctccaaaaaaggccattacggaatagttatcgtcgactcgtaaaccaataaactcatctttatcctctgcagttactgccggttgctcccagaattggaccata

SEQ ID NO: 11837 - DNA, 467 bp, Saccharomyces cerevisiae
tcaaagtactaatgttctaccttttataagggaaaagaaatagaaaaagattatgatttgtaaaaagattttggtatgaatgatttgtatattacatttttaaggttctctaaaagaaggtttcttttatttagataaatattttttttttaatagacgtagccacatgcagcctttaatatacacattaggactggcttatttttgccgtgtagcgaggcaattatgtggtcacgatcactcgttgctttccaagtctttttaacattttataagattattagataatgatatacagaaaattagttataaaaaaaacattttatggaagagtatataaggggcaattaagaaaattagcattgccaaacgaaccaataatgggaaaacatcaagtatggctagccaaattctcggaagaatggattggccaaccgcagaaaagataaatgcaaaggaatggatgc

SEQ ID NO: 11838 - DNA, 481 bp, Saccharomyces cerevisiae
ttcccgtgggcttcctaccctctctcctgtaaatatatatatatatatatatccacacacactcgcacatacatacacacatacatacacctttatatagctatacgctgtatgtattcagaaattagtcacgttgtggaaaatctccctagcaatgccgcctaccttactcttattgtcgttctgtccgtccagtgcgtacttgtctttcaccaggtcacgggcgcttagctccaattctagtgtgctccattgcgatgtaacaatttcgacttcctcaagggggcaaacctccagtaagcggcccaagatgctcatctgcagaacaattatctctgtgggaatttcattatccacccaatttggatcgacaaacttccccatttgataaaatgttaaccaatgctcatcgcccaacgccttcatcatatgttggcccgcttcttgacaaatttcaaacacttgcttgcccaattcgtat

SEQ ID NO: 11839 - DNA, 470 bp, Saccharomyces cerevisiae
cttactcatcttaacaccatttgcttcagttttggtttcggaaggatcatatttcatttattcaggtagaagatatatatcatattacacacacacacacacacacacatacacatatacacacatatatatatatatagatatatatatgaatgcatccttgattccgtttcagttaacaccccgatggtccacccaagtttatatcatcctctttttgaccgaatctttatttgacaatcttcaagcagcctcagggcaaaattcaattctggagggtttgatatatgtgccctatgcctccaggtaagcggcattcgcagtagaagagcagcaatcacatactccaactaagttaaaagacgatacttcgtatcttgaaaagaaattaccttattcgtctagtttttttgcttatcccttctttgcttcgcactttctactaagctgtcccagcgttctcttaatcg

SEQ ID NO: 11840 - DNA, 411 bp, Saccharomyces cerevisiae
tgaagtcaaagtgattcaattcattcatctctattaataataattatataagttgactgcaccttatttcttcaatgcatgataaaattttatttgctgtatactacatttttaatattttaaagctcttcgtcacactttttctttaatactcctaagtttttgggtgaacggtggcaactggattgaagttatttcgcataacgcttagtgtgccgtaaaataataggacagacacttttctttgttctcgtacaaccctggggccgatgttaaacgaatgattttcaaaaaaacagtagacttacaaagaagtcgtgcactagcgcttatgggtcattttagaatgagcgaaatgcacgacaaccaggttgatcgtattgaagtaagagcagagctttatttgccttt

SEQ ID NO: 11841 - DNA, 490 bp, Saccharomyces cerevisiae
agcgaaacgcctctgcttactcggaacatcttaaagtaattacatatcttaatttctaaatattcatatagataaagaacgttttttttgctagattcctcccctagtcactatcaaatattgagctatttttggtgacttgtgttttccaaattattcattacaattgtgacttgatttctgaagttttaagaaaaattgcaaactaagttattacaagcgatttatccggtcgcgattgaagaactgaaaacaacagcagcagcattgtaccaagaatcccaagatgctcaggtgtgcggtcaagaagtttgcatattttgccaccttcctcactatcgtcgctaatatttacatctatacttatccatctttccatccagaacagtgttcatggaactgctctaacaagaacgcaccactacagaaagatttgacttttgtggacaaagtgaagaattacttcagtgatgttcgagagcaatggcat

SEQ ID NO: 11842 - DNA, 445 bp, Saccharomyces cerevisiae
atatcatgcataaaatgctttcacgcatcagaatacaaaaataatctctaggcacataaatacttatatagagttcaccacataatgtaagaaaagaaaaaagaaaaaaaaagatcacgaaagtatcccacgcgaagaagatctgtcaaaagacccccacaatcgtttatcctttttgaactgcatctggcatcgttaacagtaaggccatctggaacatcaagcaagcactccacttttacgtcacaaccatagttggttaactaagaaaagacagtacatatttcccttccgagtcacttattttttttttcttctgaaaaaattaattagattaatttcaattaatatcatttccgcttatctgacttctttcattttttttctctatatttcgcgtttactaggaaagaaaaggaaaaaaaatttttccccctccatctgt

SEQ ID NO: 11843 - DNA, 463 bp, Saccharomyces cerevisiae
tagtggtacgtttcctcattcaatgattatctaattaaacacaacatatgtatctatatagtccactaactgatggcatggacgtttacttttatttgcaataataacttttatctgagcggttaaataccgaaagacacgtttattacccgctttgaaaattttcaaccgatgagcttgcctttctaccggaaaactggggcataagaataagtactaaatagtataattaaattgccatccaaaaattgtatagagggtcaataagcactagaaggttaaaaatgtcgtattactttaaaaatctgaagccagacttgaactccgacgtagaagaagatgacggaaacttattggagagcataatggcgaacaaaagtaagcgagaaattgacgaacaagaatcaagtgacgatgagttgaaaaccttgtcttttggttctttgaagaaggctgaaacggt

SEQ ID NO: 11844 - DNA, 432 bp, Saccharomyces cerevisiae
ttggttcttacatgtcatattattttccattcattttgcatctcagaagattatgtgtatattatcattttcctgttgtgactttatgtacatttatatatacaaatttaatttgataatcccaaagcttgagctctttccctcaacgaaaagttttcattttttcttcattactttatatatctatgtttagtatacccaaagggtatttcggacgcaggcaagctgccattatttatagcggaaactctaagagtggtaaatctatttctaaaaaaaaaaaagattcattcaagcgccctccttggttagttagttagaaacatgtattcagagggaattaaataaagatgagtataattagttcttggttacttgtctctattatttgcttaactacttctattgtaacaaaattgcaagctgctggag

SEQ ID NO: 11845 - DNA, 477 bp, Saccharomyces cerevisiae
gaattagttatcttgttggcttttcgtgtttctagaatgtaccattgcctatgtaaatattttcaaattgcttgttttgaagatttctaccctctttagcaattcacacgtgaatacgtacaatatctattaagattatgaaaactgcacatatgcattatgtaaatttattatttttagtcagcacacattcaccaggttttgacggaatactatatatactgaaggttccatcatcagaggcaatatagacttggttgggaaattcgtctggaaaccctaagcaactcctgttcgattcattaactgttatataagcaaagttacggctcaggttctggtttggtattgaagattttatttttttcgagaagtaattcgcaattcttggtttcgagagaggtatttcctttggagttcccatactgggatttgaatttgatgctagtatatattcctcttcattccagtggccat

SEQ ID NO: 11846 - DNA, 400 bp, Saccharomyces cerevisiae
atggaaaattaacgaagaattacttccgtatacgtatatatatatatatatatatattaatgacacctgtaaataaaatacgtactacatcatctgcgacaagcgtacagtttctttacacagttatcagcatgactcttgtattttcataatgaaaaatgaaaataaaaattttagtagatgaatataatacgcagaaagaacaggctaaaaaagtacgaaaagcaacttcattatatttccgcattcatccttcaattatggccagcaagactttgagggttctttttctgggtcccaaaggtacgtattcccatcaagctgcattacaacaatttcaatcaacatctgatgttgagtacctcccagcagcctctatcccccaatgttttaaccaatt

SEQ ID NO: 11847 - DNA, 400 bp, Saccharomyces cerevisiae
cctaatcagcaaattctactagccccagcttttaatattcaatatcttgtttttctcaagtttgaaacctgtgtataattgtatttggtgtataaggctacgtggtggccttgaattcggaagtacttttcaaacattaatattctgtgatatacatttgtaaagaccttttgcgttgtgcctgaatctcaagccattgtgtcatttcacagcgaagtgtcattgttttaagcgatagaagcttggcgcaacgatcggataaaaaaaattgaaaaaaaaaaaaaattgaaatgaaaataaaaacaatcagatattcaaaaaattgaatatctgtattcataaagaggagaaaaaagaataaagaaaaaaaagaaaagaacattagactacacgtgcagca

SEQ ID NO: 11848 - DNA, 481 bp, Saccharomyces cerevisiae
acattgcatttattggtgttgaatctgcatacaccgattgttcatccttcatttttactggattgtactttactaaaaagaaaacttctggaaaaaaaacagtatccaaataactaaatagctttaataatacaatataaaaaatggagacactgttgtgaaaagtcaacctttactacggtttctgtctttgcctttgatctgctcacttttcggtaacttcaacactaccgtcagaattaccgaagtaggcttttgaagcgttgtcgatgaataaacctgtttccaccacgcccactaacagtttgatttctctatgcaattttcttggatcggaaatttcaccgaaatccgcatcgataatgaagttattattgtcagttacaacaggacctgctttagcagaacctccttgtctgatgtcaactttttcagcatgcaattgttctaatagatcattcttgaccctcacgtatgagga

SEQ ID NO: 11849 - DNA, 431 bp, Saccharomyces cerevisiae
aaaaggtctaacatcctttgagttatgttttcgtcaccacagttaaagagaaaaaaaaataaatagcgggtaaataattgtcatactactgatttgcattgttaccttgtaactttgaacactagccatgcaggttgcttttcctcctttacaccttcccccctgtcgctgttcaaaagtaaatgcaacaacaataaaacgtgggtagaggacgttccctgtatgtactaaaatcatactatcatccgttgaggtcgagcggttctctaatctcaacacacgctgctgcccctgagcttgcgagctaaggacaacagggccaacttgttctttctaggggggagaggcccaacttaggctcggtgaagagaagcgcggagctcacgaaaaggggtggtgtcgcgcactacttttttcgtggggaacttacg

SEQ ID NO: 11850 - DNA, 432 bp, Saccharomyces cerevisiae
ggataatatgtcagaagttgttcactataaaatatacgcatatgtaatcatttatttattcattcatgacttttagttgaaaagggcacatttttctttgtcgtaaaagtgaagaagacagcgaattttttcctttctccttcaagtattgcttttttgataaagtatttttcgaaatattgatacaattattgaatctttgtaccgtatcctttttttccttttttctaaggattcttcacgttgtaatttaaagtgtacagggaagaaaaatcgtcaattttaccgggccagattgtctcaggaagataagttccattttccgctataaaattctgacgttcttcctggtcctgagcatctaaattctgcaactgcttttcacaatctttcaatatagttttcattctgtttgccacatcctttctcctc

SEQ ID NO: 11851 - DNA, 436 bp, Saccharomyces cerevisiae
tttctgctgtaagaactattttatcaaatagaaagttataaataaaaactaagagttcttttggtataatgcataaataatttttttatataatgtttgtaattgtaatgataaatttttatcatcttggataattttcgtattatcgtaacattcattcgttctagttttatgactaatttgcatcgataatttctacagacgccctatcggcttctaatgagggtcttggtgttactcttctcagtaattgatcttctaaacatctactacttagcagtcggtcttgtacttgaggtcttacattaaaatataaacctttttcatcctttgtgtgtttagactttttgtacttgaaggtctcaataggaagtatccactctaaccaagatgtacccattatatcttgccagttggccattgaagaacccaagtc

SEQ ID NO: 11852 - DNA, 485 bp, Saccharomyces cerevisiae
cttgattaaggaaggaaaattagaaaaaaaagaagaaagctttttattcacgcatcatatcatatcagataagctagttttcacataatatgtgtatatgcagtatactcctgtacataacttcctttatttctgctttataattatatactagttatttttcttgggccgcttttattacggcaactattctatcaggtttagtcataatctaaatctaaagatggggaaaagccaaaaacactcaactttcaatgaatacaaagcttcatgaaagcaatagataaaatgacggataatccaccacaagaaggcttaagtgggaggaaaataatatatgacgaagatggcaaaccgtatgttggattacgcaaagcaattcaggatctactgatccaatcaagcttgtgattttttattaacaaattctctataatagttgccgatcatgtaacaccctacttgactttcagtacgtgaccggg

SEQ ID NO: 11853 - DNA, 449 bp, Saccharomyces cerevisiae
tgaaaatctaaatgtcgtgatgtataacttgtatataatagacagctgcagtgatcgaaacacattgtttccctttatagaacataactgttacgcttttgaacggcatttctatgagcttctagaatatttttccgccctagctggagaaagttcagacagaaaattatttaaataagtcgaatatcagaggtgctgatgcgctcacatcacatagaaaactggtaagacaatattcaggcgatcaaggagtaaaaatgactagacctaaaactttttttgatatttctattggaggtaaaccccaaggccgtatagtttttgagttgtacaatgacatagtgcctaaaacggctgaaaattttttgaagttgtgtgaaggaaatgctggtatggcaaagactaaacctgatgtaccattgtcgtacaagggttccattttccacaga

SEQ ID NO: 11854 - DNA, 487 bp, Saccharomyces cerevisiae
gaaaataaaggcatctacaaatctcattgtaggcatgcacgtttctaatattctaacaaaaacaaagtcagagttcacaagcaagcctgtaaataatatatatgcaattacacaaacgtatagatagatatacccaaccaaactgacttaaggtttaaatagtatggccaatcgaatagaacccaaacattatagccatattaaattactctttacgcttgtaaggaagacaatgtggaaacaacattaagagaatgcagacaattgacgcaagttgtacctgctcagatccgataaaactcgactatggactatcctgatccagacacaataaggattttaattactacagataatcatgtgggttacaacgaaaatgatcccattactggcgatgattcttggaaaactttccatgaagtcatgatgctggccaaaaataacaacgtagacatggttgtacagtccggtgatctttttcacgtga

SEQ ID NO: 11855 - DNA, 444 bp, Saccharomyces cerevisiae
agtttgtcaacgacactcacaaggtatttaatcagcaaaatccccgccacaaactatttttttgaagacatgctttctcatgactgcctaataacaatacctcattctactagtaatcgacctatgtaattatttcataaactataaagcaggtcattgcaataacagaaaggccggtttttctataagcttatctcatcgcataaaaaatcgacagttgtaattatctccggcggacttttccctttccgtcttttttttcaaaatttttttttttttcacttcttctttcaaagctgcctcaaaagagatatatatattggtaagaatcctcttccaatactagcttcatttcttcttgaaccatgaacccgttattctttttggcttctccattcttgtaccttacatatcttatatattatccaaacaaagggtctttcg

SEQ ID NO: 11856 - DNA, 452 bp, Saccharomyces cerevisiae
aagagaaattaagacggggggtggtattatagacaaaatacataaaaaataatatagcaataatacaatacaatacaatacaatacgatagtgagcacgattttaaaaaagaaatagagacagacagagaaacagagttacactttatgcttggcatatttaaaaaatgatttcgcccaggatcgaactggggacgttctgcgtgttaagcagatgccataaccgactagaccacgaaaccaattatttcttggagatgaacatttaagaaacaaataccttgtagaaggaatgtgaatttcaaaatattatggcctttggcaacaatggaatcacaacaattatcacaaaactcatacatctcttaagattcatttcttactttaagtaatcatccaaatttagccaaagtttgattttacctaaaaaaagcagaggattcccgatttcaa

SEQ ID NO: 11857 - DNA, 473 bp, Saccharomyces cerevisiae
tgaagaaagaaagaaagaaaatacctttttttttccactgtgtcgtttttattctaactactctactaaatcacacaaccacactcccctatttaataatatattttactattaaaatacatatacatgcatcgtaaaaaaagaaaaaaagaaaagaaaagaaccgaaaaagacaatacaaccaaccttcctccactttttctttttccttgttctctctcgcttcctacgttactcgcgcctgtgcactacattcccaccagattaactcaccaccaggcagagaaccaattgttcttgttattgttccaaccgataattgtaaagccattaaggtcgtaaacgactgcttactcagggagatctccgaaaacggcaattgctgtgcaccgtgcgacgttatgatcgccgcctgtcccgtacagacgaacaattgcaacaatgggcggttgtttagagaggttttgtgccgc

SEQ ID NO: 11858 - DNA, 426 bp, Saccharomyces cerevisiae
ttgacaaaaaaatgaaaaccactattatttaaattacggaaaaaaaaaaaccaataaacaaaaaacataataaaagaaatgaaaaaaaagaatattagtagagcatactgaattgttttcagaaagagagtgaaaggtaacaaaaatttacctacttttcctttttatttctctggtttcgtttcttttttttcggccaccctatttattttttcactgcttgtaaacaacgtctcacttcaatagtgtctccttcatgtactgagatactgctgcaagcgaaatatcacgaataataatataaaaaaaaaaaaaaaaaaaaaaaaagatgtttaaatgttaacaacctaacagcaataaaaaataaaaataaaggtagaagattgcaagaaagaaactttacaatattttgtttggatgcccaac

SEQ ID NO: 11859 - DNA, 486 bp, Saccharomyces cerevisiae
atcgaccagctctttagcatccatagctacttcttgcatttgtactttataatataaagcatttttagaaggcttaatcgatatcagaactaccaattgttcctactacaagaagtatgtgtcattgaatgaaagaaaaaaggatgcatggaaatagcacaactttatttattttcttccctttggaaatcggaaattcaatgatatgccctctgatataatagcaaagacatgatcgttaatttaggcctcgctttgaatccataaaccaccgcaaaaatgcaaaatctacggatcttcgaagaggccatgtttatgttggtgaagtttgtcacaagaaccctaaaactttcactaacatatacagtcttgacccatgacaataaaggaatatggaaaaatataaaaaaagattgttaggctcctacttagcaacttttcttatttccatattctagtatcagtggtcactgtgaagtagttccc

SEQ ID NO: 11860 - DNA, 428 bp, Saccharomyces cerevisiae
gaatgatgtcttcttcaacagagattttatatacatactctatatgtatgtacctgtaaataggccattatgtatgacaggaaaaaaaaataattgaactcaaatttcttctgctattcagttgctgcccccaattgtctgctaataaaattgatctattcatcaataggaattttagggacactatgtgtacaaactatccgctcatattttgccgaataagaacaatgatttcttcttttttttcttcttctttttcttgtcgttacgatcatcactttcaaaaacatcgccactgctactattccttctactggatgatttatttccagaggaacttccacttttaaacaccttaaaaatcccaactccacccccagtgaaggtgttcacagtactaaaactagacgagcttttctttgaccctg

SEQ ID NO: 11861 - DNA, 400 bp, Saccharomyces cerevisiae
caattttgagaatattcccttttttttaccggattaaaaaaaaaaaaaaaaattctgttatagatgcacatcatatctctctcctttttcccgcttttatatattcgttcgtattagtcacaacaaaaaccaaaagaatactcgaaatgttagtttatatatatatatatagtgtgcgttctttgcggatatggaaaatcttgatatctgctgcattcacgactatgtcgcgcggcaaaggtatgctcagcttaccgttaatgtataaaatattctctgcgaagttgtagctcggagagaaccggtccggcttcgagttcggagctttgttctcaataagaattcgcagcttgtaggcggcccctttgaacctcttcatctttacctcgtattccggcac

SEQ ID NO: 11862 - DNA, 459 bp, Saccharomyces cerevisiae
aaggaaaacaccttcaaacaagatactaagcatgaaaatagtgaactactgaacggacctactgagccaaatataacaaaaatgagcccagtttcatcgtctcccccaggtcacgatataaatgtcaatgatggtacaaaccaaaatacaaatgaggatgacagcgattttttcttcgacctagaaaaagaacttgaattatttagacgataaatttttgtagcagaaaaccacaactaatagatgcgcacatacactatctataatgaatatgtaaaatgcctgttcaccttcttaattattggtatatacttcaaatattgcaaaaagagaaagtcctctcggcggttttgcagttccttccgaaagcgggaaaaaccaaaatgtgagaaagtaggatacaccattgcgtagattcgcgatgatccgaatataaacatgattccctcgtcagtcctc

SEQ ID NO: 11863 - DNA, 467 bp, Saccharomyces cerevisiae
catgtttacagaaagataaacccatggccaaatttctgtattgtttctctcaatttatcttatgataaaaatgtaaaaaattatttaaaagtaaacaaataaacaaaggaacaattcaaaaacgagaaagtgaatgaaaaatataatatcatttattgtctgataatgctgcatttagaacatacgtaccatccgcatcagtggatatccaatgatagtaatttcgcgagtttatccgttgctgttatattatcactttttaatattcttttcaaagagctgaataatttcaacgcgtcttcgttaatggattccttccgcaattcttctgaaatactgaatgcccgatttataatatctttgtccaggcgtgccaatttcgccacattcatcccataactattataagtcaatcccttttttaacttatatagaaaaattacactcatccagtcctcgccagtttt

SEQ ID NO: 11864 - DNA, 493 bp, Saccharomyces cerevisiae
acccatttgcatttacttgtgttttttcctgttactatttagtcataataccgctaagaagcatataaatattcaaagagaaatattgtcgtacaccattaatttttcaataactcttaaatacgtttagaatgtcacaagttttcctcacaagttttcctctattatgtaatgttccctatactactttattcctacagtaataatgttgactatctattccttttcctactatcttgttcatctcttggtggattcggcatacgattgtaaccaaacgtacgattataccactttatcatgttacgtggtggttcaccaaacaccatgtagtactcgcaaaataaacacatgggacttgattcgttaactaggacagagaaatctggaacacggttttccgttctggaaatatattcaaaatcatgataatagtagtttcgtagtttggataagttttcataatgatgatgcgggcaacaacttttatggt

SEQ ID NO: 11865 - DNA, 434 bp, Saccharomyces cerevisiae
taggctatgtcgtcggaggagatatttattacttttattattctagttttttacagttatttattaattaattatttttatatgcatgcgaataaaaagtctatatttaagttcttttatttattaatacatttttttttgagagtcctgtgtagcctatttgttcttagatgcagatcctcctataagacataacctaggatgacacataaaacagtcaaacgccagtttgccgctacgttggcacctgcgttattaccgctcattgagcttgtactgctggaggcgcttccgcttacagaagatgttgtttgagtttgggaagtgacggaagaggatacggaggatacgactttatctccgttcttagtagcagtagaggaagaagaagaagaagaagaagatgatgatgatgatgatgaagcggtggaact

SEQ ID NO: 11866 - DNA, 448 bp, Saccharomyces cerevisiae
acctcctagataatgatattcttcaaaatttcttttcattcgtgtatttacagaaagatctttttatttaaatttacttaattagtgtgtatattaattttatttcctgccttttgttaattcctttttattggaatttgttatttacaagactgttttgcccatgaggacttgactatttcttcgcttgcttcttttggaactcagatatcaattctttttgaacatggggcgctgttggagcgtaatgactaaactctaatgaaaactcacctttaccttgagtcgaggctcttaatgaggtggcgaaaccgaacatcgtgctcaaggcacattctgcttttaatgtaaattcatcatgaccattttcggtatcctgtattactgcttgtaatttattcaataaaccgatgacgttaccttgaaactcgtttggcgatgttactga

SEQ ID NO: 11867 - DNA, 497 bp, Saccharomyces cerevisiae
cagcaattccattcattttccgcttggcttcatcgggctttcgttgccactcttcaggataacaaaatatatatttgttttttagcattaatgcaagtcgagaaaggacaaatctgcataattaaattaaatttttaagtctgttaagagtagttttatttctactaaaaatctttgcaatcaaacatgttgtgcgcacaaagcttccaccttgcacctactaatgttgcagactgatggatgagtttgattactcatcatataaaccaacgaaaaaacatagcagaatataacgcgcaaaaaaagaaacggactaagtgtgtaaatgtgccaagaaaagaaacggcgacacggcgcgtaattgacagaaaagaaatgctgtctttggggtgccgcaaaaagaaaagcccttttttcgatctaggagtataaggaggctactgacactgccgcacgctgcattatgtgccgcttctcacggctcatattttgtggga

SEQ ID NO: 11868 - DNA, 404 bp, Saccharomyces cerevisiae
cccaaataggtacggacatctacgtaagaatgcatgtaaataataatcgaataaaagaacaattaaacacttgtatatgcacgctatatctacaagaatccaaacagtctcaagatgtagtcgactgccaaggcgtacgtaaagtaaagtccggtgttgatatttgcattaaaatacttccagcagtttttaggattgtcaagatccactttctttatcatgctgaagagtctataagcgaagactcctagtccaccaatgaacccaggcccccataacaacccactgttcaagccggcgacagctaacagtgcgatttgagacgcggacatggccttcatgatagactttgtgcgtggaccccaagccaaagcggtagacttgattccagccttgatgtcaaa

SEQ ID NO: 11869 - DNA, 443 bp, Saccharomyces cerevisiae
tttcgtttacttcaatcttggattttcttctctaataatagccaatcgagagtcggagatttattaacaaaacactgtatattactattataactgcccactttcatttatcattaatattatttaaattgactctcacatagtatacatattttctagaaaaaaaatacgattcagtatatcagcagtcatggtcttcattcaatctgcgctcaagaattttttctcttgcctgattaaactctatggggaaatcgacacgcaaagcagcgtttaaatagtcgatgttctttcttgaagtttctaaatcacgttttattttttttgaagtagcctcaccattttcaaacttctcttgcagttgagtgagcctgctcttcatttcatcaatatattgtttaagctctaggcttttcgaatttataacagcggaggttttggtc

SEQ ID NO: 11870 - DNA, 420 bp, Saccharomyces cerevisiae
agctgactataattaagttcgataattgtacgatacaactgtgtagtatctttgtaattataatcatgatgataacgctaataatttgtacgtataatgctgactgaaagatgtacttttcttctaccgtttttcttcggcggctattcgtttacaatgatttggaaaaatgagaaaaattgaaaataaaaaattctgctcgatgagatgagatgaggttatgatatatatgtaagaattcctcaagaagaggttgcaagagtctgcagacattatcatggcagcaaatagcaatagtagagttgcatcaaaccatacttctaaaaaacaaaaggttaggaggaatatacatccattcacgaataacactcggattaaaagagctagtaaaatcgtaaagtttaatgattcaggcgaggg

SEQ ID NO: 11871 - DNA, 461 bp, Saccharomyces cerevisiae
ttgaaacttacacggtacaatagggaaaaaaacttaacgttgtaagggcgaacgccttcatgtatagtagcctatagaagatatatatatatatatatatatatatatatgaccatgaaagataaagtaaaaaagaaaataaatagcttgttcttccctctggggccggcgttcatttttttatttttttattttttaacttactttttttctcgtttttatcatattttcggttttacgttttggatttacaataatcatcattttatcacatatagaactcattaatctctttttaaaggatccggcttggaaaatttaggactctgtgcatatttcaaacctttgaattgttgttctttatcatgcgtttgatgaacgaccaagaacccaacgtctactaacttaggccagttgacaaactgaataccgttcttaaacatgaatttggttgaaagcgc

SEQ ID NO: 11872 - DNA, 453 bp, Saccharomyces cerevisiae
ataggcttggtttcattgtcaccttcctattttgaatctattcagtcataatacctttttgttcccaccgtcttcttattctttcgtcgctgttctttcttttattgattcgtcacgtccattttcttccataatataaaaaataaaaaaaaaatagaacattcctaattaaagcatccaaatatacttacatatatttattttaaaaataactacatatcaatacttacttaaattggtttggaatacttgagaaggggagtgagggtggaattgaacaaaatgcaggttattaaaatgcggaaaggtggggctgagctttgctgtagattgctcgggtattatatatcatttattttattaatttgttacgttatgttcagtttcaaactccaaatttcgtaactcttcaatgacgtttcctaattcgttttcagagttttccaatgacga

SEQ ID NO: 11873 - DNA, 408 bp, Saccharomyces cerevisiae
gaagttctcaagtatacacatatttgtatcggttatgtccccgactatttttttttgacgttcatcttgtcctttttatttcctcatcatcgaacccttcataatataattcatatttctatgtaggttgtacagctacgtaaacaattttttttgcataattataaagcaaaaacctcaaaacttcaaaaagagtaatcgtatcatgtattaagattaagaagtgggtggaagagcgaatgaatgttgttaaattattttatattactattgcgattcctgttatacactttttaccaatacccggcggtgcttcaattttccagtaaaataaaaccaacgcgaattggatatttagcacaacaatccggagcattttagttgatagggatcgattttgttaacaca

SEQ ID NO: 11874 - DNA, 400 bp, Saccharomyces cerevisiae
ttaatttaagtcaacataccgaagaatagagagatgctattaaaaggctatcatactctaagggcatttttcagttacaaaaaactctaatggcgttagtactttatagaaactcgctaatgtaaaatagccaagcacatacgcagacatatatatgtagtaatcacgtatgcagacattaaatgtgagccatttattggtataaatgtattcctgaattacaaaagtactggcgatggaatcactctggctatcactgttatttccaggcagggtaatactttgggaaaacaatagaataatgaaaacatatgatcagtagctaaattgaccgacctaaagagcaaagccggatctcatggtttttaaagggatatcaccgaatttcctggcgacttat

SEQ ID NO: 11875 - DNA, 438 bp, Saccharomyces cerevisiae
aaaaccgataacaaagtgatggcttaatattataacttctatataacggatatattttatggtaaatgtacatatttcagtaatggtaataatgacttttctttttatcttatttttatttttgtattttttgtcttctgctctttgtttctgtgcctcatatatcaaatgaaatatcatctctcgaagaactgaatctatttgaattttgattaccatcagcaaatggattttcaatgaacggttctgcactttcaaagtcgttacttcccagtccattattgtcattaaaggggttcgccgaagcatcttgtaattcaccgtacttacctctcttttgagtagtatcatacattctgacaattttttcttgcccaccctcttcagcctgtgaaaaggcaaatcctctttgttttttcattctttgcacttgcctca

SEQ ID NO: 11876 - DNA, 472 bp, Saccharomyces cerevisiae
taagccgatggcctcacaattggtatttagcactggattgctttacgaacggataaaaataattatgatttgacggtaagaaataattagatatacatacgtatacaaacatatatatgtattacaggtacttttaatcagttgcactgtgttcaaaaagatattttttaaatgcggggggagattcaagttttgttctcgcatttaaatttctgcatacaatttgtacttacaagaaccttatacgattccagttgagacacgtactgatatattaatgatcatattaagaatcttaatgcttaaaacttctcttcaattcagcatttgatctgtggcaagttaatcttgttccatttaacgtggatttgacttgccatgatcttcccataaagcggtaaatagcctttttggtaaaaaattgaaagtttaaaagtacggaacaaactttcgagtttttcctcaaaggccc

SEQ ID NO: 11877 - DNA, 413 bp, Saccharomyces cerevisiae
tgagcttgaggtgacaggcttgggtcagcgaaaaccaagtaatgacgcgatccctccgctgaagaacgacatcctgtatatagcattaacttgtctatttttctttatatcggtcttgcagtatgggccaatcatatcgtacaaagcgggggatttcccgtactttatgatgagcatgagaacagactttaaaggcatcgccatctcctcaaaagcaactataactcttcccataccagtataagctaactttgttttgagacttatttaattttggtagtttcctgaacgacttctgacaatactttaaaaaaagaaaaatatagaaaaatgagaccagcacagttactgttgaatacagctgtatgttaagggatattttctttttattgtgacaaacggataatcatgcg

SEQ ID NO: 11878 - DNA, 439 bp, Saccharomyces cerevisiae
tctttggcctagtcgggagcgagcgctcagtcaggtcccttatctatttaataatatttaacaattccactatttattctgtatagtaagtaaatctttaatgcaagcaaaaatcttcccgccgcgaatcctgaaacatattcccctcggtgaaacacgctcttgaaaatgacctgagaacacaagatatcagacggctcttgttgcacaaaaaacaaaaacaaaagaagcaagctacgttgcagccactggtactgtctgctaactcaaacattctttttcatttttaatatacagatttcgtattctcccgttcccgctatacgcaattttctttcttttttttccctctttggttaggagactgcagatcagtcccattttttccaacagaacaaacaagcaaacgtttcagtttaaaagaacacacggtcgtcgt

SEQ ID NO: 11879 - DNA, 407 bp, Saccharomyces cerevisiae
gctaaccatgcttacactatataccaaggaacaaatacatattcggaatattagtatggtgactacatttcccggattagtgtatgtatatacaaaaaggcacctccggggtagccggagtagaaagctggaaaaataaaaatgaaagcgaatggaatgtgtaagagaaaaaaaggaaagaactatcaagttgcagagttgatgacataaatagtagagtggaaaatcaacgaagatcgaattccaaagattatttttaggcagacagagactaaaagataaagcgtcatgtccacaccagctagaagaaggttgatgagagattttaaacgtatgaaggaagatgccccaccgggtgtatctgcttcaccattacctgataacgtcatggtatggaacgccatgat

SEQ ID NO: 11880 - DNA, 499 bp, Saccharomyces cerevisiae
agcgatctgctcttgcagtttgccgtgggaggaaaaaggcaaaaaggcgaccattagaaaaagaaacgagatgactaacacctttatcttcgagaaggcgcggggctgacagggcactgcgcgatgcgtcatactacttgaatacaacacaacccgtcttctgttatataaagaagaagaataaattaggaagtagggggaaaaggcttatagtgtaaaagtattttagtttgttgttgtaatttcgtcttttctctcactaccgtaacaacgtggtagttggcagaatatatatattcttggcaacctagttgttactcaaatagaagaaaaagcaagtttctccctatttatttggttctccctattcactcgcatttagcattggcatacttttttatatttttttcgttttgtttttggttttcctaggttcgatatagttataacaatgcactcttccgtcttctaagttttccttttattaaggatgcgcgca

SEQ ID NO: 11881 - DNA, 489 bp, Saccharomyces cerevisiae
caaaccctttaggtttcatgcatgtaatttcctcctatgtaaaatataggaatattaataaaacgcaccaataataagttagatatttttctgcaagatataaatttgtttactcatacatatatattctattgcggggcgctcttgtataagtaattcaataaaaaacctctatatgatacaattgaccaagccttcatttaccattctatatcaatttggaaagaagggtatttctctatttgggctctacattataacgcaatcttatacccattgcggatagctcagagtccaagtacttcaacacaaatggtatggccaccgtagttgtttcattaccaccaacaaatttgttaccttgtccatcttcccaaatttgagagtcgtcaataaaaattttctctccatcttctgatttagtcaatagcttctttgcatcttcgaatctcatggaacaacgacggcaacaaacggtggaaatcgaac

SEQ ID NO: 11882 - DNA, 409 bp, Saccharomyces cerevisiae
ccttttgcttcttccgccccaacattttagaagtatgcatttttttttttctttcgactacttaccttcccttgctagcagttattacaaccatcattttttcgtgacgtttcatagtttttttatatttttacgcaatgggtttcccgagtagttagttctacggtgtcgatatatatagtgttatgattttaaaaatgaacatatttaaatttttgaacctccttcttagttataggccaagttcattactccctaggaaacaaaaccggtccatcgtagaaattttttttattttacaaaagggttatagtagaatcaagacaatttatttatcactgagatattgatcgagtagatgaatggtcgctcaaactgctaaactgaaaggcgacttgtcattcaacaa

SEQ ID NO: 11883 - DNA, 475 bp, Saccharomyces cerevisiae
tgtgaactaaaaaaataaaaatgaatataaggtacgtctccaaaagaaatgtaaatatagaaattttaaaaaaaaaaacgaaaaaaaacataactaaatttaaagtgcagcccaacaataaccctgaaaaatctaaatatcttagaatttttttattttgattattatatattattattattcttatggtaaataatgcccctacttttcttctaaggaagtgagttaccaccaaaataaggaaatatcgcctgcaagcggtttttattttggagttgtttttttttttcccacaatagcctctagtttattccattcttagcactgactcttttttccgccactatttcttataaaaggcccgaatttctggcacggacgttgtttttaataataaaatattgaatgacagttaaaaaatcacgtagtcagttaatctgtttaacttgaaaatatgtctgaatcagtggccatt

SEQ ID NO: 11884 - DNA, 497 bp, Saccharomyces cerevisiae
gaaataaataatgaatgaaataaaaaaaaaaaaatcactgacaaacgatataacgattacttttttttaccatctgtacaattgtacttaattctaatagatttaaaaaactaaatacaggtttaaagggcttcctccatacaacagaggcaaggaggactaaggggttgacacgagcaaatttcatacatgcaaaataataatgtcttaaaggtaatttataccataaatgtagtaactaaacgaaataataacggcagaaaagaaaggatgcagctcgagtatttatacacgtatattacatatatagttgtccttatcattcttgaatgaaacaccgttgtgctcaccaaaactttgttattttatcttttcagaattgggtaatgattggttgtctggatccttaccaccttctacgggcttgagatctatatcgtcatcgtcagtatcgcttccgaaacgttgagagtatggctcgtgcttgatggctatga

SEQ ID NO: 11885 - DNA, 464 bp, Saccharomyces cerevisiae
atatagataaaaatcactgcatagggaaaaaaactttaaattttaggtatactgaagacaacaaaaaatacataacttaaaataaaggggcattgatccaatgttgtataaatacataggaaagtggtttgaaaattgtgtgacatcatacgactaattcatcaaacttagtgaaaaattctgcaattgccttggtagcccacgagttgttgtctttatctaggtaagctaaatgaccacctaaatcggttctacaatacaaaatacgaggattcttttccacgattgagtatggttgatctgggccgacaacaggatcatccctggaattgataacaagggtaggaacccgaattgtatcaactctgtttattgagctggccgctttataatactccatagcatttgggaagcctaaagcaggcgcagtgtacacttcatcaaattcccgggtcgatttaaag

SEQ ID NO: 11886 - DNA, 463 bp, Saccharomyces cerevisiae
taaattttgcgacgcctgccaatgcttttgtaaataaatcagacatatactgtaaataattagaatggcatttaattttttttttttctctacaccaataaactacgctacgcgaaaaatccaatataaatattcagttatagctaatgagagtgtcgaaaaaccttgaaaacaactactgcacaccaaattgatacgattaaatggtaccccccacggtagaagcatccttggagtctccttacactaagtcgtacttttcacctgtcccaagcgcgctcttggaacagaatgactctccaataataatgggtatcgatgaagctggcagagggcccgtattagggccaatggtctacgcagtagcctattctacacagaaatatcaggacgaaactataatccctaactacgagtttgacgactctaaaaaacttacagatcccatcagaagaatgctgtt

SEQ ID NO: 11887 - DNA, 483 bp, Saccharomyces cerevisiae
atatattgcacttaaaatatacatagtattaataatcattttgcattttccatgctgatttttcacgcaggttttgagaagcaactatgaaatattgaatttcatttacaccatcgcattatattagttcaaactaaaccttttttttcttgcggacaggcaaaatattaatacctgagttagttttcattccattgtgtgtttttacaaaggtcttttcgttacaagagggcactattgctaagtttgggttgatattgttaataatagcacccacattctcagaagacctttgtgaaatctgagatgcagtgcaagatgaaattgaacctaaaggtgccttctctgaaagagttggacttatagatgcagcattgttccttaaggcattcatttcttttgatttgacagtctctgtcacagatatttcctccgctttaacattcagtttcatagacttttgtgtatcttgccttatatccc

SEQ ID NO: 11888 - DNA, 401 bp, Saccharomyces cerevisiae
tttgggctggacatgatatttgctattgttaacctgctaaagatgcttatttgaggaagtacaaagaaaagaaaataaaaagtaaaagaaaaaaaatgtaacaaaataatattatgcataatctatatcttctttgtaaaaataagaatttatattttgaaatatgatagatttttttaagataatccgttgaagcaacaagaaaaatccaaaccaattgaattatggagtggcaaactcttgcacttttgcataacttggaggatgtagccttctataaattgcctttgccgtccagacaggaaagatcgagatgagtaatataactaaaagtccagcatagtaatttacggtagtcatataacctaaatcaaaataatcgccaagaaatggaaccgata

SEQ ID NO: 11889 - DNA, 429 bp, Saccharomyces cerevisiae
ttacacctgcattttcctttatgtgtatttgctttgtttgtatattattataactataaagaacgatttattttgtaatgcaaataactggacgagagaaccacgctataacctatttggtaataaaaatgtttgtatgaataaaaaagctgctgactgctttctttgatatgtgtatatagaatatttaatcggtgattgaatctaagaaaagcttacctctgaaagttctctcttcggtcgcttgctgatttgtagtaaacaatttgaaaagtttagcaaattcttcctcaggattttcaaaaccggcttcctttaaagaatcaatgacctcattcaagggaacgtttaaatcgtgtcctcttccaatggcttttaaactttcttccaattcttcacgctcgggaaactgcgataagttcttcccca

SEQ ID NO: 11890 - DNA, 418 bp, Saccharomyces cerevisiae
tccatggaggcacactttaacatgtgcatatatgtgtatatagactataaacttgtgtaagctatgcgagcattacaaacctagaaaattacaggcaataaatcaatattgatacatggcgaatttttgtggggggggggcaggatctttgcctacattttcttctttaattttacctagactgagcgattctgccaccttcaggactactgaacactttcaatgctacttttgccagaattatactatactaccacactttcatgtgatgaaacgtgaaactctaatcacgagatttagggggaggtgtttcatatgcggataacgccgttctcgcgcaagctgattttccattgcttaataaaaaggcgaaaagcctcctacatagaggatgatgttggtttgaccgtgattgatg

SEQ ID NO: 11891 - DNA, 417 bp, Saccharomyces cerevisiae
gtttttcaataacgcacatggtggtgtacgggtgtgttgatgaccatattttggaagaagtgtgccctggtggtaaagttgggttgaatggaacagaaatgtataaagaatatgtaaatattgcggttagcgatagacaatttgttgaagctaaatcttctgtgtgtgtactcaggactgttttaagaacgtagatagtatcatcaatcgaataataaaaaaaaaatgagcactaaagttgttaatgttgccgttatcggtgccggtgttgttggttcagctttcttggatcaattgttagccatgaagtctaccattacttacaatctagttcttttggctgaagctgagcgttctttaatctccaaggacttttctccattaaatgttggttctgattggaaggctgctttagca

SEQ ID NO: 11892 - DNA, 486 bp, Saccharomyces cerevisiae
tagaacttttaccaatgaaaagaaatcagcaggccataatttggctttattaaaattaataacattatggtgctgttgcgtttattaaaacagactaaagctgttggaatgaaattctaatgttatctatttagtagtaatagcatcacatgcggtgtaagaggatggcgtaaattatgagaagctgtcatcgaggttagaggaagctgaaatacaaaaattgataatgtaataggagaatgaaacatataaaacggaatgaggaataatcgtaatattagtatatagaaatatagattccattatgaggattcctagatcctcgaggagaacttctagtatattccgtatacataatattataagcctttatcaacaatggaacccccaacaattatctcaaaattcacccatatcttaattagtaacatgaatagtactaaacagatgatattttaaagtttcattccaacaagcatcttaaat

SEQ ID NO: 11893 - DNA, 454 bp, Saccharomyces cerevisiae
accacttcataaaatcacgtaaatacagatagaaaacacattgaggcaacaggaatgaaaatgcaccctactactctctgaaccaccatatgataatattccaatctattgtgcttaacattaaaattgttcaaacttggtataagcaacaagtgggagaattaggtgtacctcaaatttttgaaaaagcacagagtgttactaaaaattttaatatgtatgtatatccttttctagccgtcaaaagtgtaagtaatttcgaaaaaatagattctatttcagtaagtcagagattcgagtcgcctcccgtcttccgctttcccaagcaccataggcacagccggcgccgtccatgatagtatgttcgcctgcaaatcttatgcgggagtcttgaccattagacattgcaacaaccatatcaactggatcatctcctggaaaacaggccgaataa

SEQ ID NO: 11894 - DNA, 497 bp, Saccharomyces cerevisiae
ggcagaaactgaagtctcttttatatatatacatggggtgctgactaaacagttccaccctatatttgagcgtcgataaaaaatgaatgaacgtgtatcatcgtttattataagaatcatagttttatggacaagttttccgtttagcatttatacccatatagtaaaaagtttcgcagatagtgcgatagttgtattctgattgccttattattatttcactaattctttattcacgtagagcatgacactttttttatgtgtttccttttgattgtgaaataaaggcgaatcctaacaaatattaaaatgtttcaatacattgataaaaattgtaaacattatttttttgtagtataaaaattcgttcctcatcattaaagaaacaaaaagcatacagataataataaaaaaggcactttagacagaatgagaatactagcaatcacgaattcctacttttcctttctgtatccctaggcgtttcactcgacaag

SEQ ID NO: 11895 - DNA, 425 bp, Saccharomyces cerevisiae
tctttcatcgcatatcttatattcatatagcctagaaaaaaataatcaatatcatatttgtaattctacatcctttcagaaattagtatacatacgtatctatagaaagcaaattaaatcttcatggaaggggtgggggtggaggaatacctgcaggtggaattgatgggatacctgcagtagaaactggttgtgccccttcttcctcttcatctgtaccaactgattcaggaatcgataaaacgtcatcatcagaatcggatccatatgcgcccgtgcctttttcagcaccattgtagttatcaacgtgagcgataataggttctgaagtggaagcttgttgagttggtaaaggtgggggtggaggcaaaacgcctccagctaaagctggggtggaagaacccgatttttgcacggcagtagct

SEQ ID NO: 11896 - DNA, 436 bp, Saccharomyces cerevisiae
tggtaatcctctaaaatcgaacatatttgagtaataattctcagatacagtcctattctatattcgccacaaaacaagtaatgatgctaaaaaacgacacatttataaaatcacatcttattgattaaataaatacgtagatagatttttttttttaaaacatatagtgtgctattatttctgactctgtctcatctcagaaaaataaatgataaaaaaggaagtaaaatccttaaacgttatcaggttattagcaacttgaaagtgacaggagccacaacggattaaaatttaatttctagtaaagaaatgtcaagaagagtggttatcacaggattgggctgtgtaacgccgttgggaagatcattaagtgagtcatgggggaatctgctctcttccaaaaatggactcacaccaatcacatctttgcccaact

SEQ ID NO: 11897 - DNA, 442 bp, Saccharomyces cerevisiae
gtgcgatcgctctgccttcagtctcacactttttcttataatctattgtcatgaaatttatacagatgaaaatgaaacgttatcttgggtatactgcattctcttttcttttacatatctacctatctaaaatacccttagttttatcatctggctgataacgcaaggaccacttaggtcccatgatggtgataagagccatatccagtagtgtgaaaatccacgaagcacagtagaccaaaaatgagcagattgccactaatctgaccaaaaactgtataaagcttaaacgaacatcagaaactactatggataatggttcgaaattgtatttgaagaagatgcccggcattttatcacctttagcagcgacatctttgtacaaatagcggtaatcgttaacagaatattgattagtatccacttctgcccccaatttctt

SEQ ID NO: 11898 - DNA, 423 bp, Saccharomyces cerevisiae
ctttttatgcattataattatcgagttttatagacctatatttaattttttaacaactttatctctcttgagaatttttacatgaaaaaaatcacagagtaacgctaacctttctttaattgaaagctgccattgctcgtttagttacaaaacgcctttgaacttgccttcgacactttgttgcttcggagtcgcggagtattcaaaaaaagaaatagtataatagagagaacaatagagatattcgcgaagaacaccaattcaaacatatcgagtaaagtgcaattgagaacgccaaaaagagcttgtataatgttattaccattaacaaagctaaaaccgagagcaaaagttgctgttgtagggggtggcgtttctggactatgttttacttattttttaagcaagttgagaccggatgtt

SEQ ID NO: 11899 - DNA, 496 bp, Saccharomyces cerevisiae
cgctcatagactgctttattttttgtcttcgaaatttcgacaaaaagatatgagcaatacttcatacacgtttgtacagttaagcatatatactttgatagagtactttcatacctcataccacttgaaaaatgataatataatgttataatactacctcataattgctataaagtaaaacaattcggcgttgtagtttatgcttctataatcacaaaaaaatttcactgaagttgtcagattctgccgcaaggcttctcatagattttgttaagtggtcttactcggttttatggcttgaaggttaacataattatgaaaacttattgatatcctccccacccctaacgttttaaaaatgatctcgtccaatatgtttgaggtgaataatatcggaccagttcttgtttttaaaagataagaattgctcatatttcccatacttgttggaaaatttctctcaacaattgtatgaaggcaaaatccctcaattgaa

SEQ ID NO: 11900 - DNA, 464 bp, Saccharomyces cerevisiae
taagtaagaaaatcttgtaaatatgtaatcttatgttaaccgtagcatcattgtgttggacgaaatcctctgtgatgttctgtgtgattgaaattgtatggtattttcgatcatacgagtatttttcctaaagatgaaagagaactcgattcctaaacagttgtttgtagggcataacgttgtatcgtaaatacttaccatacgcttaggtatattcctttagatttccgtaacacctttcagttttactattccgcgtggcgaggtaaagatcataaaaatacaagtttgttatagcatttcctgcaaataattgctgtaactagtggcgaaaaggtcatagaattattcgcctaaattatgttgttgttagcattaagtgatgcacatattcctgatagagcaactgtatgtgttattctcctttcttctctggttagctgtagtggaacctataacggcca

SEQ ID NO: 11901 - DNA, 416 bp, Saccharomyces cerevisiae
tagtggcgacaagcgaggaaaaagggctagacttggtacttgaaaattgcatttacgttttgtataacacagttcagtaagagtacacattcaataacgtagtaagagtatatttatttatataagaaggataaaaaagaatcaccaaacggatcacaaatggcataatcacgtagcaacctggaaataaagctataagttgaatagttcagtcaaaattttgacggtgtcatcaggggattgtactgaatgtccgatggttctttcatcgacaaaaatttcgtaatcgttaccaccgaccatagtcttgtcaccaaagaaatgaatttccttgaaaccatctttttcaacgtgttgcaaacagtaggtcttatcccaaccagcggggaaaacgtcgaaagagatttggccaccaa

SEQ ID NO: 11902 - DNA, 431 bp, Saccharomyces cerevisiae
aacataaacttaaaaacttttaggagaagacaaaaactaagtaacaaagtagactaaatgacaaaggaagagcagcaatgacattgacatctcactttgaaaatttttgttttcatttttgtttcaatatacacgtatgcatgttctaatatatatatatatatctttttctttttctctttcattctgtaaataattagcagtgcgtataaaccacaaccaattttttcaaccttgaagccctcgccaatttgcggagcctaaaaaaatctggtcaaatacaaaaaagatagtatatatatctatcatgaaaattagcttgcataacaaacggcaacgaggagaccaaaaccaaaacatgtctgttttcaatgtactcaaaccactacttaaaggttcaaatagtttcaaagtgaagctcaacggctttc

SEQ ID NO: 11903 - DNA, 400 bp, Saccharomyces cerevisiae
aactattatcctacataataccggcattactctgcccttttcacacttcaaaaggatagattaaattatctgtatattatacaattccaatcataaaaattgtcattccgattgcccttcggtaataatgggcatatccaaataacggaatatgtgttttttatacttattggtcgctgacatatgctgttttttgcgagatgtctctcgtctctgcagagcagttgtaaaattataggtcatgcatttttttttttttgataatgaataactatctaatctaacaaaatatacgtgagatactatgcccatttccctagaagagccattaaagcagctccacaacacatgatgagatatgcactaagcatttttttgaggccatcaggtcctttgaatt

SEQ ID NO: 11904 - DNA, 445 bp, Saccharomyces cerevisiae
gatgagcgagcaaacacagggagaaaataaagcgcaattatttacctcatagggtacacaatatccgtgagaaaaggatgaatttgaaataattatacagactccttttttttcaacgtaaaattataagcatagattagaggcgctcctggataataataggaacacacacaagtaaatcagcaatttctcatatcgtacttattcggtagagttaataatattctactaaaataactactggtaagtagtgagagcttgatttttgtactaataacttgtttcaaaaaaaaaaacgaataatcagttttacaaaaatgtgtatacctatataaacaatcttagaggtaaagttctccctcactaaaaataataaaaaattacgtgcagatgagaaccccgtcttaccttagtatacctttagttccctttatgacccgatttg

SEQ ID NO: 11905 - DNA, 421 bp, Saccharomyces cerevisiae
atgatctgttatttccttgttgtaactataaattttctaaaagaaaagacaaccatttgccattattttgttaacattttttcattgtttttgtttttgtttgtttttgtttttgtttttatttttgtctactttttttatgttattttgttttatcgtttctgttcgttgtttacctattttcctgccaattcaatttggtactatctttctattatcaatattttctttcccttatgtttttttctatatgaaaacttcacagggagaaatagaagaaaatgttcattattctgtttaactttgataaaaattacttatacgtctcccaatcatggtttcatggtcactggtaaggaaaaattcgaaaaactacgggactaaaaattttttaaagattgtccatattcctcgatccaca

SEQ ID NO: 11906 - DNA, 499 bp, Saccharomyces cerevisiae
ttgatcaatcaaattagtggaggaagatagtcagaaataaagccttctctcctcctctttcgcatctatacatacgatttcatatatacgtttcattgcatcatcttttgatatatctcaaaaagatctcttagttcgcaaatagtcaaatcttcaaatttatagcctttatattttttccacgatttctgaaactcctttttatcagcaccgttaatgctagcggttactgtcaaatcgccggtaaattcgcgatttccgtgctctaaagatgctgaagatcgtgaagatgatgaagttgatcgtgagccatccctagacatctctgttgtatctctattgctcaattccatggataattgagacgaacttcgtggtatgtttaagttgttgctactgtgaaggttattattgctagtattgttaggatgtggtggagtatatgacctaatttttccgatgatattttttaatgatgaatcaaaaacggtcctgaagc

SEQ ID NO: 11907 - DNA, 428 bp, Saccharomyces cerevisiae
cctttttccaatatacacaaacatacacgttcctactcacttttttactatcacttctgtttctctcactgcgtatctatattccccgtttggttcctttccttaattacatagaagcttatcaaatatgaaaattctttcattatacaggcaattttttgtttggtttcataaatacataaacaaacagcttataaaatatttcttctgttagcaaatttaagtttctttatatattccttactttcgcgtctcaacacaaaaaaacaattaaaaatcaaccatagcgcatagagcgtattccgacgacttcaaggaaactatcgctgtaaatgtgaatgcatttagaagttactattatcgcctttgacatcatatttgaaatattctaccttcatgtacttaaacgcccaaattacccgatcttt

SEQ ID NO: 11908 - DNA, 443 bp, Saccharomyces cerevisiae
atacccacttacatttacaatatgttttatttttaaacttaatgaacttcataatttaatgcttaatattttccccctcccaccttctcctggcgttctctgtacgtacataaccatttattttaatatataatcaaatattgtaacaattgaagcagatgagtctcgctccttagttaagcacgtgccgatgatatcaattggatttgttagcaaatcagccttgctgctcgattctctgctttttttttacttctcggtcattgaaaaatcctgacgaaaatatttcaaggtcctatatggtcatcgaccttgagcatgtggtagactacataatgcacatagactctcagcttcaactccacaaggcttctccagcaaaaatgaattcagagtctcgagaagatatggctataaatagtatcaaattgctagcgggaaac

SEQ ID NO: 11909 - DNA, 479 bp, Saccharomyces cerevisiae
tgaatcgctttctagctactttttactacaagaaagcattcgcttaaaattaagagtgtatgttggcgcatttaggcaaacgtcttctaaattagggctatagacaattatgtcgctcgtacatttttcagatgtagtgacgcaaatttctagcaatttgcaggtagtgctccacggcccccttccaatttttgtgcactcaatcgatcaaaacaatagagactgccctgttaacttctcaacataattatgtaaaaaattatctcattaagccagatagcaaatatatcacatattgcattgattaatttgagaaaaatatacatgtatcttttcagttaattttattaaaaataaattatttccttacttttttttctacagtttgcaccattaacctcttttcttgcatccatacatctttgaactccatacatcttatttttttgctgttttttttcagtgtctcgggcatacag

SEQ ID NO: 11910 - DNA, 477 bp, Saccharomyces cerevisiae
cagagttaagagtctaccacttgaagcttagaagttggacggacgtaatttaaatgcatttactagcgccgttggttttcccaatgctctgcggatataaattagttacttgattccctatccctaccataatgctatgaaaaataatggtatatttggtatacgtttttattatgatacaaaaataaactagaaatattatttgagaaactatatataatgtaataacgtcaaatacgtaaggatgatatactatatcatctggaattttcattttcattatgcttttgttcgtcttgctttggagaatatgcaggagatcctgggctgtagcctggagatgttggggagtaagaaggtgaagtagggctatagtttggagaggtgggagagtaagaaggtgatgttggggaataggatggtgatgttggagagtatgaaggcgatgtaggactataacttggtgatgttggggaa

SEQ ID NO: 11911 - DNA, 444 bp, Saccharomyces cerevisiae
cagttttgatgttcccatttaaagatctttaaagatatcaccatgggcgagcgaaattgagaaaactagtgcagctcgcatttggtcacgtcctaaaaattgtaaataagcgctggttcaacaaaatttaatatacacacatatataattatttatttataacagtcattctgctaaactatacatcaaatgtcactaatcttgatattatggtcgtccctgtatcatattagacgaacacacctgtttttgggcattttccgaatttttttttcatgctagctaagtcagaagtactacattaaagaattgagaactgactgctcccaccattcttgaactctcgctttaaattatcttactatcttttgagttccttgtaactattctatcctaaccaccacctcaaaaaaaaaaaagtaataaaaatgtcttgggacgacg

SEQ ID NO: 11912 - DNA, 436 bp, Saccharomyces cerevisiae
cttcctaagcactgtgatctgctagtcgattccgaggttcggcgaagaaattgtcgttgccccgccaggggccttttgcgatactcggcgcttctttcagcaatctcggtccgcatctcggcaagggggggcatgacacgggccgctctggttggtcagttcctattttctgtaacttccattgtttggttaaagaatatataagttattgaaaagctcataggtcccttattataggccctaaggttttagtttctcatcatagtcatatcagaaaaaccctccttctaaagttttcctcttttcttatttctttttcatttattattcatatttatataaatatatattccaagtgcatgacattattggatacactttttctgaacctgaattaccttggtagataataagatacagatcgggaacgaacaac

SEQ ID NO: 11913 - DNA, 400 bp, Saccharomyces cerevisiae
aggtaaaaacggacaaccggtgtataatattaatttaagattacaagtgattttttttttctttttttttgttatttttttttttgttcttattatatggcagcaaacattcttggggaaacaacatagatgggtaattatttagtttataaagtataatattccaatagaaaacttaagttcggtaatgatatagccctctctatagtataaggtaaatctcattataccagtcattccaaacggaattcggtccttacccgctgctcgctcttttttcatcattatgatattttctttattgagtcttttcaattatagtagtagaatgataactgacaagaaagatcagtttgaagtttattagcgtgtctcgttatcagggcttccttgtttttca

SEQ ID NO: 11914 - DNA, 413 bp, Saccharomyces cerevisiae
tgaatggagagactgaaaaccataatgggttaccggggcagaataatacgaaataaagaacctaggttttccaaggtttttgcaatatataaacttgtgcttgatttaagtttatgcagcacttttcttccagcaaattctttatgtttttttaagggaaaacgtatatcacttagagattatattaatgaaaaaaggtgtatacaaatgtataataataatagtatataagaaaagtattcgctatttatagtgattttagtttgtacaatgtactgtattttttttaaatgtagtattttatatatatgttacattagttcgaactgaaaaggaacttatgaattaaatcatcacaattcttggttcttccgtaaagctgaattgccggacggttattcccgcattcttca

SEQ ID NO: 11915 - DNA, 471 bp, Saccharomyces cerevisiae
gaggatgcatgattatagcctagctttaaggctactttaaaaactttttatttattcatacatatatattatcgaacattcgtataacttaatatcattcaaaaaaaaaaaaaaaaaaaaaagaaaacatatacacatatatatttatgtttatagagagagagagagaaaatttgaatttttgaatcatttgcaaagttatatgttttatacattatttattcattttttttggtgtcgaggacattgtgctgttcagagaaccacttaaaatacgcatcgttctgtaaatatccactttcattaaaaaccttattcacttctaattttgccttcaactccttcttggagttttctcccttttttttctgaacaagctcaaccagatataatggttcgttcttttcgaactttgtctttacatatatttcctcctttgtacctcttctctttcccacataaacagtcccc

SEQ ID NO: 11916 - DNA, 430 bp, Saccharomyces cerevisiae
aaagtaagacaagcagccctcaatcaacaaggaaagcaaatcatcgtaagaaactttacagtcagcggaaagcctttttttattttggaagtaagaccaattattattggctgattttctagctcttgcgaaagtattatattcaagaaaacgaataaagcatctatattatcacatttaactaaagagcatttttaataagtagatttttacataaaatatagaataaatatcaatattattaatcatttgaagttcttcaacgggtctactttaccattctttggcttactgactcttccctttttatgtgaatggcgcttcttagcattgtggaaaggaacaaacttgactttggttccatttcctctggctgattcaggaagcaagtaatctggaacacgctttaaatgctgttgcactcttgctg

SEQ ID NO: 11917 - DNA, 401 bp, Saccharomyces cerevisiae
aatattgtttaatttaacgaaccctgttaaaacatcagtataaaatgcgattaactatagtgaaaataacaatattcatttggtgacttcgaccgtatatgttataagttagacatgctctttgaatcttttactttgatattttattccgcatatatattctttttttcgcgttcatagtttattcactcaaatttttcatatcatccgcaattcatcttccactttttagcagtaaaaatgaccaaatgaagttcatttatttttgattttttaaccgtatttggtggaatctgagcgtggcattagtgaatcattttaagccaaattacccgtgagtttttcttagaagcgcacaatcatattcattattaataaatgcttcaaattcatcctcttga

SEQ ID NO: 11918 - DNA, 499 bp, Saccharomyces cerevisiae
aaaaatcaccctgcattgcctctttatttgacgttgtttttgtagaacatgaaacgaattttgacttgatgagacgaagtatatatccaaagaataccttaaatagaaaaggaaagataataaatactaaacactactatatattcaggtaaaatacaaaaattataacatttttaaaactttttttttttgaaagtccttctcgctttaggattttttcccattaagattatgatggtttcatgtatgtgtcagttaaaaaaaatatggctaagtagcaatgaaacgaaccaagaaaatgaaaacaatatatagtgctgttgaaataacaaagacattggtatatatttgtaaaatgtctgttaaatgttttttatctcaggttcttgcttgtctttggtagaagaaattatagtaaacaaacaaacaaacaaacaaaaaaaaaaaaaaaaaaatggtcgcaatctcaatgatttggttttttaccaagcgtatgccc

SEQ ID NO: 11919 - DNA, 493 bp, Saccharomyces cerevisiae
ggttaattcaggtattatttttatggcggtttcaggtattttacgtaatattattattatatcatttttgtagcaatatattatttttagcggtgctttataaaacaatggatactaaggatggttcaattcactcatcatttggatttatcactataaaaagcagtaatgaatcttatatacatttatttcagtgaatccatatttaagagagcttcctcagtgacccctccccaaaactcctctcctcctgggccctctcttgattaatttaaattgcaaaaagatttacaagtttgcgaaaagactgctttatttccgcttggcctgtgagctgtgtgttctctcttctaatccagtaggcatgttgcataaataaaccttatatttgatgttgttttagaaatgtaatctatatataatttcgtagtataaatatttataaataaagaagtgaaaccataccactcataaataatgcgggatggttgtc

SEQ ID NO: 11920 - DNA, 461 bp, Saccharomyces cerevisiae
tatatagcatacaacataataaaataatagtacaatcacaaaattaatcataatgttcatttatctataatcaaacaatgagaatatatactgaagtttggtaggttattcttcagagatgcagtacgatatcaccaacggtatgcagacacctatcaaaacataaacggattcatcatgaggtaaaacgacttcctgttcaacgctgagatcgtgatcatgagaatctccaccaacaaatgctgtgaaagacgcatatagtaaactgccaccactcataagcagaagatttccacttatccaatccatcgttggcgaatgactcagattcaaaagggataacactatgtatccgatcggagtcgatgacgcaaacaagaaaacgttacagatcacctcccatttcattaagttttgtctcgataccatcaaactagtgagggaaagaacggcaggaattt

SEQ ID NO: 11921 - DNA, 467 bp, Saccharomyces cerevisiae
gacacaatgcgaaaaatcgcgcagggacataatttttgttttcattattctttcgcttattccctccgttagctccaccgcttttttgattggaatttcctttcggcaatggctttccggttaccacgcctcgggtttcgcatcccgaaaagcatatctacacaagaaaaatgaatgataaacaattgatgagtggcgctatttcccttatcatctcattattgtacttagtatcgtctattatcaggagaaatcgcatgaactaagcccattttctcacccttctgccttcttatataaagcttgctgggaaccgaacacaaactccacaagtccgtagcagctcttctcttttgtcttttatatatcataaacatcgctacatagtaataacactaacgcacgctagaaatgatagcttccaaaagctccttattagttactaaatcgcgcataccctctctatg

SEQ ID NO: 11922 - DNA, 408 bp, Saccharomyces cerevisiae
atatttttctctttacttccttacccttcctccgctctcgtcttgtgtcttgtatatgatttctatatatggtaaaatattgcatacatcgtctaccatttagccagacttttcggaaacgaatttaatgattgcagcaaattcccttcccctatcaactgattgaagaatgcctcgaaacgcaatgtgatttttaagttttccatttttttttttttcataagggaagcctctctcctccgaaaaaggtaaacattgcgaaaaatgatccaaaagagagaataaaaaaacaattagaaaatgatttactcatccgcttactagagaggccaaaccggatagtcctgacgctaataagagtaggattaagttcattgtggtgtgtttttttattgcgcgtaagcgata

SEQ ID NO: 11923 - DNA, 480 bp, Saccharomyces cerevisiae
caagcctggtgaacaatttttcatatttaagtaaacactcaatgtataatatcctctaactgttgtaatttcattaacgtagatggtttgcgccttttttaggggactcttgttgattgattctaactactgaggcttaagttgtttcaaataacactttttcagaaaaataatcgtattaaaaagcagaaaaatcatacgtaagatgacagaagcttcatatttagtaactctgaattgtataacacaccaattgccgatagaatatgaaccaatcgatcttcagcgttcatgtacttaatttaactacctgtattttcttataaagataaaattggtgtataatgtaaggaccaagagaaaaaggaatcccgcatcccaagcaatttctagtggactatttcttcaaaaaataactcaataaacacctatataatgttcggaggttatactttagtgttttagaatgcagtaccaaaa

SEQ ID NO: 11924 - DNA, 428 bp, Saccharomyces cerevisiae
tatggtgcagtgcctttcacgtaatctcaagagccaccagcgcaccactggttggaaaagtatacaaaaaattcaaaaaaattataaaatgttaccggtgtttgtgtactattatatatactgtaatcaacatatgcaaacattttgaaacaggtcttgttaaacctttttgtcatcacacgccagaattagacttctttgtgcgatgaagtaatatctattaccagaaaagaaggtcttacccttgtttggcctctcatatgtttcctacttgtttcccgggcgtccgtaacgagtactgactgtatggcgaaaagttgccagaaatgttcatttttgtttctgccaatttcaggaaagggtaacgtcattacagttagttaacgttcgaacttacttatagaagtgccttggctcatatgcaatgt

SEQ ID NO: 11925 - DNA, 500 bp, Saccharomyces cerevisiae
acgaagtaaaattttctcaaattcactataatgaaaatcatccgcattgtacatatataaacacacacacacatatatatatatatttgagattctatttattttcattttgtgttgtaatgctataaaaaaaaagatcttcgtataaaatctcagttcattcaacctactaaatgattctagcttcattttttggaggtctagcaccaaaaatgtcggtaccaattctgacttccgctgttccttgccttatagcctccctgaaatcagcactcatccccatagacaatttcaatgatgtaccaaatttagcatcaatcttcttcttccactcaaccagcgtagcaaagtctctgttttctttgctatcttcatgagagacgttccatgaaccaatagtcattaacccattcaacttaatatacttgcattcttcggataagaagaagtcgatgacttcaaatatttctgcttcattattcaagcccgatttttgatcc

SEQ ID NO: 11926 - DNA, 415 bp, Saccharomyces cerevisiae
ggctttgttgaatggtccagcagattaaaatatgcttagttgtagaacacagaaaaaatgagaaggttgatatacttttactcatattaatcctgatttagtggcggtgatcctttttagattcgtttaattcataaacaaggtacatcatatagcaataacaaatatgtaaactatgtagaaagacttatcaagtttagccattttggtcctcattcatgggcattttatactaacttcatttttgccgaaataagaaaggatgtaatcttaacctaaaatatgtaagcaattaagggcgcacgtagtcacttgcgaacaaataggaaaagaaagaaacaagcacggatactgaatgactgagtgtattactacacgatttatctcaacgaatttaagtgtggaggacgatcgg

SEQ ID NO: 11927 - DNA, 446 bp, Saccharomyces cerevisiae
gcttaaaacctgataaaatccatgtatatttctttgccttttctattcttttctctaagtatagtttttatgtatgtatattaattcaaacagaaaatgttcaactccgtctccataagaaaacttctttcaatttgaacacttgtatattcaatcagaattcgccatagagagcatgtcagccaatgtacaagaagctgcaaatgcagctatagagccggccagtttcgttaaagtcccaatgcctgagccaccaagtagtttgcaacaattgatcaatgattggcaattaatcaagcatagagaaggtgggtattttaaggaaacagataggtctccctacaccatggaagtagaaaaaccagtaaatggaggctcaggtaatactgaaatggtaacaagaaatcaatctacgttgatctattatctactaacccccgacagcc

SEQ ID NO: 11928 - DNA, 436 bp, Saccharomyces cerevisiae
gttggtaattaacatggtgtagagaattatatatagatgaaaatggagctcttttgaatagctgtttatatgtagatagagtaagcaaaaatgaaaaaagaaaagcacgtaaatacgatcgcaatatggtttcttttccagcggagtacataggtctgttagaaatgaaacgaaacgaaacgaaacgagattggtaaaagtacatatacatattgattcagattaaataggccatatggataccatgtggtataagagggcacttttagttcttttaggaatgatattaacattggaatattacaaaattatgtttttttgtctgctgcagctgcggtggaagtagcatgcggctgttcttgtattattttagtagtgatttttttatcctcatgactatcgtcaggatcatcgctagccccacttttcttcgatt

SEQ ID NO: 11929 - DNA, 444 bp, Saccharomyces cerevisiae
aaggaaaaacactcgatgatgataaaatatatattaataatacaatttttttatttatttatttaatcatatgtatagatatagaaaaagggcagtagagaaaagaggaatagaaaggagagagataataaagcaagtttcaaaaagaacaagaggaaaagaaattaaatcacacagacaaaaacgcggggaggaagtatccctaagccaaagtggcgttatataactccttttcggattcatatctcttcttatcggcctgggccttggcctcgtaaggctgcttttcctctggcgttagagccttccacttctcacccaacttcttgccgacttgtccaaatgtgatatctggattttcagaacgaacaatatctctgttttcgttagcgaaaaacatgtaggcggacaaagccctcttaggggcatttgggtccttcttct

SEQ ID NO: 11930 - DNA, 413 bp, Saccharomyces cerevisiae
tgatctgtaagtagtgaaaagacaaaaaagtaccgtcaatttcgagaaattttcaacagaccttccttcttctttctactgatctattctgtaaatatgtatataagttttaaattctctttctcccgttatgttagcaaagctcggtagtactgaagctattctgagtaaacgcttctccaactctgtatactgagagttgttttataagtcaataaagaccggatatttatatgtatatattgatttggtataataaaaatgaaatgctaataaaaatgcctatgaaaagaggaaaatccaggaatatcgagttttttcatttggtgaacttcctttttttattttttttccatttttttctgttatttttcttgctattaatcttcaatgggcggttatttggttcgtta

SEQ ID NO: 11931 - DNA, 429 bp, Saccharomyces cerevisiae
gcagaaagaataaaagactaatccaaatatagaactcctttaatttttttctttttattaatctccctttttcctttctttatctcttcgttttcactccagtactatacagtcatacgttttatgcatccattagtcgatgaattgactctttcacgctacttgacccacggtacttcagttttatcaagttccctttattctgttgctttctttctctttttttttcccaatttcctttttttttgctcttgtcccaatcataaatgggtgagtttaccgtttattggaatggatattttggaagccctttgtttttatagagagggaaaaatacggaatatttttgaaataggtggtctattacttcagagtttttataattaaatcttgaattttgcaatttggaagcaaaatattcattgccgg

SEQ ID NO: 11932 - DNA, 448 bp, Saccharomyces cerevisiae
aaaaagaccttttgaaagtttcgcctcattttccttgatctgactttttatcccctgcttatccaattttagttaggaactttggcataatttcagtattacatactacctaatcgacataaaataatattacatattcatttttttaaaaaataatcataatcaatttatcctttttattccttttttctcctgtgcaaggttgatggtgatgtttatgatggtgtgtttattatttacaaataaagatgctatctaattcttgtatatcgtattaacatgcaaatgcaccgcgagtggcaattttcttctcgtaatggatcagttcaacatcttcaatggtatgaaccagaattttcgaattttcttcgttaaattcgaatatgaatgttcccttaatcagccgggataatctcttttttttacttcttttaccgtcgccatcatt

SEQ ID NO: 11933 - DNA, 457 bp, Saccharomyces cerevisiae
aatcactaaagtactccaaagtggtaatagtaataataataatagtggtgatataaaaactgaaacaatgtaaataggtaaagtacatatgtatatggtagggcaaagaggaaaataaatcaagggttaaaccgccggtgtctcgaactcgcatttggcaaattcttcccagtcctcctccgtggatggatattgtctcaaccacttcattctaggaccagatactgcctcatcatttatcctgaacccaaaaactttcaactcgtaggactctttacttttcctttccacatactcttccaattctttgaaatgtttcaagaacacaccagggaagcttgtcccccaaaatgcaccttctaagcacaggaatctagatgattggggaagatacaagtcctgacaactgggacagtacaaccttacggtgtgtttcccaactgtatcgctcaaccca

SEQ ID NO: 11934 - DNA, 409 bp, Saccharomyces cerevisiae
ccgcctgtataaacatgataaagaaaaattagatttcaagctatgtaccattatttactttttaaactaatgaatcatcgatgttatattctctaagaaattccgctttttttttagaacattatctacgtattatttttccaaacatgagcggtgaagaaatgatcaaacaatgaagatcgagcgaggtcagagctttccaaatgcgataggaaaggactttttccagcagctatgaaaatgtacttcaagtatctcgtcagttgctttacaactcatctcctgtaatttccaacatagcatcgttcacgacacagttggcgctgaacaaattttgtgcatagagcaagcagccgtttcttgtctgcgtcaagaagaaagataaaggtagaatggacagcgtgtcaaa

SEQ ID NO: 11935 - DNA, 472 bp, Saccharomyces cerevisiae
ataaatcacacccgaacaccatcttgaaggttcagaacggctgaagccgcatatcaacttttggtttctactgttttaaatttcctttctcgttttaaacctttgttgccgtctcttctactatcaattttgttgttcatgcatgtttaattacctttttttgtaaaaataatataaacgtatcaatggctatttataacaaatatgcttgaaaaatctaacgactctgtttcttacattaggttcgaataaacacgggtactgtcctctagccaatctgactttttggtccaaagtctttgaaaggtagataaccccgttaaaatagaaccaccaatccatgtagtatattttctttctgaaggggctataatctttatcttggatgttcctttggttaatgcctccaaatcccatagcattcggtctccaaagcctttaagcgttgtagttccgccacttaggattatcg

SEQ ID NO: 11936 - DNA, 447 bp, Saccharomyces cerevisiae
tcggttcatggcaatctcatggtcccaaaaacaaccccaacacaaaatatcagcggaacgtcaagaattttccacatccaactcatctttaatttttaagtaaacagaatagatcgaatgaatatataaatactaaaatgcataaagtcagtcgaagatctgagtagctatccgctggctgtccttttctaaggagcagcgttattcaccagccgcgagtctcttgaaaaattggcgcttttaatacttattaggatggggaacttgattctttgacgggtttgtcagcaattagtacgactatcctacttcatcaagaaacgaaactatgatcgaagagaagaaggaacttaagaaacgcagggttcttcaaatggccagattttatggtgcggccgccttcaccctgattaccatgaggcttatctccagggccataaaagtacg

SEQ ID NO: 11937 - DNA, 467 bp, Saccharomyces cerevisiae
atagatactgtacataccgaaacgccatcatttacagtcgtgatacgatttactgtcacttagcaataatatctcgtacatagcgacaaacatacatattattggacacgtcgccctgaaaaaaaaaaacataagaaaagaatacgaaaaaaaagaacgaaagaacttacggaaagatccgtttcgtgtactgtttattaatagtgttgcattctttttgagggtaaaaaaaaggtcatttctcgagactaacaacattaccaaggagaaccggcttagtccacatcgctactgtcattctgtttcgaaccgtggtccagcaatcatgtcctcgtcttcgtctaccgggtacagcaaaaacaatgccgcccacattaagcaagagaatacactgagacaaagagaatcgtcttccatcagcgtcagtgaggaactttcgagcgctgatgagagagacgcggaagatt

SEQ ID NO: 11938 - DNA, 462 bp, Saccharomyces cerevisiae
aatttggaatgatgcgatttttttaaacaatattcttttactgcttatttcttccttgcgcactattttctttttataaacctatataaaatgttgtaactaatataatagaccttatggaaacaatacagtcggaagagcgcctttagtgccaaaagcccaaatgaacgtatagctgccatgaagtcacatcttgggcggctcaactaaacaatggttttagtaacttcccactggtcccgtcgcggctacaaaaattccttgaaattgtataaaggagtttatgactccatttcaggcagtaaatacaattcatacacaccacacatacattcagagttaacgttcgctataataaaacggtagagagtcagatgtggagtcagcgtggggggtggggtaacactccacctttgaaaacggtgtgacttcgccctttcgatgggaggaggtaaagctcaa

SEQ ID NO: 11939 - DNA, 456 bp, Saccharomyces cerevisiae
tctggatatgaaaaatattaaagcagagtacattgcaagtacaaataaaaaatctatagaagataatactgtatactagtgtaagaggagcctcagaaaaaaacaatataatacattaatatgtgctgttacggtataatttagcatatgatgacaatgtggtgaattacagttgtgtaacttttttatatcacccggcatatatacgctcgtagaatgcgatgtgaaaattttctttttttttttttttcaaagtgaaatttttttgagtgatgagatgggaaatgaaaaattttgtgcaattgcgtagtgtctacagttttttaagtagttattaaaagtgttttggaaggtatatttctaggagaagaagcgtgcagaacagtatttagtgaaagatggctcctattgaatacctactgtttgaagaacctactggttacgcagttttcaagg

SEQ ID NO: 11940 - DNA, 423 bp, Saccharomyces cerevisiae
aagaaacacacatcctcacacgcatattcttttgtatactataaaaatacacacttatacatttccctctgtctctgtctccttctacatgtatacttgtatatgtatacttgtatatatacacttatatctgtatgtgagtggtcaatggctccgcgcacttttatgtagtgatgtattttcctttttttcttggttttcaattttggtgctttggaactcccagtaaagaagaagaagaagaatcgagtcttccctctgagcagctgctgaaagggagagagaaccatagcgatgtggagcaggaacgtcagattgcttggatcatggacaaggtcctacatggtccccgccaccaagagaaaaaccatccccgtgtacccacctgtgcagcgcatagcttcgtcgcagattatgaagcag

SEQ ID NO: 11941 - DNA, 419 bp, Saccharomyces cerevisiae
atctcacatgatgcttgactgatattattcgacaatatgattatgtcgtgtaaataacccactttcatgttgtcactccctcggctttggttggttaaagggacttatcggtttctttttttagagttgatttaagatcagatcgaagtaaataacgtgcagaacattgcatatgatagataacaacctatagtatatatttcaaaatcgcgacaaatctgaaatattaattgatttgattagctgcagagatcttctcgatgtaaggagctatttaaatagaaagggtcagaatcgtcgtcctgtgggagctggtatatactaaattgatgaacaactaaaatagcactctcattgtcattttgggtgtgagaccttaagcaaggagagatatttttaatggatgtattagcgcagcc

SEQ ID NO: 11942 - DNA, 474 bp, Saccharomyces cerevisiae
gaagcacttggtacaaactcgtatatgcatgtagtttctgtcatacacatatctatattccttcccccctggtcctatcgtatttagtcatatcatatcatttattgatatctatataagtgcaaaactataaccattatttatttgctttccacattgttttacttcatttgcttcaatatcgttcattacgtttagcgaatggctaaggcccttgtattagtaaaagcctagaaaaaaaaaaaaaaaaaaaaaaaaggatatgatgttatatgatacgtgtagttcatgtatttatcttcggtagtatagggcagatttaagactgagtgtgcacgcttccaaagttttttttactatttgatacatgcttaagttatggagcagaatattattagtaccataagggatgagtgtattcgtcaccggtcgaagtaccttacgatagcacaactaaccgctattgcagaggct

SEQ ID NO: 11943 - DNA, 469 bp, Saccharomyces cerevisiae
ttacttacgaaaagagaggctattgtttattgttggccattttatttattattatttttttccaccttagcataaggaaacacgatttggatttcaaaagtagagctttaataacaaaagataaacaaccacagtgtcaagaacggttacaacgagaaggataggctgatgatttatcaaacatcttcttattggttcctagtaatttccctatttttgagcaacaaaatgtcgggataatattctcataatactcaaacactcttaatatcatatatatatatatacagtcattttttgttattcgttacccgaacttctttattattataaccagggaacatcaataacgagctacaataatcatgttcatctccctcattgtctcttatttgatgttacacacgcttttctagcataggaggaacttccatatgcatactaatagatcatgctcagaagacacgga

SEQ ID NO: 11944 - DNA, 458 bp, Saccharomyces cerevisiae
actgtatacttttctttccacctttggtactggcagatgcacatacattaccatttgtaaaatatatggatagataagtattttttttttctagtggccctctggaaaatgtaaataataaaacggaaaacacacaagccagggtgaatgaccaaattcgatattcaacgaagggtcaaaccttgaaacctagcatacatgagtttaaggaatagtgagaagaaaagtaatggccaagagactgttagaatcaagccaaaatgatcaggccaatcgaaaaaactcaaagattgagaagaaagaagtatcgttttatgaggaggaagaaacagatgattcttttgatagtttttaccaggatgaagaagatgatttaagtgatattgattgggaagaagtttctttagatggaagcttaactgtcacatttggcaatatacgcagagacagggagaaag

SEQ ID NO: 11945 - DNA, 427 bp, Saccharomyces cerevisiae
tttgaccagtatgaatattccaagcataagaaacttcttttcatttaaaaaatttatatttatattattgtaaatgcacatatttacgtagtgaataacccaaacaaggaagaaaaacgaaaaactcaattgcattttctgaataatgatagtatttaagtactcttttgtgcattagcaactaaaatgaattgccgcctggcctggagtttgatgtaagcagaagccggaagaagacaagaggttcattcagagaaaacatccgtacattcgagttctcattgaacccatacatttcaactatttttacatagttcgtttttcatgtgtaaaattgtcatcgacgcgccggagcatcggaaagttggaacgtgcgcgattgcaccaatcccactggggccgtgcattctgtaggcaggaagccact

SEQ ID NO: 11946 - DNA, 415 bp, Saccharomyces cerevisiae
acaaaaatacctttttgagactgaatgacctcatttacactaataatattccataagccagaaacggtgattgctattctgacaatgtgcttttcgaaaaggagaagtaatttcgagacatcagctagcaaggacatatacgattgacatttttgaatgtactttcaaatacttgtgaatcaaactaagatatgattcctgcatattcaggtatatactatatattttaatttcattagcatatgtgtcatacggtttttaaaacttatgagcaggaaaaaggtgtcacgtgatcagatggtctttttttcaaactttgacgtcggaattttttgtagtgaaaaatttttcgagatgaggaaaggaagaaaaaattaatttgttagccttataacgtgagcaccttttcgataga

SEQ ID NO: 11947 - DNA, 488 bp, Saccharomyces cerevisiae
atgtctgatcgattctttttgcgatttatataaggacacatgtctccacctataacgcgagcttgtaaatatctatatacccatctgataatgttcaaaaaagtcagctaagtaagtaaaataataaggacaataaaattaaaatgtcatacaatgttacctatgaaataattaggaaatactgttagagtaatatttagagttgaaaatgcaatcgcaaaaaaaaaaaaacagaattattttcatcatatccatctatgctcgtcagttagttcgttagtgttcttcaaaaaatctggagtatttgggagttcactatcagtcggtaaagacaacaaatgatcatttggatttgcaacaatatcagcatcgttggataaatgttcttgcgctagatgattctcctcattattagcattatgattgttattgctgttgacggtagtatccagtaaattgagcgtatcatccttgctagcttgacgtcc

SEQ ID NO: 11948 - DNA, 496 bp, Saccharomyces cerevisiae
ggctgaagtcacgtgttgagtattataataaaaaataaaaactcttaatgacaggaaacataataaaaagctaggagaatggagttacgtatctgacatttcgctaaatttggggatgggtttaagccctgtgaactgaaccattttcacagcaacgactttttataaacggttttttaggatatttgttttgtgatagctttgtttttcttccatgataagatagaagtgtttaatttttagataagatattgtacttataaaaagaacatttgaaccattaaatacaggcacttttctggttgatgtacactcattgaagtagcttggcataatggtaaattaacttttgacattactatgatcatgatttacgatgaccgtctcgtctcttttttttttttgcattgctctctaagatttctaagattgatatttcatatgatgacggtagggtttacaataagatatcttagttgatcgcaattgctaaagg

SEQ ID NO: 11949 - DNA, 458 bp, Saccharomyces cerevisiae
taaacggcaaactcctctgcccatactatcgaactctatccaagaagcgcgtaatttcacgagcactgcctaaacggttttccacattagttttgcaactacaatgattcggatatggcacatttacataatttaaacttgtacataactaacacctttttatccatataccttatgtgccgctcaagatatgaacattgcgcgttgcccggacaatatcgataaataatagccaaaacaaacatgttttatcgacgcatgaatcctttggcgttaaacttgtccaattgcactgaaacttggagcgtataagctcagcaattgcaccaaaacaatatcagaaaaggcttgtattgccactttcacctatgagcgaagataaagctaaattagggaccacaaggtctgccacggaatatcgtttatccattggtagcgctccgacttcaagaaggtcg

SEQ ID NO: 11950 - DNA, 497 bp, Saccharomyces cerevisiae
gcgcacctattccctctgttatgttgcttattattttcttcccttctgaaatgcatttttagcttttttcatcaatttggcatcatcgtgcatttcaacttctaagtatgaatgctttttggtagttaagcttgaagggttttatgaaaactctcttttcttagatatttctacagtcttatataacgtcaattcacacaaaagtgttcactgccaactacaagaatagcatatacacatattagttacttcaacgagttcttattgttattataaaagtatataaaccctataagcatttttgcatttgtgctctcacatcacctttaatcattttttcactcatgtaccagtatacgtcgacctctacttcttccctcctttcttttttccaactttatccaatcttttacttttcttactacttgctttccttatatgatcggtactgtcaataatcttagtcgttgtactctctgccagttcatcgttttcaa

SEQ ID NO: 11951 - DNA, 432 bp, Saccharomyces cerevisiae
aggcacagataatgaaataatacaaaaaaaaaatttatgaaaatggacaaatcgatttattatattcgttaacattttttctgcttaattattgttattctatttttttttttttttaaatggatgagctgtattccattttaaccagtaacggtaatttttaatactaataaaaaaaggagacaaataatatagtattagttgtaattcatattgtgtttctgtttagtacatatgttagtacatatattcttaatatgctatgataatgagatacgagaaccagaagaaacacaagaatcactccttgtgctcctcatcgtcatcggcaatggcagaagagtcctcttttgactcttccttgccgtttttcttcttatttttggggaatttaggcaagtttttcttcttatggccgttaaaggatcttga

SEQ ID NO: 11952 - DNA, 435 bp, Saccharomyces cerevisiae
acgtagtgtatagcggtaatgtttattaactctttcggcaaagtgcgtttgggctcgcaatgaacagacaccaccattgcttcttctgcgcttatttgcctttgttgtatatctagttctcaaaatggagtcattcatcagtcgatgtgtgggcggaaatgacgttcatctagcaatggcacactagtttttactcaacaattcaaactcaatggaaagccaggaagttagcgccgggaaacttcaggacaatataaaaacaggactaacggaagaaaataatgtgggcctttttgagcaacgctgacggtaagtagtttcctacgatcgtacaatcccggaaaattgtagtggtgcaagaagggaaaagaatgatggcgaaaaatgcacgcgcgtaaataatgatttgtcgagtcctattgaccacaaaacccg

SEQ ID NO: 11953 - DNA, 463 bp, Saccharomyces cerevisiae
agatgagaggctagatcgagaatacaaatagaaataaagaaagagctatatgacttagcaacgcaagcagaaaagaaggtttgcttcttcgctggactccggttggaattactattcaaaattccaagtgcactgatggaaaacgttttgctcaggttgagctcttttactgcatataaggatactgggtaggtgtatatgattattttatacatgatacgtaggctaaaatgatttggacccattaaatcatcttgtcgcatctcttttctttttcctccatgctcagatttcaataatatcatctcaaatggctgtgacaaatttcaccggaaaggcgagggatttttctgttgacattatcaaattagctttttgtcaaaataatgaaaaataaagaaaatatataaaagtacatattataatcaaagctagctcaggtatattcccaccttgtcgagca

SEQ ID NO: 11954 - DNA, 448 bp, Saccharomyces cerevisiae
ttcgattaatctttcactattgcataattaattatacacatatagatgtaaacatgtttataaccaagacgtttggtctcatctagcaaaaatgtcttctagtgtcagctgtcttacctcacaaatgtaaggcttcaccaaataaagaactaattaaatagaacgcgcttaagaaaagctgcaataattaatttcttatattaaattcgaggcaccaaagcaagcaaccgctacatgacaaaaatctaatctggtacagaagaactataaaataacaatatgatcatgttgagaataccgacacggtcttattgttcaccttcgaagctaataaagggcgtaggtctctcaccattgaagaaatctctgttatccaagaaaataaaggaagatatccatccttctttacctgttagaactaggtttgcgccttctccaactgggtttt

SEQ ID NO: 11955 - DNA, 408 bp, Saccharomyces cerevisiae
gaaaacagacaagaaaaagaaacaaataatatagactgatagaaaaaaatactgcttactaccgccggtataatatatatatatatatatatttacatagatgattgcatagtgttttaaaaagctttcctaggttaagctatgaatcttcataacctaaccaactaaatatgaaaatactgacccatcgtcttaagtaagttgacatgaactcagcctggtcacctactatacatgatgtatcgcatggatggaaagaataccaaacgctaccttccaggttaatgatagtatccaaacctagttggaatttgccttgaacatcaagcagcgattcgatatcagttgggagcatcaatttggtcattggaataccatctatgcttttctcctcccatattcgcaaaa

SEQ ID NO: 11956 - DNA, 488 bp, Saccharomyces cerevisiae
ctgcattgtgttacatgcgatatcgtagaagacgatagaacgaaaaagaaacgttaatctttttttcctttttttttcgattaaaaaaaaaaaattttcgcctcgtggcccgaaacacggccaagagagggaattcgaaagtctaccgcttttggcagctgaaaaattcagaaagtcacctggccagagaggaaaaatacgaaaccaaaaagaggcatccgtaaattcgcattagcaacgcatgcttacatagatactcacatactacacacacttacatactttcttaaagacatacatccgtacgtacaattagagcgaggtagcaagcaacccaaacttcttcccttcactgcctcacaccccatcctaaatatcccacaagatcctcgactaatacaagaaatgagcaatgatccatctgctgtatcggaactaccagacaaggacagtcttgataacggtatcagcaatgacaatgaaagggc

SEQ ID NO: 11957 - DNA, 471 bp, Saccharomyces cerevisiae
tctactagcgataacattaacaataatttataatacaaactggataaagagataaatggatgctttaaaaaataaacttctaactatttctgtttgagtatttccaacttattctccagttgcttcttcttttcctttagtttcttcaattcttccaattcctcattagtagaagatgccatcataaccacgtcgtccgcgtctctgccttcgtattcttgacccatgtctggactattcagagcatcatcgtcatccatactaatgttcttctttagccttaaatcgtttaattcataagtttgctgcaaagtatcgagttccctttgcattctacccatagatttacgtaacttatcgcccagagtcctaaccagcggttctacctcttcaatcaaatctaattttgatctttcaacatcatattcgggaactaaacggaaaacccttttggtttgcaacattgtcgat

SEQ ID NO: 11958 - DNA, 421 bp, Saccharomyces cerevisiae
acgctaacttaatcacaggattcattatttatttaattattttattcattatttatttaaatttttctattcattcttttatataatctatattatttattcacgtaaaagagttcttttcagccgacaaacttttcagcttcaatgaacctcacgagaactttagaaccagattgtaaaagcgggtgcccggctaccgattgcatccaggtattcaaaccttgtctcctctcttcaatgacttcgttactaaatctattactcaagagaattttacccggtaaatgaggtaccatgacttttgggtgattaagcatagaaatttccttgatcaagcatttgcggaagaattcaaagtctgagtatcgtctccttactttcgataccctcttgtgaaaacttggcaagtttgtacggcata

SEQ ID NO: 11959 - DNA, 480 bp, Saccharomyces cerevisiae
tcataaaactagaacgaatgaatgttacgataatacgaaaattatccaagatgataaaaatttatcattacaattacaaacattatataaaaaaattatttatgcattataccaaaagaactcttagtttttatttataactttctatttgataaaatagttcttacagcagaaatgagattaaccctagcaacaaactgccaatacggatggttaattgaccagcggcgcccgagtatgtagaaattgaaggaggcttaatagtagatgaggaataccaggtaattattgtagatagagatgtgctggaacttgttggcaatgaaatagtagtacctgcatctaaagttgcagaatgaggggaagaaagggcggtacatgtgacacaaacctcagttgctgttgctttttggaatgtgctagttttcaatgtatctatggcaactaaatttgtgtgctcggcgtattgggcagaatcta

SEQ ID NO: 11960 - DNA, 404 bp, Saccharomyces cerevisiae
cttaaggtagataatagtggtccatgtgacatctttataaatgtgaagtttgaagtgacagcgcttaacatctaaccattcatcttccgatagtacttgaaattgttcctttcggcggcatgataaaattcttttaatgggtacaagctatacatactaggatgaggatggtactgagaacgataaataaactttctagatatataactttatgtcatttaaatataaataaagtgcgtgttagcttgaaagtgtgcactcagatagtttggtagttggaggacaatcctctttcattcacgggcttgggcaaaatctgagatcgtatgtaaaatgttaaagttagtgaaaaaacgactgtgaggattaccagtgtaaggtttattgggaatggattcatgttg

SEQ ID NO: 11961 - DNA, 453 bp, Saccharomyces cerevisiae
aaaatgaacttaaagacacctttctgcattattttgtttatttttattatatgtatttacaggctaaattatataatgacatcacaacgtttccttgctctctaaattgaggatctctttgctccaagttattacttggtctatggacgaagtcatcaattttgttcgacatactattcaataattcacttccaaaggtttgttccagttttgaacggatgcggttaccatcaggtaggcctaactgaacgtaaagatttgcaaggaaaagaaggtcggaggaaagtattacagaatcatccagttttttacgggcagccaaccaattgctgacgcaactctgtagtctattatcaaattgaagattatatttcacctgttgtagctcttgcttacccttaattttgttcttatgcgcaattttgaaggtctttgattgtgctagttgcgagg

SEQ ID NO: 11962 - DNA, 445 bp, Saccharomyces cerevisiae
agctaatgacaagagaaacatgctgttattgtaatactaatatttaaatagaattaagatttttaatgtttaccaagattttttcttttttaaattttattatttcaatatgtatacataaatctgttgcgccctcaccgccgatctaaaccataaagaaaaatgctaattgtacaaattctgctttgaagaatatccaaaaatatggtaaagcggtataaattttcaactaaaaggcggcctcttcatttggatcctcttcatcaccgtaatcatcatcgtcaccattgttgaaatacttttcagcattataatcatcatcatcttcttcgtcttcatcttcttcgaaatcatcatccgccaaatcatcatcttctccttcgcctgttttacttccttttgctgccccatcacccgtcgacgcatcatccacatcttctgccaa

SEQ ID NO: 11963 - DNA, 459 bp, Saccharomyces cerevisiae
tttaacatgatagaatataaatgcaaataatatttattccctttaggaaatacgggtgttttgaatttacttatctgtaccatacataaaatttacatataataatagaatctttatcaacacataatagtcactctactttgaggcaacggcagcatacttttctctttgttttctttttgcctcctctctgatggctcgagctgtttcggggtccaacttttctactatgattgggaaaacgacaagggcaattaaggtaataacgcccgccagtttccaacgtgagttcaaaatattacccacaatacctgtagaaaagatactgacgtttctagcctgtaaataagatctaatcggggccttatgtaaaagctccactgtaatataagggtgcaccttcatagattgtaatttttctgggtacgttatatctttggatgggaaatattctcttcc

SEQ ID NO: 11964 - DNA, 477 bp, Saccharomyces cerevisiae
ttacaacgacatcttaagtgagaatcgatagataatatatagatacaaatagtacatataatatgcattgggaaagaatttttattttttacaatctttgtagacaaggtacagtttattcataatccctaaaagtgttcacgaaagaataatctctgtcatagatcaattttcctaaaggcaataaggctctaaaagcttcgaaatcttcctttattccactgtcactattaaaattagaattttcaggggtctctagaccactggaaagagtatctccggtatcagaactatggatgggataaacaagagatgttaggtccgaacgaattgggtacaaagatgagtcatcagatattcctttcctatttgaagatggcgataggtctccaaaatttgagatgggggagtgagattttaatagttttaaaatttcgactgataactctccaaataagtttattggtgcttcctccg

SEQ ID NO: 11965 - DNA, 486 bp, Saccharomyces cerevisiae
acaggccccttttcctttgtcgatatcatgtaattagttatgtcacgcttacattcacgccctcctcccacatccgctctaaccgaaaaggaaggagttagacaacctgaagtctaggtccctatttattttttttaatagttatgttagtattaagaacgttatttatatttcaaatttttcttttttttctgtacaaacgcgtgtacgcatgtaacattatactgaaaaccttgcttgagaaggttttgggacgctcgaaggctttaatttgcaagcttcgcagtttacactctcatcgtcgctctcatcatcgcttccgttgttgttttccttagtagcgtctgcttccagagagtatttatctcttattacctctaaaggttctgcttgatttctgactttgttcgcctcatgtgcatatttttcttggttcttttgggacaaaatatgcgtaaaggacttttgttgttccctcacattcca

SEQ ID NO: 11966 - DNA, 486 bp, Saccharomyces cerevisiae
atttcatcatttcttaccatcttctcgatctatttttattattcccagaaaactttgtgatgttggtgtagaggaaatgatccggcgcactaacaccacacgcttgtaacaaactaaggatgtcctgaccttttttgattatgttaccaccccatttttgcattcttctttttttttttttttttgggtctgaaaatttttttgcttctacttaattataattttatataatcatatatggatctgattcttaaaaaaaaatgaaaaaaagacaaaacaaaccatataggtaacaatttctcttagtgacataaaagaagaaggaacgataactttttcaataaacggaaatataattgttgattctttctctttggttttgtgcgatacattctgcaatccaggtaatattcctaacttcttgttccttggatttcatccaggcccaaacagtgctgatggcaaattgttgcgtgaaagcatctc

SEQ ID NO: 11967 - DNA, 407 bp, Saccharomyces cerevisiae
agatccgcttagcttatgttaatactattattactactatcattacattttaatatcctgtacatatatatactctttgaagaagtttggatttttctttcccattatagatcactttttttttttaccttatcttttctgtaagttctttttgtggctatatttcctctttggcggctaactcaagaagcagtaagggaataattcgttacacattacagctagctaaaatcatcaagaggcaggaacacacgagatatactgataatgttggaatgtctaagcgctctgctggttctctttgccggtggtggtgggagcgttctcgcagcggttcaaagcaaaactgtggcagatcctaacttatgtccaggttacaattcacaactgatttcccccttcctctc

SEQ ID NO: 11968 - DNA, 487 bp, Saccharomyces cerevisiae
aaaccttctgcaccatttttagaaaaaaagaatctacctattcacttatttattcatttacttatttatttacatatttatcatacatattaacattgaaccctccatcgtggtagtgtttgctgttcctaacttttctttcgttgttcttgtagatatatatttttccagaattttctagaagggttattaattacaatcttaaacgttccataaggggccgcgatttttttgttcaattttcaacagggggcccatctcaaagaactgcaaattatatcacagtaaaaggcaaaggggcgcaaacttatgcaacctgccagattattatataaggcattgtaatcttgcctcaattccttcataattcgttcctttgtcacttgttcctttttacccttgaatcgaatcagcaataacaaagaaaaaagaaatcaactacacgtaccataaaatatacagaatatatgaacgaccaaacgcaatt

SEQ ID NO: 11969 - DNA, 468 bp, Saccharomyces cerevisiae
cgcatgaaaatttaggatttggatgacccggtacggccttagtagaaaagctgtgtcgctcaccgaaaagaaaaaagaccgaacaactgtaggatgaaaagcatattttaatgctcctaattttcaaacatgtctattacatacttatcacataatccgactgatttgcccttctttaacttctttcatttatttttacggtgccaaccgtctgatcgatatagcatccgttcataaaatattatacgactccatcctcaatcgtgattgtgcgtgcgtgactcattttttgttagaaccaatactttcaatcatcccaaaatgcataacatccaattagtgcaagagatagaaagacatgaaaccccgttaaacattagacctacctctccatacactttaaaccctcctgtcgagagagatgggttttcttggccaagtgtgggtacaagacaacgtgcagaggaa

SEQ ID NO: 11970 - DNA, 403 bp, Saccharomyces cerevisiae
ttatcttcatcaccgccataccattcttgcattctaaatttattatatctctgtgtacggcaggctcatcgatttttcttttcttttttttttttttttttttttgcctgcgaaaattttccagtcgaatagtaagtaataggatgagttttataaagttatgattgcgaacggtattattcgctaaactcgtatctgtttataatcacgtaccctcttatttacttactttttcttgaatatatctaagaaagattcatactcttttttctacgtactttgccagcgcaggataaacgaacctacccattcaaactgagcctcatatattcacttaggattacaaaatgccaacaaattccatcaaattattagcaccagatgtccaccgaggtttagctga

SEQ ID NO: 11971 - DNA, 459 bp, Saccharomyces cerevisiae
taagtgggcggaattggcattctcaacaatcatttttatgtttgtaaaccagtgtcctttgatatgtaacaattaaataaaataagtcatgatggggcacgaattcgcaaaatggtagaaacacagtaaatcgaagaaaattaaataattcgttatagatataaagtagtcgattataaaaacgtaaaaacatgaaggcagggtaccttgacgaaataaaagagaggcggtgagatgaggtgaaaaataaagaatattgcaaaaaaaaatattcggactctatgaatcaatctctaataactttaaaagtaattgctttccaaataagagaaattacattgggtatagactgagtcgccggagtcataagcataacatgtggttccagaagcacattccatgtaaacccaagcgctatgatcacaaacggcgaacttcccatcagcagagcatgcaatt

SEQ ID NO: 11972 - DNA, 481 bp, Saccharomyces cerevisiae
atacacccttctagacggcattaaaaataaataaatgatatatttagttatcaaggtttttagtcatatatttcaccgttattaccattcttggtcacgtgcaagtaaaaccactcgttgattggctcccctcaagattgcattaaaagtacaataatatgactaagggactcgaatatgtaaattcatctttcgcatcaacaaaggagaaaaagacgatagtgaagactaatattttagccagattgcagtgtttcagtgatcttaaaagtctttttcatttctagccgcattgaattctttaaagcaaaccattaaggagtacttccccaggtttttaaccgataataagagtaagataaaagtacaagaagacagggaaatgattgctacacctataagattagcaaagagtgcatatgagccgatgataaaattcgtcggtacaaggcatcccttagtgaagcatgcaactgaggtc

SEQ ID NO: 11973 - DNA, 409 bp, Saccharomyces cerevisiae
tagcgatagctcgaagaatcatgatcaatggattgaaagtagggccaccaatgctcttttcaatctattttttgaaaacatgagagtcctaaaagagctaacttaaatgaccggggcagattaattgaaaagtttgaggtttttgtgataatcttcaaagttgaacgcatgtataaaatgatagaagcaacagtccattgagaagtatgccactatagtcatatatatatatatatatatatatatatatatttacgtattaattgataaactataataccaacggcacttgatacttgaattcatcttacatttccagtgatgatttttttttctgggactacgctgataaagaaaaattgcaagaactgagaaaccacttgttttgtatggcactttgactttcgaa

SEQ ID NO: 11974 - DNA, 419 bp, Saccharomyces cerevisiae
aacaaaaaaaagaaaaacatataaaaaaactaatctataatttacaacaaatatcatatccaacatatacactattgttttgctgggttctgcttttcgttttcaatcatcttcttttgtgattttattttctcaaatgcggggatgaaaaatttgtcggtaaattgttgaccaggtaaaataggtgctatttgcaatatgcttcgtatttgcttctcagggtcctcgtcgacagggatatttttataaatacaatagtcaagatcttcgccaggctttgatcttctaaacaactttggatgaaattctacgccatcttcaatgcgttttttggctaactgtctttggtgatcttcaatctgaaatttttcttctgtcgcaacaggatgattgcgaacggccaacgcatctgtaacctt

SEQ ID NO: 11975 - DNA, 442 bp, Saccharomyces cerevisiae
gataatcaaggtcaaggcaacgcaacgccactgctaagaacacttattgctacagaaaggaaactaaaaataattataaggctagagagaaataaaaacaaaataagagagataatatgggtaagggtctgccacccatctgataaaaggctgttctatcttttggaactctacaacacaggtaaacggatgatactggctatatttatatagataaacaaacttgcaggacagatagttaagcgtctatatcatgtgtattttaagcgaagaaaaaagtacaaaaatgataaaaggcaaaaaagatgagaagttttttttgtgataaaattaattattaaaaaatacacacgtagttaaaattaacagcgggggaggaaaccttaagagaaagagaaacaaaaaaaaagaaaggaaacaaataaaaatgagggtgacccga

SEQ ID NO: 11976 - DNA, 455 bp, Saccharomyces cerevisiae
gagaagaaataatgaaaacattgttataatcttttaaaggttattatttattttgtcttctgtacaccgtacccttgtttatcttttctgccttaaatttaatgacgttcggctggagaagtcaagactatgaaatatatctcgtaatttatgatcgtatattatttatttattgattgttttattgtttatttatttatttaagtacccctattgtacgtacataaaaaagcaaaacttttatattatattgttgctgattatgtactcagtttaacgaggattaaaaaaaaaaaaaaattaagtaataagtgcaccgtctgtcagacggtcgaatttaaaaataaatggtctctagcgggatcgaaccgctgatccccgcgttattagcacggtgccttaaccaactgggccaagagaccaaactttgttgaatgttgagcaagttaacatct

SEQ ID NO: 11977 - DNA, 486 bp, Saccharomyces cerevisiae
taaaccttggcctttgcaccgtgccacttcatacacagtgaaaatagtcacgtaaaccgttcatgatatccttcaattcaaaataattcagcattgatgtgcgtctacgacaatcgctagtcctaactttattttttttttttttttttacatctgccgtcacccttgcgatgaacgagaaaaaaaccgcctttcgaagtataaaaaggatgaactcgatatttcagcaacacattctttaccttggtcttttctcattttgttacaaaaatatatacttataatagcacaggttttattattttagatatgcataacacaaaataatgtgcgtggcagcgttgataataacgagctaatgtcttatatctcatatgagttcatgtgatatttcatgttacagctcagatgcgtaaactctctatccaagatgaggaataggataaagagatgtatttatttagtgatgatactgccgattctggc

SEQ ID NO: 11978 - DNA, 490 bp, Saccharomyces cerevisiae
catgaatgaagagccgccccatccatagtttttcctagttcaagcattaatataccggaccactctacatcttccgaaagccggaaaataagaacaaaaaataataaaaaaaagcacgtttaatataaaaaacatttcattgtatgagttggattcttttaattttattttaaaatacggttgcattttgcatagtaatatccaaccaattatttactgaaatttgaaatttgattaaaaaagtcaaaccaaaaaaactacgacaatacatgaagctctgaatcttctagcctagtcattttatatatatatattcacctcctctcgatacgttccatcataagttagttttgtttttctctttctcgcgatcctaattaaaaattaaataaaataaataaatacatatgtatatatattcatatgtagaagattattgttcttatacatcagtgttttgatttatggtaacctatcccaaccttctggc

SEQ ID NO: 11979 - DNA, 480 bp, Saccharomyces cerevisiae
aaaattaagaatgttgatgaaataggatgaatctaaagcaattttcaatagcatgtgcatatgtttaataaaaattacatgaaatgtaatatttgtttatattattaaagattatactagtaatagttattatgagaaatccaatatcggttagtttatatgaagtattaatatgtatatatatacatttacgtggtcattctgtcctaaacttaggggtactgccagcttttgccagtgggttcaaaggtaccttttttttgtttttctttccaccacgcttatgaaactttttcttcaactgtttctttatctcacgagctttggtatcacgctccttggttctttcaagtgccagttttttggctgcacgttgcttttgaccaggtctcctctttttaatcttcaattccttctgctgctctaactctattctcgcattgtgcttatacagatctattattcgaccctggcaatatg

SEQ ID NO: 11980 - DNA, 463 bp, Saccharomyces cerevisiae
tcttatcgatttccgtatataattcatagacgagcattaagaggaaaaagctgtttccgtaccaattaaagaaagatagacaacaagaacaaaaacgtacattactctatattgaaaaaagccctatgtcggtaaaagaataggaagtaccttagtcatcggcacttacctttttttttacgattacttctggtttgtttctttgcctcatttcattttgctgccactttctttcataggcaagaagattcaatcaaatctccccttctccttccccggatatataaaatataaatataaaactttaagaatataaaaatatgagaaaccacacataacttgtatactttactcacatacacacatttccaaaaaaattataatgttaattacattgcttttaatgctaatctttttttagttgtataatcattaccatataaatgcctctcggtctaatttc

SEQ ID NO: 11981 - DNA, 457 bp, Saccharomyces cerevisiae
acgaaagcatgatttattcatacactaagattataattacacttttcttctcattgattttgtgagccgttctatcacagatacgaaaactgtgtggtgataatagctcgatgggtatcatcaccgccctatataaaatactcttattagtatagtacacaaaataatgtacctgtacgtacaaccgtcgttaaatattacatttattaggtctaacatttgtacctaatatgtcattccaaaattatgcgttgcaattgagaaacttcatattattatattattaatcgcgtgtttgtctctatcgttatcgttaatatcgcaatcatccataaagttttataaatgcaaaacttcagtgttgtcaaagcgttcagcaaaggcatcccttaaccaatagtatagtttttggaatacaattctttgagcgttgtggtaccggatggaatgatcagag

SEQ ID NO: 11982 - DNA, 444 bp, Saccharomyces cerevisiae
tgttaataccgaagaaacaagttcaatttatttttgtagaatatttttttttctcttctctagtactcatccttcataattaattattccagatcatttaatgcataacgacatgacaataaaaaaaaaacctgacattttgaaaaattatcatttgaatacgtggatgaagacttcttcgagccaggccgcaataaaattaataatatatatagacatcaattcttgacctacacaaaaatagcttctctcggtagccaagttggtttaaggcgcaagactgtaatttatcactacgaaatcttgagatcgggcgttcgactcgcccccgggagatatttttttacttttgcacatcgctggtcttagcttttttacttgattcgcattgcaatctatctgccaagaatgaacaagtatttttttcctctgcatctttccctg

SEQ ID NO: 11983 - DNA, 443 bp, Saccharomyces cerevisiae
taagcagtttgcagctacgtatttcctttctccagttgaggcaaacaggacttcttccatctttttcgaagtttttacttcgccatttgatctatatctacgtaaattacattaattagaaagtcatgctatatcactcttgcccttgaaagcatccacagctgtccgtcaaaaacttaatttctcaagtggaggagaaaattttacctcttgaacttaaagaatgtaaatcttcatttgcgtctttaaagtcatcgttttgattttcaccagttgctgttttttgcaaaaaggattttctatttccaatgctactgcgatcagaaagactagatattggtgcaagtcgcagagaatttgatctagcaacgtcgattttatccaagccaacaatattctcctcatcaggatctttgattttattcgcgtcatctgaaaaagtt

SEQ ID NO: 11984 - DNA, 483 bp, Saccharomyces cerevisiae
aaaatagacggcttctactatcatcattacagtaagggttgaagtcaggaaaggttaaaaataaaataaatatcaaaaagtttttagcggaaggcgttaaggcagcaagtacacattcatttatctatctatacatgtataaacacaactacaatttttttagaaatggaatttattatatgaagggaagacatatagaggcaacagtacataaaggtaagaataaaagcgattttagctagtatatttctgggtatttcttacatagtctctgtaaagcaaccacaccgtttaagcttaaatcttcgttctccttgaatttgcatagtacagcgtctagaatcaaaaatcctagctcgccgtcatcattgttcctgcaaacaaactcataccacgagtcgatctcaaatgttttattcatagatacacgaatattgttcaacgtaatcatttcaacctcgctgccgtttttcgatgatatgg

SEQ ID NO: 11985 - DNA, 447 bp, Saccharomyces cerevisiae
ggcatacgctaaggaatattgatatatgttttgatatatggacgtgaaatgactaatgaagtcgtagagagtttgggaactgtttcgaggcactgtttcacttcttacattcattttcataccctttgtaattgcgttttccatttatccagtttgcctgtccgattttcaaacgtacagtgatgatatgcatcagttgggttagaacatttatattgtgtatcgcccataattctataaactttactatgtaaaaataaaaatgaaccttcactattctttcaagacggactgaaaatttaaagacttggttgttgcagttgatcgattatacaagactaacaattccagtatcatttttgccttaatttgagacctttttcaacaagattcgcggcaacgtagttgtatttttttttttccacaacccgtttccttacaaaagca

SEQ ID NO: 11986 - DNA, 450 bp, Saccharomyces cerevisiae
tttttaaagcatccatttatctctttatccagtttgtattataaattattgttaatgttatcgctagtagattacttatatgtacttaactgtttgctagctaccaaatttgcttgatggttcgccatcgaagctttgagactgttcaatttggcgcttatactgatcaaagttggatcacttgtagatactattaacttttcacattccatgactaccctattatcgaaagtaacgccccttcttaataattcctgagcttctggaagtgttatagcttcactttgaaaagaagaaattatgtggttaagtaatgtggaatcctggacttgtacaccgttttctgagaggatcttagataaagttttgtttctttcatttgtcacttgatttcttatttggtcgcaaaatgacctgccagttttactatcaatctcgcaccaaggtttt

SEQ ID NO: 11987 - DNA, 437 bp, Saccharomyces cerevisiae
tattgtttccatgcctctacattacatcgatcttttgatcttctaaaaacttacatatatattctgtttataaaacaagagcaaataacccccatatatttattcagtcagtctatttatttacttacagtatcagtaataataaatacttaagcattttttgttttgtatatctttatttactaaccttggtatgtaagtgtctataaactacacagcattttgttttcctcatccaggagctttgtagtaattgttcaatggtgattctcttcgtggggtcgacctggaacgttctatatagtgcaattttcctcaacctattcagttcgctactaacatgtcttaattcctcaaatagataaaactgtccatcatctttaatttcactgagaaatgatttaaaaagagaatccttttcaggaatggcgattttc

SEQ ID NO: 11988 - DNA, 427 bp, Saccharomyces cerevisiae
agcaggaaataaactaaacaagctcaatatgcatattttaatgacttatacagtatttaatttctcagtaaattttataaaggtgatattatattggtgttaaaacaaaattcttgtcaaattcataaacagatgttcttttctttgctagttcttgaccttcaccaaggaacaagaaatttcattctggcactcttccgaggaaaaattttatatgatatagtatgggttaataccacataggcgctatacatagttcaaacgcccgcttatgatttcggaaaaatgtcaaatgaatagaaattgacaacgctgctgcttcaacatctagtagtgttacttaagcctgttaggatgttgtttttaggtatttataattactagcaataatttccattaacagataaccgagtcgatctcaatggat

SEQ ID NO: 11989 - DNA, 409 bp, Saccharomyces cerevisiae
ttcatttgaataaataactgaaaaccgttgtctatacactttttttcccgttcaacatggcatatcattatttccatctaaggtcaaagtaaaaaaccctaaatacaaatgatttattttaacggtaacaaacgaacttttttttagaaggtgtaaagatgagatcacgcccagattttgtcttcctcctgtgcatctcttggattgatgattttcctttctaccataatacgtcatgaaaagtatgtaaatatttatagcattacatatatcttttatatgaaaaaaatcactcattcccagtcatcatcgtcgtcgtcgtccttgctctcatccttgttggcgaggccaacatggtcactaacatctttcaatccctcttgagacacagcaactttcgtctcccctt

SEQ ID NO: 11990 - DNA, 415 bp, Saccharomyces cerevisiae
atgtaattatatgaataagctagcaaatgctagattaatttagattaagtttaaccaatttataaacatgtaaatagaagaaagtttattgttacgtacaacgtgatattttccgattttcctttaattgattcttgaataacccacctaccgttagttgaaatagaaacaaagaagaaggatatgcaagtttatattggacaacataaccaatagaagatggatccaagtttagttttagagcaaacgatacaagatgtgtccaacctcccatcagaatttcgttacctcttagaggagatcggttcaaatgatttgaagctcatcgaagaaaaaaagaaatacgagcaaaaagaatcacaaatacacaaatttataagacagcaaggctcaataccgaaacatccacaggaag

SEQ ID NO: 11991 - DNA, 400 bp, Saccharomyces cerevisiae
agaatagcgtggtagacgcgtaatttttttttaccgtgacgcgtctcaccagagtttcttagttctttctcttttctaaaactgtaataatatgagctctttgtagacacatataacattttgtttcatatacataatatatttgcatataaaaatatcaagataattgattgtcaattggttcaacaaagcttgaaggtaaatttaggcaggagcaagtgactgaaaaaaaaaaaaatgagcggatctatcgatgtcatcactcattttgggcctgatgcagacaagccggaaatcatcactgcattagagaatttaactaaactgcatgcattgtccgtcgaggatctatacattaaatgggagcagttctccaatcaaaggcgtcaaactcacacag

SEQ ID NO: 11992 - DNA, 445 bp, Saccharomyces cerevisiae
ttacgttctgcgattttctcatgatctttttcataaaatacataaatatataaatggctttatgtataacaggcataatttaaagttttatttgcgattcatcgtttttcaggtactcaaacgctgaggtgtgccttttgacttacttttccgccttggcaagctggccgggtgatacttgcacaagttccactaattactgacatttgtggtattaactcgtttgactgctctacaattgtaggatgttaatcaatgtcttggctgccttcattctcttcaggctctattaattttaaccgttataagttccttttctcccttggaagcaaacatcaactgccttaaaatctggtggcgaggaaagaggaaatggcatgtactaatgatggtcctaataaatatcccgaaattgtgagtgttaagcacctgttccaacattcgg

SEQ ID NO: 11993 - DNA, 468 bp, Saccharomyces cerevisiae
acgaaaggaatgaacattatccgtttcaagcaggtaaccttcgtcacaatgcatcgtaataatacataaaaaaaaattagctttaagcacatgtatattggacattccacagaaaaaaaaaagcttttgatgtgattagcttaagacgttgtgtcatctttgaactgttttgacttcaatcatatcgaatttgataatataactatctatgtactgtctgggtgcatcgctgttgttgcttcggtagatttattagttcgctttggataatgtatcatacaataacattgccaacatccatcataacagaaacattaggtgataaacaatgaaaagaggagaaagccaggcgcctgatgccatctttggtcaatctcgtgcatttgcactatctgattcttcagtgaatcctgatgtcattgaatatcttaaaagtgttaggcaagaagcactaagaaccaacgccat

SEQ ID NO: 11994 - DNA, 438 bp, Saccharomyces cerevisiae
tgcatatgtgcagttttcataatcttaatagatattgtacgtattcacgtgtgaattgctaaagagggtagaaatcttcaaaacaagcaatttgaaaatatttacataggcaatggtacattctagaaacacgaaaagccaacaagataactaattctcaccaaaaccatctcctataccaaggcttcatatgtgttgattcattactgccctttcccctactagtattgtgggttttatcctgtacaattaactcatttaattggtgttccaggatttctacctctttctttagctgactttctctctcctcatgctctagtttccaccaagagaagtgaagcagtaaataaacggaagatcccattagaatgaacatccaaagaggcctaataaatctttttacagggatctcatgtcctgattcttcctcttgcg

SEQ ID NO: 11995 - DNA, 490 bp, Saccharomyces cerevisiae
gtttttcttgtcaattactcgttgttatttgtttgaaatcccagcctgcacacccgcacgacaaaatcaaaaaaaaaaaaaaaaaaacccagctaccaccaacaaacagatagcccacatgtcatatttcctaatgagctggtttccctctgatatttttgcatattgcagctcgacgtatattgtacttcaatgtcttgcataaaattatatagcataatagataaggtgtaagttgacagtaaacgagtactattgaccaagaatcaatgagagagatagagagaaaaataagaaaaaagggaaagatcatttttgccagatcaataaataagtttgccctccaaaataaataaataaataaataagaattaataggatctgacagctggagggactggggcgcattcattctcatctaaagtatgtgcgattacattcctgtacttgatttttacaggtgttgatgtccccttttgccatgataatg

SEQ ID NO: 11996 - DNA, 492 bp, Saccharomyces cerevisiae
ccacctctttaattcaccaattttctatatacgcatactcatatacacatatatatatgctataccgtttctaatatattcatttaagatcactgtttcctgcgaaaaggagaaaaaaataacagcacatcgcttaacctattcctgtgcttctggaaaggacgcagcctgcaagaaacagtcaacatcaatgtcagatccatttgcacatttactgacttctttgaagaataaggactctgcatctgcatccaaggaaacaactcctcagagcagcaattcgccttccattactggttccgctgttgcagatgttgcaaggacggataaaagccccaatgatagtctgcattcaatttcagctcctccgctgataccgtcaccgaaggtagatttttctgcacctcctttggtcccaactaatagcaccactaaatctaatactgccaacaacacacctccctcggctcttgccaataccgatgacgactt

SEQ ID NO: 11997 - DNA, 436 bp, Saccharomyces cerevisiae
aaattttctttccaaactcctacctattcatttcatcaattaattaatattatatagccacgaatttatgaaactgaccgataatataaagtgctcaatatatatatatatgtatataacggttaacgtaagaagagctcttccctcttaaacattcgaaaaatgattgaaccagtatatttggtcgagcaagactttctccttcgcatattttacggcaggtatggatatatcgcctcttgctgcaaacccgtgagccacaccactgaagaggtctaactggtaagtagcgtgattatcctttaatttttcctccgttaagtgtcttaagtttgccggaaagatgtgatcctcttccgctgctgaaatcaatattggtttcttgctatcaattgcttcaatttcctcgatgctgacgaaagatggatgtgcaatg

SEQ ID NO: 11998 - DNA, 497 bp, Saccharomyces cerevisiae
aaacaataggaacggaaagctttattgcaatggaatttttagaactcatattcaaaggtaaggcaaaactatgtatagactctaatagaatgttttacggactttagaagcaagggaataaaactaattaagcgcaagtcaccttctttgttagtgttcttcccagttttatataacgggagtgcgtcttcaagtttacttggacgcacaaagacgtttttatgtttatgtattatttcgtaaatatatgagaggcaaagaagatggatgatgatataatatgcaagggaaaatgcgtagttgaggtattgggaaagttccatgtgatcacttgatgcaagccgtgcattatttatcagcagatctattttcacttttcaatttttttcaggttgacccttcaatatttttttacctctttttctagatatatttgcagggtactctcgatgtccgcagttcgtcaaaatgattatgattgccagtaaggccaagtg

SEQ ID NO: 11999 - DNA, 410 bp, Saccharomyces cerevisiae
aaagcttcgacacatacataataactcgataaggtatggtatcttatttcattgtggggtagtttttacgaaaaaaatgaaaagttgtaagtatagtatatattttttttctatgtaagttttataagattctattcgctattaccaccggtaaattaaaaagaacactattgttacattatatgtttttaaatcatcaaaaaagacaatattcatttaatattccttatagaactacttaacattgttcttctttctattaaacgtctttatgcaaaccatttatgtactttctccataatatcagctggatatctattgaaaattgccatagcatcactagaaggcaaaaatcccaacaactttttaactgaacttatcaccgtttggccttccctttcggtcaaact

SEQ ID NO: 12000 - DNA, 467 bp, Saccharomyces cerevisiae
gcgttccataactttgtgtatctacatatatacatatataattgtaaattagtaacagtagtaatagtagtgcctattataaagggttttctttaagtaatgtcatgtacttgtttaatgtgactttggtaatatattttcattctccgatgccgatgcccagtggaaaagtttaaagtgaaaaatttttcaacacatacaagtttaataagttggttttgatgcaaatagcattactaaagaagagcgctaggataattgtgcattgctattgtgatttttgatacagaaattatgcactatgtggtactagagctgcaagttgcgcatttgccagatacccccaaggatcaatgtcgcattgcgaatatagcatttcaaattgtgaatgctgaaacattagtatgccattatgggaccaattctttaccgagcattgaagtaaacgggacgacaaagagtttgga

SEQ ID NO: 12001 - DNA, 460 bp, Saccharomyces cerevisiae
ttgtgcaaaagaaaaacctgcctctaattgtattactgtatattatataatggatttttttagagatatttttaatttcaaagagacttcttagagtatattctaccccagtattattatcttgaacaaaagtagatcgcaaaacttatcactaaaattcaaatgtattttcgaagtgagtaacgcatgggccgtggaaaataattcatcaatcaatacctcaggcaagtgtatttactatgcctttatatcttccgtataataatagagcgttgattaattgagatgtgcaacaatgtgaccagtacacgtagattatagcatttttcaccgatcaagcttaagcttaatgaatatgcagtagggggccttcataaaaaaagctgtccttctggttgttggccattacttggacttctttctttctgaaatgttctgctaggtggagcaacatgggtag

SEQ ID NO: 12002 - DNA, 498 bp, Saccharomyces cerevisiae
agtagtcgtttttaaacttttttatagcatttgtattatttttctaccacagtcatttaacgtatttatacatataaaactacatgataaaaaccatgaaacaaaatttacttataagaaatttgctttcttcacattagtagaaccagcgtatcgttttcaaaaactcgcgtcaacgttttgagaccaaaaatgctaaatattttggaatctggtatgcactcacaagctgagagtgaagacctcatgccataaaagaaaacatacaccggttataaagttggaagataaacaattatgtcctctacacatagtaataatgtaggacatccccaatcttctccacaaggtccactaacggaacaacaaagagcacaacagcaatatcaaatttttgagaattcattaccaaaagtaagtcaatctgtgtatcagatgctgttgaacgagatggttcctctagctatgggcattgagaggcaaatatcaggcgatgtt

SEQ ID NO: 12003 - DNA, 495 bp, Saccharomyces cerevisiae
gattttgcatagtattatgagcatttttttttagcgttatagcatacttgatatatatatatataaacaacgtgaagatcaaataacgtcaaatgtattaaatagactaaaatattatgcacttctcttcggatttattgctcgcgggctggttgacgttacatggtccattccactgaaatgttttaagagatgcctatatggccaactcaaagttttgaaaaagggaactaggttcacataatatggggcatttagtgtttgcagatgattatgctccatcgcagagattatcgctagtgccagttgggaaggtatgatgtcaggagccaataacttagatggtgtagggacatcaataaacatattagttttgatttttcccgggcacaccagtagtgtttttattccagttttattacattccgtggacaaacttctgaaatgcctgctcatacacttgtgaaaaccaatcattgctccttttgatgcacc

SEQ ID NO: 12004 - DNA, 479 bp, Saccharomyces cerevisiae
taggtttatgcatttcgtcaaatccattcattcgttaaacttagttaaaagtgttatatttattgtgaattggtttgttttggtaggcttttttctatattatgtattcttttccttttcttcaatattcttgtatggtactttaatttactggcaggtattttttggagcggtcaattatatgaatcaaaacgccattctagaaacaggaagaaatatatgagaaccaaggagtaggttgaaaggcattgtagagaaattttattagtatttatagccgaagaagaaggttaagtgacaaattttcatttataagcctcgctaaaatgaatgctagtggaagatctcattccaaaggccccattataaggtctgtgtctttagaagatcttaagagaaactctagtttcaaaggcaatctaaagtacaaagatgaagtcacttcacataaagaaccacaggtcggaacattgagcaac

SEQ ID NO: 12005 - DNA, 481 bp, Saccharomyces cerevisiae
tggagttgagatgtttacgtatatttttatgtatattattatcattagtattactattattgttattatttatgcacggttcctatttacacgcggcgtttatattttaccattgaatatttaagatctctttgaattttttctcgaattcgtttgcctttatacgtccctggcttcgtctcattccttgtccaattaggaattttaaagaggacttctttttaccagtaaccaggttccgtataaaagtgtcatctgtgtgctgtgcaatgacatcattacagagatccatcaattcttgagggtcgacctgattaatcgcatgcaattcaaatttctcgattagttttgaaaaatctggaatagacaaatcttggcagttactctgctcgaaattttccaatatgtgaaacagtaacattttaccactagttgcggatataacctcttcatgcaataacttcaaaaactgggcgaaaac

SEQ ID NO: 12006 - DNA, 492 bp, Saccharomyces cerevisiae
gaccagctatatgaggagttatgcatatattatggctgtgaatttaagtttaaatgatcttatcctaggtattcttataaaaaagaagagtgctttaatcgagcaatggttaactatttgttgcatactcattttttcccattgaaatctctaattgtaggctgatacaaactcggtactcagctcaagataggattgttagttctgatatgcaatcttattaatctatgtatagtacacaactgtatgaaaacctcccgaagtctaagtaaagctccattgatgttctcttgctgttaagtattatattactccataaccaaatctgtgttcacacgtactacaagcttgacatgatactgaccatagtacatgtgcaagttattcaaactaagaattacagagcttcatttgtcacagtcacttcatactactatgcttctaatgcttctaatatttatgcattgcaggttcaacatgcaacacttgggt

SEQ ID NO: 12007 - DNA, 411 bp, Saccharomyces cerevisiae
aacctagttacgccgaggggatttcttggtggacccaataagctgatgcatatatagatcaaagactttaatttataaaattgtcaatatttaatattaatattcacaaaatacgataaaattcaaactaatgcggtagagccactactggccgcaaggcagaatgatcttggcaactctacacgctggtgcatgggtagtatttattctaaaacttgctgtattattttgaatagtgatattaggaatcgtctgcccacgtacaccggtgaagccgaaattttctcatggaaaccttgggaatagaagaaaggtccattgtaagtgctacatactgaccatcttacataatcttacacaaccctggtaataaagccacgtctagaaagttttccaggccaaacaatcttc

SEQ ID NO: 12008 - DNA, 478 bp, Saccharomyces cerevisiae
accttataaccagcaaattcggctaatagggtgatttaacgctacactaactgcaagtatatgttaaccttccccgagactttgaaaaaccgtgactctagttggaagtcagcatctcgtcaaccaaatgattacagttcactttgaatattctgaatagcctttatgatatgagttaatcctatattaatcatggccgacggcatttaagcgatgtatatgaaatttatgaaaaattaaagtagcgtactttatgctacatagcttttgaaaagaaatctctggtctgtaaataataaataaatatatatatatgtatatcttaaagttgacaaagtactgttagccattcatagaaatactatatttcatcttgggttgaaggtgataatcggcccgatttgactacactttaagaagattggaaacaatgaagttttatatagatgatttaccagtgctttttccataccccaag

SEQ ID NO: 12009 - DNA, 489 bp, Saccharomyces cerevisiae
caagagtgaaagaaaagaaagtaaaaaaaaaaattggcactgggactaccagtagccatttcatttttactgttatttaaggagccttttccctcctaacgcgttttctctttcccattcattccattaactacttcattagaatttttagaaaaatacaatataatatatatgtagtgggctttctagttatttaatgcataatgactttataaaatttgtttatttaattgccactgaattaacacccgccgtcagcacagaaacaatattgttctctagtgtctcatctgctgtttcggaaaggtgcttctttggatcttgcctaccaacgtatcttgtcttaagttcttcttcggttaattccttttcctcttctattctcttagagtactgttcggctatcttaaccatactctttgtagcagccaaatttgattcttctttttcttcataatcgtacatcttaagacctgattgccactgttc

SEQ ID NO: 12010 - DNA, 461 bp, Saccharomyces cerevisiae
taagcgctttccagggacaccttctgtcgcaaaatatcagaatttttcttgattaaacgcagcatattgagtatatgaaattaacgggacactgtgtgaaaaatttgtagttgtacttttttgttatcccctttggtagacatatggacgaattactactaagattggcttccataaggcccaaatccagatatcacctacggtatgtccttttcctacttgcaatgacaaataatttgttatttatcttggaacctatataagttacatctgattgcttttgtattttttttggagaatattattacccgcggggaaggaagtaaggggagaatttttgaggtgtataaaagagagtggaggcttaatcaatcaaagaattctttctcgtttattttcagggtttgtgactaagaaacgatattaaaatgtggaaggccgtgatgaatgcttggaatgga

SEQ ID NO: 12011 - DNA, 454 bp, Saccharomyces cerevisiae
gggggatcttaatcgtagaaaaaaatgttcacttcatattctttcctttgaaagtttttttttttttacttctttattcactacttgtaacagtatatagcgggttgtactatcagcagaaaaaagtaattcataatttttcagaaagatttctcataatatagtatataaaaaaatgcttcgagaggagatgatagacagcgataagtatatggaaatttggaaaccaaacaggagatacaaatgggtatatattatatttaataaaaacgaacagatggcgatccagaatgtggaaataaataacaaagttgaacatcatacggttattccaaggtggcgagaatgttagcctgcaaaggaacttgctagtgacatctcaatgaaagattttttcctcccagcaccaaagtttggtttcgaagactgttgctgttgtactggctgccttggt

SEQ ID NO: 12012 - DNA, 400 bp, Saccharomyces cerevisiae
gaaacagacacagacacagacaaatgcatatacatatatatatatatataactagacagtatataaacaaaaagagttatttgccctttatgctgaagaatcccttttaaagaaaccttggacatatattaaaatattcatttgcttatttacagatatattaaggtaaagagaataatgactcggagagataaatcggtttcatattaacgggtgttttgcaacccgttcacaatcctgatattagtatccaaaaaccgattcacacagttagacaaacattgctcttcttgcgaacttaaattagaatcattgacagactcaacacattttttgaagcatatattagtgaattgatggattgacatctggactttttgtttggagttctctccctcca

SEQ ID NO: 12013 - DNA, 428 bp, Saccharomyces cerevisiae
tttttactctattaacgcatggaaatacggctttaccttctcacataaatatagtttgtttaattaataaagccaatataaacatttgcatattcgacttcgtgcatgcagaaatgcggcagataaattcatttctgtctaatcttttgaacagttttaaagtacaaatatattagtatttaacaggaaaactaaaaaaatgtataataagaaatgagtaaagttatgaggctatcttgtgtttattatagtatataaagctaccgaaaaggttgttgtaacaagtagcttagtaaacgaaacccaaaatcttaccagaaacgtgctttcttctggcttcttcatggtccatgataccagcagaggtggtcaagatgacgtaaccgaattgtctggctggcaacaagttggcagtccatttttcaatg

SEQ ID NO: 12014 - DNA, 404 bp, Saccharomyces cerevisiae
tcttttagatagacctctacagcttttacataatggcaccagtaataaatgatgaacgatttcgttaccctcggtaaaaccggccaaaaaaaaaaaaaaaaaaaaaaaaaaatgttctcaaagtgtaaacttaatcaaaagcttatttgtttgttatctgtttctcatcggtttcgtttgttgcttaaagggtggatcggtcatttacgataacggttctttctgcatattccgatccttaaaggcttacttattcacattacgggtccaatataacatagattgttgtgctcagctcatccatttcgctggtcgcttatattctcttttttgttttattcttttctttccttcaaggttctttgcaacagcactgaaaatagttacaaacaactttgcgccag

SEQ ID NO: 12015 - DNA, 489 bp, Saccharomyces cerevisiae
acttcatgcaatttcttgtagataaggaaaaatagaagcctttacgtaaatagataactatagttaaataattgtgcataaaagaaccaacgatttataccttatttttttttttttttttttatttattttttttttttttgcgtaatacaagcgaaggcattgtttacatgccaaaacccaaaactgagctcgagagaatagttgacgaacggaagctggatatcaacataaaataatgagcttacccgatggattttatataaggcgaatggaagagggggatttggaacaggtcactgagacgctaaaggttttgaccaccgtgggcactattacccccgaatccttcagcaaactcataaaatactggaatgaagccacagtatggaatgataacgaagataaaaaaataatgcaatataaccccatggtgattgtggacaagcgcaccgagacggttgccgctacggggaatatcatcatcga

SEQ ID NO: 12016 - DNA, 472 bp, Saccharomyces cerevisiae
taggtgcagaaatatcctttggattgatacttctgcgtctacgattcgtcctagtgccatattatgtacctatttatttactattcatttctttgttcttctacttcaaatagctcagaatgtattatttttttattaaaatcatttctatatataggattaacgagaaaccattccgggagtggcatctctatgttttctctatgtaagccacaccagagaacgttgctgtactaagacacccatttcgagtatagaagcttattgaaaatgaactgatattttttaatacatataaatctcgattaaagacaaagcttattggacatggagtagatgttttgatcaatagattttcaacaaattgaacggtttgctttagataccgtttgagataaaatactgcattttaatgaaacataaagtcaaccaacagctgaagcttaacaatagttactactgcccggcgtta

SEQ ID NO: 12017 - DNA, 475 bp, Saccharomyces cerevisiae
ttccggaaaatataattggtgaaagcgaaaaactcaataatgtttgatagtacgcgttatttttcatcatttatcttttttttagccctgtaacaatttggcaaatcttgtcttcacttattgccggatattgactttctttttcttccttgacgccaactgtttttatttccaacttacacatggagccgttgtatttatattattttacctatatgtataatgaattttattctttctcttacaagttagtttgatttcttctgcctacattcttggaaggactggccaagcgcggcgtgtacgaaaggaaataaacaataagcaggtggaactcatcagtcgtttgccgagatgtgattattaaagatgtcattcatatattcaagttaaaaaatatatagaattgataagccatatatagaaacaattactaaagagagaaaaaaaccaagtctggtaaaagaaaaagaaa

SEQ ID NO: 12018 - DNA, 400 bp, Saccharomyces cerevisiae
ccgaaataaagataaagaaacgttgtatacataaaagcttacagaaaggcttaaaaggaaaggcatttattttcgtaccatatatctcacaaaaatagatagatagatagatatgatattttatgaatggtatcacttattccgcttgtgaaaaacttcaaaactccgtaaatatatgaactcttttctttcaaaaatttacttaactttctatatacgaggagtagagtatttatacatgcaatagatatatacaatcattacaaagaatcatattcaattctaagtatcgtccacgattactattgctttaaatgctgtttggcaaattcccaattgtgatggtcttcaaaacagtgtaatcttcaataccatatagcgaaccttctcttccaaatcc

SEQ ID NO: 12019 - DNA, 400 bp, Saccharomyces cerevisiae
tcgtctgaataagtatcagcagaaattttttaattttctttgttcttaattttcagtcattccgtcattccgtcatctatgtttattgttctatattattacgtatgcataaatatcttaagtatagatcgatcctaatagctattcagttttattctcctgagaggttatccttaattttgaagagtttaacttatcatttgactttataaacttcgcgagtctggtagatttgaaattgaatgtttcatttacttcactaaaaggatgagaaagaagctcgttagcggttggccttttctctggatttatctcgaagcatgcgtccagaaaatttcgtccgatttgcgatatcaatggtaaagtgtcctcaggaattggtggtgccgattttgacttt

SEQ ID NO: 12020 - DNA, 491 bp, Saccharomyces cerevisiae
aggtgatcctaaatagtatgacattatagtatcctgtacatataaaataacgtgtcattgttaataaagcttgatgcaaataatataaagtaagaatctgaaaaatttttggaatgtgaattttgtttacaatacgatacgtatgatattagtatgttctagaatatatacatttcatttttttccttattgtttgtgcactaacgaatgaagaaaaaaatatggaacatctagcgaacgagaatccatcataacttcgtcattcagtgcgagctaatgtgcatttttagtatcctatttatgttgaagcttctatttatgttgaagcttccttcagggattcaacggcgttaagaataactctttcaaaatctatattaggatcttccaaattaaatgaggcgttcgcaggcacatctttaggagttactacagggtgtagcttggcgtattccttctttgcctcctctaccagcttcaatttctcctcg

SEQ ID NO: 12021 - DNA, 483 bp, Saccharomyces cerevisiae
acactatatggttattcactgttgggtttttctcattttgtattagaaatgcggtttaggtagtaatagaaatttcgcatgcgtgtattttattttaaaacatatagttcgtaagggtttatctaaatgcagtagatgttcataaattataggggttttatgtttttatattattgatatagtttttcacatgagatgagaacgacgcgtttattttaaaggaaagaaaactgtgtcgtaatatgtaacaagactacattgatactccatagcagagaaatggatatgttctgtcggtggtaaattcaggtgaattgtatatcagtgaaactatgcaacaaacaaaatttggcaagatgtatttggaccacgattcggtagttgagtactcagaagatgaaattgtcgaagccgatcgtattacattgggctataaaaagagattgtcaatgattgaaaatcaaatgcgacatcttttggagg

SEQ ID NO: 12022 - DNA, 430 bp, Saccharomyces cerevisiae
caatagaaaagcattatagagacaacgccatcttattatttctacatattctatctctctcggttgcaaatgtatgtattgtgtatttagatcaaaaaaaaaaaaacagcgcattttctacaggtaatacagctccaaatttgtctgatcatgtacctcataatcttccagagagatatggtcttttaaaacacttccacccttctgcaacacaattttgtttggttgggtgccaatttgcaaggacaatacttttttgaaatcacctacactatcttcagcaaggcacttcactctgacttttttgcctaatcggtcattcacaactacctcaatcattttcagagtatttatttgcaatctaagctttgccaccgctcctctttctcaatcttttcctctccctcctcatctctctcagccaaaaccg

SEQ ID NO: 12023 - DNA, 438 bp, Saccharomyces cerevisiae
cgcagttccaatttacaagaatgcttcgtttgctattacaatattgaaatataaataaaattccatacagcatgtctaatcatagctaatttatacatattcatcatgaaaacatataggggaaaatatggtcggttaacacacctatcaaaaaattattcagcaattccaatctcgttagtaaaatatattcttattttttttttttttctctgattgtattatttctggagttttgacttatttttttaccacatcgcgcttttcgtccccaatctctctgatatatgatgctgtctataggtagccacttccccgatgtcggacctcgggccgtttacaaactttattgagatgaccttatttctccacattctagtcattcaacttttaccctcatatgtttaccttcactaatgtgaaagcatgaccaaagaa

SEQ ID NO: 12024 - DNA, 460 bp, Saccharomyces cerevisiae
gaaaacacttaaaggaagacatagttttttactttcccccctgcccttcataaacactacgtttcattttctaagagcatcaatttgcaaacacctgaactacttgcacaatacatagtttcttctcctacagatacagttaataattaataaataacattacacataaacatgtttaagtttcatttcagcaagacaagattgacattattaagcgtgatctaaactatgaatttctcccgggtatgaaactacattctactattgattttaatagatgagcgattaaacgggatatttgaatttatgacttctgtaaaccatcgaatgccccaacttttagtaatcaaacatgcaccgaaaacaaccatatcaatcaatgtcttgcttcattcttgatttctcatctctttctttccttcgtaatttcaccttctccctccgctccttttatcgaaga

SEQ ID NO: 12025 - DNA, 444 bp, Saccharomyces cerevisiae
ttgcatctcttaatcgttacacatacataccttctacctctgtactgttacatatgcattgactttacgatctaatataaatccttttgatgttaccccgcctgtgggctcgttctcctttcgtttcttacgattttttcgccggaacaagaaaaaacagaacaaaacaaatcagcgatcgtatacatgggtctttgatttctgcttgcttcttacaaacaacaaacgcaaaccgttcattgagtgctctgtgactggttttcatgtggatgccatagtagagaaaagacacatacaaaaatttcgcgcattcgctggcccttttcctgctctcctcttccccatgtccatgcccatagcaagtaccactctagcagttaacaacctcaccaatataaacggaaacgcaaattttaacgtacaagcaaacaaacaactccacca

SEQ ID NO: 12026 - DNA, 435 bp, Saccharomyces cerevisiae
gcgacagggcctcctcttttaaggggcgcgtcctttctattgtgtagagaaaatctactgggattttgtatatatttcgcatatataggggttggagaacgaacaacaatgcctgttcagatcaacttttcttctatcttatcaggcaagatcaggcacacaacccaactataataactataaacacttatagaacaattaccgtttcttccttcacacaacatggcttctacttcgaacacgttccctccaagccaaagcaattcttccaacaaccttccaacttctagacatgcatccattgtggagatgctgtctactccgccattgctgccccacgttcaagtgaacgatacagacgacaaggaacaaccagaagagtccacgccgccaacagcaacagcggcagcgcctggtccaggttgtgctgctaca

SEQ ID NO: 12027 - DNA, 411 bp, Saccharomyces cerevisiae
tactaacgaaatctttacaggaagaaattggatttgaggacatttgatgtgaaaagcaattggttgttccgtaccggaacacttgctattttacttatcatgattgtttttttttcttattctttgctattattatcaaattatatataggtaaataatcttacactagtttataagtgtcacgaacgatgaaatggaaacttgggggggaaggctcaaaaaacatactgtgtgtttatggggctgcctttgctagttgttgaggggtgagaaccgcaattactgacaaacgttactgatttgtaatattcaaaaactccttgcattgccttcccgttggccaaaatagtagtcgttgacaaagagtacggcgtcgattctaaagttggtgaggggatttgctcgcatata

SEQ ID NO: 12028 - DNA, 475 bp, Saccharomyces cerevisiae
tttcggtataggaacaagtaagttaaatagccgcttagataccataatggtggccgaaaagagaaaatctgacattctcttaagtgtatgtatataaatgaaaaataacgtgagatttaaaaaaaaaaatgcaacaatatcattttgataaataaaaacataacttatatcaatacatgtattagcgcgtacttatgcgcctgtcccatctgcgtgtacctatgtacgtgagcgtatgtgtgcaaatatcagagcgacgaccattaaatggcaagaaagagaaaagggggtattcgttaaatcgtgatagtcatttcccaatgaaatgattatttagctatagtcttctaatcaactatcctgttgttttcttatataaagccttgtcaaattttacagcaatagaatttcttctatggtgatgccttgcacaaggactagaaatatctaatggctggttactggggaactgagg

SEQ ID NO: 12029 - DNA, 425 bp, Saccharomyces cerevisiae
gagagttaatggttatacagctgccatttgaccgtgcaccacagcaaattatctgttggaaaaagaaaaaacgcaaatttttttcattatttttttccagaataagtttggtagcaaattggcgatgagatatctaacaacgactactactactaccataggattgtctcgaatacattgtgttttgcagtcacactggtacttcgtcccttgggcaatctagatcactgtatatactatagatattgttttcagaagagaaaaactgttcatataaagtaattgtcagcaaagaaatcatgaaacatccgtatgaggaattccccacaggttccaagtcaccatataacatgtctagaggagctcatccaggcgccgttttgctatcaccacaatcttctgccataaacaagaacaatccgggc

SEQ ID NO: 12030 - DNA, 473 bp, Saccharomyces cerevisiae
tatttatttacggtttatagaatggtctggagttacatttggaataatactcgtcttgttgatttttttccttctcttttttttacgagctataatatgttaccatatataatcctatagagtgcatcttgaatcttcgtgtccttcaagtacttaatggaataagcttctttcaatgatgtgaaattacctgttttaatgtattctgggtttaaaaactgctgattgtttggatcatactttagctttaatatttttactagttcgtgtaaactcatacatttataattggtagcatgtgacggtaagctcaaaatgctgcttaaagatttaaaatcatgtaaaaactgatttaaaccgttttgattaaatttgttcaactttagaattgactccgtaaaatagttaacaataacatttaacaattcgttcttaacctttaatgaaatagctagtgggatatccattgaatc

SEQ ID NO: 12031 - DNA, 477 bp, Saccharomyces cerevisiae
agagattatgccaaaagaattgcccatgcatcataataaccatcatcaccgttcttattagtcccagacgcatgaaatcacaggggagagcagcttaaaattttttctacagacatacaagaagaaattgcagtttttttttttttgtttctctaacctataaataaaatgtttcaatacacatactaaacaaagaaaaaaaaatgtagagaattttatacgcaaaatatatagacactttcccctatttttatcaataaaaaaatgaacacatcaatgccactaccatccatgctcgaacaacatagaaatggattcaccgttatggattcttctaattgcttcaccgattatgcaggagacatcaataacatccactctgtccttacctaggtactgtagtgttctatcttgaggaaccgtgttagaaatgatcaacttatctatactactttggccgattctttctagcgcatc

SEQ ID NO: 12032 - DNA, 444 bp, Saccharomyces cerevisiae
tttaaatagtttttgttgtcacttgtcttcctgttacatatgtataaatagttagtatcatattcttcggagcatcttttctattgtttaaacgtttttgacggcttgcaggcgaaactaaattgtctaaaattcaaaacaatgccttctaacttgatatcactgctggtcaagcctatttttattctggtttctcaggcaaacccaaatgatattgtcaaatttttcactgagtttgccaagcatatttccatggacttttgtatggaaaccgtgatgagaaatccgggatttctcatcgaggaaagaagtgactcgagcctcttaaggcttagattaaacttttttctttttatcgctgcgtataagcaatacacctaaaacagaaccagttaaagtaaacccgatcaacagtaagaagatgggcaggaaaattgcaacatt

SEQ ID NO: 12033 - DNA, 472 bp, Saccharomyces cerevisiae
tttatggtcttattagcgggaaaaaattaaatttgaaaaaggtcaggtaagcaaaagcagtaaaacttcaatatctatgtttgttccttctattgggagaacgttaatcgcttccgtactcgcaagataatgtaatgaaaaaattaggaattgcaacaaaataaagcggaatattagtaacgcttacatgcaacgttttgaaaagagtggaagagataggcaagcagaattatatgtaacaaaatctaaaattattcactattattcttggttatgtctaatactttggatatattaattctttagaattttatgtattctaaatgcaattatgtcaataaaacccatgtaattttctttcatgatatgatttaaatgcattagtattatcaggcatattgttatatatgaagaaggttagttataagtagtgtataatatatacatgtgctgcccgcaattgggtatgata

SEQ ID NO: 12034 - DNA, 470 bp, Saccharomyces cerevisiae
ttgcataagtagtttttgtttttcctacagtttttatttataaccaaccttatacttttatatccttgtctacatattattgtcataacgaattttttattggttaaatgcagctattgcgttctctttattgcataaatatattctattacaatatgggagggcattatcagcctccatgtgcttgcgtgctgtcaaagaaggagtgcggggatgacaatatgaatagccgccgaaattatgcccggctgcagttgaccgtataaataacagtgcttcaatgaaaggacacaaaaagcaagatcgtcccattttctaccttaatcagtatagtaaaaatcaaaaacataatatattactgttatgatgaataaagtagatcaaatcatcggttacaaaaagtacgaagtgaaactaccaaaagatcgacaagtaaagaaaaataaatcaaaaggtggaaatgttgatca

SEQ ID NO: 12035 - DNA, 404 bp, Saccharomyces cerevisiae
cagcaataaacatcctttcatatacttaagggtatgctgtttaatattgcatggaatacgttacccttctaagatagatgggaataaggcggaaataaaaaacgcgatgagcagtggaaaatttttcagaaattttcagttccctcataatatagatgtagatattgtataaggtcgtacgtatatcagagtagccactagaaggaccagagaaactggaataagagctattatggtcaaatcataccaacgttttgagcaagcagctgcttttggtgtaatagcctccaatgccaattgtgtttggatacctgcgtcatccggaaatagtaatggtagtggaccaggacaattgattacgagtgctctcgaggacgttaatatatgggatattaagaccgggg

SEQ ID NO: 12036 - DNA, 464 bp, Saccharomyces cerevisiae
acgaataaggtaatttcttttcaagatacgaagtatcgtcttttaacttagttggagtatgtgattgctgctcttctactgcgaatgccgcttacctggaggcatagggcacatatatcaaaccctccagaattgaattttgccctgaggctgcttgaagattgtcaaataaagattcggtcaaaaagaggatgatataaacttgggtggaccatcggggtgttaactgaaacggaatcaaggatgcattcatatatatatctatatatatatatatgtgtgtatatgtgtatgtgtgtgtgtgtgtgtgtgtgtaatatgatatatatcttctacctgaataaatgaaatatgatccttccgaaaccaaaactgaagcaaatggtgttaagatgagtaagttaggcttctgtcgaaacaatccattcttctacaatttgagaacagcggtaatgcttttggtc

SEQ ID NO: 12037 - DNA, 434 bp, Saccharomyces cerevisiae
ataaaggctctatatctctctgtaaatataaaaatataaaactcaaaccctcgataggcgggaccaaattttttctctctcagcagtggattgtatacatttaccacgaaaattgtttattgcttgaaataatcatttggattcttaataaaatcttgcaggattgtctgaactgcacctaatctggaccccatgctgttggctaagtcttcttggtttataaaactcatggaaaatacaatagccaagtttgatgcgtccattttattatttacaacatgctgatgtactttattcaaatgaaatacaattcttttcaaagtttggtaatagcatgtaggtaacttttggagtaactcattcatcattctcttgtattcttcatttaccattgcatgtgctttatacttaatcgccaaatcggtaaagtcgtt

SEQ ID NO: 12038 - DNA, 469 bp, Saccharomyces cerevisiae
aaggaaaaaactaaaaaagaagaaaaggaaaaacttacatatgtaaatagaacaaatgaatataaactaaaatttgacaaattttttttctttttggggtgattatatcatttctggatgaggaatacctgaagaccactcttcattaaaatgttctttaaaaatattcttttggatatattctactagttgtccgtccttagaagataatctgttgccattcgatttcacaatttcgtaattatccagagcaagtttcaattcttccatgctactgactccaagaacaacgggtccctttcctacccattccgaaatcgcgtatcttgtggccaaatcggctaagtcgacattttgttcttgacagtatttggcagcctgagatgcgcattctctcaattcatgagaacacgggtgaaactgtcttgtctcctgtgaccttagtagcgacatgctcaagattgatgcg

SEQ ID NO: 12039 - DNA, 468 bp, Saccharomyces cerevisiae
tcatgatcacctttattgtaaaagcaatggcagcataatatcttcccattgcgcattaccctccgcgagcagagtcaaacttcaaacaaagcaggaaaatgaaataaaacagaagttattatatagaagaaagtcatctatagatatattatcgttgtattaatagtagccatataaaacaattatacttcatcaccaacctctcaaaatttcttccccaaggaccaaagcttttccagtaagttgctacaactaaagtgaaataaactatccgaattatataaaagatgcctgactatgacaattacactacgccattgtcttctagatatgcctccaaggaaatgtcagcaacgttttctttgagaaacagattttccacatggagaaaactatggttaaatttggctattgctgagaaggaattgggcttaactgttgttacagatgaagcaattgagcaaatgc

SEQ ID NO: 12040 - DNA, 476 bp, Saccharomyces cerevisiae
aaatgatagcgtgagcgaacgcttgactgtctcctgctgtaaataactgatgatcaatagaatgccacgtatatatggacttatataattatatgtacatagacatataaagggcatgtggtaattatgacatgaactgtatcactattgacgttttttttactgctttttcccatccctgcaagcgaaaaaaaaagcaagctgactcttgtataaactgcaaggactcattgattaaaagtagatttacattacagactaaaggaaaaggcaaactataccggctataccacattcgttcaaaaatgccctctaccacgctactgtttccgcagaaacatattagggccattccaggcaagatatacgcgttcttcagagagctcgtcagcggagttattatatccaagccagatctaagtcatcattattcttgtgaaaatgcgacaaaggaggaaggcaaagatgcagcagat

SEQ ID NO: 12041 - DNA, 474 bp, Saccharomyces cerevisiae
gccaattaaggcagcactatttattcataattattcgtaattatatctccataattatttattcataagttttctttaagtttattctctacatcactagttattacaaattggtcgtatgtacaagcactaatatttcatacttatcgtacttcatacatagcaaatcctgttaggaaaaatatggcagcaaaacagattggctgcctacttttgacacatttttttctaattcggtacttagatcggcatgaactcaacgattatcgcattatacggacaatctgaaaaaaaaaagtagcctaacttatgcagttgtgtgtttataacgttgaattcctaaacctcttgaaggtgtaatataacaagtaacataactaggttttcacaactcgttagtttctattaaaagaggaataaacaaattttattaggactaagaggattatacagagtaccagcagagaaaacttt

SEQ ID NO: 12042 - DNA, 469 bp, Saccharomyces cerevisiae
aatgaatgaatagactttgacaaaaataacttacaaacactaaataagaaagggcaggcaacatcttcatgaggcaaaccaggttctttttttattgacttcgaagtatacattttcatcgcataattgacacacaatacgccctttaccattccaacctactacaccttttacttatataagtgtataaactatgttcttacgcggtgtttttaggggacggcctgttataaaatggaaaatataaaaatgaaatttcacccgcggattaagtaaaagttcaaaggaaaacacatagaggcaataacggaatagtagcattgaatgtattactttctggttggccctcacatctatggatcaatttgagtatatcattactttagaatttggaaaccaaaatcaggttgaatccgcttatcaaattttcaagagtattccgaaaaagttgaaggcaaaaagtatcggg

SEQ ID NO: 12043 - DNA, 416 bp, Saccharomyces cerevisiae
caagtatcttgattatggttcgttatatacatcgattctttgcaaaattatccatgagagacttcgcgccatgctacaatttaccaatgcgcatcgagaaatttatgctatcgcatttaatatgatataattatccgtctgtttatatatatatatatatggggccaaactgaaaggcggcagttacattacatcgtctcctctacctagtcatgaacatcagtggcaccttaaatacgctccggttgctttataacccatcactgtgtaagcctagtctagttgtccccacttttaacgatcttcctataccaatccacgattctataaaggccgtggtcttggataaggacaactgcatcgccttccctcatgatgacaaaatatggccagattacttgcaacactgggaaacc

SEQ ID NO: 12044 - DNA, 408 bp, Saccharomyces cerevisiae
ttcagcaaatagcattcaacaataataataaaacaaaaaagaagaaaaagctatgcatattcctatcacagttaacgcttgcttccgttcttttttctatatcatcgtttccatcatgtttttctttaaattgaatactttcctatgctcttaatgagttgcgattgtgcatatactgtatttcaaaatcctttgtatctaactaaggaagaaaattactatgacgtttattcaggatttttttttttcattccttgctatacgaacaaaagagcaaaggctggaaaactaagtgagtttatatatagtaataattaaagaacatatcattatcatgaatttagaatgcaaatttgctcctctcaaaatggcataccttgttgttcgcgaaggcaagcccttggttat

SEQ ID NO: 12045 - DNA, 402 bp, Saccharomyces cerevisiae
atatttttagttgaataaagaggcaggcgtcagcgatattgcattgtcgctgtggtgggcagaaagccacggtaatgcatgtcctgttgtctcttatccttgttgataagaaaccctcttgatcagctagtcataattttgtctcttcttgcattctctttccgatatataacttatatcttcaggtgtcaggcaatagaaacaacaaggcacagcgttaaaagaccatcatttcattttagcttgtccaagcacataccatttttcactcaagctatagcagagaagttagtaaacattaatagattataatataagaaaggctatgaagaaaaattcttcggtagttttcttccttgtgggtctatcacaattcgtcactatggcgtttctcattatcgg

SEQ ID NO: 12046 - DNA, 500 bp, Saccharomyces cerevisiae
aaaaattcgtcataaataggtttcataaacgcatttttgaagtgatctctccatctgctgcaaaaatagtcttgtaaatgtgtgataatgatgagattagaacttggtactgtagctaaggtacttaggcaacttctcttcattatgtattaccatgttctgttggttcacgtgacatgcaaaggtataactttttccgtacaaattattctctccaccttttttgtgttgttgtgaaagaactttccaattattgccactgtaaccaaccgtccctaaataccaacgacacaaaaactgctgctactatgggtggtaacgttctccccattcattatgaccccaaaactgttaaacaattaactaaagaagtatgtaaaattcaagaatatatctggccctgtcttgttcaccccagaataaatcgctaacacaagtctaattaaccttctttctcattcgtagattactgttgcatcatgtataggagctgcccaagg

SEQ ID NO: 12047 - DNA, 411 bp, Saccharomyces cerevisiae
cgttgatttctctacttcttattctttcttttgcatgtactttaaaaaaaatatgaatataaaatgtggatgtacgtacacgacattctaatctttttgggctggtaggattaccatttacatttgattatctctctcactattagtggtttctttttctttctttctcactttttctgtatcttttttttaaaaaaattttatttaatctgtataataataataaaccgatttaaattatccaacaagccgacccctccatgttctactatttttttgtatgtcactggatgtatacaaataattaagcatgtggaaaaagaaggggtgggatagcgtcaagatgacacttctacttttttgtgacacatcatcatgcaacctatcgagtctcccacgaggttgacaaat

SEQ ID NO: 12048 - DNA, 425 bp, Saccharomyces cerevisiae
gcataaaacaagcaccttcaaacaacaaagccatgtgatatcagtcattatcttcccaaaaatcgcatattaatatgtcttaaaccgtttatataatgaaatttacttgacacctttctttttaatattctcatccaaaatacttcttaagtatagtatataattcatcgataattcctttataggccaacgaagagccactagacgtagacaccgaaagaattcgaagcaaaaacagtggtcaagccagcaaacaagctgccaattacacttaaaattgtgtagaagaagagtttcttaatgtatgaagatttagaaccgacggcgaacagggcagatgataatacagctaatgtaacgattaaaccacaaattgcaaattttggttgagtgtctaagtggataaatggctggaagctctttga

SEQ ID NO: 12049 - DNA, 463 bp, Saccharomyces cerevisiae
gtatagcgcacaggttttgactggggacgctacaaacacatgtaaatacatacatatctttcatacacatataataaacaaagcaggaagagcattctaaaagcctcacttaacatagacaccattaaaagccacccatttatttcaaaaatttataaaattctaaagataatcagtggtatgtgattaaataaactacatgtatattatgctaaacgacaatcctgactaagaaaaagaaagaaaaagatatatatttatatgtatctacataagaccaaccgtatccgtaattgcagataaaatactcattaagccctctttacacctagtgacgttatagacgtggcggacgaacgagaaacagaagtagatccatcaaataacgaagggcttacactgggttcatcagtcatattaagatcaaagtcaagttccaagttggacaaagggacactttcga

SEQ ID NO: 12050 - DNA, 415 bp, Saccharomyces cerevisiae
gcttaaaccaaagcgaaattctgcatgttccatatagattctatttcatattttatagttatttattctttagtaatagcaaaaaaacagtaataatttttctttaacagtctcggacaataaatacgctaaagaagatgaaaatgacaacttttacgctggtgtgcacaagtggtaccagaatacgtggccaccaaaacaatgacggatatagggagaaccaagtctagaaattacaaatgttcttttgacggttgtgagaaagtctacaacagacctagtttgcttcagcaacaccaaaattcgcataccaatcaaaagccgtatcattgtgatgagccgggatgtggcaaaaaatttataagaccgtgccatctacgagttcacaaatggactcattcacaaatcaagccca

SEQ ID NO: 12051 - DNA, 485 bp, Saccharomyces cerevisiae
aagggcatttgaatcaaggatatcatgaaaatttcaaggcgttgaaatttgtgttgttaaggcaacactataggaatgaaaaatggcctctctattataaagtccttttgccttattttttcggtagctgcctacaatttgtaacgttaacattcccgggtgaaaagatacatgagtatgtagagatttgtatatatatacctacgtagaaaatagaaaggcgaatagctctgctcctagttgaatattagtagcgttctcacatcattaagaggataagccggcattttatagggcttttgcagctagtgtgaaacttatgaatcgaacagtctccacattatcatctactgtatctgatgtatccgtggaaataccgtcaatatgcaacgtcattaataccgaattaccaacatcagatgtctatctttacactttaaaactaattttgttggattatatcaacgaaccgcgatttaaagaag

SEQ ID NO: 12052 - DNA, 454 bp, Saccharomyces cerevisiae
atgttcggtacctcagaacaacgcctctattttatcctttttttttttatttgcatgatatacatatactattttttattagtttcttattctactatgtatttacgtaacaataaatttacaggtctctctttttgtaagtatcttgcacgctgatatctataatactacttcacaagttgatcagcttccgagatagacattttatgtatcaagtcgccatgtccgttctctactggccggtgtatattatgatatttcgaccggttctaatacataagcaccgcccactctgaggagaagacatttttacaagaattactagccatattttcccttgtcaaattagagaaggaaaaattacttgaaacatcccgtgtttgggcactaaaagtatatcaataggagctgaagaacactacactagactctcttggcgtgaaggccttattat

SEQ ID NO: 12053 - DNA, 413 bp, Saccharomyces cerevisiae
ccctatcattgaaggtggaataattatgttctcctctaaaccaaacgcaccgttaaccccaaatcaattgtttgagtatttgctttcggtcttcatgtatataaataagtatgaaacaataaccataaatttatacaatcgataataccttagagaattcaagcgttgaagtaattaaatactatttcgtcaggcgcttgcaaccatctcgacatcataatcctaacccctcaaaatgattgaaaaacttgtaaatcttaacgctcctgtgatagtctataaaaaaactgttctttatggaagactttgatgtatacatacatacatacatatataaatgttttatcaaatctggcctatttttcactttggctgttgccggtaaattccttttcaatccatttgtgcgtgat

SEQ ID NO: 12054 - DNA, 407 bp, Saccharomyces cerevisiae
tgaaacagaagggccttggcgcgcgtcccaaaagggaaaggctcgctctgaaacaggcgaagacacgaaaacaaattaccgtttcggggcgttttgcagcaagtggctagacacgtcgggcgttgccagatcaaaatagcaccagtgggtgtttttttactatctcatcttcgtgctgatatatataacttttatacatttccatagtaccaagttctttatttcctgcatttttacatttataatagattaccaaaactattcgacctcaccaagggaccccataatattgctaaaataatcttacctgttttttaccatttttttctttttttccagaagtaataagctctctcttagaagaactaaaagcatctgacttcggctcgttccaaccgaccaaaata

SEQ ID NO: 12055 - DNA, 479 bp, Saccharomyces cerevisiae
agttcaaacagtaataagagtctatcgattacataaatgtgagcaagcgaaaaaaaaaaattggcattataaaccatcattttcgatgaaataatcaatcaacgtagataagctgatattatataattttggtctgttcgtgttgattttatcactgatggactttggcatacagatagtgacaatttcgttattgaaccattgagaatggaaaatcaatggaacttcatccagagttatgcacatagaagctccctcagccggaaaaaagctgatagcgccaaaatctattagtgacaagtctgtgttaaggccagttccagtaaattttgtatacgactccttcaaggaccataagtaagtaaatattgtgcatggatcagacgctttcagtaaaccgttaaattctctttcactaaaaacttctttaaatagctccaactcttccctcccgccataattgcacggagaagcgatat

SEQ ID NO: 12056 - DNA, 441 bp, Saccharomyces cerevisiae
aagtacttaactaaataataccagcataatcgtaactaaaactaaaatatagatatacgcatttcaatcttttcttctcagagaagggtaaagctaaatgaagttttcaatcggaaaacttttaatttttgatgaattttaatttaaacttatatttcttggaattttgttcatcgtctacagagaaaatggggctttgattccttctccttggataggtgtcaccgccccagttgtagttaccagaataaccaatatatccgtctcctcctttcgttggatcaaaatcgaattgacctgcatccttaatgttcctgaatttgcagaccaattcattagatgaagacgaaataatgtcacaaaacccttggttagttctcaagtagtaattcccatagggagatttaatcaactcgtaattcgctggtgtaccttgactca

SEQ ID NO: 12057 - DNA, 488 bp, Saccharomyces cerevisiae
aattgatgagagaattttgagatgaaaaaaaaaaaaatgaatctgtactatttctttttttagtgcaaaagttttgttttaatatagagataaataaaaaaatgaacatattactataatatcaacaaaatatgatgtaatgtctgcaataaagatgagtcaattgcatttctatacgtactaatcgtgtgtacatagccatgacattatgtaagtttatacacataaattgcgttggagtctgctgtgtagtttataaatgtgtaaacagcggcttttgtattcctattagttgccgttacctctcattttttcggcggtaagaatgtcactgcctatggattccattacatttttctcaatcagttcacctacgtttgaataaaccatactagcttcgtaagcacttactatacgttgttgagtaatgcctatttcacagaacgctaacgctttgatcacgttcgcataccggcaaattgcttgtc

SEQ ID NO: 12058 - DNA, 480 bp, Saccharomyces cerevisiae
tgacagtattatttttgggtaacgttaataatcggcatacaaaactctaaccaaattggattatataatagctattaaggaaacaattgtctttacaagagttttttttacgaaattttcccatccaatgtgcacttattctcagggagtataataaccatattcctctaaaattatattactgctcaacttccatgcgcttttgcgatctagagtatttatgttaccatttatcaacagtatctagtactcgcagcatacatacgtatttattcagaaaaatgtaattaggcgaacaaggccgaaaactgtgatgtgacaacgcttgctatacttgagagataattgtaaaggaagaagagggaactaaggaagagtacaacacgccatacaatgatcagaacatcatctatattaaaaaactgtaactatagatacatacattgcatccatagatgcttgctgaatgaagccaatttg

SEQ ID NO: 12059 - DNA, 402 bp, Saccharomyces cerevisiae
gcaaaagtgggaaggtctcgtatgctttttcctatctgtgatttaatactacacaaatctaatattgcaaattttaataattatagcaagttatcgttatacccctttttaattgttgcgtcacataatcgatactattgttcaaaataagagtgatgcgagaaatagccacagtaaacaatgttgccataataaatagttgtcgtttttattcatctcatttttcttatgtatccatacatatatatatataatgtaatatagcctgagcaaatgaataaagttttcgtggatatctgcgaaatatacccttgcaagcaaaacaaaagaactctcagaaaaggttataatacaggtgctggtaggagtaagtacgttcctggggcttggtatttatcggga

SEQ ID NO: 12060 - DNA, 406 bp, Saccharomyces cerevisiae
cagtaaagtaaagatcagaaccaaaaataggcatatacactttttatagtataacacacttccagtcaactcgaatcgcttttgccgcgaaacgcaatgaaaaaaagtacgcaacaaagagaaataatgaaaaaaaaaagaaaaaattttttcattgctaggcgatgagcatcgacagttttatacgtaaatcaatggttagatagataatattaataacatacaagacaatttttgcttcgattaaagtgttggcacgaattattgttgcggttcaccaaccactatacattttttctcttccttccgcatctttatctggccccggtaggtcatgaagtctagtaagcaattggttcaggacgctaaggattatcgcttcaatccggcgataccattgagaatt

SEQ ID NO: 12061 - DNA, 476 bp, Saccharomyces cerevisiae
tcataggattatctcttcctctttcaaactgcgcgtagttcaaaataaaaaggtatctgtgtaaaaaaaaaaaagtaagtcaattgtatgatttttaagtaaaagttgcccttttctactagaaacggcgagaaaaaatgatagtagtgtgccaagaagaatatgaagttactttttaaaagatattcgtctagtcatattggtaagctgattaaggactctttaatcactcctgaaatactaccacagctagggcgacagccatcatcgcataaacgtttaccaaataacaaaagaactaactcaataactgataaatggttgaaggatgcgctaacaagaaaagataaactgaatgaagataagctccaaaatgtaaatttacgattaaatgtggtactgactactctacagaagcttcgtacatccgataatcctgctttgtattttgcgttgttgaatcgtattggcacagg

SEQ ID NO: 12062 - DNA, 485 bp, Saccharomyces cerevisiae
ccgccctgtacataggtatattataataatagtaagttacgcatccatatccacatcagtatccactgccatcatttcaacatcggtatcagcctctccatcataagtgtatttcgaagtcatttgattatggaaccacttccaccagcttagataagcaatttccttataatctacccattttattatttgtagccttttttctctcaaacgttcccatattttgtcataaaacaagtcattgtcgccgcgtttacttgtggaacacttgatgatctctttcaggaccttatcatcaatagcgtctgtgaatactatattgttatgaataagattgttatcatctgcatgtccgttcttgggccctttatcatttaaggataaattctctaaatctataattagtctttttcttttataattatcaattcctattgggtctggagaatgatttcttttcctaatgtggttgggattgccattac

SEQ ID NO: 12063 - DNA, 494 bp, Saccharomyces cerevisiae
acaaaataagagcagaactgcatatatacatttaaatttaataactatatattatattaaattctttgttcttggtatttgatgggttgctcatttgtttattttttttttttttttttttgcttatgtgtccattatattatatgtaattttacatatgtagccaaaagcccaactaatcattaaaatcgattaaagaccgtaaagtaaattgttcattatagaagaaaacgacaaagaaaaacagggtacacttcgttactggtcttttgtagaatgataaaaagtcaatacggttttatctccttattcacttgaaaatctttttccatcaatttgttaattttagcatctttttcagatatttgacttctcgcattttcaagacatttctttgtaaaagttaaatcaccttgaagtgaagttattctaatttcattcctcataacttcatctgacaaagaccgaataatttcatttgcaacagccaattg

SEQ ID NO: 12064 - DNA, 418 bp, Saccharomyces cerevisiae
cagtaagccttattttgtaatgaaaactatattcatacatatatacatattaatatatatgtatatatttttatttattaatttattctagaatgtaatgtgcatagatttgtgtggaatatttcctggggttttctcgtcaaatttaaagagtaaaaagttagagtatttccagatctgaatctgaaagggactcactgataactggcgctttacgcggctgtctctgggacagaatttcacatagagactcgtcttcgtcgcttctaccaaatgtttcattgccaatattattgctgttatcgctatcgctatcgacaatagggtcatcattaaaagaagtttcttcgtcttcaagatcgtcgttagccatcatcacatttctttcatattggtcaatcaacatgcgaagccttct

SEQ ID NO: 12065 - DNA, 422 bp, Saccharomyces cerevisiae
gattagaataaacaacaaaatcataacttttagaagtatctgtataatattaaataattaaagcagccggcagtttacataaagaatatttttctttaattcttttttttagatgtggtcctttcggcgatttggcacaagttaacttagtatttttaaaagttttgaatagtactgctgtggcgacgctcagaataaagctaggtaaacgatttgaacgcctcaactagcactatttgatagcattttggctgcagaaaatatacaaagaccttatgagctctgaagaggactatttcgatgagctcgaatatgaccttgccgatgaagttaatgaggaaaaagaagacatacaaactaaaaagctcactacggtaaattgtcaaacagaaaaattcaatccattcgaaattcttccggaa

SEQ ID NO: 12066 - DNA, 499 bp, Saccharomyces cerevisiae
tacgaactactcaattattttcacttcttttttcgattaatttaattgtattttctattttttcttatttttttctttcactttccaattgaaacgcttgacgaaaatctatatactatatatacggaagagtatctatcatattatacatacaatatagagtaacattgccctttgctccaaaagcaagaaacatcactgaattattgtttgaatttgcaattagaaaagtttaaaagagtttttgttttaaacaatatgtacagcatagataatgtcatgaatatttacatctattgaatatctttcgtagctaccaattctgaattatattttaacaatgatatattgttgacaccccatttctcactgaatgtatgctttccgtttaaggatatagtgtcattatatcttaatgtccaataaagaaacaatcttttcagtaagatttctttccctaacgtgtcattaaccatctcattcaagtcatcgcccatgt

SEQ ID NO: 12067 - DNA, 482 bp, Saccharomyces cerevisiae
tgagtgctcaacgaactttcaaaattaatgacagagggagagaaaatgggacttatcttcacgtatgtcttgtatgtatgagaaaagcactactatttacaccagcctaatctaccggcaaaaggatgatgtgaaataacagggggaaggaacatgaaaaaatcctgatcttagcaccgatatatgtaatataataagaacgattttttatctgtaacaaaagtagaaaaaagaatgtatactattgttttctttttcttctttaaaaagtcaaaattgtatagatgcgtatatgttcagtatataattaatgaagaaagatgaaaatgtaatgaaaatggacgagagatacgtctaagtttgatttcatctatatgctaatcttctggcttcacatacttcaactcgccgttcaccattttaatgtctttgaactcttccaataatgtgtttcccattatttctagcgattcatgcgtttg

SEQ ID NO: 12068 - DNA, 437 bp, Saccharomyces cerevisiae
taggcaggtgacgcattaaatatatgtctgtatagtacgtattttttccattttatttattcttatcaaaatttaatcaacatatatgctaaagaaactattgataggagatatgacaggaaattgcactgtttctggaactttggcatgccgaggccgtcatttccagtataactgagcaaaaagaagtgacggtaaatacagcaagctgcggcattcaggggacatatctttacgaaatagtctggcctatgtggatttagtagacagaaaaagggatctcgacaggttcgtgtggctacaccttttcatccatcgtgtatgcctaaattctgctgtgctaaactgctagtttattaattctcgcccgattataatagacattttatttactctgtttttttgtcggccaagtacggaaagtcatggtcgctttg

SEQ ID NO: 12069 - DNA, 419 bp, Saccharomyces cerevisiae
aagcttccaaaaaaaaaaaagaaaaatcaattgctaaatgcatacatgcaggtaggcacacacacacacacacacacacactcactcacacatgcacacgcacacacacatatataaatatatacgtactatgtatgtcagttttcgaccctaggaacccctatttggttgtgatgaagctgattttcgcaccaacaccacagtttcattatctgcgtcaatcttggttcatagggaaattcggaagagtagtaattattgaattctaaacctttttcctttccatttgaagaggaaagcaattcagaagtttgattccagtaatttttattttctaagttatgaaaagttgtcgccgctgaacctgtgccaacatttccatccctttgatttagccaaactgaattagcagcagccgt

SEQ ID NO: 12070 - DNA, 462 bp, Saccharomyces cerevisiae
atggaagatgcttcagtatcaggatataaaaacgaaaaggaattcataactcatatataaaacacatcgtaaagtagtcaatgtataatatcgaaagcaaacaatcgtgatatctcttgtagagtgaagaaaactatttagaaaatggcaaaaaaattgacattttggtggtggacaaaaaagaaatgcgcaagcccggaatcgaaccgggggcccaacgatggcaacgttggattttaccactaaaccacttgcgcgctttcatgttatcctgagcatccactcctctatttaagcgatatataaaatagtagcagttttcttaccaaaacatttcttctgctttttaggtcggtggtagagtttcaaaattcaaccagggtgtatttaaaacatttaaatgtatattctttcttaatcgtatctttagtagtattttccagattaaaatcaacttaaccg

SEQ ID NO: 12071 - DNA, 414 bp, Saccharomyces cerevisiae
gtgcacttatccatcgactctcttatatttatttaaacacttgtaacgcatccaatctatttcatagttagagtctctcttccttgttattgatatgatttttcttttgtaccgtgtgtgtatgtatgtatgtatgaacgtactactaagcttcaacgtcactctataaagaaactaaaaagacacgtatttataccttttttgaagaatgcgagattgcaatgaaatatgtgtctattttttacatgaatcttttgaccaactcctcatatataccccacgcaatacctgcactgaaggcctttcttgccagcctcatgcttaacccgctaaataacttcagcacattttcatttttaactatagatgtaaatgtattgaaggagttggtaaattttgatggttccaattgca

SEQ ID NO: 12072 - DNA, 485 bp, Saccharomyces cerevisiae
gcgcgcaaagtttcaagtcacgttcattttcacacctatcgcaataaaaataaaaagtgtacatctgtatatatatatgtttaccatccattaaagatgttttctcattcgttgattagttctttatttgtctttctatgaggtggttaactctcttcttccacaggctccggcactgcctctccttgctccggctgttgttctgattgttgttgctggggagcttcctcttcttttttttcggcttcaactgcctctgagttggattctttaaactcgctgtcctcaacttcagcttctttgttttcgtcagcttgttctggggctggagtggaatctaagtcaatgagtggttgggcatctcctgaactcgaagagcctggtaaaccttcggccccacaaactctttctgatacagtattcttaccgttgagtatcaaattttccttccattttgtaacaatatcgttgactgcatcatctcc

SEQ ID NO: 12073 - DNA, 484 bp, Saccharomyces cerevisiae
ttcctgatggatttttaactgtaaagtaatataaatggctaagtttgtaaagtatatttgtaaagtacatagaatgtaaagtttcaagaagcaatttctatcgatcaatttagctttgacggttcgtagagctccttttcttaaagttttagttccgcttctcgcttcttgattacaagatggttccgtgttaacgaagattgagttctatgtattttttatattcacacgctaaaatcacatatttattaaataatgaagtaaattttaaaagcacttttttcaaccagagtgctctgtttgatacatatcaacaaaatccattaaaatatctggtttgaaaggccactccatgaataatttcgttagatatataaactcgtcatttgtcaaatcaatcggacacttttttagcagatctttgtcagtgattctactattaaaatattgttggccaccatgtcccagcgagtccatgacagta

SEQ ID NO: 12074 - DNA, 466 bp, Saccharomyces cerevisiae
gtaatcagagccatagcgtatcagaaaaccacacctaattagatggttcttgcatctgtacctcttatcactaaaagcggcactaaacttccaacattaaatgtttgccttgttaaatatatatttttgccttggtttaaattggtcaagacagtcaattgccacacttttctcatgccgcattcattattcgcgaagttttccacacaaaactgtgaaaatgaacggcgatgccagaaacggcaaaacctcaaatgttagataacgtggatctccgacacatgtgaatttataagtaggcatatgaaaatacagattctttccactgtgttcccttttattcccttctcatgtgaagagttcacaccaaatcttcaaaatataactaatatagtagagtttgattcaaaggacctttttttttgcctctttgattagtttatcttcttttcttcattttatcccc

SEQ ID NO: 12075 - DNA, 488 bp, Saccharomyces cerevisiae
atgtcaggtactcctgaggggattcccctccttcctcaagtctgtttacagttgtatgcgaaagagtccccatgttgcaataatcttcttacgtatcatttgtggtattttttttggtataacaaatattttttcttaggtttctatgcattttaattttagttgtatgtatattatgtactcttttattttttttttttttcttatacctatgggtgactattcattgcagtttaagtaggcgtcttaattgtaacatgtagtcactttgttcgaagcatatgtaacgggtttctaagcaaattctttgcataatatggattttccgtccgcttctccgactattctgacaacttgctcagttccaagtatctgttagacaatatagaacttctccaagaaaaattgcaccgcacgtagaccatttgaaggcttttttgtctagctgctaggacatactattgtctccaccagaacccggagagtag

SEQ ID NO: 12076 - DNA, 481 bp, Saccharomyces cerevisiae
gaacataacaaacacacgtaataattttaagcttcttttcatacattttacagtaaatactatgtacatatatattcgtcattaaaaatagctagaaaaaggcatgctataaagactaaatgagtgctcctttgattttagatgccaacaaaaggtaattcatgccaatgtctctatgacggccactatgtcaccagaatcaaccatatcaccattgccatggcaaatcttgataatcttacccgatttaggagcggatataatcatttccgctttcatggcttcaataattagtagcccttgacctgcttcaataacatctccaacagatgctatggatttccaaaaacgcccagaatactcagaatatacaatttctgcaccttctgggaagtcttcttcctcgtcaggtttgactgtgacactttcttttagttcagagtttgcattttgaatcaatttggcaaattcctctgctctt

SEQ ID NO: 12077 - DNA, 473 bp, Saccharomyces cerevisiae
cctaagaaatgaataacaatactgacagtactaaataattgcctacttggcttcacatacgttgcatacgtcgatatagataataatgataatgacagcaggattatcgtaatacgtaatagttgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaaatctacaatcaacagatcgcttcaattacgccctcacaaaaacttttttccttcttcttcgcccacgtta

SEQ ID NO: 12078 - DNA, 462 bp, Saccharomyces cerevisiae
aaagttattttgagtagctgataaagcgagctggtgcctatcatagccggctcagactttttatgaattcacaggccagccctggctattcttttgcgtacttttagttcgatatattttcgcggctcgcgttttgtttgcttcttattttacactgagttttcgtgccgcaaacgtggagatgggaaaaagaaaagtcgggaaaataatgagaaatttctacttttggtattcctcatacagcctgcgcggtttattagtaaaatacccgataatcctcgaggtttgaaaaacttttccctctactactgttgacacggatttttttatttaagaggaaaagtcgtggttgttttcctcgaacaaattagatatccataaatagttgtgtcgttttattaagctatttcaaaatcagtttttatttttaaagtctgataaaacaaaaacaacaaacacagc

SEQ ID NO: 12079 - DNA, 497 bp, Saccharomyces cerevisiae
ttgttacatgtactggctgtttcgaaaagatttcatataggcattgagaaaaagcatgggaaatccgattttgttcttatatccaaaaataataagtaaaagaacctgggattgataaaaaagtttcatctttttagtatagttcataatagtaattttcatttcattattgggcacctcatggtgcgatacaaatattttaagattgcttatataatcacgaacacctttacgtaccatcccaaactaccacacagttgttagttcacataccattgacacaaagtcatagcaggaattaaaaacacgaaacatctatattctataggagttgcattataaaaatatgaataaaaaacggtgcttagaaaataaacggcgaaccatacaggctgtttctcaaaagagaacaaaagttaaggcgtaacaattaagaataaatcgactggtttagctttatagtatcattattagttgaatcaccatcatcttcttga

SEQ ID NO: 12080 - DNA, 446 bp, Saccharomyces cerevisiae
caccaagtatgtgtattctaagggtatacaaaataaatactgcgatactattcaattcttcaacagcagcttactagatgtaaaattagttacttcaatttatactgtcacttttgcatattttcaatagaataaaattaccgacgtctgcctatttcttccattgatggatatatttctttctctatctcattgcttgttacaacaccaaaagttttgctaagaatgtgtataggaaacaaaagccagaagtcatttcgttccaagcctttaagcgcctaatagtgaactttgcaccgcatacgttagcttatggtatgtgtggtaatgtgtgaattgtttgtgatatgtaaaaaaaaaaaaaaaaaggccacgctcaagcacacaatgaaataaaatttaaatttcggggccattctaccgttggttttgctatctgccggaaa

SEQ ID NO: 12081 - DNA, 491 bp, Saccharomyces cerevisiae
tttttaatgaagatgacattgctcctttattaaacttttcttttactttgtgttactaatattattaatatcttgttatgattctttgttttagcagctccaaaagaaaggaatattataatataattgttgtaattcggaaaaaaaatattaaattactatggtgcatatgcgtatataaaattgagcattacctaacgccatatattactatctaaagtcctcacagatgatgtgttttcaaaatcaaatgattggagctcctcatcatcatccccggtaaactgctcggtttcagatccattatccagatacctcaacgggctagtgtacgcaattgaagggtacctataaaataaagtacgttcctctttcaactgaaaaaacccccgataatcccttgacaagaaataatacataatataatctcgctttctgacaagacttttcagttcttggtactctaattcccgttcgaaaaccggatatgt

SEQ ID NO: 12082 - DNA, 475 bp, Saccharomyces cerevisiae
tcttcaatatttgtgtatggcgtaatgattttttagaataatacttggcatttagcacgccacttttagcgcgaaaacaccaaaaaagtaaagaaaataatgtcgatcaatctttaaagagagacaattgaatggtagtgtaacaatttacaacataatagagtatcgcattcagcaaaagtaaagaataaattctaagaaaatggctcaagccttgaactccaccaatattgcttttttcagagtagcatttttattcacgatcgccttcttttgtttaaagaacgttaattctattttgcaaaatacatatttcatagtcttaacgcaagcgatgaatttaccgcagttaacactgtcacgttatagtggtcaattgggtcttttcgctcttctgtttactcttaacggtgttcatgatctaattcccctgttagaaaacaatgttaaatacttccaatctgttgtgccagtt

SEQ ID NO: 12083 - DNA, 415 bp, Saccharomyces cerevisiae
aaagattctctttttttatgatatttgtacataaactttataaatgaaattcataatagaaacgacacgaaattacaaaatggaatatgttcatagggtagacgaaactatatacgcaatctacatacatttatcaagaaggagaaaaaggaggatgtaaaggaatacaggtaagcaaattgatactaatggctcaacgtgataaggaaaaagaattgcactttaacattaatattgacaaggaggagggcaccacacaaaaagttaggtgtaacagaaaatcatgaaactatgattcctaatttatatattggaggattttctctaaaaaaaaaaaaatacaacaaataaaaaacactcaatgacctgaccatttgatggagtttaagtcaataccttcttgaaccatttccca

SEQ ID NO: 12084 - DNA, 441 bp, Saccharomyces cerevisiae
tattcgatgtattaattaagcggacgtgcattataattttaatcatgtgaaagaaataattgtaacttgagatactactcaacttttatagatacacaatgtttatcttgacacacattcaattacattacttgatttaatgcctttccaaaattatgatcttttcttctataacacttttggatacttagccgccgacggataccatcttcggtcaacgtcggaagtcattataaacgaaaaggtttcccaatagaaaagtcctgcaggagccacgtataacactggcttgaattatcaacaactctcgaaggcgctggaagagaatttttacgcaagttagtattcgcataacattagttggcaaattacacaattttttgatacaatatatatacatatattttccccattgtttttcttagatgcccacgatgatca

SEQ ID NO: 12085 - DNA, 444 bp, Saccharomyces cerevisiae
acagataatcctacgtacgcacacatgcatatatagatagacaactggtcttctgcatccggtaataggcattggctttaatactaataaaagcaagaaaaaagcgacaccagtaaatttcagacatcttcgagaatttttttcgcgcgctttctatcaaaaaaaaatgaaaaataaataaataaacaaaggaaaataaacaacaacatatactgttcttatataacatagaacatctattgtttccgtgttttgctctttcctgcttttgttcgatcaaagatcacaggtctcaaagtcgtttagctagcgatgcaactatctaaaagtatactactggcagcattagctgctacaccatctctggtgaatgccatgctccccatccatatcaagaattataggttcattaagccatcctctgccacaaatagcgaatccgat

SEQ ID NO: 12086 - DNA, 488 bp, Saccharomyces cerevisiae
tatagttattgtccgataccctatgaacgtgcaccttttttgttagtgtattgatatgtgtttcttttcaccttaaaggtgcttagcaaggagaaaaagagaaaaaacaaaagagaactgtacgagttgtaaatatttaaatagtaccttataatcataaaaaaaagtttcaaatgtaacctatatcgattaaaacagcactcctatatacagacccaaaacatggagcagttaaaaagaaaggagctacatttatcaagagcttgacaacctagtctgaaaattctttgtcgtagccgactaaggtaaatctatatctaacgtcacccttttccatcctttcgaaggcttcatggacgccggcttcaccaacaggtaatgtttccacccaaattttgatatctttttcagagactaatttcaagagttggttcaattctttgatggaacctaaagcactgtaagaaatggagacagcctttaagcca

SEQ ID NO: 12087 - DNA, 438 bp, Saccharomyces cerevisiae
tgcgtataaacgtttttcacaaatttttttacagcgctataatctgtatcattcaacatacattctactcaggaaggtgaatttcataactcatatatggctatatagtacttattatttaatgatttatccattgcattcataaaagctatgctggtccaactttttcgtatttagtgatgttttcggtgaagaaaatatgaaaaattagaccaaatgctcaaatacatacgacatttgaattgtttaggcaagtccgaaaacgaggtatatcagctaattcaacctgaaaaccaattgagtgctacttcgaagtaaaatacatagccatttcaaatggaattatcccctacttatcaaacagaacgcttcacaaagttctcagacactttaaaggaattcaaaattgaacaaaataatgagcaaaaccccattgac

SEQ ID NO: 12088 - DNA, 402 bp, Saccharomyces cerevisiae
tcaaaaaatagaaaaataaaaaaaaaagcatttgacaatgtttgtaaataatataatatgaaagtaactactgaacaaaaacattaaggataacatttctacgtaggaaaataatgtatacctaaataacgacaccaataataacaaaaatcacgaaaaaaaaaagcttacatgtccactaatcttcgccgatcggtatttcgtcttttaaaattctatttaacttaaccttgatctccgtctgagagtctcctctcaagatatccgacacaaaccagacatcacaatccagctgcaccatttcaagtgaccctttcaaaacaccacacaatatattggaataccagagcgatttcatagcgtccatgggtaactccacaaagtcagccaatgggttttcat

SEQ ID NO: 12089 - DNA, 485 bp, Saccharomyces cerevisiae
tgtctgtcgcattcacgcttgtcgcagataacacgttatgcgttactaatttcctacaagcttggcacatatacgaccaattgtgcttctgtatacgctacgctatgtaatcacatatcacatgcagggtaaccagcacctttttggtgttttttcaaatctcgaggtcaagggacatctaaagcaggcacaagcatgtggaaaatttgttcttcacctataatataaaacagcttactcacaaaagagacgcctagaggtacgtagcgctttaaggactcttcagccagttgttagcagatcgctcaaatccttcttggtcgttattttttgaagaagaaggaaaagcaaagccagcatgtcaattatgccagttaagaacgccttggcgcaagggaggacgctcctcatggggaggatgcctgctgtaaagttttctacaagaatgcaattaagaaatagaactgcggtgctatggaatagaa

SEQ ID NO: 12090 - DNA, 420 bp, Saccharomyces cerevisiae
tttcaatgattaattttgtaaggtgaacattgactgccagcaggatagatgatagatagacataaacaaaatatacataacacacggtggtgttttctttttacacataatatatttaattctttttctttttttttttttttggtttacaagtccactgagggacattttgagttatcacttatggtctcctgtagcattattaaaagaataaatatcgaaaagtatacatacttaataaaaacttcaggctattaaataaacatcagaacacattgaggacaaagccatagaagtttggagtagatacggaatttttattgtatgtatatattatatatctaagcattttgcttttttttacttcataatctttcagaaatcattatattaaacggatagtcatttgttttcaaggcg

SEQ ID NO: 12091 - DNA, 497 bp, Saccharomyces cerevisiae
tgaaaaaaatgtaatgaaatataaatgtgtttttccctcccttaatattattattcttatgagtgatgcccttatgttttttttgcggtctagtatatgtaaatatagacacacacatatatatatatttatgtgtataatcctagctaataaacatttttagattgttattagtataattttttccacttactttgttctccgggagagaaaaagttgtttattttgtagtaattttgtgcacatattatatatacaaatattacacaatattttcaatacttatggcataatccattgctttttcgataatgtttgtcttttggtcttcttcatgcatcatttcatcttcgtaatcagctttctcctttgattggttattgaagtaaactttcgagttgacaataggccagtttctctctagtgcaaatttttcagtttctttttcgttgttgaaaaagagcaaagcctttatgttggagagagggagaaagtcg

SEQ ID NO: 12092 - DNA, 432 bp, Saccharomyces cerevisiae
aaaatggggtcactcttcattcttgcagttaaaagtgccactcactcatgatttttttttttcctgtttttttgattttttttatatattatacattaagttatctaagtaaatatattctttctactctaaataagtattccttgaatcaaacacaaaagatacgggtatcggcagttataaccgataacaaattgtccttatttctcatttcacgttattttctccaaagaaatttatggtagagcagtgtttctttttagtatattatttatatgcaatgtttctatcattattaaattttctttacggtataaagtagaagatggaggaatagaaagcaaacggatcgatagagaaagaaactcacgatgaagccctatatttgattgaacaaaaaggtaatcgaattcataatatcggctcggcatt

SEQ ID NO: 12093 - DNA, 464 bp, Saccharomyces cerevisiae
attttctctgaatgttacagtgcatggtatataatcagtcttgtttagaaattcatgctaaaacggatacaagagatatcattgtgtagctgcgagatccacggtcacggcaaaaaccatgtccattaatatagtggttggttggtgggaatatgtgggatatcctcaacaaaatcgaacttatatacgtcattctcgttaacaaattcaaattttgtagttgtcatagtaacgcaaaatgagatgcgtgggtgtgattcctgcttgttggtatttttctttgccgctggtgaaaaattggaaatgctggtcccttgaaaaaataaccagcctcgccttaacagatatgtgcgagtaaatatgagtttctaacgtgcaatgtttggtgtttgtttatttgtttatgtgtttcagatgttgagtaaacattagcattggtgtaagaactaagcccctcgatggtt

SEQ ID NO: 12094 - DNA, 442 bp, Saccharomyces cerevisiae
tttgattaatgagaaaatgaaatgaatttcaatttcaattttttctctttttacgttaattactatattccatttttgaggaaaaatttggtctataatattttgtgtacattagtaagtaaataggatacattcttaaacctttcattcaccatctctatttgccaacttttcttcgaatggcttactcttttttttttcacgatgagatgagatcgctagatacggaagattacaaggccttggaaaatactcaaaaaatttcagtaatatgaaatgaatatctaaataaaagcttgggcgttgtgcttgattgagccacgaaaacttcctttaaggattagcacatactccacttaaaagtaggaacatactcacattaaggtgttatcagaataaatgaatgttcaagacagaaggaggttattaggccctgctgctg

SEQ ID NO: 12095 - DNA, 461 bp, Saccharomyces cerevisiae
ttctcaaggtatgacactttggattggtggtcgcagtagccaccatataattttttatcgtttctacatataatacgagacagtcagacagaactttgggtcgcctgagaagaaagactataaaaatgtaacccgtcagtaggactcatcttaaaacagtgggtaatttactaaggaggctggaaaaactgcgataatcggcttatagtacatatatatagaataatcattaatcgagcctttaccgcgaaattcatggatttctcaaaaacaaaggtgcaattacatgttaagcaccgaatttctatgcgaaacaggtccgtctcatcagtcatagctttccaagtatataaaacttgaacgcaaaagtgcgtcatcgacgcctttttttgcgcaaggattgttactattcatttaatgaactctgatgtcttaataagccaatggtatccataagtgaa

SEQ ID NO: 12096 - DNA, 455 bp, Saccharomyces cerevisiae
agaaggtagactatcgcatataaatttcatataaatgtactacattttttaaacaaagttccttttattattgtgctctcttacaaattatacaatccagccctataccttgccaatccagcccatcacccggatattctggaaattttttctcttcaggattttttcaggataaaaatcgaacttgaaagaagaatggtttttagttcaggccttgttttcagtttttagctactaaaagagggataaccattgatgaaattctattgaatgtccccaattttcggaaaaggactgcaccgaaatatttcaatcaaaatcatttatcgttttgtttagctatttttttctcaaattatcactcttttcttcctttttcattctctcaattgttctttttatttgaggaaatttgattgtattgcatatacaactatgcgatgcactttgttcat

SEQ ID NO: 12097 - DNA, 495 bp, Saccharomyces cerevisiae
gacggtagatgaatggccccttttattcttacaattaaaatgcattggtatgtacattagtctatgtggcgcttgaatttactgagccattcattacacgatagaatatataaaaattgtagctgtataaaagcaacccacgtaacaaattgcgaaaaattagcgataagaaaaccctaacatgagatatgtacattcatgcttacagatagatattgatatttctttcattagtttatgtaacacctctaagcagaacatgacatccttgataaaatcattgtcattattctcttacgttcatagatatcttcaggttttacatctaaaggtatcatcatgtcggagttcttcgcaaatataccagaagaagtcacaatcgataaacctcttttggttagacgttcaatggattcttcgtgaagtttttctaacgaattagactctgaatgcgtcactaataagtttaaaatatcgaaagcaagtggaacacaa

SEQ ID NO: 12098 - DNA, 430 bp, Saccharomyces cerevisiae
gcatgtagacattatatgagccattttttcatcgttgttggaagtacccttattcggcatgttttttgttacataaatgacgtatcgcactagcctcctttacgtttttactttatttcagccttttatttcaagattaccaaccatttctctcaaccatgtacatattatatattgaaaaagtaccatacttcatctctgaagagaaaatatcaacaagccaaaagctagtgcagaaactttataatgttactttattaattgtaatgactatacgtataaggaaaattaagaaaaggcaaaattcatatttatttagtatatcattatggcaccaagccgtaataaaatgaaatgggtagttaagaaaagtcagacaaaataacgatttattcttcgacaatgtgaagtttattgaacgcgcttgttg

SEQ ID NO: 12099 - DNA, 400 bp, Saccharomyces cerevisiae
ggacaattccctcccacgtataaacacatacatatatattcttatattatataataatatcctatttattattacatcacctttcacgagcgggtatcatacctttttcccttcgatctaagtagaaaaaggacctgaatgatcattgtggtacttattcccacgcataaccgactacggcaccacaacgacgcaccaatgccatctgacgtagcatcgaggaccgggctgccaaccccgtggaccgtcaggtatagtaagtccaagaaaagagagtattttttcaatccagagacgaagcactcgcaatgggaggagcctgagggcaccaacaaggaccagctacacaagcacttaagagaccatccagtgcgtgtaagatgcctgcacattctcatca

SEQ ID NO: 12100 - DNA, 490 bp, Saccharomyces cerevisiae
agtatatcatccttacgtatttgacgttattacattatatatagtttctcaaataatatttctagtttatttttgtatcataataaaaacgtataccaaatataccattatttttcatagcattatggtagggatagggaatcaagtaactaatttatatccgcagagcattgggaaaaccaacggcgctagtaaatgcatttaaattacgtccgtccaacttctaagcttcaagtggtagactcttaactctgaacctttttagcaattaagctcttgaagatatcaaaagtgttaccgtccggctgtaaattataaacgtttcctgtaaattgagtggaactaccgcttaccaattcttttgcaatcagtaaaccgtagtcttccgtgataccagtaatcatggcttgcgtatttccgtgatctggtaatgttactatttggttactatgtaaccacaactcataataacttggcaatatttccgcag

SEQ ID NO: 12101 - DNA, 485 bp, Saccharomyces cerevisiae
gttgcatggacaacttaaactaggaaggatattccgcttcatttcattaatttcacatttttttatctacatgatatgtattttccctcagttaccagattcgctagcttcgaagcaaggactccttggtcatacttaataaaggaacgtctgcttcattctcctaaagttcctttcgataaggacgcagaaggcaccttactagaccattgtataaactcataactacatactaattcaacgatatgttacatttattttcttgtggttaccccccgcaaatttccaggcatctcatctcatcgcagttaaaaaaaaaaaagttgtaaaaaggtaataaagcgatacttgatgaaagcaaacatctgtaataacagttcacaaggttaagctggttcgtttcactagcgtatcattttttatttttcaaataaacaaacgagggcggagtttattgggtcgtcatgacaaggctcaaagcaaaa

SEQ ID NO: 12102 - DNA, 470 bp, Saccharomyces cerevisiae
tttcagaaacgccatcggtgccagtgcattgcaactaattccaaaattagaaaaataaagctgttgaataattgtaacagaaagatagaaaggcggaagataaaaggaacttcagacaacatatggaactttttgatatatagtatacataatgacactcttggtcgtttacaaatagatagaattttaaggaaaaagtaatactatctgaagtctataaagagcttttgaaagctgcttcagtagtgcaaaaaaagtgtatagtagccttttcaagataacataatgtaactagcggtaccaaggaaactgtaaaagaatagaaaaacatgcgaaaaggtcgtaaaaatggtcattaaaaggcgggaggtagatggagttctggagaggatcataaatataataaaggagtaccgatattcaactcccgtatggtaaagtatcagtcaagcaaatccgttgctttcaat

SEQ ID NO: 12103 - DNA, 403 bp, Saccharomyces cerevisiae
tagcattttatatattctgtttgtattatttagtaattgtatctagtacatatcctgtagcggttggcctgattccttttaagttagatgacaggcacactttgcattatcacatcagacggaattgttctgcctaatggcggctattctatttctgcttcataaatgcaaagacagagtataagaataattttaaattaaaagcaatggtcttatccttgccataaacagaagacaacttgcaagtatgaactatttggaaacacagttaaataaaaagcaaaaacagatacaggaatacgaaagtatgaatggcaacctgataaagatgtttgagcaattgtctaaagaaaagaaaaagtatgtagctattttttccagtcggcaaaaatcggtataacaa

SEQ ID NO: 12104 - DNA, 404 bp, Saccharomyces cerevisiae
aatatatctctaataagattcacgaaatattaattgaaaaaaatattattaatattaaactatatatgcaatgacagtgaaatcagagttcatctctgaaattttttattctatgagccatggggttgccaaagatcaagtgtctgctgtcgataagtttcttatcaaatgagtcttgttcagtatctctctcttggagcccattgtccaagttagattgcctggctttacattgttgcgctaaccaattcaaaaaccctttgttgatcgtgatgtcacttttgaaaattttcttcaagttgtaaagggtgtcaaaaaacgttcttgtatgtagttcatctatacttttgttctggaccatctcttggaactcgtttgcccactcttgcagatttgacgaccaa

SEQ ID NO: 12105 - DNA, 480 bp, Saccharomyces cerevisiae
tagcagcattggaccgagtgctaaaaaaaagggcgatcacttactgctactagtaatataaataatactttataaaagtgtaagaatgccatgtaaaatactaaaaattgaaaaaaaaaaaataatatcattattgtacatgaaaacgacatctaatcgcctcactactaaaaacctctcacaagacaaaacataacattaacaatcacaccggcaaaaatcgccattttttgccgtctgttgaacaatccatcaaacttcattaatagtataccaaagacgccgaagaagaatccgacacatatacctaaaagcaagtctttgttgtgctttatgttagcgatcggcacagagttaaacctgtcttcattgccgcctccggccccattcccctgagcggtcccactcccgctttccatccactgttcctccaactgtctaatgtcatggccctcatcatctctgttgccattttgagca

SEQ ID NO: 12106 - DNA, 465 bp, Saccharomyces cerevisiae
atcgggattgtttcgatacatcatatagttgagacccatctgttctaaaagtatcaatattagtgtaccattttttcttccttttttaaataatttccacgtttctttctattgttcctgatctttcgaatttagttgtatttcacttcacctactgtaataactttttttttttagagcacaataaaatttcacatattttccaaaagcaagggcggtaaatcagaaaagattaagctttaatgaaaatctcatagagaccagatgaagaatattggtggcagcataagcgctaatactgaatagatatacgcattttttttcaaaatatctgttagtacatttatacaaatatattcgtttatacctcttctttaaacaggcgcatgtgtaaataaatatgagactgattctccattatgcaatcttctgatagcttctgcaatcgtagggctgatatccacc

SEQ ID NO: 12107 - DNA, 469 bp, Saccharomyces cerevisiae
ccgggaaaacatgtctttttatagcatctacatccattaaatcaagagaataaaagtaaaactccaaaagtatgtacgtatatagaaccaattattcaatcatttatagaaatgtgacctgttttttctctactattgttacataggcatcacgaaaaaaagtcgcattatacgatactgttatataatttttttcatattcttcagatctcaaatgcaagatggtcctaatttgtttgtttgtttatttattagtttcgctgaagaaggaaaacaagtcatttttggttagctacccaattatacaagcattcaataaatacgccaatcttttgccacatttcttataatatcctttgccctccttggtgtttggttcaaataagtaaatgataaaaatgtggaggttacagattgtactggtgccgccaagtgctcaagatattatcacatttctcgaagcacgctt

SEQ ID NO: 12108 - DNA, 427 bp, Saccharomyces cerevisiae
attatctaaggattggtctcatgttgccgaatcatagaaatataagaaaaaaattaaaaaaaaaaagaaagaaagtataatactaatattggcaataatgctaacacattactaataatagcaataatattaataataataataataataataaattataataatagcagtaataaaaatatcaaataataataatagtaatagtagtagtagtagtagcagttgtagtaatgataataataatataataataatataataatagtataataatagtataagtagttgtaggtaaaaatctttgatttatcttatctggttgcaatgcttctcccctctgatgcctaatatgtctatctttatcctataccaattggcaggggagcaatcataatttacattaatatcgtccaccataccctgaaat

SEQ ID NO: 12109 - DNA, 453 bp, Saccharomyces cerevisiae
tacatgttcaaaaacaaaaagaacggcccccctgtatatattatgtatttgttttgcttccttctttttctctaaaatgtacatagttttagcacaatacaacattgagaggtttgaaaaggtataatcgcaaatttagaactatatacatacatatacacaacgaaaatgaaaaggaagatatactgttacaagaggagagggatagatacatatatatatatatatatgtgcatacactatgggcaaagcaagcccatgctgctatattttattcctttttttattattatatttattttagaaagacagtagagtaatagtaacgagtttgtccgtccatcaaatagaagagttggatttgtccttcttcttatccttcttcttcttcttcttcttcttttccgaagatccatcatcatcgtgaggtctcttttccacaggaggttcagc

SEQ ID NO: 12110 - DNA, 483 bp, Saccharomyces cerevisiae
gaaacagagtcgttagatttttcaagcatatttgttataaatagccattgatacgtttatattatttttacaaaaaaaggtaattaaacatgcatgaacaacaaaattgatagtagaagagacggcaacaaaggtttaaaacgagaaaggaaatttaaaacagtagaaaccaaaagttgatatgcggcttcagccgttctgaaccttcaagatggtgttcgggtgtgatttatttaaacacagtagtatctgtcaccaaagtcacccaaccctggaactagatacttgttttcatctagacctctgtcgagggcaccagtaacaattctgacctctgggaaggcggcatggtatttttcaatcccttccttactacagattaggtttaagaagtaaattctctctggcttaacacctctcttaatcaagacttctgtagccatgatagcactaccaccggtggccagcattgggtctaatagg

SEQ ID NO: 12111 - DNA, 424 bp, Saccharomyces cerevisiae
aaggaacaatgaatcgaaataaagtatatcccatctttttgtgtacttttcttccctttaaagtttttcatatatatatatattatcttttattcccttctaatattcttctttaggatttggaagctgtatattgtatatttagaaatattattaaataaaaaagtcatatgttattttgagcttaagtaccctcttatgcctctttcactcgccattactgacattctgtgatcgccattcatatatataggcctgattgtgcaccaattgccgcgctatcacacctccataagcgatagcattcttcagaatatcttgaaggctcaaaaccaagccattgaccgcacaaatcaactaaagaacccatgtcagacaacgaaagtttctcaaatccattaggcccctcactaggcgctacaag

SEQ ID NO: 12112 - DNA, 420 bp, Saccharomyces cerevisiae
ttacaaagatgacacgataataatgtttaacatatattgctttctcttttaattttctggtgtagattggcggtataattaactatttaacagtgacgtttactatcttactgtttcttgtactcttttataatgaacagacgttattatataactacgaactaatgataattctttttacgttattcctgatgtaaaggatacaaaatgggtttctttattttgcagcagaaccgtaaaatttacgctacttttaccgtgggtcctcttatttgattgtttccgtcgctacgagcgaacaaggggtggagacaatagggatggtgaatatatacacatacgttcatatataagaaaaaaactcaagaagaatatcaaacgaccaggatccttgcttatattattgtctgttgctgggcc

SEQ ID NO: 12113 - DNA, 484 bp, Saccharomyces cerevisiae
tatactggagttgcatcgttgatgtgtattatctatattcaaaatagttatttttatgtttaagaaaggattaagaacaattgaaaaaaaattaccattagcaacgaatattaaattgtaaattatttagagatatttttctataatatgctcgcctaccattctcttttatacaatatttaggttttacctggaggctaaaatgatatgaggggacgatagcttaacatgattgtgacacaaactttaaaaaaggctttcagttgaagagttttcttccgctatagtctccaatgctatcttacttttcttattacgtttatgtctacctttcatatcatttcttgtaagcaactcctgcatttccgcttcctgggcagccttgagtaaatcatatctggtaattttatcaggtttattgctcacatatctgcctgaaccaacaacgttgatatatttccatggacatgctacccactctgca

SEQ ID NO: 12114 - DNA, 489 bp, Saccharomyces cerevisiae
cttcattgaacattttagcattagtgggaagaattcctcatgttacttatgagggagttaattttccttagggattttaggaatttctatacggaggtagcgatcgaccttagaacttttatttagtttgtacatatacctcacctgagttttgcttttttctctgggagcctaaaccatttaaaatgatatataatagataataaatccaggataaaatgtggctaattgatcttttttcattttcaacttggtaatgacgtactggatactttcgacgctcttttttagtccccgatccccgtcttccaggaccttgacgtggaattccgatcacagccactctcgtcacggctccgttaaaatgaatggttttccgttacatttactggtctttttatctttttacagtaaatgggtgatatactgtgacacaatttgtgtctctactgtgtgaacttccattgctgactaaagattccccgctcc

SEQ ID NO: 12115 - DNA, 424 bp, Saccharomyces cerevisiae
atgtaccaagtgtatgcactctatttttatatttgattctctagtgtgatttttttaatcagtatatccccttcactattcacgtagtaaataagttatattcgacctgtatatatgaaagcataaagtaaagttcaaagaatattcagatattgatgtgggcaaacgtgatgacttcaaattacaaaatcttttctttaaaaataaattatgtgcgtatgtacattatttttaaccaataaaagggtttaaatatttatttacaagattaatgactgccctttaagcgttgtctctttatctcattgtactaatgctaaaatcgttcctgtggtcgctttgcttcaccaggatatatccaatcccagcggccttttttatgtataatggctaggattagaattgccggtaggtgcaatacact

SEQ ID NO: 12116 - DNA, 463 bp, Saccharomyces cerevisiae
gcacattttatttaaccagcctgcacaagttagatagagttatacatacttgttgagtgggagggaagaaagagaaaaattgtattattttttaaagagctttttaatattttatttgttctatctattattttcacttccccgaaatagtactgaaggaaaaaacatgctggtttatttagcgtttaataggatgtgtacgtactgagaatatcatcaagaatcagtcctcggccagagcatctagatatgtcgatagcttggtctagcgttttcaaaagagaattacggcttgaaagatttttaccaagagtatattcgacgaaagttcctgataatgcaccaagagcggctgacaatgaacaatggctagaaaccctaagacctataactcacccagaacagaaaaagtccgaccatgatgtcagttacacaagacacattaatgttcctctgggcgaag

SEQ ID NO: 12117 - DNA, 419 bp, Saccharomyces cerevisiae
acaataacttgaaagttgagatcttgggtccatcaaaaaaaagaaagaaaataatataactttaatatataatctcattactgagctgtttgccgacgttatatttgttctttacggcttcggaaaagatattgctattcaagggatcatgtttcctgacgtatttgtaaagttcacgtatcaatgattcatcttcagcggcactaacaaaggagacagcagtgccctcatttgctgcacgacctgttctaccaattctatggatgtagtcatccatttttttggaaatctggaaattgactaccaaggaaacattagggatatccaatcctcttgcggcaacgtttgttgcgatcatgatttggactttgttggtgcgaaataattgcaaagaatgttccctttgctcttgcgattta

SEQ ID NO: 12118 - DNA, 460 bp, Saccharomyces cerevisiae
aaaagcacataaaaacttgattgtgtagcgataataaaaaaattttttcgatattataggagtataatgtctctaaactcaaaattaaagaacttagaataagaaagcgacaccggcagcgacggcagcaccgaagacaccagcacccaaagcgttggaagcagcagcaccagtggagatcttggtgctggtggtgttggaaccgttggtacggttggaaccattggtagaaacgttagcagcttggacagcggcaacagtagcgaaggcagcgacgatggtcttgaattgcattgttttgttgatgattagtgttgattgaaacttatgtttaatgatgattttcctctaaaatcaaaaacaatattaactaataaagtaaataatacagtaggagaagatggaaaagaaaatcaagaatttctcgagttccttatatatgaggagaaaagccaggaaa

SEQ ID NO: 12119 - DNA, 470 bp, Saccharomyces cerevisiae
tccagatgatcgagagatgacttctctaccaacaacttcccatttgcataatatcattaaatatgttttaccaaaaaaaagttcatctttcttatttttaaaatcgatagttcttcaggatcttggtcacatatatatatatatatatatatacacttatataaaataagacgtttatttaatcttgttttcttacgagtttctttttttttctttttttattttctacttttgcaaggaacagtgaccttgccaataaataatgaagactacttgggttactagaatataaaatacatgtaaaaaattcatttatggtgtgagtgtgcgagcgtgcctgtatacatctagcagcttgcttatttctattttatgtgcatggaaaatatattatcacacatcttaccatctcatcatggacatgtcacttctgattctcatgtaatctaataacccttcaatttggcctg

SEQ ID NO: 12120 - DNA, 430 bp, Saccharomyces cerevisiae
tgaaactttatagagtcatattttcaccaaagaaaattaatgttgacatttgtaaaatagtgaatagttttttatgttcaaatgcatacatcccttgcgggtagtttcttttggtttaacctgacttccacctttggctattctttttataccgccaaaagactataaaaatgatacatatcgttgaaaggatatatggtttacgcttactatttcgtttgatgtaagcaatatttctgaaattttaaacgaaaatattatcttttttattatcttgtgttatttattttctctcccgttcttagtttcaggattgtcactgttcttgtataactgttcaaaaagtttcatcgatgaagttcgcaaattgtcaatttttgttccaacatcgtcatcattaacctcatctccagcttgactccgagaaacc

SEQ ID NO: 12121 - DNA, 478 bp, Saccharomyces cerevisiae
atccttcagtaacttgaatcatacagcagaatttgtacaatagacaacgcatataactgcgaccatatgtatacgtataactaattattatctcaaagtttattcccttagcctcaccggtaacctgtgaggcgcgattacgttttccctctgttcaccaccacgtaacgcgatatttgacacatacgtgacaactacttttgatggaatctgctgatttttttacctcacgaaacttattaaaacagataatttccctcatctgcaaggttggggaagggttggacagcaataaccagcgactgtttgaagaaaagatgactgttagtaaaatacccatatggctagattgtgatcctggtcatgatgatgccatagccattttattaggctgtttccatccagctttcaatcttctaggaatcagcacgtgttttggtaacgcaccgccagagaatactgactacaacgcccgttc

SEQ ID NO: 12122 - DNA, 494 bp, Saccharomyces cerevisiae
ggttaataagaaatgttgcagctcattttctagtacgcagagtaaggctaaagcacttatttgaatttaacgttattcattgcatagttcagaaagggtgtgatccaaaagaaaatgcatatacgagtggtccgacgtttacatatgtactagtgactgtatattaatatatgcacatttatgtagctacggatttcactttataaaagatcttcttttttgatattctaatattcgtaacaatgatttcaacgggtagacaggtgccaaactgctggcaaagattaagttggaagcatctcctttcgtcatcttagtatttacataagtagtaacatcatccaaagataatctaataaaatcttttgaggactcaccatatactttctttagctttctgaaaacaaagtctctttgttttgacgtaggaactgtttgtctccatttcgagtatttactagatattgcctggtattgcattgtttgtccttcca

SEQ ID NO: 12123 - DNA, 489 bp, Saccharomyces cerevisiae
taatgatgaagattattctgttgcccattctgtacgcacttacaacatttgaaaagtggcaagaaaaaatacacacattttactatcttccgctatcttatttatcaagacgaaacaattagaacctgatttaatttaacttccatttttctgaatctggtgtgatataccgctccaatatattcgaatttatcccaattttatcataataattcattttaattcgatgtcataaagtactaattcgatattaatctagcctaattacattaaatacttaataaaagcttctgtgacataaaagtacaaatctgtcattttattttagaggaatagtttaggacaaagtcattatgtacgaacagtttgaattttctttttttttcttcgaaaattcagacaataaggttaaatataaagctcatctcatctcatcgataaaacgctggagtattatcacatgcatgcgttgcttttggaccgtacaga

SEQ ID NO: 12124 - DNA, 448 bp, Saccharomyces cerevisiae
acatagtacacacatataaataagtaaattacgtaatataatattctgttggttttctgacctaatttgtcgctttggaagaaaaagtggattgtatttttttgcatattccctaatattgaagatcactgaatatactcacagtgaacaattacttgaaatgctacggtttactcatcgaggccttccctccagcactcgttttagaaacattttcgtaaggttaaatcacatttatgtaccatggttctatgccatagacgtacccaactccaaaccctatttacccacatatcaaactttacactcacccaaaaagtttaagccgttctccgttgatgattctaatcgtttggaaaaggccagtaagcgtcaagaacgcaggcctgttttagtcaacgaagattacctgtttaaagtcgacctctctcacatggaattgtcccct

SEQ ID NO: 12125 - DNA, 488 bp, Saccharomyces cerevisiae
acctttaaactcgcgacttctttatatctgtatattcttctacatccttctttttatgtattattattttatctgcttcctcacaccacatagtggcataccgtgtgtggccgttttttttttcatcgccatattgaaacagtgatttgttattattcaattgaaataatagttattaggtttaaaaaaaactaaaagataaaataaatagcccaggccacgaaaatggcaaaccgatccctcaagaaagtgatagaaacatcatcaaacaatggtcacgatttattaacttggataaccaccaatttggaaaagcttatatgtttgaaagaagttaatgataatgaaatacaggaggttaaggaaatacacactcaactggatgagtttgtgaggtatatctccgtactagaaaatacggatgatttagaactgcattcagtgtttatcagtttgtctcagctctatacgatttccatatggcgttt

SEQ ID NO: 12126 - DNA, 498 bp, Saccharomyces cerevisiae
tgaaatgttttgcttagtgtaaatctatcagatttattgaagccactcacacaactcataagcttgcgatatgcatttgcatatatttttaatgtcatataaatagttccctatagttatatacaaacacacagacacgttaggagaacagtaattataataataactataataacaaaaaagtaaacacggtaaattgaaataaattattcgatcaaaaaatattttcatatcatttttctttttgctcgttttttgagaaatctttcatttcaaaagattccttcacttcatgatcttcaacgacaaattgccttagtttatcctttattgcagttcttgtttcaccaactgcactttgaacaacattaacaacagggccccagaggccgaacttatgaataacaaaaaaggttgcacctaagatcaaggtaagggttacaaataaggggtttcttatgacagccacgaattcgttccaccctaatacggctagca

SEQ ID NO: 12127 - DNA, 441 bp, Saccharomyces cerevisiae
tagtatatacgtgtgcgtgcgcacgtcccacacagacaaaacaaactatcatcttaacgaataatgttgcatcattactagtttaaactgtatttttattaaagggaaaaaaatgattcaatatgtatatatttattcatgtatatgtattttgaattaaaaaaaaacgttttataaatactcaataaagccgttgtattttctttattactatcgaaattcttgctttaaacatttcgcgcatcgccggctagaggcacagagagggaaggggaaaataacatgaaaaaatcgtaagtttctaggcaatggtataaacaaataaacaataaacatgcaattacagctctagaacacatattatcttcatggatgaatgataaactccaagaagagcataacgaaaaagacaccacttcacaaattaatggtttcacgccg

SEQ ID NO: 12128 - DNA, 492 bp, Saccharomyces cerevisiae
tatggttgattcaattgttgttctattactacttttctatgatatatatacaagcatatattcgaaaatttctgtaaataaacatgattatattttttgacgaatattactgattaggtctgattttgaaccgatgacgtcctgcgtcaactcttggggcattattgtagaggaacatttctgtaatgaatgcttgagatccattgctgatgaaactgacgaaagtggacttgcagtagcatcttgattgtttgagtgcgatacagcttccgtgtggtcagtggtataaaagcttaatacccgaagcaacttgtcagcgtccttcgtcctaatattcaagataccagtgacgctgcacattattgcgccgagcgggacacgtatttgtatgtcttgctctgtggattgtatacattttatatcgtcacacaaacgaattttgaactgatgaaggttataatcagaatcataagccacaatgaagtttcccat

SEQ ID NO: 12129 - DNA, 400 bp, Saccharomyces cerevisiae
tcaaaacaataaaaatgtcatctgttacatttttggtaatattcttttataatggttctttaatttttttacataatttacatattatttcaaagtttttcaaaaatatccgtactatatgtttttccagacaaaacataaaacatacaatgatctttttgaagagagaattagtacactcattacaaggtgtatgacgtgccgaagaaaaaaattgcttccaatcggatttgaaccgatgatctccacattactagtgtggcgccttaccaacttggccatagaagctcgtacttgttggttcagtactcttcatcaagctatactatttatctaggatgacggtcacagtgattcgtactcgactgcttctataatctgtaggtggcttgcgcatatc

SEQ ID NO: 12130 - DNA, 418 bp, Saccharomyces cerevisiae
tggtatagtcccgtacacactctatttgaataaactgtaggttctgctgagcaacatattgatataaacagtaaaaagaagtgggttccttgttttcctgcaattataactaaccgtgcttactaccaaaaaaaaagtgcgtataaatattcactatttacaatgttgaaggttccagatggatacagaataggaatcctaaatataaacactatatttatttatttttttcgaataaaagtcatgttagcaatatttatatagttgattttcctgcatttattatataattggcggcatagtaacatcaaaaaaaaaaaaaaaaacattcaaattgcactacttatagcagtagcatctataaaagttttatgatataaacctttacagttatctcaaatggttttgggattgtcca

SEQ ID NO: 12131 - DNA, 493 bp, Saccharomyces cerevisiae
aaccgtatatagatcaataataatgcactatgaacattttttcaacctgattacttcatcgttccttttcttcgacttattttttttttattattcttcgctctttggcagcatacgcaatttgaatttgcagtttttgactcttttttccttagcggaacgaacaatattaatcatgccaactaagtcattgcagaagtcaacttatcatttataaagaagatcctaccctacaatgtgtgtaccctgatgtgcccagaaatgaattgactcctctcataacttgttaatattcggatgtgcatatcacgttcggatctatgtatataaatgtacgctcgttttaacctttagtgtagtacctaaaatctttcttaccagcaactaatagcccttgaagtagttttgctagcttggacatcaaagcacatatcaccatcaaatatggccaattacacaaaaaccgcaatcctatccgtctatgacaagacag

SEQ ID NO: 12132 - DNA, 418 bp, Saccharomyces cerevisiae
taaggtcaaagaaaaacatacaaaatggtaacttaaacaatatatatgaatatatatatatatctaatgaaaaatgcattaattttatctccaaccttttttggtaggacaaatactttctataataatgaggtaacatgctgacaatctcccagtacaactaggtctacaaatttcaaagagtctagcacattcttaggcggcatactggtgtttaaatataacacaatacccctgtttgcatggactttggccgcaaactgcctgcaaatatttttcactccgggaatcttcaaactcgttccaacaataatcaaacaatcaattcttttctttaagtcattattggcaatttcaccgataaaatcaccttcagggtggacctcattgtataaaattactcttggacgcaacttgc

SEQ ID NO: 12133 - DNA, 475 bp, Saccharomyces cerevisiae
taggcgatctttttccggccaaatacacatattcataaatacgtacatatacctacttgcatataccaacatgattacctagaatggatatatcaaatgggacgacgaagtaccacgacaatacacaataacaacttctgtttttcgctgattgccttctcttcagcagaaagttgatgcatatttcgcgtagcgcgttgacgcgtcttctttctgaagttttgtgcttttgttatcatactatataaagtaaaaagaaaggagaacatattaagcattactgaattaggatcctttggaagaaataaagtaagagacactgaaagatgatatcaccatcaaaaaagagaaccattttatcaagcaagaatataaaccaaaaaccacgagcagtggtaaaaggcaatgaacttcgttcaccatcaaagagaaggtcacaaatagacacagactatgcactaaggcgaagtccaat

SEQ ID NO: 12134 - DNA, 416 bp, Saccharomyces cerevisiae
aataaaactaatcccatgaatgagtaagtatactggccaatcgtaaacacatcgacggccgacttttttatttaaagcacagatgatataatgattatttaacgaatgatacttctatattaaatcctatgaggagtaatataaatataaaaaggccaattttaaaatgaacgtttgtccgattaacgcttatgacatactgtagggatgacaaaattatagtgaggactttaattctatataaatacattacaatagtataaaaaaacaaaaaaatgtgaagaaacaccaaatattaaacggcagtaatgaagtttaacctcgaggctattattcttgttttcttacaccactaacaatatcatcaacccttaatagtaaacatgcactttcaatagcggttttgacactttgct

SEQ ID NO: 12135 - DNA, 455 bp, Saccharomyces cerevisiae
aaaccgttgcacaaagtttagacattcacatctccaagccagttggagtttctggcggaaatcgttgctctcgcttgggcaaagtttttttttattattaattttttattgttacgttggcggtcttcatttttacttcacaatagtttatcttacccactaagaataggttaccatttattcacatttttttttctcattcctagtatactatttacctgggatatggcctataatcaaaggctttaatattctaataattcgtttggcatctagaataatctataaagtatagtctatatacgtacatattgataatggcggtagctgctgaactagtatttcaaattaccttgtttatcccaggtcgccagtttctctctcctcaagtgatattgtgttcgtatgtccagataatttttgatgaactgatccaggtcatcggctgagtcaat

SEQ ID NO: 12136 - DNA, 463 bp, Saccharomyces cerevisiae
acaatttgatttttatcttctaatgctatttatatattcaaataattttaatactgacaacgctaataataatagttacttaattaaggtttgaatcttcgagaaaaaaaaaaggtaggaaaattaaggaactactcacaaattcagagagagagaagggataaaaaaatatctgccaatggaggtaacttcaatgtttctcaatagaatgatgaagaccaggactggtctttatcgcttatattcaacccttaaagttccacatgtagaaatcaatggcataaaatacaagaccgacccacagactaccaatgttacagattcaataataaagcttaccgacagatcattacatttgaaagaatcacatccagtaggcattcttcgcgatctaattgaaaagaaattaaactcagtcgacaacacatttaagatctttaataatttcaagcccgtggtaacc

SEQ ID NO: 12137 - DNA, 473 bp, Saccharomyces cerevisiae
tgcatgatggatcaacccattttacaagaagatgttcggaaaaaagtaggtcagttaattaaataatatagacttccttcaaggaataaaaataatatttgatcttcaatttttaacgctttatgaaatatatatttatgatttaatagtttatagataatactttatcaaactacaattttgaattatgttttttgtttcatagttctggaagaggttaggaataggccgaattctccacttaacgatggcaaaaggtcatcaataaatacgacaaaaaagacgtaaatacgtagaacacaactttgatctaccgtcaatcaaaaagctttgaatgacctacctgaaagtgggtcaatatgttcgggatagtttatctgaagaatcgcagtttactctgcaagaaccccttttcttcttaccctcgttatggcttcatgccctcgttcgacacccagttcagcaaccaattt

SEQ ID NO: 12138 - DNA, 477 bp, Saccharomyces cerevisiae
tttgtaaattaagtttgaacaacaagaaggtgccctttttctacttatgtgaacatgttttctatgatctttttttttcttacttttacaactgtgatattgtataaactttgttagaaattcacgggatttattcgtgacgataaatatttatatagacaaagaatatgacgatttatgaaatctacatgattttagtttcttttaacaattgctcgtttttttctcttgcttaattttaaatttttttggtagtaaaagatgcttatataaggatttcgtatttattgttcaagtatttaaagactagatgtctttattcttcataaaattgcacgccaattttaaccctctctacacttcctctagatagcttgcgtactttcttttgtagcgtgataattctggaacgaacggaagcacttgttttaagatcgtccttactaattctcacaaccacttcatacccgcgatttt

SEQ ID NO: 12139 - DNA, 499 bp, Saccharomyces cerevisiae
gctaatttgcgataggcattatttattagttgtttttaatcttaactgtgtatgaagttttatgtaataaagatagaaagagaaacaaaaaaaaatttttcgtagtatcaattcagctttcgaagacagaatgaaatttaagcagaccatagtatccttgatacattgactcataatcagttaaatagccattcaatccctttgagctatcaacttcatattcctccacaaggtccttccacccgcgaattttacgcagccgacttaattcatctcctgtaaattggaccaagggtttggtgccatactttaatggacctacattgacccaatgcagctctttacagtatttctttagtgcttcaatactggatagatattcaaacatattttccgcggtatctatgaaatatgcgctacaaatgataattttatcatagtctttggaaatgggagaatatcgtgtgaagtccccccatagtgggtccagattactgcg

SEQ ID NO: 12140 - DNA, 412 bp, Saccharomyces cerevisiae
cctctgactctaaaggtgatttggagcactctcatgacactaaatcaacaaatcatactcatactcattctgattctgccgatactcacacccataaacattagggaattctcaatgatgaattttttcaaaagttaagagcaaaagtacagcctttcacatttcaacaatttactgagcttaatatatatatgtatatatatatatgttgaacaaggaagaatgccttgtgttgttcctttgtataaagtaatgtattctatataatcaatcacaaatatatatgcatgttcatttctgaccgacaatccaatcgttcaagccgtgtttatttctagcaatttcaaaagcgtaaaattgtagtctcacgacaaaacaagtagtaaattgaccatactcggctgaagcgtct

SEQ ID NO: 12141 - DNA, 417 bp, Saccharomyces cerevisiae
atgcctttttaaagaaactggaaaattcttaacattatacatatgctaggaagcagcatgttacactaaatacattttataaacagcacaagaagtattgttaattaattatccttgccatgtttttttagagtcacaaatgcttttccgtacttcgccgacaaaaaacagagtaaacatcatatgttttataatctaaaggaatcaactaacagttcatcagatgggaatttgggagagtgcacaagtaagatggggtaaaagaagataaatctccaccggatctaaacctttgccaataatcctcacatggtggagctacaatctcgccttctccgaccagtcacgattaattaaattgcctaaaattaacttttatattcccatacagtcgatattgctagctcaaaaggcgtt

SEQ ID NO: 12142 - DNA, 401 bp, Saccharomyces cerevisiae
gagaccaaataaagatcctgaatcataatatatacgtgtgtacttcactttctatagaggaaaaaaagctaaaaaaaaaaaaaaatgataaaataaacgaaaaaaaccataaaacgatcatgatagaataatgtacattattaagaatgcttcattgatgacatgcagtgcgaaaagaaaggaacaaatgaaagaagacctcttcatttcttctttggagctcccaaaggcgaaccgatgttgttacctctcaatttaacgcctaaggctctttccaacttagacaaaacttgttggtttggaatagctctagcggcttcataatcgtttaccacggttggcttttcgttaattttggttgccaaatccttctgcgacattttcttgtctgttctggcacg

SEQ ID NO: 12143 - DNA, 421 bp, Saccharomyces cerevisiae
tgtgttggttgcaatgttttccgtccccctttttttttccttattcatctagcatgcgcggcaatttgatagtttaaaaataaaagagacgcgtaattgagcttggctttcctacgcgtttgacattgcatacatattctttccccccacccccttatagatatcgaaaaatttgtaagctctgacgtgcaattctactttagccaattaggtttgataaaaaatacggcgccagctgacttttttctctttctggataagtactcagaatatatagataagtagaatgggttcccgaaccgtcaatgcagccaattcatctcaatactgcgccgaacagcttctgaagcgatcttgactttgtgggcagcttgaaattttcttggatgattctgtcctatttgagctttacctcctccca

SEQ ID NO: 12144 - DNA, 421 bp, Saccharomyces cerevisiae
tagtcgccgatattgtttcggctcgtgcattaagcttgtatagtttcatatagaaagtgatgtatatagcatttacgcactctaactggcattttaaagaaaaagggataaatgcaatgtttggcgtgcggcagtataagttcaaaaaaatccactgcattgttgaaaagagtcaggtcgatcctgctattggttttcagtttgagggatcctttgatttgctagatatcataagataaatggtccaccataaagtaattaaatcttgaaattaaattcttattccattagagacagagaaactattcattgtacattctccaaatgtggtgatataaacactacattcgctaaattacattatattatttcgagctttgtcttgtttatatttagttacgttgggatcaagttttaaaaa

SEQ ID NO: 12145 - DNA, 438 bp, Saccharomyces cerevisiae
taagggagaagtagaacctcccacataaaaaacgaaatggggaataaaatacaatgaatttaaatacacattttattaccactattatgttttactttcttcaatgtttgggcaaggattccatatccttttgatgatgtcatatatcatttaaattttgcatatatatatatacgtacgtaaataataaaaggtatatatatgttgtgttatctatctagctagctgtgtctttattttgcggggttttggaaatgccactttttctgttttatatatcacagcgtcaaaatttccgccgttactgtttgcaactgatgagaactatggaatacacatgagtacattggtatagacgtgggagaagaaaagtctggaaatgcattatttgcctgttgcgatagtaacaggtgccactaggggtataggcaaggcaat

SEQ ID NO: 12146 - DNA, 491 bp, Saccharomyces cerevisiae
ccgcaggtgaaattagatggaggagaaaagaaaaaaaaaaatgaaaaaaaaagtgtaactttgctaaaattttcacctgcgggtaccgtcggtcaagacgtgggttgcgaacaaaaaccctggaacaacaatacattgaatagttcctgctcctgcacactgcacgttgagacctgaatcgcatcgtgtggtgcttatacgctaatctttgttagcggacatactttttctttttcttttcgccttttcttagtatctttcttggattcttaactattttgctttttttagtcattcattatatatggttctttagatcggtcgttccattaacatttttttttttttttttttacacgtcaatagtataacttactccccaccatttttccactctttcataaagacaagtgtatttcacgtactcataatcttcgggctaactaccaacaatacacgtaaataataatgggccgtccaaggaagaatgt

SEQ ID NO: 12147 - DNA, 401 bp, Saccharomyces cerevisiae
agtggtcaacgtctaaaaatatgatatactacgatatataatgtaatgtaattcaataatggtgatgaaggcaagatttcatttagagctgttacccgagaaaccggtgaaaaattttaaaatgaaaaaaaaaaaaaaaaatgcgatgagcttcaaaaagagtatctttaaaagacatatatcacaagatttttatatttgtaacctcgataaacacacactaacacaatatacagatgtccaccctgattcctccaccttctaagaaacaaaagaaagaggctcaacttcccagagaagtagctattattccgaaagatttacccaatgtttcaatcaagttccaagctttagatactggtgacaatgtaggtggcgccctgagagttcccggtgctatc

SEQ ID NO: 12148 - DNA, 475 bp, Saccharomyces cerevisiae
taaagagaaccttaatcctggaacaaggtttgtcgcctgcattttaaattgcgcggatatgcaaaacagaagattacctcatcacgttgtcaaaacctggaaaaatttaaaaaacaaaaacaaaaaagaaacgtgcgatacaatactgctccactgttgcattaccgttttatgtatctctgatattataaatgtagccctagatttatatgaatatatatatatatatatataccatttatatatgcaaacacaaaataacctaaaatttaaaaatgactattgatggagacgtacatgaaatttccccatttttccaggttaggcaaactaaatggggcggtagggcttgtttcagtaatggtaatattcctaaagggacaacagtcttgcaagtcagtaattttacaggaacatctatttcctatgagttcaggaaggaagtttgtcacaattgtttcgcatacgctaatgc

SEQ ID NO: 12149 - DNA, 400 bp, Saccharomyces cerevisiae
gtttaagcctactggactgaaaaaaaggcaattcgcgtacaattttcgttgatcgttctttatataacctttgcattaaataaatttaacaaaaaaagttctttctaaaataatattatggtgatacatgaatgtgctttagttttttcgtaggctcatccatgtatatatataaatgataaaaaactaagttacgatattgatagcatacgtattcgtgttggtaactaaatggaaagatggaatatgttattggcgttgttatcccccatatatacaggtttctaatatgattaaaaaaaaattttctcccctagtttattgtgttcatagcttttccagacttaacggccaatgttcaaaagcaaggaatttggtgatcccgaagactcgctgttac

SEQ ID NO: 12150 - DNA, 498 bp, Saccharomyces cerevisiae
tgatatttgtgcttcagggctggagccgatttttccctttttcggggtttatattgacttaaggtactttaaatgttttaaataaggttattataaggtcatattagcatacctttcggttcgacaagtgctctccgctgttgacagtttttttttcatgttcacttgttggctttgtaagacatttttggcagtcccctatatttcgcgatgaagctccaaatcaaaggttaagggtagaggttatttctttttcagactgattaagggatacttctgcaggatatacatgatggaaaatgatgcactcaaagatggtatttaacacatgaaaatcttcatagaaagcaccatgttttctacaatgtctaaacaaaagtgatcacatgagttcaaatcagtagttttagagtgtgattgacaataaaactttaggaacaagtacaatactataatgtcactaatatctgcgttgcaaaccaccgatgtggaatctgt

SEQ ID NO: 12151 - DNA, 475 bp, Saccharomyces cerevisiae
acgtaggacggaaaccacggttgccaaaaggaaaactataacaaggtcagctcattctctaccttaatggctttgcgatgtttgcaaatttaaggagttttagataatgcatttattattactattttttcttttatttttccatatttacaggcgacatactatgatagaatagaatctaaagttttttacccaaaatggaggtagctatctttacaccagtgccaacatgtctttctgggtctgattgaaagtcttctagagttacaggttttgtatattgtaataaattatctaactctgctttcattttttttcttagctcttcatctcttgtaataatgagagcattcgattccaaatctaatgaatacgcccttctcgtatagtttgaagatcctataaccgtgataaagggtttccaattgttagcatcatttttatcacgagcggaaagccaaataccttttgcgtg

SEQ ID NO: 12152 - DNA, 426 bp, Saccharomyces cerevisiae
tcagctcccactatgtatgaattataaactatgtaaaagaagaagaaatatatatatattcgtgtaaataattcgatttttccctttttttaattgtcgtcgttagagttggccaaaatccttaaaatagacaaaaacaaattgacgatgtccaggtaaagcatcatggcgcatctaacttcttcatcaggatacactttcctaaaaatcagttgcgtatcgatgaaaagatacgcggtaaataaaatggcaccaagccagccgtaaagcagattaaacttggaagagtgggtattccagccgaaaagcaaggccgtgagacccattccgatcataatccatagaccccagtttaaccaatagtatattgacgttgcggaattcagcacgttctcgaatctctctgatagtgcggtcaaggaaacg

SEQ ID NO: 12153 - DNA, 443 bp, Saccharomyces cerevisiae
cagctcctgtagcatataaacatatcttgagtatacataatgttggatgagagcatgtaatattgatcgctttgtacgatgattataccttttttgtctttttaccattgtctctgatggaatactattgacaattaacaatggtagatatatccgatacaagtggatacctacataaacaaggtgtcttacctagtgtttctttcatttgcacttctttttttgcgtgtggactgacatcttggaaagttgaactgtcatattatatagttgttgcagccgccatgggaaacagtccttctactcaggatccatcgcattcaaccaaaaaggagcatggacatcattttcatgatgcattcaataaagatcgtcagggaagcataacctctcaactgtttaacaataggaagagtactcataagagacgcgccagtcatact

SEQ ID NO: 12154 - DNA, 481 bp, Saccharomyces cerevisiae
tagactaaaatatgaactgcagcgtatatatatatatatatatatatatattagtttctgtattgtgaaacaaagaaggccgctggaaacaacaaatgttgaacttcgcattcagataataatctattaaaacccgaagttactcgaaaatgttagctttggattctcacactatatgtagtttctttgacagtagtaaaacggtattacacctgtgcattagagttatcaatcgcttgataacaatttgacattttggagggtccatgaagataggtactgattttactcgaagtgtgaatgttttataccgaagttttgttatatagagatacagatatcaacaggattgaccaccttcttttttaaacctagtataatggggacggtgagaattaacagttaaggtataggcgtgatgccatgggaggggcaaatacggaactggagtaaagtattgtgtggtttaggtgctgggaaa

SEQ ID NO: 12155 - DNA, 434 bp, Saccharomyces cerevisiae
atgatgaacaatgggactacaaaatgaaataaagaaaaaatagaaataggctagaagatcaattattaatcgccctattcttccttattacctacacaaaataaagcagcaacataagaaacaaaaacaaaatgaaaacaaaccaaataaatctatgtaagcatactcatttcaatttgatattcattacttgacttttttgtccttatttgaggctccataagcgcgccatttttccctactcccttttttcgtaaatagtaataatgtgctgaaaagaacaatgaagtagttatcatacatattccgtcgtgtcgatatgaggggaggtgtctctttctttcatcccttgtcgcaacctccaatatataagagcataagcaactgatcttactttagtaattaacttagcatacctagcccgaaggaagaaa

SEQ ID NO: 12156 - DNA, 466 bp, Saccharomyces cerevisiae
aactgaaatcatgaataaagacattgatgttatgtatttttcatattcctgccatatttttaattacaaaactcacatatagatatttatatttgatacatcaataattataacttaaggaaataaagatagtttttgtcttcactttttaaagtattttaaacatcatccaagccaaaaagactcgatctttgtttatatagggcagctttctcgtgcccgcgcgctgttcaaagggaataataaaatgacttttttatgcttgcaagcccattgacgtaaatccaccgcaagtgagattaatcaaagaagaaaattcttgatatctgcaatagacgtgattcgggcgtgattaatattcctcatagcggggtctttttattttaggcctatagtatctctttttttcgatttctccttttttcctctttagatgagttactttcctcgaacatatgctcacttg

SEQ ID NO: 12157 - DNA, 474 bp, Saccharomyces cerevisiae
ggagatagtaggcgacacttcgaaaatctaaagtcttgtaacattactattatatactattttattaaaaaaatacacacacaattctttaacagaacaatatataacaaatgaagcgacatgtttctcaaaaaaaaacatagtaggtaggtaaaaatgggaaagaacgggacaaacaaaacgaagagcagggtgtatttgcccacacacggcaaacaacatccattcacgcccgcatgcccaaaacttttttgcgataaaacgcccacgcaaatcacatcgttccaacagaggaatcgaacagcacagatacaaagtaggaatatagcacacacacaggaaaaattaattaattattagaaattaaaagggttggggagaaaagaggtctaatttattcattaatattcagtaattgaaaaaaaaaaaaaaaagaggataactaagagaaaacaacatcaagctcgtttggct

SEQ ID NO: 12158 - DNA, 416 bp, Saccharomyces cerevisiae
tcggggttatgaatgagaaaaaaaatcggttgggcttaactttaaagaaaaaagttgagattagatttattgtgttataaatatagatatacaattctttataaaaaaaatatatatatatatcattgttattaaataaagagttttcctagtatatagattaaaaaactactctattaaatgagagctaaaaaaagcaggctgccaaaaaaataaagcatttatgaagggggttcagcaagatgcaatcgatgggggaagattattttttaacatcgtaagatcttctaaatttgtcatcgatgttggtcaagtagtaaacaccactttgcaaatgctcaatggaaccttgaggtttgaagttcttcttcaaatgggcattttctctcaattcgatggcagcttcgtaatccttt

SEQ ID NO: 12159 - DNA, 455 bp, Saccharomyces cerevisiae
ttaaactgtgtatatcagctactgctccccttgaatgatacatgactaaatataatgataaatttatttcttgatttttgattatttcatattttgttgacatttgagagcttcaattgtataaagttgcaagataatatatgaggttagggaagccggataaagaaaatagagtactttaaaactgttcatggactaagaattcagtgacgatgaagtagtaaaggagagtgtttaggatataaataagaccgagaaattgttagtaagcattacttctagcagaaataatgaaccacaatcgtgacaatatatactcgagttagcagttaacagtaaccctttccataccattctaaactttgcaacagtaaatatcttggcgtttaacgttttattttattctacgtttctcaaatatcggctgtactcatgtggcacatcatgaaaagagc

SEQ ID NO: 12160 - DNA, 441 bp, Saccharomyces cerevisiae
atttattaaagtgtatatagttgccatacttatagaaaatggtacaaaaaatatctttctatttacttagcataagaaacaaagagcaaaaaattatttttgagaatttgtaaataatgttattttgctctatttttgttacacaacgacattagttaaataaagtacaaaaggaggaagaatgggaaagatggattccctctatttagagtactgtttagcttgaagcaaaactttcttgtcatattccgccttatttcttgaaaatgatctccatgcaggctcttgagcaggggaatttggatttggagagtctaaaagatcctgaaccccaagaacaatttgttttaacgtgatggcgggtctccaatcttgatcttcatttaaaatacttaaacatattgtgccacttggatacacgtttggatgataaaatccggc

SEQ ID NO: 12161 - DNA, 485 bp, Saccharomyces cerevisiae
aattaagctgtattatattcatccctgtatatagcatgcccagctgccaagcatttttttacttaattgtctctattatatatttgaaaacctagcaagagcattacgggataaaacgctgcggcgttcgcattattaatttgtattcaaacgactaattaaaactatcttacagttcgtaaaacttcataagttcgaccatatctctatccttattgtcattccttaacattttcattcgagaacttccttccatctcatatatccaatactgatagttctcttcattatacatttcaacaagatcatgttcacgtataaattgttcagaatcatcaccatcacagacatcaaatggatcgatttggaacgaattattgtcaccacatcttaagttggaaaactgctttgtaacacaccaagtcaagtacgtataaaatctactcattagtaaatcgttgtacccaccccctccaagtaggaat

SEQ ID NO: 12162 - DNA, 457 bp, Saccharomyces cerevisiae
ttcctaagcaccaaccgaaccatgacctgtgtactttatgataacgtataaataataaggaagcgggcgggttataaataactttaatagttatatttatcattttgaccaaaaagaataaccttatttaatccctgtaaaagagcaccacttccagcgatgagatgcgaaaagcgaagaaaaaaaaaaaaaaaaaaagggtattctaaactgaatatataaaaactgccaccaattaagagaagaaaagctacacaattaatttccaaaaattgcaaatacgagtatgaagagtttgttctatctcaaattgctcctctgggttgtgctattgtctttatgccttcttatggcacaccggaaaaccaaagttggtatgtatatttaagcatttgaaaatgcaaagtgcaaaccgtatcaaattactaacagctgtaatagccgacaaatttcgtgc

SEQ ID NO: 12163 - DNA, 403 bp, Saccharomyces cerevisiae
aaataggctaggcgcgggttctgtggccacccatctcctgtatataagaaaaatagtgcgtgtataaaatctacgtatactaactatgggtaaagtaaacctttttgtactgttttcttttttttttttttggtttcccgtagtgatgacgtacgtgtatagagaattgaagcgaaaataaaaaaaacgacacaaaatattgttctcattggcttttttattttctattttacacagcatatagaggtatactcaagtgctagacatcctctaacatccgccaagaaaaacagcaaaaaaacactggtcatgaagccacagtgcatactcatctctttgctggtcaacctcgcatacgcagaggagtatttggtgaggttcaaaaatcccacagcattccaac

SEQ ID NO: 12164 - DNA, 426 bp, Saccharomyces cerevisiae
ttaggaacaggcgaggtcaataaatttcacacaaccacattgtattttttatttttacacttttatatatttatatactttttctacccttacttttttcttcaggtctaactgattgctgaagaacgtaattgtgcgcatatatatgatatttgatagaatgtaggacgttgattttcaaagtattccagaaaatttgagtcatgcttacttagtttaattaagtactcctattttatttcatcagacttcaagacggttcttaagcaatcaccgttatgcaaatcttcaaaggcttgattgatttctttgaatggtctcctgtgagtgataaattcttcgacttttaaggcacctttttgatagtctttaattaaaccgcccatttcagatctacctttgatgccaccaaaagcagagcctttc

SEQ ID NO: 12165 - DNA, 462 bp, Saccharomyces cerevisiae
agaatatctaagaaaaaataactactgtggtgagatacgctttttttgtgatctaatcgtcgattatttttatcttttttcaaatctccattgtgaattacattactttgtaaccatacttttactattgattttgaacaagaatcagtcgtaatttaatttttgtctctgcttttttatttttttatccgttttctctagtttctgtgctgatttttttatcctcatttgcgcaccgtttttattactatcactttgttatttctttttgtttctctaaaattatctcaaaccacttcattcttttaccagtcattgttgtaaccaatactaccgtccatatcaagagctcaagtgcacttgcccagtttcatcgacactttcgcttttagctaacttttattgttataatttccacaataaactattcatttcaactgacaagatgaaactttctttgaa

SEQ ID NO: 12166 - DNA, 474 bp, Saccharomyces cerevisiae
aaactcgagcgtccctaggatatcattggttttattagtaggaaagcggtcagtacaatttgtataataataccacatctttctcatacctgttacggtgtgctgcatttatagtaagaggttgaatattgataaaacctttcaatggcttggacgcctcgtttaacaagcaagaatattttaattatggggtttttgctagttttcaagatgcgttagcaaacctaagtaccattaaaaatttcatgtttagaatgctcctacatgtgttaacttttagtgcattttttcaaagtaatttgccgttgatgttaaagacatgaagtaactgtcttttaaaactaaggacaattgactttcttaatctttttgtacctaagatggaagattcagataggacatccagtagcaaccagtaaatgtactaactaatatttcatcctttctttgactgggacgaagtcggatcacact

SEQ ID NO: 12167 - DNA, 485 bp, Saccharomyces cerevisiae
gaaggccagatcttgtgcgctacaatcacttcgtctcgttcccttacataaaaaacttacgtagctacattgtcgtgcgtggcatcaacctaattatcctagcaaaataaaagagaatgttacgggactaacaggcggatgtaaattactcacttaaacgcagccaaacatcatcgagaacttagggtagcgtgccacaaaatttgcatgaataaacttttgttttcctaattcgacagcattcccttgttcgcaacacttcactgataggaaatcgaatagcgcacactctcttctgggacataccccaatgcggtaaagccacgaaaacaccgcgcgtaaaggggtaaacaagtccattcctacaacctcttggagaaattctttacctactacaaccccgcgcctgatactttcagtattcatgacaactcgagccagatcccgctcgtgggcgtgttcattctgtgacgatccactagcga

SEQ ID NO: 12168 - DNA, 488 bp, Saccharomyces cerevisiae
tcataatgtgtttcggttatgaatacagttttacaacattaggtagaacttttattgctcagtgactttaaagttaaaacatttttaatttaaaaccttaaagatgcattaatttttttctaatttatcagttgatctgcaattacctggcatggctatgtgtattttttttttttatgaattccatcatattaaatagaaaactaaactaaataataaatagagtattacagagtcgtcaaaaaaaaaaaagaaaagaaaaaagaaaatctacaatcaaatagcagcagtacctggactaaatctttgcataacgcagaagtatagctacaaaaattacagggaggatactaactagttcccctaaacccgcatactctggtggaatatgaaagtcaacaaaggcaccagccgccaaaaggatagcaaataagttgtaagtaaaactccataagaaattcaatttgaccctaaacatggccttttga

SEQ ID NO: 12169 - DNA, 461 bp, Saccharomyces cerevisiae
ttaccctcgtacttttcatttcatatatatatatatatatatatatgtacctatatattcttcttattatggcttttctaattcttgcaagattctttgacagctccatctttcgtttggtgaaaatgaaaccatccccaggatacaattaatgaacttctgcttgactttgacatccgcaatctcgtccagtcgaggcatattcctctcaacaatgctaatctgtacatctttctcctggtccagtacatacttgccatcgccatctgcaccaaacataccaacaaatgcatcaaccgagccgtgttgcgcaacctcttcccatttctgaatggacggtatgcccaacttttcgaatattgagcaaatcagtctgaaatcgcttccatctgagttcatgtcgtcgctgccgtcatcaatcatggccggaacgtgccccatacggcttgtttctctctgga

SEQ ID NO: 12170 - DNA, 473 bp, Saccharomyces cerevisiae
gaaataatgttgtaactctaagaaagtaaaataataaaaaacatttcatttgtgctgatcttgccaaaaaaagggtaaacaagtaggcaatagtaataaaataagaatgaagcatttcttttaataagcagagagaactttcaagcattcaaaaaacacaaaaataatgatgaataaaatgggactcacagtgtttatttatagtccttgtttcgcattttaccaaattaaaatttaattttatcaagacatattaatgaactttagcggaaaaccttaaatatccaagtcataaataatgacttatgtaaaaagttataagaaaaatatacggtgttcattttggaacaatgttgctgttacacactgttaaatatatttagtattcataaaagaaagaagattttaatacgcgttttgattaaaactacataacagataaatatatacatggattgaagactgcaaaaagg

SEQ ID NO: 12171 - DNA, 419 bp, Saccharomyces cerevisiae
tgaaatcacaaaaacagatgcgtttttaacgttacatatacaaaatatatgcgtgcatatatatttatatattaggttgtcgtcaatcacatgtaaatatcattaaatgaaagaaaaagaatgtgcattttctaccgcattccttccatcaggtaacttatttttttgagttgaatctactcggcctatccttgccaatcctatcagtattcttactcgtccttttattgtggttgttgcctccaccgttgtttttcctacgtttttcaatcatcgtgttatcgaacatgtctttccaataagttattagatttttttcgtttttaacaaaatgatttgatagtgtgtcattcttgcctgacatgatataccatgatttatcaggataaaacttcaaaacgggatcggttttgtaattg

SEQ ID NO: 12172 - DNA, 411 bp, Saccharomyces cerevisiae
ctttgtctataatcaagcaattatccggaacaataaataatacatttatagattagtatgattatatatttttcttcagaagcatggtgtaggatatattaaaaaaaatcgaaatataaaaaaagaaggtttaatgagtggtttcgttttccggaattttctctgctaccaactgttcagttccaacattcgacgtatcctcaatcttcgcttttttgctctctactccatcaacgttctccttctcattagcggtctgatctgcaaattcttcccttatccttttaccattttcatcttctttcttcattctatctttagtggcgtcatccaatacaatccctgcgttaaattccttttccaagcattgcagtaatgtatttcctcttctggctagctctacaggtgtcc

SEQ ID NO: 12173 - DNA, 466 bp, Saccharomyces cerevisiae
gcatagtcacagaacctcttgcatgccttcaaaatagaaaaaaataaaaaaatagacgtttcattaatcaaaatagcctgtagagattttgagggattgccccaaactttatgtataatatcaccacttattattcactattcatagtatgttacatcataaggccattgtcaccttcggccagcgatagtactcaaatctataataaattttccatattatcctttacgtacttgatagcgtgtataacagggtcattattcacgatatgttcaactgttgtcattttcgtgttattgcactgaaacaaaagaaccctaccaaaaaattcgttagagaaaaactaaaagtacaagatcttatactgaagacccttcattttttaggcccaacttctatattaagaagatccctggaccctgctagaaattttcaattagcttatcatttttcttcattgcgagcg

SEQ ID NO: 12174 - DNA, 474 bp, Saccharomyces cerevisiae
tcagaataatgatctcatgcacatatttcatgtatagagtagcctagcaatatgtatttgtaaaaatataatagtaaaaataacttaccgcaggagacattttttactgataacgatcgcttctaaaactcgttagtacaggctcgttgtgacttagaatcaaataatagatgggttaggaggcgcacgtaccttcctaagcacagaagggagcttaagttgctgtttcaggcggtgacttaacaatacatcttaactatccaatgctgacagctgagtattgcaacacaactatcagagggaggagtttgccgttactaatgtagcagggtttttgaatctaaaagaataaatgtaccagttgaatcctaagattttacttggaaaaatatataaataagaaaacaatgcattcaaaattgtgccattgtaatgacaagtgtttttgttcagcaccaacgcaaactcaaaacc

SEQ ID NO: 12175 - DNA, 409 bp, Saccharomyces cerevisiae
gataaatttttttttatactcctttttctcaatatatagattttataaagcatgtatatttttatgcagaagtggtaaatataaacatcaatattccagaataattccatattttcttcgcgtactacaagaaaaagtgaacccttaatgaaaaatagacaatatgaacatttagtaatgttttgaacagtgtatttatagagtacttaaacacatatgaagatatagcgcaagtaaatataaatgagtgacaaatctcatcagatatattgctacttttggctctttggtttgatcaataatgtactttatgtggtaatactttcagcagctgttgatatcgtgggtcctaccttgcctaaatctctagtattgctagcagatatattcccatcactcgccattaaat

SEQ ID NO: 12176 - DNA, 477 bp, Saccharomyces cerevisiae
ttggacaacaatactcttagcaaggcaattctttttccaccactgatttccatttataaaaagcaggggttttccttttttgtagcttgatattagagaatatccttaatgtgaatattaaattgcaaactctatttaacaacgaatgtagattattatatgaccagaaaatcactttatatagatataagagccttccgtaatgctatgcaagttttgatgaattattatattgtcgtgaggcgtgttccgaggagtttcgtcgccattgggatagagatgctcgtaatcgtacgtgtctggaagtgcctgccgacggtagcgatgtctactctcgtcccagacaatggaatagttttggaattgttctacatcatttattagaacacatgattcacgaaatctcccacgtttgtcaatatctcgcctacgaacagtgtcatcgaatgatattgaacgctgagagagccatttacc

SEQ ID NO: 12177 - DNA, 462 bp, Saccharomyces cerevisiae
ccgagacagattgaggtctttcatgcattaccaccagtaataatattatacggaataatatagtttatataatatccataatcataatcataatcataatcataatcataatcgtgatattgtaccagccccgcttctccccttttgaactaccattattatcggaccctctttacctttgaatggctcagtaaggacctttgcgcagccgtaagggggtcgggaatacatttccggggttgatcctcgaggaaaagtgctatctatataaggagaagcccttctagatccaaatatcaggggtaactcttcacaactggccaggaacatattccaagttaaaaagaaaaaataattattagaaaccaattaccaacacaagatgctaagatcaaatttatgcagaggatctcgaatccttgcaagactgaccactacaccaaggacatacacatctgcggc

SEQ ID NO: 12178 - DNA, 465 bp, Saccharomyces cerevisiae
taatcgcgcggtacgacagttactgcgtgaaaagattatcagcgcccctttttttcttctttgttcttaacgtttctttttcttgcggcttatgcccgtacttataaaacaacggcctcccgtgccctattaccttcctgatagaccggacaataacgtcactacatacaaagttatacactaacagaaactcaaacacaaacgtttttataatagtcaaaattaaatatctctcataatgggttccgagacaaaacattctgcaaaagtcaagattgtcacaagggaaagtcctccttccgccaaggagcacatgcgccccactaaaactcaaatattagttccaccgacgcagagtttgcccaatggcaagaaaccaaacttcggtaagtctacaaaacagcggcgagaacctagggaacgcacctcgaagacgggacacgaggacgataaggcaacgatggt

SEQ ID NO: 12179 - DNA, 462 bp, Saccharomyces cerevisiae
taatgaaaagaaaggaagcgatagcctcttaccctcatatgtaattataaaggtatcgggtagaaggggatctaccaaaatcttatatactgtaaatagttttattttatcctctcgctcgtgttttaaacaaccttaatggcaattactttatcattttcatctttcagcattgtggccctatttctatcgcataggggcttcaaacaataatagagcaagctttcgggcattctatggaactcccaattgactgtttcatcaccttcactcaattcgtataacgtaatgacttgattcagttttccagagtcttcgaaccactgtagtatcaaagaagcccaactgtctaagctcttccataatataaaatatctcgtagtggtggtattgctgcttctcctaccactttggtcaatcggtaagcatttgccttctttggtcatttgcgaccaaatttca

SEQ ID NO: 12180 - DNA, 448 bp, Saccharomyces cerevisiae
ctcctctaatggattaatatgtaggaatgagcaagttggtttgacataaagttgcatttgcgagtttagcacggatacacacaaacacacccatatctatatacatatatatatatatgtgtgtgtgtatatcgaataggatcgaacagttttattttaatgaatttttatgaatatatattgtaaagtttactctccgtctcattatttttatgctttactaaagaaaaaatgaatagagccagaaagtgacggagtttccttatagacatatgaaaacaacgaaattttgttctatcacttatgtactcctttcaatttcgctcaaaaattatttggatttaccaaaaagtttttcttctctttgcatgtttggtttaaaaaggcttaaaataaagaattttctacaaaagtaaaactccacgttcaatgctcttccgcaccttta

SEQ ID NO: 12181 - DNA, 484 bp, Saccharomyces cerevisiae
tctgatctctccgccctactaccagggaccctcatgattaccgctcgaatgcgacgtttcctgcctcataaaactggcttgaaaatatttattcgctgaacagtagcctagcttataaaaatttcatttaattaatgtaatatgaaaactcacatgccttctgtttctaaaattgtcacagcaagaaataacattaccatacgtgatcttattaaactctagtatcttgtctaatacttcatttaaaagaagccttaaccctgtagcctcatctatgtctgctacatatcgtgaggtacgaatatcgtaagatgataccacgcaactttgtaatgattttttttttttcattttttaaagaatgcctttacatggtatttgaaaaaaatatctttataaagtttgcgatctcttctgttctgaataatttttagtaaaagaaatcaaaagaataaagaaatagtccgctttgtccaatacaaca

SEQ ID NO: 12182 - DNA, 448 bp, Saccharomyces cerevisiae
ctagtacaataatcaattcaagagcacttgctgattgtaatatcatgctatcaaagaagtttaaagatactacccaaattcccgcctgtttatttcttcttttgggcagcagttaggaaataaaaaaaaaaaaggtcaatgataatgcaccaaaaacagaaagtacatgtatatcttaacaaactctcaaaatacaatttaaacaaagttttttgaagcaaaattcgaatgcaagattcataaatatggggcgtaggaaatctatactatatgcaaatatcacgtagttaaaaaactataaaacataaaccagaaatatggtatcaaggacttttgaatataattaggaacgagattaatgcgtatcatctagtatcttgacatactgcttttctgcaagataaacaagcttttggacggggataactgcggtttggtgagtgaattt

SEQ ID NO: 12183 - DNA, 435 bp, Saccharomyces cerevisiae
taaattgtcatgcatatgactcatcccgaacatgaaattttttttcactcggttttttctcaccgccatagattctaaccgcaaatgtcgaacaaattcattatacaagcggtttattaatatagaaggtaggacgccgactcgtaaccattagtaacagatcacagctatactcggtcgttcaagtttatataatctcctagttgagaaatccctacgtaagataattgtatattacgatggtgcagttagccaaagtcccaattctaggaaatgatattatccacgttgggtataacattcatgaccatttggttgaaaccataattaaacattgtccttcttcgacatacgttatttgcaatgatacgaacttgagtaaagttccatactaccagcaattagtcctggaattcaaggcttctttgccagaag

SEQ ID NO: 12184 - DNA, 484 bp, Saccharomyces cerevisiae
tgtctgcatttttacccctcatttgtgcccccaatttctcctgtgaataatctatatatatatatttataattataattataaggaaacaagtcaactttataatatactcttaaacaatcgtttcgcgatatcctctgtcatgcctccactgccaggtctttattgtttagtctcaataatcgcaattaagttaataatatttgcaattgcggcaaagaaaaaataggtaaacaaagaactgaaaaaacaaaaaaaacaaaaaaacaatgaatatagaatatgaaatgccctaacaacacacacatacacacacattctcctcgcaaaagcaccatttcctgaccagtgtactttatggcgtcacagcaaaacaaacacgcttttctttcaaagaatagaatctttcacaatcccgataatgtgtcctcatcaaaatctcgaaaccttatggatatcacaaacacgacaaacaccatgaatgg

SEQ ID NO: 12185 - DNA, 447 bp, Saccharomyces cerevisiae
cagaagaaataagacccataaactttgtatattatatgataatctaagagaggagaattctatatgtatgtagtaagtacattacaaatgatctttctttttttcccttatttttatgtattctgttttacctatgcttatttgaacagccacaaatgttctatttttctttagacagttctacgttccttactaaacgtaacatgtttctcaacaacattgcaatggtaactttaccagtcattggaacgtaaagagaagctttttccttgacatcatcgctaaaatttttggtgcatgcaaaattgatgcagacggcaccttctttgatgtattcggtggggaatttgtaattttcactagggacaccagtgatgaccacatctgaatcaagagaacactttttcaacagatcttcagagtactccccaaggtcttccacatgat

SEQ ID NO: 12186 - DNA, 480 bp, Saccharomyces cerevisiae
tgtataaaaagtgtgtgtatgcggtatgttgtaattatattgaaagattataaaccttatttgtttcatatctaaatggctgtgttaagaaagacgataatgtgaccgagcttaagtgagctttttctttcttttacaaagttgtgtttgaacttcttctgaaatcgttaataatttattgacattttttgaatcgttcaagtttagcaagaaaaaggatttagtatcagaaattagttttttcagaacaagtgcaataggggtctcgcatgattccttcttaaagatgcttttatcaaactgttcaatggacttcagattatttaactcgataaaataaaagtccaccggtacggggtcattgttgccatcgctttttgaatctcgaggaaaaaactgcaccttgattatacccatcccagaatgaggtaaatttgggtgttcatcacaactaaaatttaagggcaaatcttcgagtcc

SEQ ID NO: 12187 - DNA, 426 bp, Saccharomyces cerevisiae
gctctttcttcgtttctatttcttttctaaaagaatacgagagtgagaaaagcgcaaaaatatcaacatacaaatagtttacgagatctcaagtgcataccgcatcttatttttacaaactcgaaatcttacgagcattaacatttacataccgggtgtcttccctacatatatctatctatacagatatgttcatgcagtactttcatcgaagatatatagataggtttaaagtgcagaaggaaaaagctaggattgcagatatgccatctgcaggccaaatttcacttccacatatctgcactgttcatgaaaatgatcagtttctttctttcttgcagctttagataatctggtttttctgcttttacaccttagagatgaatcaaagacactcaattcggttatacgacaaagggcgaacac

SEQ ID NO: 12188 - DNA, 466 bp, Saccharomyces cerevisiae
gaaacaagatacctttgctttatttcgcgactcggggttacttagtttgtagtcaaatttaactgtaaataatttatatatataatacacatgttaatacattttcaacaactttatgtttttaacaatgataacattttccttttttcttatcttctgactggcccctaaattcaatagattaatttttgaaagggcataacgtgcagacaaaaacaattttgaaccgcacaataaaatagttggcaacaggcagcttctcgacatctaaaaactcatgtttcatggcgctaaaggacctttattgatagaacgcattggtcatttactttctatcaattatggcgagaaagaggaacgaaaacgatgggccatgcaaggcattagttatttacaggaagtccagtgtacaagcactccctatttggaaattttggtagaagagagcggattaagacctgtgagc

SEQ ID NO: 12189 - DNA, 445 bp, Saccharomyces cerevisiae
aataataaaaagaagatcatgcaacatcaccccgtaaattttttcaattctccatccttttaattttcttcattataattttctgaattgtatatagacaatatattttaatcatatttaatatgaaacggaacacaaaaattaattaataaccttgcctttttcaaattcaaatcaatggtttttcctcaattggagcgttcgcatagatgacggtgggcctcgatctcacgctacaccatagaatgaaattcagtaatgctccaacgacagccccccacatcaaaccctggtagttcctaccaatgctcattgaaataccgtaatcactatagttatgctttaggatgtatttgatgtatgagtaagtgcccaaacacgaacctatactgactaatagggcggcaaaggcgaaaaatgaaaaaaaggcaccaaaccacgttag

SEQ ID NO: 12190 - DNA, 462 bp, Saccharomyces cerevisiae
atatattccccaataaactggaatctgttatttcatagatatatatgtaagtataagtttgtatgtataatattcaacgcattttttatgcccgtcgtagttgctacctaccacacgatgatgtattataatttcggaactacttcaaagctacgctttccgcactatgaaaagctataagtatgtgaaaattggtcattgactgtgattctatttcaaaaagtaaccaaaggagatagacatcgttcggacagaaaatggtccgttgtcactcccattccattatgtccttcatatagaaattggatattcttgttttcatttcgcgcaataaagcaattccgtgcggcagaaagaacttatatatatttaactgatcttacgctatttatggcaaaacttgtgttacatttttgaagataaagttacaatcattacggcagcctcaaaacaaaattggga

SEQ ID NO: 12191 - DNA, 464 bp, Saccharomyces cerevisiae
agcttttgattaagccttctagtccaaaaaacacgtttttttgtcatttatttcattttcttagaatagtttagtttattcattttatagtcacgaatgttttatgattctatatagggttgcaaacaagcatttttcattttatgttaaaacaatttcaggtttaccttttattctgcttgtggtgacgcgtgtatccgcccgctcttttggtcacccatgtatttaattgcataaataattcttaaaagtggagctagtctatttctatttacatacctctcatttctcatttcctcctaatgtgtcaatgatcatattcttaactggaccgatcttattcgtcagattcaaaccaaaagttcttagggctaccacaggaggaaaattagtgtgatataatttaaataatttatccgccattcctaatagaacgttgttcgacggatatctttctgcccaaa

SEQ ID NO: 12192 - DNA, 466 bp, Saccharomyces cerevisiae
atgttacggatcgactcaaagaccctctgtcactctgaaatttctaataattatgcacaccacgctagtatagatacagcttgatttgtgtatcccgtttatagtcgtgctatttaaaatctatgtataatataaccagataaaaatacaccttcgtacaaggtgctaataatgttgagaattcgaaattcctttttaaaggcgtattccgtattgaatgattgaaaaatttatttctttttttatttcttttttttttttttttttttttttttacgccgatgctcatcgcagaaaatttttccttcagtttatttgtcttataaaaagactgtcctacgctcaaataacttatacttttctgtatctcattcaaattattttcttgtcaacaacctgtaacagaattaagcactattaaggcaaatttagagcaaatatgacttacggtggtagagatcagcaa

SEQ ID NO: 12193 - DNA, 466 bp, Saccharomyces cerevisiae
tttttctctttctttcctataacaccaatagtgaaaatctttttttcttctatatctacaaaaactttttttttctatcaacctcgttgataaattttttctttaacaatcgttaataattaattaattggaaaataaccattttttctctcttttatacacacattcaaaagaaagaaaaaaaatataccccagctagttaaagaaaatcattgaaaagaataagaagataagaaagatttaattatcaaacaatatcaatatgactgatacatcatcctcttcatcatcctcttcagcatcttctgtttcagctcatcagccaactcaagaaaagcctgctaagacttacgatgacgctgcatctgaatcttctgacgatgacgatatcgatgctttaatcgaagaactacaatctaatcacggtgtcgacgacgaagacagtgataacgatggtccagttgcc

SEQ ID NO: 12194 - DNA, 422 bp, Saccharomyces cerevisiae
ctaacgagaacacgttcactacagacatggggcttcttttccttttttcattttctttctcttattattctgggtatttcttattaatcggttgaactatgtattacgtcgaaatttctttaatatttctttgtattcttcacgacgaattgttcatttcattttactccattttttcagtattcctggggctacaggtatatgtggcaaaaaattttttttctattatttgacgggatctcctatatattttatacacttttacaggaaaaaaacttattagttttcaatattttctttatttttttttccttaagacaactttgttgactaccagcaaaatgggaaagaaaaaaaaagcactgaaaaggaaaaatgaaaacactataggaagtttaagatatgtctgaccaacccgagac

SEQ ID NO: 12195 - DNA, 400 bp, Saccharomyces cerevisiae
aaaattttagaattaaaagtctactgcattaacaaagataaatttctaatttttttatgtatattatattttttggaagagaaaatatttgtagtgcttctctacactgttttttttttttcgttcatgttgtctttcctctcctgaatatatttaatttaataaatctatcttatctgacatatagaagctgtttcgatagagttttcgactggccaacagttgttactgactggataaaaatttacgatttttcctccaatcttggctttcaaaatgagaaataagagtcttgaaattcaaagaatgtatctatgtatgaatatagaatatgctcaaatatttagttttgtataaggaagttctaaataattttccatggcgtgcttttaccaaagta

SEQ ID NO: 12196 - DNA, 421 bp, Saccharomyces cerevisiae
gagaacgacggcagtaatattgtaatgaatcaatatatgcaattgtacaagaattttttttttggccttccattctcctcttggctttgtaacgtttatatacctgaatatctgccaatggattttgcgcggccatagaaaaaatgaaaatataaaacactagttctcataaatgagagacattcgagttaactattgaatcttggaaatttttataggatagaatcactaagaataatgttatcaaggtacaaccgcgttattgaaataaatgggggtaatgcagatatttctctgcccattgtcaaatttccaccgtttaaactcagagctcaattaattgaaaaggaccccgtagtatggctgcatctaatagaaacctatgtaacgtattttgagtatttgatgcaaggtgctaacg

SEQ ID NO: 12197 - DNA, 423 bp, Saccharomyces cerevisiae
acttaagttttacaaagaaatttgcgaacagaggacagaaaatgtactatagttatatggcagagttaagcgtatgtatgttattcttataaataattgtgctactctatttgtaccggagaattattgaagcaatgggagaaaaatcataatggagaaaatctttctacgagttactttgcaaggcaatctaacgattctaaaagacacaatacactaaagaaaaaactttggaagtacagttttttccccaagttgaagtgtggactcattgtgaagatgtaaaaatgtaaaaaccaaccgacaatgcactcccagccaaattcattgtagacctcccatttgatagaaaaggaaggttcagcagttgtccacggattccaagatatcattctcttacattgcacgcacatgaaaatgatc

SEQ ID NO: 12198 - DNA, 472 bp, Saccharomyces cerevisiae
agttgcggttccctctgtctctcctaatattatcctaaatttatgtttacagtcgcaaattagataaaggatacgtaagatataaattgtaattttagcctaatgataagtaagttgtggacaacttttgcacgttgaaaaaagtggagggccaccgaactctttttcaaacgttctcctctttgaacttagttgtctaccgttttggatggtaatagctgtttcttggatagacctaccttatatttaaccttgttagaatccacctgatagaatgtcttgttcgtttcatatatcaagtcctttaggctcttcttcttccttggagggcttttcttcattgaaggtggtggttgtagcctgtcaagctctttcgagggacctccttggtattgatcttgttctcttactccttttttggcgtccagataagcacccccattggggcttccgccacctgtgttctcagaca

SEQ ID NO: 12199 - DNA, 444 bp, Saccharomyces cerevisiae
tgtgcataaatatctagaaaaatcgcacccttttctttatttattaagtttatttatttatttacggttattcacgtatattttgttaatctattgatacacaagttcttatttgtaatttttctacttcttttcattaaatttcaaagatgctcttgtgacgtccaaaaccagtgtctgacctaaagcccgtgggaaaaacaacgtaaatttctacataaaaaagtcaagtaggcgctcgaaagagtttcagaaaatacccagctgaccattaactgaagtagcaaacatctatggataaatatactgctttgattcacgatgagaatttttcaactcttacattgaatgtctcgagataccctaaaagtttggcatattgggagaagttactgaactatatagtaaaggcttcggcaccaatatgcaagtccactgagcctc

SEQ ID NO: 12200 - DNA, 458 bp, Saccharomyces cerevisiae
tgatcacggaagtgtctcgcgctgccttccgtacgtcacaacgcatacacaatatagtttatataaactcctgcgtataatctatccttttgcataatattttcgtcaccattatcttgttgcggtgtttttatttaaaacaatagaactcgcctaaaggggaaattttcgatataaaaattcaaaaaaatggctttcatggatcgagtatttgtttgtcgaaaaaggatcactggagtgacgttactacgctacgaagcctccttccggcttagccctgttgattacgaatttggatcagttggtatttgattcctcggaagagttaacttcacgcgggtaaatcacttgtgatgcggtatattctctatacggctaatagatgaatcagggtgttttaaagtgcgtataaacccttttgctattttcgtttatataattggcgttgataaagagcc

SEQ ID NO: 12201 - DNA, 434 bp, Saccharomyces cerevisiae
taggaaggaaataatcaccataaaatacttcctaattttttttttcttcctacattcgcagtaccataactctgcatctacctccaaccgaaatatttttttgtgacatggtataatccatatgtatcgtgctgaaattttttcttggagattttcatttattctccaccattctttctcgcctcccctcctccttttccttctaataataacttagttctttttccttcttcattaaagagactaagaaaaaaaaaacgtcaataatacccggcaccttagtgtaattaatagtaataatattgaatttaattctttaataataccaccccctcaagaaaattaatatataatactaactaactcaaaaacacctttttttatatgtaactgtagagataagaataataccgaacaccgtgaagatttcccag

SEQ ID NO: 12202 - DNA, 494 bp, Saccharomyces cerevisiae
taatctccttaaacgcgcattgagcacagactttctggtagacccaatcttatctatttacgaaaacaagagtgtataagagtgtataagttattttttgcatttattcttttgtggtaggggggtttcttagccgctctttttgactcaaaatttcctttgatgtctagtgatagtgcacttcccatgtgcgcaacctgtgttttttgtactccgtagtttaaatgcaagggctcgatatgccctttttcctttttctactttgtacgatctacactgaccttttttcagtagtccgtaaatccccacgaatttctactagcgactgccaataaaaaaaggattgtgctactgtatgtaaaaagtaagaaccctgttattttccgttaactgtcatttgccttactgttgcttaacggccgccaaccgttatcaagaaacaaaacattgtatgcgttgtcttctaaatgaaccttgtgggccctgataaacat

SEQ ID NO: 12203 - DNA, 471 bp, Saccharomyces cerevisiae
actaagcagtaaaaagcaaattcctgttaataaattactaccacaatgttaaactagaaagaatgacaaaaaacataataataactaaccagtatttttgtttctttattttttaagaacatttatatacataatatacacgccccaaacatatatcgtttatataagtactgtttcctcgcattaagcgggaaagccatgtatctcttgtaattagtttgatcctgttctatacccaaatgtactcctcaaaattattacattttattatgcctttttcttagatgggctttcactccactttacgaaaaactgagaaaaaaagagtaggagaaaaactagaaaaggggaatcacacacacacacacacacacacacacacacacacacacacgtctaatatcggcgcatatttatcaaatctaaaaggcaaagaatcttaatacataaaatcccagacggttatgatgg

SEQ ID NO: 12204 - DNA, 469 bp, Saccharomyces cerevisiae
gtcgcatataacagtggaggtgtatagatatatttaaaaaaccttttggttattttttctctttcatggcatttgctccgtatgcaaagcgatagtttaatttaatgttttctttcaaatgtcatcgcggattcaaagagcgcactattattatttggcaaaagtttaagagggaaaatgttgaaatagcatgttctgcaaagcgaattacaggttttgaaggagtctacaggtaaagtctaataatacagtgatgtttgatggctttagcaacaataaaggtaaacgaaggtctttttttcggtttggttctgaaagtaaaaacaatgactctgaaaaatccgttagaaagccatcggtgccctctacaataaagaaatcaacaaatatcgcacgaacttcgacggctgaaacttctgcccctgatataccgccaagaagtccaaataggaatgctcatagcaggagc

SEQ ID NO: 12205 - DNA, 440 bp, Saccharomyces cerevisiae
tgagcattatctatcgctttattatttattatttattattatcattattattattatcattattattattactaccaataccttctatatccctgtgatcagctaaaatgattcaaataactgtcattttaatcgtacattttatattaggcctaatgtgctgacgatcagtcatatttcaaatggccatcaacacagttccaaaagtctgtgatatattttgtttgttcgtcactttcgttattaattgttcccctcacagccaaatatgtcctattgtcgacatcaatactccattcacctggattggcacctactacacgaccgcccacttctttcaaaatacaccatccagcacacacgtcccacgaatagcaaccaccatcccaataactatcaaggtaccccatagcaatatatgccattgtcattgcagatga

SEQ ID NO: 12206 - DNA, 421 bp, Saccharomyces cerevisiae
gaactgagttgaaaagaaacaaagcaaatcaaacattcttgtcatttggggttttaaagtaggtcatatgaggaagactggtatgtcttttatctaacagttttataaatagcgtcgttttattaaagacagtgtatagtattactattaataaagaaaataaaaaacgtatcaagtttacggttttacttacggaaatgctaacgtactacagctttgacgttataacttggattttttattcattagtatacatgttataaagatatattacagctaggctctctttcttttgttacgtctttgataatacccattttcatccttttcatgctttctcttttccctcgatctcgcatgctttctcaactttttatcagcagaaatttgtggagcgttaacagccagaattgccctttta

SEQ ID NO: 12207 - DNA, 401 bp, Saccharomyces cerevisiae
agttatagttgttttcacagtcagcattatttctgaatgctagaagcctttttttttttgaagtcataataaaatatttggcttgtaaatttaagtattgaagtcaaaatatcctacttatatcacagtgaaatgtgaggtggatatggccctttagggcccttaattttacaagttacagaatcttttttttttttatagcatttgtaaggtccgtgtattcagaaaaaaatccaagcttaaaaaagtgtatataacatttggtatctgaaatacggatctatcataaaatagaacacctcaaggaggtataaattttaaaagtttttttattgtatgctcgtgcccgttttttcttaaagtcggaatttgttatcgaacacttggcatgcgctaaagat

SEQ ID NO: 12208 - DNA, 400 bp, Saccharomyces cerevisiae
tgaactgtgcatatttgaattttaagatataaaatatttttctgatactttaatagtttatttttatgtattatcaattctgtagaatttaataatttcaacatttcatgaacggccagaggtaaatgggtaaggcttcctttcaaagaatctatagatattaaggtttgcatgaagtaaatagctgataaccttagtacaattagaacaagttgagacaaataggaagcaccccagcataagagcaatatcctcagaaaaaaaaaaaatgactaagctaaataattaatttttttaaaaaaaacttatagtacaatacacgctaatgtttggcaactggggtttcaccagtcattctggcgacaaattccttcgccatatcaccaaaaccaaccatgaa

SEQ ID NO: 12209 - DNA, 457 bp, Saccharomyces cerevisiae
ggtcatcaataagcctggtgtccaatcgatgcttacatacataaaattaaatattctgtctctgttatatttccacatgtcatcatttcaaatatatgtactttaaagaaaataaaataaaaaataaaatttttttctcccgataatcaattttcttaattaattaattgcgttacgattccgtttttttacttcttttatctcattatctatctaagttatttaaaaaaaagaaagaactttttatgaactttcctcttttctttcttttagactatttaaaatacatcaccttggtcaaacatagcatcagagaccttgatgaaacttgcgatattagcacctttgaccaaagatggcaagaccttaccgtccttagtgtacttcttggcatagtcgatacattcattgaaacagttgatcataattctcttcaactcttggtcaactctttcgc

SEQ ID NO: 12210 - DNA, 441 bp, Saccharomyces cerevisiae
agccaaaacatccaaccggctgagtgattttatttatttgttttacgttcttttctatcattttggaagaggaattaatgcaaaacacatttgtatttttttttatttttgcatattctcgattatctatacatatttttaaactggatcataaaaggtataaaaagtaattgatccatacaacatttttaaatatttacccctctattttcagaatatttactaaaacatcagttatcaaagagtagggaaaagttaactacaggtttgtttttcctctttttatgtatcttttgagctttgtaattgggcagcacatctctatgttttcagggaaacctatttcattcgccattttgatgatttaggcatacgccaatgctaacgccgtttcttgtaatttctattttttcaaatggagtactttaccttcctcccgca

SEQ ID NO: 12211 - DNA, 412 bp, Saccharomyces cerevisiae
atcagcgaatgagtattctcaaagaataataatgataatgtgcgaagaaaccctacaaaagtgatgttttagtttgttttgggtagctttatgtatacattgatataattttttttttgttatacgttcttatgttaatgacagaagagtcgattttaaccagacgaaggcgttgtactgcgccgtagatacttaatttttatgtaacacttatgattcagagattcgccaagcagacgtcattgacatatactgggcaccaaagggcatttgtttagaacttccaaatggggacataaggggtcagaaaggaaaacgaatacatctaaccctatagctgattgcttcaatttattggttaggagaataaaaaactctttcttttgtcaagcagaacgagagaggaacgcaa

SEQ ID NO: 12212 - DNA, 445 bp, Saccharomyces cerevisiae
atgggtcgggtcactcaattaggaagggcagcttgaacttttgcatcctaaaacatacgtctgtgtcatttatgatatattatttatttgtacactgtaaataggtttaaaaatataacttcatacttatttttagctattttagttcccatacttggggatggaaaaaacattgcgcaagcccggaatcgaaccgggggcccaacgatggcaacgttggattttaccactaaaccacttgcgcttgttatttatatgagattattgcatcatgcaatggggtaatgtcaaggttcttgacaatcctaatataaacagtcttagggaagtaaccagttgtcaaaacggtttatcagcttgattcacgggatcttacttatcctatatattatataaaatatggatcatactaaatggtggaagcgcggaatcttggatctaaacc

SEQ ID NO: 12213 - DNA, 474 bp, Saccharomyces cerevisiae
tcatctagatttacggagcgatcactcttccttcgatcaatattcaccatgacagaccatgacaggcagaaaaaaactctggggggaagtaacgtcactttattattcattattattgtataaagaaactattttaagcaaatcctcgctaaagagaaattaggtatatttaaagcactttcttcaatctgttgaagaagtgcctgtttaaatgatgagcataatataattcggttttcgctaccagttacttttcaaagtctttttagagacgctgattttgcgaatctttgctggtacactttcatcaaaatcttttgcttttatcgtatcattaacaactgagcttttatcttcctctaagtactcatcaagatcgtaacgtctccttttttggccagaaattattggatcttgcgtaggcaagcttgagttaagatcaagctcctgtagggttgacgacggagaaagagc

SEQ ID NO: 12214 - DNA, 477 bp, Saccharomyces cerevisiae
tgctgtctactacaatcattccctgcgtaacaattaataaatactaattaattatagcaagtttgtattttttacatccttatgctttgtaacactattcaatactgtatgtaggctcgattgagtgggcggcttttttcttattcctgattggctgaaagaaaatattgttaaacgcactaaatttatcccgaaggatgattacatttaaagaccgaaaaatgaagatgcaaagatccctcatattttctactccagtccaaatcgacaagataaacctgccgataaatcatatttcagaacgctaatcaattcatcatgctaagcaggatccaaaattataccagtgggttggtttctaaagcaaatcttttgtcatcaaaggctttatactatggtaaagtcggtgccgagatttcaaaacagatttatttaaaagagggtcttcaaccaccaactgttgcccagttcaaatca

SEQ ID NO: 12215 - DNA, 473 bp, Saccharomyces cerevisiae
tgtaggtattgtaacattatttattctagttattaaaagggtgttgtttcgtgaatacattgaagtcctttattgggttattaagcacataaatctgtttctgctttcggacgtcctgtttcaataaatcggaattgaaatgacaatttaatttaaatgtatatatgcaactttcattaagaggtcattaggtattttaatgcggccttctcattcatcggaacgatgtaattgcctttagaattaaaacccaaagagaaacatgtatacacttactaactctattatgtttggatagagctccttgataattcagttacaaaacaaattatatgtatattcaatgccatttaaaaagtatgcatctacactttttttttgcaaatctttatcgctataactgttcctcttttataacatcaatcaaccaatctaaaccttcggtaataccttcgcctttaattgcactggat

SEQ ID NO: 12216 - DNA, 454 bp, Saccharomyces cerevisiae
agggtatgaaatgaaaaacaaaacttataaaacattaaaatgatttaataataatgataacgttacgtttagacatagtcttttttttttttcttggccaagagtttttataaaaatttatatatcatttacccacaatacttagcaaattgttcgagacgaaatattctttttttgaattgttaccgatggatggatttgttcgaaataagacccaaggcttaggcatcttttttttttttttctgtaatatttggactaaatataaatcaaatttcaagaaggaagggaaaaatcataaaatagtgaagaattcaggcaatcaagatttaattcgcatgtaaaatatctctttctcgtgaacaaaactttcgtttgtaccttttgagtacagatatattgctttgttcaaaggtgatataaaaacgatgacgcgtcacaggggaaaagaggt

SEQ ID NO: 12217 - DNA, 404 bp, Saccharomyces cerevisiae
aacaccctttttaacgaaatggttatgactagacagacatcttacgtcttactccttcatgctttatttttttctttgtattgtatttgaacagtcaatatgtggtgttgcgacgaaggcatatatataatagtctcaacccaccattttcgaagatttacatacacattatatttttataaacttccaatatgtaataactttatatgatatgtaacttctcactattatccttactattaaacggtttttaataaatatcattgttctttgttttattaatgagaaaaagaaatttaatacaatgtccggcgggaagaaaaaaaatcgatgaattaattgaaaaaaagtatctttatcatgtgaactgaggagaagaacggcatctcgaaaagagcacgtcg

SEQ ID NO: 12218 - DNA, 445 bp, Saccharomyces cerevisiae
ccaaagtagattcagtataacgatgtattgatcgaataaaacttttgtaaaggttttgtataatgtaacaataaagaaatgtacactatgtttctaaacactggcagtgatcagattgataatttattgagtcatatccttaaacgatggacgtggtgtgtgaatgtgctacttttgcagtaagatgaaaagtgcatattatttgagttccattaatatagcccaactcactgattaaacacaataattgttgtctttgtgctcgagtatttaaagcttgtatttttccagtctgattggaaatcacagaggttaaaacataaaggacaatagcagaaaaggttccctaatatgcatttttcatactggttgctcttttcctttacaaaagcaaattcttactcaaaatttaatctttttccctatagtaacctgtttgtcttga

SEQ ID NO: 12219 - DNA, 432 bp, Saccharomyces cerevisiae
gcgggtattttgatggtaaatctacaagccctcggctttaattattaccatggtcataaaaagttacttacaatgcatacatttttcttttaggaagaaataaaatataaaagacttatcgttcaaatcgggtcataaagggaactaaaggtatactaaggtaagacggggttctcatctgcacgtaattttttattatttttagtgagggagaactttacctctaagattgtttatataggtatacacatttttgtaaaactgattattcgtttttttttttgaaacaagttattagtacaaaaatcaagctctcactacttaccagtagttattttagtagaatattattaactctaccgaataagtacgatatgagaaattgctgatttacttgtgtgtgttcctattattatccaggagcgcctctaa

SEQ ID NO: 12220 - DNA, 500 bp, Saccharomyces cerevisiae
tttgaaatttgcagcccataccaatctgatttcatgattattcttgtccgctattactgtgtgaatctcttctatttaagtatgatatttaaagatatgctatgatgataaatggaactatgaattaatgttttctttttataatgagatatggaaaagcgcaaaaaagtattaaaaattactctcttggctataactcttagatactgaattttcatcatcaaaatacaatgattataactatttattatataatagaatcaactaatattcttttgatttccacataacttgctctacatttttgaaagaatttattctcttaataatattctttttttacattttgcttcaaaataatgactttccattgacctaacatgttgaaaaacacaattttatcgcagtgaatagaaaaatacttgattgtgtatacagcttaaaaaataagtttagtgtctaagtaatctgtttttccaatatctgggcagtctttgtcg

SEQ ID NO: 12221 - DNA, 482 bp, Saccharomyces cerevisiae
ttgtgaagttgatctgcgccgtgcacgtttttacttccccttttatgtattttaatagcaataatttatataactaatcaatcaataaagaaagaaaatcaccgataacaatgtgaaggcaagaagatataacaatgacttctccgtatgtgtaagaatatgagggtaattgcgtaaaaatgtatataaatgccatctttatgaataatccgacctaaataaaaccccaaaaaaaaaaatgagagcccgcccgctcaagtagaaataaaaaaatttacaatcacagctactcaaacaaaactaggtttgggtagcgctgcctcatgtgggatatctgttgtgaacgaagcaccggcaaaggccgtatgaccagctacgtgcggtttcgaatcgatcgacgccgccgccctatcctggtactgtctcgttttcttcttcttgtatttgcacgatttttttttaggggccttatcatgtaggaa

SEQ ID NO: 12222 - DNA, 453 bp, Saccharomyces cerevisiae
aattaaatggcgattgtatattgaaacaaacactggattacataatttagatagaagagagaggatattatgctcaaagtttgttgcctttgcctcggccagttgactttgatttgatatcaagatcttttttttttatctggagtcaatgcgatgaacctaaaaaaatcacaagctttttttatctctaagctggggaaagaatcgtagttaaatcggaaagaaaaatatctgagttttgtcagtctttcttttgcatagcccatccttgtactagatttcataaacattgatcacttcaaaatatacttgtaccaagatggccgaaaatgagagaatgtacatctcctataataatattcacaagctttgtcagggagtggctaaacatatcttagctagaaacgaaagacctgatattattatcgccatcactggtggtggtatgatccc

SEQ ID NO: 12223 - DNA, 481 bp, Saccharomyces cerevisiae
gaaattaagtttttgacggacagctgtggatgctttcaagggcaagagtgatatagcatgactttctaattaatgtaatttacgtagatatagatcaaatggcgaagtaaaaacttcgaaaaagatggaagaagtcctgtttgcctcaactggagaaaggaaatacgtagctgcaaactgcttatcacatatcgtcatcaccagaatcttcgtcttcataccacccagattcgtacgctgaggcgtaatcggaaagttcatttttcaattcttctctgtcactatcatttttgaagtaccttaccacaaactcattccaatgtttgaatatatctcgatttttttcagatgattctaattccaaaacaaattcacgatcattggaaaattctgtcggtatcgtatcagatggaaaatacctgtgtgtatacatttcaatcatcttactccgtgaatcaggttcggaatgatgtttatgcgt

SEQ ID NO: 12224 - DNA, 474 bp, Saccharomyces cerevisiae
tccttgtagacattatttcatatgttatacttaaactagatagagacgttttatttgtactaagctgaacattaccctaattacgcgttataagttttaatccttcattttgaaggaaaacaaataaacaaaaagttgatgtggaacaaatacaatgtgcgcggatatcttaagcaacttcgttagttacagtccacacaaagcgaaaaagggctgataaacactcatggacgaagcgtcacatctcccaaatgggagcttgaagaacatggaatttacgcctgtaggatttatcaaatccaagcgaaacaccacgcaaacacaagttgtatcgcctactaaggttccaaatgccaataatggtgatgagaacgaaggccctgttaagaaaaggcagagaagaagcattgatgatacaattgactccacaaggctatttagtgaagcttcacaattcgatgacagctttccaga

SEQ ID NO: 12225 - DNA, 444 bp, Saccharomyces cerevisiae
acacaatatttttactgtcatttttttattattttccaacgttagtcaaagttgtactataaaataaaactacaaggagcaagcaaaattgaaaaaacgcatttgtatactagatgacatttaggtcattccttcaggcttcctggctatgttttattttgttccacagtttaccagaaggacataatggtattagaattttaatatatcgaggaaattaaatcagacagtataatacttataaacatctttattttctgataactaatcatagcatttacgccatacatttactttttcttttgacaccgaaagtaatcaagccacttttataattagagttagtttatagatagtatttaaaatttgtgaagatttcccatgcgttgtgccttgctttctctcaaaatacatcttgttaattttctaatgtgtggatgccga

SEQ ID NO: 12226 - DNA, 442 bp, Saccharomyces cerevisiae
gctctctgacgaacatttatctatgcatgatattaacataataaataatagtaacaataatataatacatttatttctttacgatttacgtacactgtagtcttaagggccaaaaaaggcaatagtcatcgtttatagggacataaccctaaaggttatatgcgactccttctcgaaaatgaaaatttttcacaacctttagggtacattgccctttaactactacaaaccagcttcacacatcctttggtaaaacacagtgtgacgattttaaatgacgcaaccttttgggagacacgatctaaaacccactatatatgatgatactgtttattgaatcatacaccctgttggttagaccggaagaaagctaaagttgatctccgaaaatacaacggtgcatcaaccaaagaaaacattgcaggcgtttccaagtgacact

SEQ ID NO: 12227 - DNA, 469 bp, Saccharomyces cerevisiae
gtaaagcattatttcttcttgcattaatgtggttcttccgaccatttcttcttctactcactgcagtatctaatgacacattgtactttttatatacaaatgcaacaatcgtaactataaaactaaagttcgggttgcttccgaatacatgctggcagaatttcaggttgtgtgtcacttgttaaaataggcgatattttttattttagaagttgtatataactgttaattacatagtcagtttttttttttcactatcatattgtttagattaaaaggacttgtcacatgaaatttaggtcgagcagaatacaatcccgagaaaatcaataggcaaaatagcatttatacacgtattcttaatccggatgcaggtgcaccgatcttagaaatcatagcaattctatctattttatctttttccgtgataacgtatttactacctgttaatgggtcagaaacggaaggt

SEQ ID NO: 12228 - DNA, 462 bp, Saccharomyces cerevisiae
tattttgcatataatagcattggtacatattgtggtgccactttccgtaattaagctactaaatttttgactctaacgtttataacattgaattattaaaatgatcttgctatactattttgcatacattattttttgtagttttaacaagaagacaaattcttgactttactcacaaaacataaacataaaatgtaataaagtcctcaatgttcaccgtatttttcaaaaaggatcagtgaaagtgtcggtaaagctacctttttgatactttctttttatgagaataagttgtatttctttattatgtatgatacgggcgttcaatcaatacgttttaagttcgttgctgacggctaagaaattggtaagaggagtagttccatcaatgtctaaagtgatatgataaaaactatacgatttgaagatctatgcgttcacttcacgtatccaagtttcccc

SEQ ID NO: 12229 - DNA, 412 bp, Saccharomyces cerevisiae
gcaaaacaatagtgtatatgttggatatgatatttgttgtaaattatagattagtttttttatatgtttttcttttttttgttctaactatctgattgttctttcttatttttatccaaaaacttatttaagaaaagctttttatagccaaaatgtgcaaaattcacagaagttagaagatcgtttgaaaatttctcaggtactattggagtattatttatcattttgatatgaccactgttctcttcaaaattcagaatttcatttctccaagtcaataagacagagtccatttcaattctaagggtgatattaaatttcgtaatttgcagaagacacagatatggaggccaatctgcagcatacgttcgatcaatccattttactaattcctgagtaaatgcatccgcag

SEQ ID NO: 12230 - DNA, 500 bp, Saccharomyces cerevisiae
gaaatcaaacttagacgtatctctcgtccattttcattacattttcatctttcttcattaattatatactgaacatatacgcatctatacaattttgactttttaaagaagaaaaagaaaacaatagtatacattcttttttctacttttgttacagataaaaaatcgttcttattatattacatatatcggtgctaagatcaggattttttcatgttccttccccctgttatttcacatcatccttttgccggtagattaggctggtgtaaatagtagtgcttttctcatacatacaagacatacgtgaagataagtcccattttctctccctctgtcattaattttgaaagttcgttgagcactcatgaaaactgcgtccttttgtttttttgatctgaagtaaatatgtgtgagcaagataagcacacaaagaataaaaccatcgaagtatcctttcttctttgttgtgattgaaaaaacacattttcccgagagtg

SEQ ID NO: 12231 - DNA, 481 bp, Saccharomyces cerevisiae
aaaaatgtaaaatatatatacgcaagagacaattatttgatacctgttcatttgttcaaatcatcgttcaaaatgctcccacattaacatatatttctttgaatgcgacgataataaagagttacgttgaacatgatctgagctggaagcgtccttgcgaattttcgcgaaaggaaaaagtgaaaaaatatgaaaaaaaaaaaaagagatgacattttatagatgagctttgattaaacagtgtaacacctggtcctgtaccgtaaatattcaaataagcatcaattcaaagttctttatttcttctttagcatttcaaaattatagaaaatctagaaaagatgtcagatgttacccaacagaaaaagaggaaaagatccaaaggagaagttaatccatcaaaacccacagtagacgaagaaatcacagatccatcctcaaacgaagatgaacaactagaagtttcggatgaagaagacgc

SEQ ID NO: 12232 - DNA, 469 bp, Saccharomyces cerevisiae
agatgacctcttttgtttttactagagttacaacactgtaaatatttataagctatgaataagtatatacctcaaaaaactatatctacgctaattttactatgcatacttcttacgcagggaacaaaatgaaatgtattcgcacaaaacgatttcaaattttccattatcctctatttccttctccttttcttgcttatttttaatgactggtcttcgtcttctactagtagtaatttttttcttgaagaaattggaggtttcatgcaatttgaacccttcttgatttttcctctcactggtttaatttggattggggaagggttggttaactctaggtcgtcatttgatgatgaagaaagatcgaactcatcgttaaatttggatgtttctttggatgaattaattcttgacttacttatatgatccaccttaggacactttttcataggagagtgaatggcagcag

SEQ ID NO: 12233 - DNA, 412 bp, Saccharomyces cerevisiae
aaatatataataacataagtttgcattcattaatattaatataaatcaacgtatcaaccataagaaccataatcataataattgtttaccttaatggcgatatcgccttttatcaccatcgacgataacaaacgcctattctgtctaccgtttctttttttcgctcgcaatatcagaatcgtttatcccaaagggtagttatagcaactatttaaataacttagatgtttctttaacttattccgtcatacgtacacaaacacccgctagatatagcactccttgctgtcgaacattataaaggtgcttttaaaactactaatcgtatattcagcaggtcagaacgcaaagtcggacgataaactatgttgaagctagctcgtccatttattccgcctttatcaaggaacaa

SEQ ID NO: 12234 - DNA, 409 bp, Saccharomyces cerevisiae
tgttgaacttcagccatacatatattgtgattttaattcacccgttttattactctttgaaaatacaaggtttttccccgataattttacgttttattcatttttgatacgcattttttttacttcttggctatttaggtaagtaaatactcgacacatattttagtcagataatagtaatgatatttatcttccctcttttaatttcagtgtttcagcctgactaaaaaagaatactactattcattccatttggctaattctgtttcatcaatagatattggctgatcaattttattgatgttgatatcactgcacaatccacatttctctacaatgatattttctaaatcattcaaattatgcttacttttggcctttaagaagttttccgtcttctgcctcaagt

SEQ ID NO: 12235 - DNA, 479 bp, Saccharomyces cerevisiae
tcttagtgcatcttgttacctcaatttcgaacggaagcgtgcgtgctctgagttttttgacacatgccagaagaaacgttatatattttgcatacaacgccgcccagcattagaagcacaactctcgttcgttattcctgtaaataaagttatatgtattcgaatattgctcagttagtattttcttctacttactgcacataatacttcatcttttttttcctctcacccgcaaagcaaaggggccttgcagcaatgactcaaattccattggaaaaaagaaggagatgataagatgcaaatcagaatagattttactatgaccgttacatgtaaaaagagtcataatataaaccataaatactacaaataacaccgggttcaggcatataaataaactattctcctgtaatatcccacaatattttgttataacccagacgtaatagcctcaagcgagcatccctaaatttctgcca

SEQ ID NO: 12236 - DNA, 432 bp, Saccharomyces cerevisiae
atatttgcatattgtacattaaacctaagtgacaaaataagagcgacgtttgttagatgattgtagatattgatacgtgaaataaaggatagttatgatagcatcataagatatcagcattcttttatttttataactacttaagcgtttaatcttgatttttttttttctccatatttcctaggataccgacagcgttccttttcgccctatagtgtttccttactttgtatcttctgtaaatagatggacctttgagtattgcgataaacaaaacaataacaattaagtaaccgggcatgccgttcccgtggattatgtctaggaaactgaggacattatggaatggagaatttatcaatctccccttcaacttagagctgtatagagcttttgatggaatatttaaggacacgaatgcttctctcagca

SEQ ID NO: 12237 - DNA, 413 bp, Saccharomyces cerevisiae
tttgtcataaaaaatacttgtaaatatgaatagaaacgcttgctttgttttgtcttttccaataattacacaagaatcaacaaaagtatgagatatatatatatatatatatatatatattatatttgcataaggtttaaccactgatagtaagacagaggtatatcgaggaactgtgtttacctagagtgggctgattctaatagtgcagctatatgcgaaaatgagaaaaaaggaaccgctgaattcaataatatattttggttaatggacgagaaaaagaggaatctaatggaaattatttccagttagaaccagcttagttggaagcaacaacaacttcgacatccacaccaggttcaatggtgatttgagtgattctcttaacgatttgaacaggagcttccaagtcg

SEQ ID NO: 12238 - DNA, 495 bp, Saccharomyces cerevisiae
gaactgcaatcattagttacttcttgaccaacttaaacaccttaataattaatatttaatagaacataatatagtgatataaagtatataaaaataaaaagtttacgaattaatacaatcaaattagacactgatactatcaagaagtacatcgcaggaaccgcagacatgatgtcctcttctttcaaattactggatatatatattattattattgttaccattaacgttattattattaactattactattacattaacttaaaaataaatatgaaacaacgaagaacaaaaagaattatgaaaacatttaacatgtttcaatttgttatgttttggccaacctgcgtttattcttgcatatgacatttttgtaattcatcgatgataacttggttaccctttggatccaaattcatagcaacagttagctccttgattgcatcttttttcctcccaactattctatatgtttgacccagcaaataatgggct

SEQ ID NO: 12239 - DNA, 401 bp, Saccharomyces cerevisiae
aaggtgattaatggaatgaaaacagcatataatctgatgactgagaggtctttagtttaaagattaattaaatacacataataagagtaaatacgtgaatcatggacgatatatttttatttcaatttcacagatccccattcatttcgaattttgattttgattttgattaggctgttggttcatgggtggcatcatacctggcatggggaatggtggaaagctaccaaacataggtaagggtgggaagcttggatgcattggtggagcgggagggtttggtgttccagacatactattacccatattactgttcagattagacatatttgcattgtttacgttgttgttgttatcaattatattaccgaggtttgagtctgtatcattcgcggaattca

SEQ ID NO: 12240 - DNA, 411 bp, Saccharomyces cerevisiae
ggcgagtgattatttgatattccagaagaatcattatcgtcttttaaaggaaaatatgatcgtttgcgaaaaaatagaagcactttactacttgaattgtcatagaatagtaggaaaacctacttagtcagcgaagatcaacttggaatatcgtatgatgagatggagaaaaatttaggggccgaaatggatggatccacttgagagaggatcaaggaatactgaagtgcagctgacgatccagtcagcgacatctgtctttttttaattactattgctgtgtacttatagagtcggtggcatttattttatttttagtatttttttatacgtgcgtattctattgttcatttttttaccaattttttttttatttttatattttgtttcttgcgtggagtttttacagga

SEQ ID NO: 12241 - DNA, 496 bp, Saccharomyces cerevisiae
gagtgatgtaatattaaacaatgtaattatataaatatgaaacatctacatattttaaatgtcactaatgtcattacagaggacataaagtgatttatgacacatccgtactagtagttaagtatgaacaaattttgggtttatttgccattttttttcacgcgggtttcttggatgcgcaaacccaccttttctaacaccactaagaaatatcaactttataggccatcgaagataaaggaacgtaagtttgtcaattcaacctcacattttcaacgcacattaagcacttggttcgtggagaaatgaatgatcctcgtgaaattttagcggttgatccgtacaataatattacttctgatgaagaggatgagcaagccatcgcgagagaacttgaatttatggaacgaaagaggcaggccttagtggaacgattaaaaagaaagcaagaatttaagaaaccccaggatcctaattttgaagccatcgaggtacc

SEQ ID NO: 12242 - DNA, 418 bp, Saccharomyces cerevisiae
taggaaacttcatcatttctaaagctagtatataaataatataagtatatcataaaatgtaaaatagaatattataaaaaaagtcaacctagctgtactaaaaccgcttggttcatttgctcagaatcttgcattataattacattttatttgctatacagatgagatggaagattaaatatctcacgcctgtttcgccatgcttttgtaacaccggcggattgagagacatgggcttctaatattaaatcatgtcatcgtcatcgtcgatgtcatcatcaccaattgacaaagatgagccgggtgctctgaagttagcaggttcttccacaaactgggaaaaatgaaaaacaataaaggcaacccctaaaataaaagtaaacattcccgccaatatgttgtagataccgccgaagct

SEQ ID NO: 12243 - DNA, 452 bp, Saccharomyces cerevisiae
aaattatagaagattgaaactgagcaatatggctaattacacacctggagaaaaaatcagatatgtatatataagaatattataatactgtatattaaaaatgattaaaataaagaaaaaaatgaatcgggcgtttaattgcttattatcttgaagaagcgaaagtacactatatagtaataatgtgaggttaattaaatatggatgagataatgacgaaagaaaatgcagaaatgtcgttttaaaagtaacccccataatctagtgaggttcgacgttgaaatgtgctgtccatatcttcctgctctgcccatttagtatcaacatttgagtcgaattgaaacattgatatgtcacggtcatcaccatgaggagactctgttaaacttttattgttctctttaaaactttcctcattgttattttcttgagacttttggttagggccttcc

SEQ ID NO: 12244 - DNA, 455 bp, Saccharomyces cerevisiae
aagaatattagcgtaggcttagcatgtatatagagtttacatttcttttcttttttctacgtaaccacgttgtttacgtactagtaacagaacatttggccacgtgaacaggtcatagaagcttctaccgtactcattttacataagcccggttgctagtgctattgctcgcgatccttctaagagggatcgttaatcctgctagctgtaccccggccgagccacccaatgagcactgaggagggacctccacgtgccaaacgacactcaaacggcaacaacagatcgtattgtgccgcctgaagtcgcattaattctcaacgggaagctcatccctcaacgaaaatcctagtgcgcctttcacatatgttccagaagattcgcttagtcggccagctaaagcggttcagcttttgagctaaaaatacttggaaaaaatctggccgtgaccatag

SEQ ID NO: 12245 - DNA, 475 bp, Saccharomyces cerevisiae
tagaatgctgtcctgcatattattcatgcccttcccttaccgttactcgtattatacatatcaatttctgatttacgtaacgcgtacatatcggttatatttaaataatttaatattccttttaaatcagtggtttttcatattagtagcatttctcctgaaatgatagctattgcaatagaatgaaaaaaaaaactttttgcccaaataaatcataatctaccggtaaagagaaattcggtccttgttctattcagtattatgctttctcttttttttccaaaatgagaattaaggacgtttcgaaaaagtaaaaatataccaaatgtggaatataaataggtttatcggcggaccgatctggcttaaaacgtagaatctaccagtccaatgtactttgatgaagaacaattgctaaaatatactatatatgcctatagattatccttttttgtaggcatttgctcacttttca

SEQ ID NO: 12246 - DNA, 492 bp, Saccharomyces cerevisiae
tggtaaggcgcaaatatccaaaagggattgtaggcggctagaaggagatgagatctcgacccatttttctcagcgccggtagtagctatcagtaaggagtaagcgggtttccttcaagattcagtccaccccctactttgagtgagggacatataaacaaacgcgataactcgatgaacccattctaatataaaaaaactgtataaatagttatatagagatgaactctaagctagtgaggcccactgtaaacagccatttttcaatatgcgctacccggcggcggaatatcgtcccagctacatgatagccgcttttttgtctctctttgtcccacctgttcaaagacatttggtaatcagtttgtcaggacaatagtaaacaaaagtgcgcaagtacacatgcgctgcacgtgcggccggaacaatggcgcttttggctcgtccggatgatgcgaaagggaaaataaaatctcgcaatcggaaaaacact

SEQ ID NO: 12247 - DNA, 483 bp, Saccharomyces cerevisiae
agaatgtagtaactttgcttttcttgttacagaattgtattattataagtattattaatcaaacgggaaggacaaaaaatttaacaaacgcagaagcaactaaatcaagactaaagagaacgtaaaaaaagtcatgcacttctttgagatacacgttaccaaaagaatacaaaatgtttatcaccaacactgatagatcttgtttctatttggactaattcgcaatttgacatatatgacatatattacggagaatttttaaatatgcttatattacatgtgtataatttacgtattcttgaaggttttgaaaggttcagacgcctcaatttttcctatattactttctattatctttattacaatcgcagatagcgaactttgcaaagtagtatgaggaatctgattaggtatgttcatattactatcaagcatccttagctgcaaaagtttgtcatgctcccaaaacccatctgcgattct

SEQ ID NO: 12248 - DNA, 406 bp, Saccharomyces cerevisiae
ttggtcattgttaaggctaaaggttctgcagacacgttttgtacgtagaaagaagcaatcatgccaaatcaaaattaggaaatgaacatcagtggtattttataagcctgcacattatatatagtatatacgtcacgaatacaggaacaccgtcagttagagaaacgtcgcctcagtttgctcctcagatattcctttaaacccatacatatcttacacaaaacatccgtacatcagaaggattatatgaaacgcaaaaaaaaataaaattttcatttctgcgtgtcgcgcgaaggagaaatcttagaattgaaacttccggctaacggttgctaaaactagtttccaatgtaataccaaataagcatttgatgttgaatctgtaagccccttcgtgatatttcaa

SEQ ID NO: 12249 - DNA, 439 bp, Saccharomyces cerevisiae
actttagatagatatttagcatatccgtatgtaacattatattagttctttagggcaaattgaaaaatttaatcatcttttcttattcttaaaagcgtgaaaatcaaaaaaaaaaatcgatgagttgagaacatatgataaataaaaacaagcaaggtgatcgtcaaactgcactcacgcacacatagatttttagctcccaaagtgctatcgtctatactatccaagtttttacaggctcgcaataagctcaataaacaatatcaactgcatatgactgaacctgccctgagtagcgctaataacgctctgatgcaaaaactaacaggtcgacaactttttgacaagatcggccgtcctactaggatcgttgcaccaatggtagaccaatccgaattagcatggcgtattctatcgagaagatacggtgcaaccttgg

SEQ ID NO: 12250 - DNA, 457 bp, Saccharomyces cerevisiae
gctttctctcgataagtttgttcatgtatatatcaaaaaacattgcccttcatggaaatatgtaaattcaaaactcacttatggggcatataagtatataatttagagtacaataagtaggattgtgctgaatattgtcagcccttgggtccctttttttgccctccgcgtatttcttgtggaaaataaggaaatttcattttcacttcaactagctagtttaattgcatgatggactcaaaaacattgacagcatcaatggtaatgcaggaggagaagaagcggcaacaacctgtgacaagaagagtaaggtcattttctgagtcctttaaaaaccttttcaggccgcctcgttcaagagattcaagtcctattaatgtcacccgaattccttatcgatcgtcttctacctcacccaagagaagctctgagccaccaagacgatcaaccgtatccg

SEQ ID NO: 12251 - DNA, 455 bp, Saccharomyces cerevisiae
ataaaataagtaacaacgaacattatatagactatcgatgataaacaaactaaaaaaatgtcatttttttatttttttcttgcctctggagtctttctggtttcccaacatatttactatatttctcttctctctgtttccctctcttttgggtgacaaattagcttcttctctcttcactcggtcacctatacttccttcctctggtaaagttgtttcctcttgttcttcattcttttttaatccatcataggaattccttttgaggcttttcttttgattaaaaacatcttcgcctttcaacgatttgtcaccctttacacctcgattatcaataccttgttcgttatcattttctagcaaggcttcttctttttctctctttacgctgaacatgtccgaatcctctttcaaaagcggttttatcagccgctctccggtgttggtagtcttcc

SEQ ID NO: 12252 - DNA, 407 bp, Saccharomyces cerevisiae
taacaccatttttctttccttttaatttcctcatttttttttttttcgttatttcccttaaaaacctgttggcggttttctttctttttctttgccttctgtataaataacaaataaacatcattcccctttcaagatttataaccataaagggaacatatataacataaatcatgaagaggacaaattacggacaattattctgtagcgatgctaatcagtataaaataaaagaataaaaattcttaagttgttaatatgccagagaaatgttacagcttgtaactcttcaataatgaatttctatgttatatgactggctgtttcatataagctataacagggatcatgatcattaagcattttctctgcaacatttatgtcgtacactgcgaaccacgattaaa

SEQ ID NO: 12253 - DNA, 493 bp, Saccharomyces cerevisiae
gcagtatcctgtacaattttatgctctctgaaagcttctatctggcacccgtttatatacgccaatacttatgtattttatctatctaatgaaaccacagtatttatcatgcctaagctgattctttttcgtcgcggctgtttccggggtctgttttccgagacttcgaagtgggagaacatgcaaaagagacgagtcttcaactaagaagttctccgtcattaaaagtcatgcgtttgcacgtttgcaataaaaagaggtgtatctacatatacaggttaacgattgcaacagcgactcttgatattatctctgtcaagtttcttccttttgttagactaatttagtatcatttacacactcggacgttaaattccgcctccctcataacagttcctgtgtttgttcattgataatcgatcgcagtttagtaagttcttttacttttgcaataattttgttcaacatgttttccagactgccaacatcattg

SEQ ID NO: 12254 - DNA, 486 bp, Saccharomyces cerevisiae
gcgtaaacaattaacccgtcttattaagtaaatggcagcttagatatttataaagttgtataatagaagtaataaaattatttgaaaagttattcgtcaatttcagcttattcctctggcgtgaatatcattaccataatccaaattcgagtaagcgaataaaacgggtatattaaagaaatataagaatgaatataagtttaacttaagatctaattgcgattctttttacatattgtatatttacagacagaactatgaaatgccttattttcttaattatttcatgtggagaagcattagtgtagtacagttcacattaatcctattgcctggcaccgtctaatggctttcgatagtcttctttgattctttgccgataagcctgtgatatccctatgttggattcttcccgtggaggtcacatatcttgaaagtattcttggtcttgcataaaattctagtggatttgcaccggacttcatt

SEQ ID NO: 12255 - DNA, 473 bp, Saccharomyces cerevisiae
gtttaaaagagataaaagacgagaaaaaataaaaacaacggcaccagaaccaaaaatcaaaattaagtagtattctttatgtgcatttttccctttaaattataacctttctatcggtatagtgtgtatatgttcagccctatataagaatttactctaaagaggtggaaggcaagagtcttgattcttcccatataatattactgcattttctgtattaaacatgttttctatttgccgaataagcataaacgtatcattgttcctttccctttatttaagctccataccgatcatggaaaagctctccaacgaccttgaaacgaaaaaccgttccttggcgatatgacgtttagctccttgtcaaattcttccgtgctaccacgttgctaccactgatatgaaacaagtacgatccctgaacggaacagcgcctaaaaatagatgggcactcacttttcctttttcgctgc

SEQ ID NO: 12256 - DNA, 491 bp, Saccharomyces cerevisiae
gagcaacacagtttatcttatatgtattcaatgtatagatttcaaaatatagagtttaaatatcattcaaaatattcaataaatttttcctttgaaaatttaggccactaaaaaattataagagccaaaacgaagtagatacaataataaaaataatatagtcatatcttaaactttttgtgtaaaatcactcctcattgttaaccttggtaataagtttacctttattaacaccgctaaatagacccttccatatcaatggaacattcttgaacttatcaccggtaccatcttcaagggtagcggatttcaagaggtcaatcttaccatgcttaaccagagaacccaatttatctaatgcctttggaaaatcatcaatattatctgtcactagtactcctttaacgaccaatcgtttagtcagaataaagctataccccttaaagacaaatttagatggatcattataggcacttatagcaccacaggct

SEQ ID NO: 12257 - DNA, 429 bp, Saccharomyces cerevisiae
aaaaagttcgcttcttaaccatattagaaatctagaagaaataaaaaaaatctggcattagatatatattttgactgtaggccttctgtatattatataatactactaataacatcaaatgtttgtgacttttcgggtaaccgggcttcgttctactgttccactttttgtatgtttaatgaaaatatcatcaaagaaataggtatataattgataacaagagaatcgcgggccgttgctacaggatattctgcagagtcgaagaatgagatttgtgttcgatgaggttttcaattcagatactgattctccagaatttgaggaaacatgttctacaacatcttctacgtcatcgcaatgccctacacctgagccgagcccagcaataaagttaccttcattcacgaaagttggcacgaagaaattggt

SEQ ID NO: 12258 - DNA, 467 bp, Saccharomyces cerevisiae
tcatcatgaacagtttggaaccaaaaaagctcgtgtaagtatcacttttagtttacttttgcttccctctgtgtatattctttatatatgtatttattattttaattgaaatcgcgaaatttcacataagcaacactaatatcaaaaaactaagcaaacaacataaggaaagttatagccatggtacgtcgatggattcctagtggcaggcatcttcgcaataatgacaacactggtgatgatgacgacagcgagttcacaaactcgatggattctgggatgtccataccatcactcagggactccatgaccacgaggtcatctcataacgatcccatcaagcctgctctgatgaacgattccaacaaagtcaaaaatttggagaaggagttgactaatgccaaaatcaagattcaagtactctatgaatacattcgcagaatccctaataaagacggcaatgcacc

SEQ ID NO: 12259 - DNA, 442 bp, Saccharomyces cerevisiae
aagtgatggttatacgcgcacatgtatataaggagaacttttggcagttcgatacactgacttcacggagaacaaataatactaatctgaaaaataatcaaagaattttttttataattttatcgttagatatctcttatctacacacccctcaattgaatagcgtctaccaaagctcttgagagaccatttacgtcttggggcttgaaatcatcacttaatttatagatctaataggtaaaaacaaaataaaaggaaaacaaaggtgaagttagtacaatgtgtttctggtgaggctgttgaagtttttacctcgaatttattattaaaacatacttttcttatgagcgcttcgtcataaaatctcgataaattgtcatcattaaactcgatctcttgtccttttactatagaagtcataatcgtcctcaattgctctttg

SEQ ID NO: 12260 - DNA, 495 bp, Saccharomyces cerevisiae
acatagactgaaaatcaaaaatctcttttggactgccatttaatcttttccatgtgtgtatattgttctcatttacattaatttcataaatacggatacgtctttctgtacctccatagccagcataaccaccttctccacctccaccgccatagcatagccagattttgttcggcgtagagtcatctcgaagacagtaatcgttacaatggtcatgtccgcaactgacgacatccacacttaacctatccaaagttgttatcccctcagaattatacttaggtgcagtaacaccttctttgtacattccaatgaggggatttttctctccgggatgtgtcttggattcaatattcaagtattctggcagtgggatgtgaaaaaatgccattgaaagacctgttttgaacttcaagttcacatcatgataatcttcaatgtatttccactgtgattccttaatccaatcatatccaggataaattttaccaaccg

SEQ ID NO: 12261 - DNA, 482 bp, Saccharomyces cerevisiae
tttcaactttttctataattttcatgcatacataaatctgatatcgaaataaaaattacattacacggtaaaaaaaatgttttcaaagcttttgatcgtaagcgattgaaaaaatataacgaatactccgatacggggagtcgaaccccggtctccacggtgaaagcgtgatgtgatagccgttacactatatcggattaaattcatgaattttttagggctccgaatattgtaaattcgttaacaattcaagcaactcatttaaacaagtaatcaataaagtcaaaatatataaacaaattaagatcgctgccaaagtagtgatcaaccaagagacattaaggttgttatctcgtggaccacaacgcacctagatgcatgcaaacataacaacagtggaattcatttgttagatttgaatttgccttaacattgcggttcgtaagttttctaggtgacagataccggagaaaggtgaatcg

SEQ ID NO: 12262 - DNA, 414 bp, Saccharomyces cerevisiae
gtttttagtgagttattggctcatattaacatatatattcccataaaacatttgacagaaaggtaataattaaaggatagtcatgtagatacaaacgaaaattttatgtttttttcttcgttttgcgaaaattcgcatgagtgtctctgtatatatatataacaaaaagatgaaaaaagggaaggtagaaaaaaccgcgctaagttttggcagtgacggtgactgtcttgtacttggtctcggtgaccgttgtggtaataacgtctagcggattcagttctctcttgcctttagaagatgagccgctaccaacatcaaaaacttcgatgttggccttggcgccgtttctggcggtgacaacacaaaagtttccaccaccagccccggaagaaccaccgccagaacttgtcactt

SEQ ID NO: 12263 - DNA, 419 bp, Saccharomyces cerevisiae
gcatgaaccggttagttctcatttataatgtataatatacccgaatcttatttatttacctttcctattttttgacgaccagtaaatactaatacataattaggaacaaaagttaaataaaaaaaaaaataataatttaacgcatccaattaacgtgtccttttttcatcattaatttatctactatttcgatttaaattccatatacaataaatcctagatacattcccgaaagcatcttttagcgaaacatcttccttgagctgctagcagtgggcttagtccacctgttagttactcttggtataccactaggtcttttcgaggcaggaacatgggtctttcttactcttccgttatttgaaattcctgccgaaggaacgggccttctaccagattgcacaccgtaccttggattt

SEQ ID NO: 12264 - DNA, 470 bp, Saccharomyces cerevisiae
ctgggttaagtgtaaagtaacaacactatacatatttattgtaaagaaatttgggattgagaagctttgctatatacttggaactgggctggattttctcgacatacatttcttttacgttttaatttgtttctatattctcctctttaaatttatttatattaatgaatttcaaactagtttctttttctattgccaagaggcccatcaggtgatccatgataacctttattcgcattgaatcgtttttcattggatctaattcgtcatttggtcgccgcctttctttgctccttctgcttttttctttttctctttgactatcaggtcataagatcttctcctccattatgcccaagtgtttttcttttttttgcctttatataaattacaaaatacatacatatacttctcgtgcagtatactggaatcagctttataccatatgaagcacaacttggatcaggacc

SEQ ID NO: 12265 - DNA, 475 bp, Saccharomyces cerevisiae
tttttcgttcaaataaatataaagcaggccttggtttatgataaggtaccaatgatgaagatatttcgcatatagctaatactgttcgaaaattagataatcttatagagaaactattatcattgtttactatattattcatgttttcttttaattatcgagcttttgaaggtgaggtagtttaggaagtgaggctgataagtaaaaattggattttagggaaaactagatccaggattggtactattttcttttgttattgcagtttatcaccattattattattattattattattattattattattattattattattattattattatcatatataaatacacacataaacgttttaagcttatgttcagcaagtgctgtagccacgatattatagaatataaatcaaagataacgttttcattcagaggggtaatttaaaggtaggtatttcccaaatagctgagcatc

SEQ ID NO: 12266 - DNA, 481 bp, Saccharomyces cerevisiae
taattacctaacgtcacccactgaaatattaagagaattgcatgaatctagcagaatgggaatgtgacatggtagcagcaaccgcaaggtgtggcatagattatagtagtgacaaaactgtacaattactatatagtgagatataatacaatggtttattcaagatatattaacccccgggtaatggaccaaatttggaaaagtctcggattctcataaaagcttaataaataaagagtatttcgaaacaaacacgacaattacacttgcaagtcagtagagaaacccagtacagagcaagcaaaagatgatctctgatgaacagctgaactccttggccatcaccttcggtattgtgatgatgactttaattgtcatttaccatgctgttgactccaccatgtctcctaagaactaaagtggttacatttggatagcgaacttcagtttttattatacgtcgctttgtgtttctgcaaaa

SEQ ID NO: 12267 - DNA, 428 bp, Saccharomyces cerevisiae
gtgttcctcaatatggctgtttttgaacttttcttttccttgatggatgaaaaaaaaaagatgagagcggtcatgaatatagaaacgataaccatttattctcacacactaaaagaactacacgacaaccagatgtgtctctgcatactgtaggaataccattctcttccaaaataatagaaaataatatatatatatcttttgtttactcttcaagacgataaaggaagtatgtagatgttacatcgtgcgatataagagacttgtatactataagaaagagcttagatgaagggtatgcctttattttttcagaaaaatacaccctagtaattatataacggtaaaaaatgctatttacaaattctctaatgacactatttattttacatcataaatttttggagacgcccttgtagcttttcttg

SEQ ID NO: 12268 - DNA, 410 bp, Saccharomyces cerevisiae
ttatcataaataccaacttttgcgtcataaaagtacaaagtaactaccaatacataatcttcaacgtactgtccataggttgtcgtggccaaagatgatagcgcctatagcgtgtcttccaagtaaagccaaaattccaatgcagaattgcaacttcaagattgtattgcacaatttgtcttccctcatagggccaaaccatactaatgtcaagtttattaacgtcatattagaggtgctaataatctcattattttcatcaaattccaggtcaatcaaatggagacagtatagtaacttcaagatcggtttaaaaatgctctttggcggttcttcttttaagtttgctcttgatggatacattaaaccgtctttttcattaaatttaggtaacctatgtctcgggcagg

SEQ ID NO: 12269 - DNA, 464 bp, Saccharomyces cerevisiae
tttgtttgagtagctgtgattgtaaatttttttatttctacttgagcgggcgggctctcatttttttttttggggttttatttaggtcggattattcataaagatggcatttatatacatttttacgcaattaccctcatattcttacacatacggagaagtcattgttatatcttcttgccttcacattgttatcggtgattttctttctttattgattgattagttatataaattattgctattaaaatacataaaaggggaagtaaaaacgtgcacggcgcagatcaacttcacaattacaaaacaacgttcttggccaatttgttcttatattgcaaaatggatccgtcccatctggtagcggtcttgttttccacaacgaaaatatcttgggcaattttgtctaataatctgaaatcatgcgaaacgacgacgacaccaccgttaaattcgttgatggc

SEQ ID NO: 12270 - DNA, 473 bp, Saccharomyces cerevisiae
acgacatgtgttcaaatactgcttaattaatttctcagaaatccatatatatatatatatattgctcctcattgcaactttgtaaatttaatgttcctttaatttatcattatttacaatattaactaatccatctcccgattttcggcataaaataagtttatattttggtctacatgaaaacaaaagtttaactaaactaacgtgtacaaaccactttgaaacgtatataaaggtctaataaaaacgactggcgttttgaaagataatataatgatctaatgcagttaaaaaatttacaaattataagaagaaaagaaaaacaacgattacggtaaaaaatgaaaactccctctcctttctaggtacgataaattatgactttcatctttcccgttttgaagatctatttatctcaatttgcccagactttttttttatatatatttattttcccctctctaacaactgca

SEQ ID NO: 12271 - DNA, 487 bp, Saccharomyces cerevisiae
ttctaacctgtaactgacaatagcattagagaaatgaaagtcttaaataaaattccgataaagaaaaacttatttaattaattaatataattacaagactaaaaagcattatttccccttcgcgttttacttctcctgctcagacgtctgcgttatttctgaaaaaggcctgtggacaatgctaaaagagtagtcaaattattgattagttcctctattgccgcaggaccagaatttcctgtggttgacagtgttgtctgcacaaggggcattctggcctctctttacaccagctcataagacaactccaacaaaatagatgtccacatggcgcgcagctaggatcactcatgttcatgagacataggatgcattttctcgaggcttctggaataaatggcaattggtttttatctgacaaatttatatgagtcagctgcgattccttcggtatgccttctatagattcatgttctgaacgctcctg

SEQ ID NO: 12272 - DNA, 491 bp, Saccharomyces cerevisiae
atgatcaaaaacttttcttcaccacacaaaaaatgttaattgatgcgcgaaatatctttttcgacttatgccttcttctttatcataacaaagctatgtacctacgacgaaatgaagatattaatccagtccagccttaagaaaatacgagaaaaaaaatgctcaagtgttaaacaatgcctgtatgtagttatctgtgaaatgcatcaaatcatggtcagggtttgcttattgatcagatttgtagttttcaggtatctaagataaaaatatatggtaaatacctttaacgaatattataaaatctactgggttattctattggaatctagaaaatcggaaaagttttgtattctgatatctcttgtgctatgtggtgtcaacacatgtccacgaaaaggtacactaccctggacactaacaacactttccagtggtggtgactgtactgtggtaagggatctttgcgaagaggaagcaggctggtagtg

SEQ ID NO: 12273 - DNA, 500 bp, Saccharomyces cerevisiae
cccttttaagtaggtaaccccccctggattgcatagccattgcatagccttagacatcaaactttatttaatcacattatccttctatgtatctttttcccccgctcgatttcttctagaacattacggaaaataaaggaaaaaaatgactggagcatcgaatctgtagactaaaaaggtaatgacgcgttcttcgttcccacaagtatgtgaaatcgtttgaacgcttttatatactgataggaatagattataatagtattcaacattcatcaaacagtttatatcggtaataaaccaacctcacgatacagtgattatttctctaaacaacacgagccgtactgtacctacgataaagtaaaacacatttttcttttgctaccagtggacacaagataacggagaatgcaacaaaacacgtctttatatgactctttgaacgttactgccgctgcatccacatctgagattaagaaagcttacaggaacgctgcatt

SEQ ID NO: 12274 - DNA, 445 bp, Saccharomyces cerevisiae
aagcttaactatcacgtacattttctgcatatttcaaagaaccttggatgtatatgaaaaaaagttcacaggatatatggcttaataagtagtttatttacgattttttaatccagtagaggcatgatagaagacgacaacggaatcattgagcgttggaggcatttttacaatggctcagtaatcacgaataaaagtaggtggaagttgaaatctattattacatattaaaaacttcagaaatacttgaggctatatattgttgtacacttaaccaatcgtataacggagcattggaacaagaaagctgagtagaaaacaggttacgaaagttgtttgttggctcatttgttcaaagtcattaacgaagcgataaaagtaataattaatcttgcacgaacttcgttgatatcttctggcaccaaccaaatcaaagcacccaact

SEQ ID NO: 12275 - DNA, 458 bp, Saccharomyces cerevisiae
tttaacgcttcctgggaactgcagctctttttttactcgctgatatacattttaaatattctagcaactgtgtatgaaaacttacgtacttttatacgggaaactaataatgactacaatgatattgaatactggccgcttcgaagagtggtataaagtttgtatcattgcattaaaagaaaaagaaatatatgtcccatcatcgccaatcgcaatgttgaatggtcgtttaccacttttgcggctgggcatatgcagaaacatgctgtcccgtccccgactggctaaactgccatctataaggtttcggtctttggtcaccccttcttcatcgcagctcattcctctcagtcggttgtgtttaaggtcacctgcagttggaaaatcactaattttacaaagttttagatgtaattcatccaaaacagttccagaaacttctctgccttcagcctctc

SEQ ID NO: 12276 - DNA, 496 bp, Saccharomyces cerevisiae
tgtgtttaagattgactgagcattgcaatattttaccttcttctcacttgttctatagaattttttacccaaaaataagagataaagagtttgaaagaaacatcattacatatatatatatatacgggcagctccgtaactcgaaaagagtgacagctgttttactctgtaatagctgacgattcttcagtgattggaataacctcagaactcaccggtacgggtaacgtttgtatctcgcggattaacttttcgcatttcgacctactgagagaagaagttccttttgttaatctgtacctttatcttgaaagcagtcgttacagaggaacagcattgggaatcaccaacaaaataagaggaataagctcatccagtccacttcttatccatatagaaaccccttctgtatcaattcaaattaagtgatgtcttctagaaaaaaaaatattttgaaagtaatcatcctaggtgactctggtgttgggaagacctc

SEQ ID NO: 12277 - DNA, 412 bp, Saccharomyces cerevisiae
taaggcagactgtgtcgtgtacatcatccaatataactatatatataactgtttcctttctttttcgtatttacctaaatgcatatattattcagttcccactaattttgtactacaataataagagaatcccttccctgttttagaaatgagtagttcttttctttttcataaataatacagttgtctctgagaagcctaataagaaaaaaagaggttaataaattattattattggttatttctttccgccacgtagttttctttctctttcatacttgtttttttccgcaccttcttcggtattaatagtgttaacaatatgagccatctttgcatggtagtcgctgctctccttgttcttttcttcaattctttgtctagcttcaaatttggcgtctttacggatttc

SEQ ID NO: 12278 - DNA, 485 bp, Saccharomyces cerevisiae
gtacacattgcaaactaaatagcacgtaatttatttttactttacaaatttatagaaaatattctcgcttatcaccaatgttcacgaatcatcttcacctcttctaagggccggtgacaaaggtgcataatgttagaaaaattgaccgatgagtaaatttatagagggaataaccaaatgaaaagatctaggtgacagaaacgccaattgacctctgtagaaataaagttctttcattatgacagcagaagatatactccttcgagaaagaacatctactacgacacaacgccctgtcaatagcgaacaataccttaatgtgcaattagccacagccccagtaaaaaattttcagactacaagcgagattagccggcaaactcttgtagacacatcaaatgatgacgtttattccatcaagaatttgaagggctcgaggaaccccattagccctagtgtttctaacgttggcttccaatccatat

SEQ ID NO: 12279 - DNA, 488 bp, Saccharomyces cerevisiae
cccttttgcatacctcccgttcaattgctgggtaaaggcaatgtctccgacttcccacgtttgtatttattatccatttatatacatcaagacatattattaagtgtataggcgtgactttgactatatatttgatttgtaacgaaagaatacatcaaaattcaactatgaaatggttattattgtgcatgcacatcttgaattatcaaaaaggtcttaaatgttcttcggactttcttgaaatcttcgaaaactgatgagaattcttcattatttttttttttcttcttttattattttttatgtttattccatatatacacttataatttttttttttgcgattaatataagtttgcctggatacacgaacatatatatgattaaaatggttgtctcgaacaaaaaaattcactttttagaggggtttcttatttattcgtatatgtacgtaattttgatgtttaggaaaaattcacggaaaagaa

SEQ ID NO: 12280 - DNA, 460 bp, Saccharomyces cerevisiae
gcagaagttgatgttacctagatgtgagagaatcttagtgtggctgcagtatgtaggtttttcttgtaaatattatacctattttgtttgccttgtatatgaagagatgaaataacaaatcgatatccattacttgaattgattttttatcaacattaattgtaatttctttataacatcttattggatatcatacgaatgtttttaaattacaaaatcattaaatcataaaatgttcagtgagtacaatctcccaaagtctacgtttactgtaatttatcgctatttacagggacgctgcagcttaaatattagcgcctaagttagtcgaagcattctgtcttgcccaattctggacagtagcagcggtctttaaacccaccccactcggccaacatttctaatttttcctttggctctaagaaatattctccgcttaatacaaaggtcccccaatgaa

SEQ ID NO: 12281 - DNA, 404 bp, Saccharomyces cerevisiae
gtctaagagatatttgaaacgatttgtatataaaaatatcagttttgcttacataaatagctatttgtatgtaattattaccattgtctcctatattggaattttaaaaaattttcttttaagatgatactgttactaaacaataatgttaaatatagtaaccaagctttgataattcgacgtacaaaaaagattacttttcttaaagaagttgcccgcttgctgggaaaagaggtaaataagaattggtttacatgaagattttttaatatattaatacttttatatgcttgattatttttttttactagctttctgtgacgtgtattctactgagactttctggtatcattttttcttgaaatcttttattaatgatgcaaatccaccacttggcttcttct

SEQ ID NO: 12282 - DNA, 453 bp, Saccharomyces cerevisiae
tcgctattgcctccgtctccaaaaattaaccttttttagtatcttcgagaagtaccaataataagctttctcgacagtataaggagttttttattgaatatgcaccatcgctatctctaggttttgtaattgatgactgaataagagtgcaatttttttttttttttttttttgatttttttcttttgatatattatatatattaataaatgtacatacaaaacttatttgcaaatctatttattttgcgcggtcgatcatgaattttgccctacttttgagatgggagcattttatgacgattaaaatacaaaaaagccattgtcttccaagaataggacaactttttgtacaatatgtgaaataggttcatccgctgactctagctgaatatcggctgagcttgaggtatctaataagtaaacgttttgcttgccaacaacagagtccttg

SEQ ID NO: 12283 - DNA, 490 bp, Saccharomyces cerevisiae
ccactttttgtcttatgagtgctttcttgtatatgcgtatatgtcgtcatattttcagccattattacttgtacataaaatattctacataaatttatatatcccatgaaagagccatggtcacgttgggcacatttcttgaatactcgtttgcaaggcttatttttctgtcttttcacatctttctattttagtgcgagaaatgcaggacctatgaaaaattggtaacaaaaataattaaaagtaaatgctataaaattgtgggtaaataaaagtggaacaagagctgagttcacaactctacactctatatggacaatattcgaattaagcgcaattgataaatcacaactcattgaccatggaatgttttgtaccgctgcgttgcgacttagatggaagtaatatagaacagttacgtcaatcacacttaagccgtaaatttattatatttgatgagcaactgaatctttggctgtggtttcaaggt

SEQ ID NO: 12284 - DNA, 429 bp, Saccharomyces cerevisiae
aggataatggaaaatttgaaatcgttttgtgcgaatacatttcattttgttccctgcgtaagaagtatgcatagtaaaattagcgtagatatagttttttgaggtatatacttattcatagcttataaatatttacagtgttgtaactctagtaaaaacaaaagaggtcatctagattgcattctccttattttatcactgatatcgtcttcttcaagaaagtgcaggatcttggtgcacgacttaggatcaccaactttctcaatatgaagtactggtatgtcgaagcaatattccttccaccattttgcgtttcttcggtcagttatgttgactatctctagtgaaactgctttattatgaaattcctttctttcaaatacatcatctatcacttcctttgcttgatcgcataacccacaattaggc

SEQ ID NO: 12285 - DNA, 436 bp, Saccharomyces cerevisiae
tttatattcgtatattggtaaatcatcatatttattgttagattaatgaaatggttatgaaaacatttgtaaactgccagctgtgaaattgttaaataaaatcgacactgtatataattgcgcttcatattttacatgtaagtatgatctatgttttacgtaggagaaagagctttctttattggtcatcccactgcaagcggttatgaaaaatttctgcagcatcgctttaggggagtactgccggcatgttggaaaaacatctcgaaacatatattgaatctcagaattaaccagtattcgaagcaaagaaaaaaatatttcgaagatagataaatacctcaagacgaacctgtcttttatatgttaagatttgatatctaatctcaccagactttcaagttttatctcacaacctcgcgtttgccataatttt

SEQ ID NO: 12286 - DNA, 497 bp, Saccharomyces cerevisiae
ttctgatgccccagattattatatcaatgctatgcttcaaaacattgtcgggcttgaaatcagtattacccatattcaatcaaagttcaaattcgaccaaaataaatcacagattaatgttgaaggcatatgttgaaaattcaaagaatttggtggagaaagaggccaagaaatggctcgccttgtaaaagataactatccaggtagcttataagttttgtattttctctgcgcattaaatatcaataattatttattcgttttcattcttttcttatcttatcttttaatattgacttaacagagggcaaggcccaccgtgatgcagaaagaacacaaacgcaaaggtttacctattccctgcagttagaaaaccatgtttggaggaaatgaagaaagatatttacagttgagtttacaacgaagtattatcctttttaacgaacgctaatatcatcggtttcttcatgtttatatgatgacgattttcccaaatg

SEQ ID NO: 12287 - DNA, 451 bp, Saccharomyces cerevisiae
aaatgattggtcgtaaaagctgcaaaagatgtatgtaattcagcggtgatgttaactttaaaagtgcagtttcgttttctttttcgtctccctatttttttctctggatcttttttttttttttcacttggtattgttttcatccttctttccttcttttaccttctttgtctcctaatataacaatacatactttcgagttttgattacaagtcactcgaaatgtttttttccttttatatattcttccttttgtctattcttatatacacatattttaatttttggtagatttttttttttttacttacattttgttacaatagagagatttaccaatggtgtatctcgattaaatacttatctagagcattgagcaatttctttaggtcatgtctgctaatttcctctttgatgataaccaattccatggggacctttccattgaagt

SEQ ID NO: 12288 - DNA, 454 bp, Saccharomyces cerevisiae
gaaatgaaataatgacctgcaacagtccttcttgagatggaatgaagtaattgctctttgaacgagagcacaaaagcaagcagaagtcgcgtatgtcaagcccatgatatagctgcttagatatataggtagatataaataagcacaatggctacagtaattgtgcggtgcagggaggcaatgtttagtgcatctcctctacatcatttctatttttaatctcgtccacgagaacgatttaaggaaatggggcttcaaaaataaaaaaatcaaatgaaagtaataatctttcagcttagacttatttttagttgaaacacttgaataagagtgcagacactcaatcgtggtgtagctacaagaacatatggtggcgtgtttctgctgcaactgtcaagatcgtctgtgtcttaatgaggtgatatatagaactgctgaatacggagccgtttgt

SEQ ID NO: 12289 - DNA, 431 bp, Saccharomyces cerevisiae
gcaaataaaaaaatatccagtattacttgtatcaaaaatcttattttggcattttcacaacaaaatatataaatatagaaatagcaccttgggatttcaatccaacatcggaccctctaattcactcacagcgtaagggtatgcatacgactcttcctcattggcagaattcaccgtagaattgtctctttcgtactcgcgaattgaactcaatgcgatatattttgacaacggcaaatagttcttctcgaaatcatataggaaacataatgtcactactggaagcgggaaaaggcaagatgacaaaacccatcctccttcgaatcctgccagtgttcctgtcattgttaattgaaacaatagcaatccaacgatgattcttctaaaaattaatggccatacttttcctgtagaatggggcaaatgatctg

SEQ ID NO: 12290 - DNA, 446 bp, Saccharomyces cerevisiae
ttttcatatgtacacatacaagtgaccccttcttctaccccatccagttattattccatctacatatttaaaaaataatctgtaaataataagcccatgaaatatcaatctcacaatgaaagaattgtataattcagaatgatttgacgtaaaagcaagtctcattcaagaaactgtaaaatccgtacacactactgaattttacatccatacatttttttgaaatttcatgtttttttgaaaaattggaaaagggctaaattatccgtcggggtgtcctcctagctcggctcaacctaggcaaatgcgtttactggggccatccaagctcatccttccagagattcgcctttcagaggcaaagaactcgtctccgcaggcctcttgttccgggaggaggagaattcttgcgcggaaactggttgatgcctgggctatggtaattc

SEQ ID NO: 12291 - DNA, 414 bp, Saccharomyces cerevisiae
taaatgatatacagccagcgtaagtacgtgtaaatagccaagtaagaaataatgatgtcctagtgcagccacaatcaatttcactttttcatatatatttttccaccttattatcacaaggtgcacctttatcgtgtgccacggcggtaaaaaactaccttcaggggtacgatacattctgtgctggcgaccacggggctgacagagacacccgtagaggctacattactgatttgggaaatttcccaaattggaaatatcacctcgtcgacgtgctgcggtgcatggctgttttacccgtttaggaaaaaactcggcgggttttcttgacgggcaaatgtcgccattcgtctcgtttgaacgcttggcctgtaaaacagctaactcattcactatctctatcctgcgaccgtg

SEQ ID NO: 12292 - DNA, 459 bp, Saccharomyces cerevisiae
ccgaacctgaccactattgtttttcgcattatattcttattcctatttatttatcttttattttttttctgtgctggcctcgattgattacttttgcaagagtttgtagggaaggaaaacagacaagtcattcttttctttctttttgacctttatcataattttctatttgtataatttgaaaaaatagttttacatatttatgtagtgtcaaactaaaataaaaacaaacttaaaaaaagagttatagaaaatgtatgtggagaataagacaggcagaccttgagtgaactaggaatagtacaatattacctttaggaggtgccacgtactacccctttgcttctattcttctatggtttctttatagcaggataaaagaataaatcagataatgaatctcgacatgttgaggacaaaagtgtttgcaactactgttgctcgaatatctgggattcg

SEQ ID NO: 12293 - DNA, 450 bp, Saccharomyces cerevisiae
caccattggtaaatctctctattgtaacaaaatgtaagtaaaaaaaaaaaaatctaccaaaaattaaaatatgtgtatataagaatagacaaaaggaagaatatataaaaggaaaaaaacatttcgagtgacttgtaatcaaaactcgaaagtatgtattgttatattaggagacaaagaaggtaaaagaaggaaagaaggatgaaaacaataccaagtgaaaaaaaaaaaaaagatccagagaaaaaaatagggagacgaaaaagaaaacgaaactgcacttttaaagttaacatcaccgctgaattacatacatcttttgcagcttttacgaccaatcatttttagtaatctaaactataagctttgttatcttcatttatgtcaccagtatcgtttgatatgaattcgttcgcatgaacatgggtactgccatgattagcagcatgt

SEQ ID NO: 12294 - DNA, 404 bp, Saccharomyces cerevisiae
gaaaccaagtaaagataaatgagcataatacaagcatagagcacatataaaaagtcgggactcagatcagatcattagatatatcttttatgtatataaacccttaattaaaatatatacgcgaaaatattcattctcaaaattccattattgggccagaaccaatacttctccaagtggtcatgtctacgttccactggcgccatttgttcagcataacgcgatccacttccatattattcccgtgggccacctgcgtaccagaattggttacagattgtgagggagttagattattgcttgaagtgttgaaatccgcaaattgaataggagttgctgtggtatttcttgctgccttagcttctgctaattttaatttttctactgcggcaattaattcatcc

SEQ ID NO: 12295 - DNA, 468 bp, Saccharomyces cerevisiae
cctgtttaaagaagaggtataaacgaatatatttgtataaatgtactaacagatattttgaaaaaaaatgcgtatatctattcagtattagcgcttatgctgccaccaatattcttcatctggtctctatgagattttcattaaagcttaatcttttctgatttaccgcccttgcttttggaaaatatgtgaaattttattgtgctctaaaaaaaaaaagttattacagtaggtgaagtgaaatacaactaaattcgaaagatcaggaacaatagaaagaaacgtggaaattatttaaaaaaggaagaaaaaatggtacactaatattgatacttttagaacagatgggtctcaactatatgatgtatcgaaacaatcccgatttatttgatgaagctcaatattctcgattttcttttttgcttattgcgttttttatcatttaatggcgtcttggtttctgcagtc

SEQ ID NO: 12296 - DNA, 463 bp, Saccharomyces cerevisiae
taagcttacacaataatctaattgcactatatagaagttgctgacacagccgttttagagaactcagaatgttacccgcgcggaaaattctttttgctccctctcgctatgttctgtttaccatattgacagtactggttatcagcctagatccagtaatacataaagccctcaatttgaactatatatcaaagctagaagaagagtgatttgtcataattgattcactttataagctcctttatcgtttcagtttccaggtgcatttatcgcttaaggccattactttcaacaataagcaatctttataagtgaaaaattggggaaattgccaaagatgcccccaaactccaagagtaagagaagaaagaacaaatccaagcaacacaacaagaaaaatggcaactctgatcctgaacaaagtataaatcctacacagctagtacctcgaatggagccagag

SEQ ID NO: 12297 - DNA, 438 bp, Saccharomyces cerevisiae
attttcttttagaaacgataagctagtctttttcctttttaattcatgtgttaaacctttttgtgcattaactagacctgatctttcatcatatacagataaatttaagaaaaaaaataagttttaatgtgtatattacaaaataataacgcttttatcccgtcaaagattaacaagattatataacaacgaaaaatgaacgcaagagccacaagaaagaaaaataaaggctgagtaattcttggtatgtccccttttcttatagcacattttgtgggctcttaagttgacgttgtctctccataccttctcttttctttcgttctctcctctcttcctttgtttcgattggcgttatattgaccttagaatttacatccggcgcacaatttatgagttctttttcaattctatcatatagtgcttgcattttcctgg

SEQ ID NO: 12298 - DNA, 401 bp, Saccharomyces cerevisiae
taacatgaattggaaaaagaaaaaattgcatgtaaatatatacatacgtagaattttatacttaggctacagatcaaagctaaatctgtaagtcgtatgccttcttcattagaaatataggctctttatttgatttcctgatccaaaccaatctatcaatcgcagtatctgccacaatgaactgtcttatgccccaatcaccgacactataaatttctggaattctctccgataaattagggaagtattttttatagaacggcaaaaactccataacatcttctttttcaatgacaattgaatcactaacttctttgaaggtttgtttaatgaaacctccctgattattacttttatcgttgattaatttgactatccagagcaacaatgcgtcattaaga

SEQ ID NO: 12299 - DNA, 474 bp, Saccharomyces cerevisiae
aaccaaagtcattcaccgactcatacatacacacacatacatacatttatttatttatgccctaataatacacatcatttctgcgtaaattattgttacgctgccctacgttattaatctagattcttgttttctctctgtgtctcgtttctctttttaggcatgaagcgaaaaaatcaacaaccgctattgacaggaagcaagctggcatgagccgttttttttactttttttgattttaccagaagggcgttgagacctgcatcagccgtttgcggataggttatgccagtgatgaagcacctgattcaactgccggctctccgattggtctccgatcgtttagttccttatattgtacactatttcagctgtacaagcctaggcccgaatcgaattataagtccgtccggctcaagtcatggactcattatcgattcgtctttttttagctgcccccacgttatctcttct

SEQ ID NO: 12300 - DNA, 483 bp, Saccharomyces cerevisiae
ctatagtaggctctatgcatccggatataccacatgtaaatataacgcaagcgaataaataattttacattcaccactcagtaaccttggtcctgcagaagatatttctatatagttattaccgtattccatttttacttatgtgctattatttatattacagaggggtttcccttgtgttaattgttacatttttatcatcattcatttttatagtttggttaccagttgcgcttgtttcctggttcgagtttggattatcgtccttgagttccgttgatgattcctcgttggcggttctttctcttcctgctgttttttcatctgcagcgtcacctgactcttgtctggtttcgttaattgaggtcaagggagaagcattcatttgtgtattagagttgacatttgtgctggaattgactcttggtgaagatgtattagagggggggtgtctgctcatatgagagggcgtaacatttggtg

SEQ ID NO: 12301 - DNA, 496 bp, Saccharomyces cerevisiae
tggcggtgattaagtaataaaaaaattgcattttataagaaacatcatgtgatgacatttaaaaagtgggaaagaatactactaatataaaactatttactggatatttagaattttttttttttcttctttatacgtaaaagttgttcaaaaaatttcatcgttttctttttttatgaatctttgattcttgttgaaaagaatttctaaaaaaataggaggataataatattatcaaaacaaatcgtgtcactcattaaacaccaaaaatccaaagaagaaaaaaaggaaaatgtgagaaagaatttagattaagaatcaagccagattagacttatttgaacttcttaccaaacaagatcatttgcagttggtcgtacattgagataacaccagcacctgcgacacctcttaagatgttagcaccacaacccttgaatagagaaccaacaccttcagcagcaacaatcttcctcaaacagtcaaaggcaccgtc

SEQ ID NO: 12302 - DNA, 434 bp, Saccharomyces cerevisiae
tgtttaagtctacttggcatcctctttgtataataaacagtcaatatacgatatagaaacaatcgagttagcgattaattcgactgcacctctatccttcccccacgcgaaataatggttcggaagtcatctgaacgaggctcagtctttgaatatttcacctaattcggaccctgaacggtgaacaaaatttcaatatgatataaacaaaacgtggaagaactcttggcaaagacaaaggataaagagctcgttggaaaagtttttttacaactgcaaacggcacttaatattgctaattaacttgccagtatcatttccctagcgccttgccgatttggtctttttggcactgtttattcttactaaacgatattcgtaaaacggaaatcaaagaaaaccaaaattgaagtcccaaagcgtggcaataaaag

SEQ ID NO: 12303 - DNA, 464 bp, Saccharomyces cerevisiae
gattaagtcattcattatcacttttaagaattacttttaggaatcgatttcattttgcaaaatatttggttgtgtactaagtactaagaagaaactatcacaaaaagtggcttttagtttcatacactacagaagcctttctttggttctgatttggtgcgtatttactgtctaatgaaataaaaatccaggtcgtttacagatcggcacgacacattacaaaaacttcttgaaaaaggaaaaaaacaagtatgattgaggtgttaaattaattgcaggttctgaaccatcgcgtacattttgatacctatatataattatttaatatagcacatcctatgtcaaataagtgtagaatagagggaattttttcttttagatcatttctttatcgagttgatttgtttttccagagaggtggagttatcgtctagtgaccttaaagcgtcgaaatgtgaattcaa

SEQ ID NO: 12304 - DNA, 435 bp, Saccharomyces cerevisiae
tgggaaataaaattgcaaaaaataattaagaataaaatttccctttcatttaatggctctctgcactaatttttttacctacgaaattttccttcgttcacacttaatattaaataacagctctttcctaataataacatatacactagatatataataccaaataaattaaaaaaaaagaaaaacaaaaaataacgtagctttgttacagtcgtaaaaaaaagaacaataaaccaatcttattgccagcgtctaactagtcctattatattccaatatattaaggggtaaggactactattattcgccctgaattgaaatcttttagaaagcacctgttctctctctggtgttctttttttctcatctattatctaatttcttcaaccttcgttatttgttgttattccgtaatcgtggtgctcaacttttgaa

SEQ ID NO: 12305 - DNA, 462 bp, Saccharomyces cerevisiae
tgaggcattactatcttgccttttttgtgctttttttcttcattccttgttttattttatttgtacctctcttataaccttgttatcatactttttattcatttcaaatattctttccattattgcagtattctttaagtaatattccgaacgtgttccataatttgggtatgaatgtatttatagaaatatataaaacgcatgatttttcttttttatatgtatattatactattagaactatgtaaaaaaatgccagcatgtatagaggaagctacaagagataagaaataactagtaataatatacagtgtatctctaacaaaattgatattgtgtgaaaactaatgaaactatttcttgctcttttcagcttgagctttcttgaatgctatcgatcttttggtaaccctacctgtagcggatctttgtttcttcttttttagatgggtggaaccttcg

SEQ ID NO: 12306 - DNA, 440 bp, Saccharomyces cerevisiae
attttataatattcgttaaaggtatttaccatatatttttatcttagatacctgaaaactacaaatctgatcaataagcaaaccctgaccatgatttgatgcatttcacagataactacatacaggcattgtttaacacttgagcattttttttctcgtattttcttaaggctggactggattaatatcttcatttcgtcgtaggtacatagctttgttatgataaagaagaaggcataagtcgaaaaagatatttcgcgcatcaattaacattttttgtgtggtgaagaaaagtttttgatcattctatatatctatgtgttacgtatatcttcaacaatctgccacgtaggtagccatgccaagtacgcgtaatcatctactggaccatccatcccaaaactaaaaggagagaaataaaaaaatccagcgatcacgat

SEQ ID NO: 12307 - DNA, 461 bp, Saccharomyces cerevisiae
gcttgttcatagtcaattcttttcctttgtgtgctcaataatagtagatagaaattatactgaactccggtcattttgtataatatattaatcacttcacacgaacatacataaataaaatatcataaaggttagcaaattggaactagttatatgttaattagttaaaagatagaaaattcgagaaaggaagaaaaagctgatattgcccatctccaactttatcaaatcatttcacgatgaatagattttggaatactaagaaattttcattaacaaatgccgatggactatgtgctaccttaaatgagatatctcaaaatgatgaagttcttgtggttcaaccaagtgtattgccagtactcaatagtttgctaactttccaagatttgactcaatcaactcctgtaaggaaaattacgttactcgatgatcagctaagtgacgatttaccgagtgcc

SEQ ID NO: 12308 - DNA, 445 bp, Saccharomyces cerevisiae
gcgcactacagggatacttattcaaccaatgggggaaagaggccccatgtggccttcaaataaatattaaaaactataaacatataaggcaaaacaactttatcaggcgagaaagagaagcaagaataggtgtaattttatgcacccaaggaattgattgtaatcatattattaaataaggtggatgaataaaagattttcaaaccagtttttccgagatagttaattatgtacgagtgacaaatgggatatcaatcaatgaacacaatcaaaacaccttattatgactttcttgttatattcttatatacataaccaacatttaaatgtcaatttcttcagtttctagcccgcagtctgtacatcttcttctttgaatttgataaccgtcttcatcaatacctccatcaactggatcactaaaatgatgaatatgggctttccc

SEQ ID NO: 12309 - DNA, 485 bp, Saccharomyces cerevisiae
gaaggaaaatagctgtgacagaactggaaaaacaatttgcaaatgtccggagaacaaaaaaattggaattttagtaaaaggaatatacatatatttatttattgccgagaataatagagcagctgactcagaaaaagcaaggtaaaagaatgagagtaaaataaatatgtggttaattaaccatacatataaattattatcttattttctgcgtaaagcgtcaaaccgtttcttcaactcatctagttcatcattttcttgctccttcttagtctttctttttgtagttttcttttctgattgtttcttttcgatcacttcctttttgatatctttcggaatcttgagctcgttcttgatattttcactattctgcctaggctttttaacagtgatagggtgtttagcatctgcattgtcattatcgtcattatctaaggctaaaataggcttttcttcgtcattatcctcgatatctcccgagg

SEQ ID NO: 12310 - DNA, 492 bp, Saccharomyces cerevisiae
ttttgaatgatacgtaaaagatcgttttattgatataaaaatttcatctgtatatagtttaatcattgaataacttgtttatagatccatgtttgaaagtaacactcctaagaaggctttgatgttttgtattgctcatattatatcatgcccattgaaatcaacgttatttttttgtaaaggtgggaagaaagatcaacaagataaatggcgaaatagaacatatcagaacatttgaacttcaaaacgaagaggacacaaagaatttcaggcaagagaatgaacgctaacaaacaaaggcagtataatcagcttgcacacgaacttagagagcttcaaacgaatttacaggaaacgacaaaacaactagatatcatgtcgaaacaatgtaacgaaaacttggtaggccaattgggtaaggtacatggaagttggttgataggtagttacatttattatatggagcagatgcttggaaaaacgcaataaggc

SEQ ID NO: 12311 - DNA, 495 bp, Saccharomyces cerevisiae
aaaaaacttacactgaaatgatacattatctttttagcaagggagggaaaaacaataccgtattataattttaatcaaatttcatagatataatggaataagttaaaaaggcttatcgatagtgcatgtataaaacacaaacccattcgatatgtttgttcgttaatgtcctacagattcttattcgagagcctttaccagaagcaaaatttccgacggatataagaaaatggcacatcaaaccatagctcaaggtactgcgccgatgagctaaacggaactgcctagtttgattatttttcgtttatatacttatttacttatttacgctatttgtattcgaattccttacgaggcgatgagtgaaagacgcgccagtaggacgcgtcttttttttttcagtataatgtaaacatattattgaattgccgaaggagacaaaaagaaaagaaaagaggagatcatctttcatataatccaaccacgtcgtagagc

SEQ ID NO: 12312 - DNA, 475 bp, Saccharomyces cerevisiae
agtatgaactgaattttagggatatgtacatatacgcatacgtataaaatcatgtaaataacaataaaatttgacacactttcttcgccccaatggccattcaattccagaccgacgcgtcttctaagttataatgctatgaaatttcaacaagttaattaaaagtaagcataataataaaatcaggtaatggattcaccaaaaaaaaaaataaaaaaacaagggcagaggggtgaccattagtacgaaacactaaatatagtattaaaatagttcaactccacctccaaatgccctttttgaggaaaatagcggggacagcacatacacattctaggtctgattcgaactcatctgtgaaattcggccatcagccgactagttcggtagcatcaaccaaaagttcaagcaaaagccctcgtgcaacatctcgcaaaagcatttatgatgatattagaagccaatttcccaacct

SEQ ID NO: 12313 - DNA, 416 bp, Saccharomyces cerevisiae
ccacatacttaacgtaaaaaggaatgtacttgtatagaaaaaacacatattgtgccgcttaatatttcgtttccctcatgtatataccttatcgctgttaaaataagaaatcttcacttctgctatctttttttttcaaacattgattaataatccggccgtccgcagattgcttacgcagaatataccgtaccgccaccgtaaaattaacgaatacttaaatttccgcctcttccgtttcggcaatagcgaaccttaatgtaagtttttaaaaggcagcgccaaaaattgctctgaaaggcctgcagtgcttcgcggctacgcagttcccatgtaaaaaaaaaagaaaactttctttttgaatctggaaaatccgcacaggcgcgccagcataaacctcagtatcctgcaaaggc

SEQ ID NO: 12314 - DNA, 454 bp, Saccharomyces cerevisiae
gtaacagctatctacgtccctgcccttccctctctcttttacataccaacagtttagcatttttttttatataaattaccataaatactgcctcaggccgctcagcttatattttcaagtctctccatttggctgtttgaggtacccaattgttgtattcttgatacggctgtttcaactattcacataataagtgtagtctagtctcttcgatgagccttttatgcaccaagggaaattaaatgaatttctaccaaaccttattcattttgaattatgtagctctgacattttgttgttttccttgcgtgcccaatgttgccagcgtaaaagttatcgtaaacgttatcgtaaacgttatccccgttttgtaaactttattgtcttcgtaaaaaatagaaaccaacacttaaaattggtcccataaaaaattgagtcagttccttcatcgtgg

SEQ ID NO: 12315 - DNA, 446 bp, Saccharomyces cerevisiae
ttcgttgcatagacagtatgaaaatatttttactgtgatacttacaagttgatatatggttgtgtgtaacttatttatttgagaggtattttaacacaccttagaactaaaacttaataaataaatatttctctatctttaaaggcacatattacgtggctaaggcaattacagctgatatactgtaaaactcatgtcgccactaaattcttctaacacgcgttctgtctctttccaagggactccgaatatgccactatttatctgtggcatttccaatttatattcccctattgggtatttgatgtggccgtttaaatagtcaccgattgaatcttcacttgttcgagttttgtcttttgcttctctaaaggtcttcaatttatctaaagcaagttttgtataattcaaaatactttgcttttctccatgacttgaacctccaa

SEQ ID NO: 12316 - DNA, 481 bp, Saccharomyces cerevisiae
tgacatttttagtttgtgtaaaattaatttgataaataaatgaatgaaaatgatcaataataagcgaataactatatttttaattaccttatttttacaatatttttcacttgcacttttattttattttcagcgcgcagctcgtcttgttctgttgaaattcaaagatacctgaaggaacattacaacatcaatcaacacttgagtagaaatatacacgatccaataaaatatactgaagcgaagcaatcagaaatggatgcaatatctgatccaacgtttaagcatgctagatcaagaaaacaggttactgaagaatcaccatctttgcttaccgttattatagaaattgcaccaaagttatggacaacttttgatgaggaaggaaatgagaaaggaagtataataaaggttttagaggcattgatagtatttctcaatgctcacttagcgttcaatagcgccaacaaagtagcagtca

SEQ ID NO: 12317 - DNA, 453 bp, Saccharomyces cerevisiae
cttgtagtgtaggatcaactattttcgcatacttgcaatgttcagcattgcaccatttcaaattttaatattaatattaatcgttttcgttcatatgttcattcatagtttacaaataatgcaatcatatgcagagatattttgtccgtggttaatagggctgcctgttattcctttaattcaactaaattacgtatgtctaataatatcaaaatcatcatgacgtttttgtttttttttctttattttaagtaggatcaaaccaggggagaaagggttgctacgcctaacaacaagaacttgtatatcgtttcttgttacttatacttttctgcccacttctctcttacaactgctcgagctcatccttggtaataaaacagtgaggacggttactcgaggtttcaacaggggaaaataaatttatatgatgaatcaagagccccgttcttt

SEQ ID NO: 12318 - DNA, 489 bp, Saccharomyces cerevisiae
atttagtgtaaattgaaacagaaaagtctccatttccaactaatggtatgcaagcatttttatatgtgtgacataatgaatggcttctggttaagtttggctttttgaacaaccattgcccggagaaaataaacgcgtgagcagtagctgatacgcgtctcactttttcataaattcatgtataggtcatcgccatatagagaaaatatttgaaattacatctgttgaaactaataagagcttttccttggagccttctttgctaacagataagattttttaattggagcaactagttaattttgacaaagccaatttgaactccaaaatggccccagctacccctaaaacttctaagactgcacacttcgaaaatggctccacatcttctcaaaagaaaatgaagcaatcgagtttgttatcttttttctcaaaacaggtaccttctggcacaccgtcaaagaaggtccagaagcctactccagcgac

SEQ ID NO: 12319 - DNA, 446 bp, Saccharomyces cerevisiae
ctactgaagtttgcctttggtttgaaaaataattctgccagccagacatgtttttaatagcgctaacctaaataataataaacagcagtgcgtaatagacttatgatactacctgataattagtttgacgtttcacttcgcagccttttctggtctggccacaagactatatggcatcaagaaaggtgtttacgtttataacacacgtattgtacaagctttctgcgttggctttagtgtctgtagaaaattatagaaaattctaattatgttttaaggttaagtgctagtggtgctcaaaataaaaaactgtttagtaactgctcgtgtaaaatggaagtactccaaaagtcccttttcttactgaattgcgccgattttaaccttttaattcggatgttttatgtttttttttctacaattgcacccgtttagtccaaggcata

SEQ ID NO: 12320 - DNA, 464 bp, Saccharomyces cerevisiae
tgatcagttggatgaagaaaaaagtcattttctcgacttctcttcacctttcgatcgatttgattttggccgccaacttgtttatagaaaaaaaatagtaggaaggttatgtatcgctttcttttattttttattatagagtataactgaataaatttgtaaatcagccactgttgttcgattgctttttggggaagtgaacttgagacctttaactttcggctttcagatggttggatagcaattttcacacaatttggacattgtctccaagttttccacaatgatgaaggttctttgttaagtgcattcccccccttttaagtaccttggctatcaattttatacccatttttcgtatttaccatttaattaacgatccaattattagcgttaattacggaagcgccaatgaatttttagaaatcagaaccatagttttgagctcaacggaactatccagg

SEQ ID NO: 12321 - DNA, 425 bp, Saccharomyces cerevisiae
ttatacgtaataaatattccacgaacgataatacatacataattttaattctgaactttgtttttttccttcgaatgttctcaaaagaatgctttacgacaataacgctgttatcttgtacatacttttctctgcccagtgacagcaggcacaataatctaaataccgcgttcgtgcgagacattctctgtgattcacagattacggcgcagaaaataaaatagccgtccagctcggagtttctaaaattacgtccgagatgacggaggcttataaaatcatttcagacgggtgagggatgccaatctacgagacaaaagataaaaaattaagactcaataatatagaaaggaactaaatgttttcataagagtcaccgtctataaccttttttttttttattggtctgttatcacttccactga

SEQ ID NO: 12322 - DNA, 431 bp, Saccharomyces cerevisiae
tatatattcccccttcttttgaataatcagtcagacattttaagatcaagaggattcattggtagattttgcaagaaccaattaggaatttcttcaggaataactgtgagcttgcgtttacggaaaggaaagtaaaaaaaaatcttccaacgagtttttccttgtaccggttgctaaaaaggtgccttctaacaggtaacaccagaaaccgcaacttttaaaatgcaaataagggcagtcaatggtgaacttcctcttggtcagttagtatgtacaataaattaggttgttttcctcaggataaaagtgatctatttgtaacatatagtttacctaggtgctgacgaggacacaggaagagcaaaactaagatcatacaagtcaatacttattataatcaaatgataatattcgttcagcctcatattcga

SEQ ID NO: 12323 - DNA, 416 bp, Saccharomyces cerevisiae
atattatgaagaaaagtggaatgaaacaaaaagaaagaataaagagaggcaacctacaaatcccaagataaaataaaaaaagaacgacaagaatccattcattatattatactatttttaaaaaaaaaattactacgaaaaagggagagaaaaagaagaagaaactcaatttactattgctcgaaaaataaaagggcctataaacttactctatttttttagtttttctgtgtcttatttccttccttcgtcactgtttaatttttaatactattattttcctttaaaatgtgaaagtcattgctaatagtgtgataaaaataaagaacgtattttctgaaggctttctttattatatttcctttttcctttcttaccctattttttttaaacatccatcccactgtattttgtcg

SEQ ID NO: 12324 - DNA, 463 bp, Saccharomyces cerevisiae
ttctgatgtaagggcaagcatatcctgtaaaaaaaattatatagagatgatttatttatataatgcctatagcaacctttatccaaaccttccgtacattatttaacagcaattgtttatcattcatgattatttctcaaaaagctgccaatttggcttcatttctgtaagtatccctacctctctcctctaacgcagatatttctgtgcacgtgatctcgttggcttttttttcggccgaaattttcacaggctaaggccgaaaaagaaagaaaattttcagaggaaaaagaaaattaaacgacctcgaagccgtattttagattttccaatctcttatttagtaacgtggtttattaactccatgattccattcctatttgtttttctttctttctgaaaatcctcttctcctcgaaataacccaactgacaaaaagaacaattcccaatgtctgctccag

SEQ ID NO: 12325 - DNA, 434 bp, Saccharomyces cerevisiae
taatgagcactttcgcccgaatttcttgtggcccccgctaccaaagaatgaagatgaagaagatgaagaaaagaaccagagaacaaaaagttttttctttttttttctttttttttttggctcaacacactgtacccatgctgtcccttgacattttttttttcaacttcttctaccattacgacacaatgtattcatatataaattcataatctaataaaatggtaattttaatttaacgggactggcgtgaacatttatcaaatacatgtgaattaaaaattaaaaaaatgcaaatattgtacatatgtgtatatacagacaacataaaacagaataactacttttcttgagtatcacgtttgtcatcttcctttcttcttttcctatctcttcctgaatcttcatatttgtgcacggtaccaacgatttgt

SEQ ID NO: 12326 - DNA, 413 bp, Saccharomyces cerevisiae
ctttagctatggaaaattattcaaacatttagaagaggcactatttcgaatgaccatcacaagcattataatcttcaaacatgtccgagctgcagatatgaagtaaaatagtgatcgggactcatttttttttcttctatgatatcatattgtcccgttcgttattaaatgtaattcttccaccgtactagttatcgaaggcaagatctcctttttacgcttaggtagattacatagatttcataatgtacaccaatacaaatgtatcttatacactcgtcaaatcttatatgaatcatgcaggagtagctctcgttttctttttacgagctacttgaaaaaaaaaaactagcgaaaatcctttgcttagaaatccagatttaaaacaaaaccgccgaaaagggaaagatttt

SEQ ID NO: 12327 - DNA, 401 bp, Saccharomyces cerevisiae
gcatttaagtacctcacctcagtatatacatttattttatttgcatacgtagagtgactttgaataataaccatgagaggcttttttgtatatactctataaacatggcttcaatttcttatacatgtcacaccgtacgttgtgcgaggtgattaggaaaagtaaaaggggactagaagaatcatgaaatgatttgtagatacagttatttgaggaaagcaaaaattaccaattcaggaaggtgtagggacgtcgataggagatcacatcgttaattagtgttaggaagaatgagtttagaggatacattagccaacatgtcattatatgacgccaagaaatattttcgtaaagctcaaaatgttgttttcaattatactgagatggaggggaaagttcgt

SEQ ID NO: 12328 - DNA, 472 bp, Saccharomyces cerevisiae
agatcattatcgtaaaagaggagcggagcggagctttttagtatgtatggtaaaatatcaatcaaatactgtaatagatgcggatatgcgcaatgacatattttgtggtgtgcatatccattgaaaaggtgcgtagaacgttacaatactactgaacttttttccttctcattttctgccattttgatatttatgcctattattggtttgagctttattagagttggcataattataatcgtactcgtatgtatatccgtatccatacccatatccgttgtaataagtgtttggtatatatcctttgatggcttgggctcctcctaccgtcgttataacaggcattttgtggcgttgtggtgaggctcctgattggctggtattatcgatggtcgtacgacttttggcattattcattgatctgaaattgccattggtattgctattactggtgttactcttgctggaggca

SEQ ID NO: 12329 - DNA, 400 bp, Saccharomyces cerevisiae
ttgcataattcatctcatttttgatcttacttcaacattgcgggcgtgattataggtcagtgtttattcctttactcagttgatgatttcaaatgtgctctcctctccattctttttcttgttaataaaaatccataactaaataaataacaaatattagcaatcgcaaaagtattaactaagctagagaaccttcactagagaagctctacctaaaggtatagaacaggaaaaagtgtttttattttggcggacttcgtggaagattgccttccatcaataataagcgtagtccataggtacgatcatttcctttttaaccgttaagcaagcgacaagatgtattttgtttaccagcgaatgctcttatttatcttctgcgcctttccaataatctaat

SEQ ID NO: 12330 - DNA, 402 bp, Saccharomyces cerevisiae
aagcaggcaaaaggtcccataattattacgatttaatattagtttatttgaaggagaaggtcagaagaaaagagagaaaaatgcacaatgggtagcgccattaaaaaatacctcttttggtatttgtctggtttcctatttcttcttgcgcgtgtgttatgtaaattaagagagctagggtattataaagtgcatcatcatcaagcggatatgtaacgcatatacattatatatgtgtagtgagttctttataccctacaaatttgatattgtgtttatttatatattggcattttttctcgattacgtgctggtatatgtatacctcatctgtacatcctagactagacgcatttttttttccaggtacaaaggctatatttgaaggaacggccaatcact

SEQ ID NO: 12331 - DNA, 447 bp, Saccharomyces cerevisiae
accgcacactttcatcccactccctccctcctctctgtacactacctcattataaaattgaaacgatcccaatctcaccgcacttcccataaagccttcacgttatacttttttttctcatcttttttttctctctctctctctctctcttttgcgtatctttttcgtcctgtttctttcttacttaagtatctttttataatatttaagagagccaaaattatttaaccaaaccaagaatcttgtattctataacgaatccttaattcttcttgttgttattaatgccaaaaacagaattaatttcccgaaaaagaaaaaaaaattgacttaaaaaatcataggaaaggatgaatgatttacgttacggcgacacgttatcatcaaacgcaagaaagcataccagattgcaaaaatgagtactagtgcggacactgataccatcaa

SEQ ID NO: 12332 - DNA, 436 bp, Saccharomyces cerevisiae
acaaaacggtcaattactgtagaaaagcataagcattaagcggccctcatgaatcctacattatccgtgaaatttcaatactttcacaagtcttcgatagcttcctagttatattcattatataatattacgtttcttgttgcggctctcttaagcacattatttgcttgttgtccacatagctatttttttatcaagaagcttgatatacaacacactgtatttttagtaagctggacaatgtcttgtctcaatgtagcgtataacaggtttcattccaaaacacatcaccagatataggactgaaatgaagaaaatagaagcatgaaactttaaaagtttcagtactttaagaaagaaataaatagaaaaatgttccatttatttctgaaaataaatcaaaaattataagatccacccgttcctaccaagacct

SEQ ID NO: 12333 - DNA, 409 bp, Saccharomyces cerevisiae
gaatacaatctcatggtcctggccagttagccatgctctatggcagaaaggcaaagggcatatataatttcccattcgtcatgtaaatatataaactgtacaagatactatctctctccatttttcaatcatatagttctctttggggcactgagatgtctacaaattgttataaaattggacgtctcttacacaactcacaactcaactctgtataaagatttttaggaaagaaaatgtacataaaagtgaatacttgtttaaaaatgagaacaaagattcctacgcaattaaaatctatttaaagattttccttatttttttatttcttttcgaattttttaagttttattcttatctcctttgacattataacttacattgcatcagctcagggtggttcaaacat

SEQ ID NO: 12334 - DNA, 496 bp, Saccharomyces cerevisiae
cgcgcttaaatgaacagacttctaattttctattgaaccactcactattaaaaatactttgatgggttgttaacttcgcattgtttggttccctaggtatattcttttgacgtggtcaccctatcttctagcaacctggtcccctcgtgtttttctttttattcttttttcttttccattttctattacattggaatgtatatatttgatgttctcattttctaaaatgaaaactgttgtataattacttaaaatccaagataaaaatgtgttgtaataatatgtgtttggtaaggtgtcgcggttattggaataaagtttatataagacaaaatatcaacgtgttttatttatacaaacataaaagcgcgcatttaacgcccttttaccttttattactcggtatttttcttaacgtagtcccatagacttttcaataatccctcaggtaaactatacaagtcaattataaattcaccctcttcaacattattcg

SEQ ID NO: 12335 - DNA, 472 bp, Saccharomyces cerevisiae
cactatgaaaacctgtccaataagactgcacagatgaagagcatgtcatttggttccttgataagtgtaataagcaacaagaaagtcctgggtcatgttcctgctgaaaatacaaacccattaactaccggaaacgaagaagattaagacaaaatggaaaagttaagttaaacgcaatcagttcatatattcttagatagttatcatgtttttataagtaaacaaagtagtcttctaccaaataaaaatagattcctgattgggtatttttcagaagtatcatctgaacttgatgttattttaaaatgaaagccagcgtccataattatctttttcttacttgttttttacagtggcggtaggattggcaatgcctgttcatctccagttttccggtccgcttacgacatcggcctttctataagacaggttggcaatgcgccacggtacatgatgacgataggagccttcg

SEQ ID NO: 12336 - DNA, 445 bp, Saccharomyces cerevisiae
aaataaatgactttttgtagtggactttatatagcatatttatgcaaccaacttaatattcatgcatcttaccccttcttggaacgggttccattttccactctatttccggcaaattttggtacttacctagtagaaatacacaaacgaatactaagaaatgctaaaaaaataatctatatattttcatagggcaaagaagttattgtcatcaaaagttgggtagataaaaccctggtcagtcaaggtcgtacagcagtttctgacggtagtttcatccaaattcaaggattgcgagatcaatggaatgggaacagcgaatgaattagcgtctttgccctcacattgcttcttacaaaattctagaattctttgtaacggactggagccggaagatgtatcgttatcatccttgacaaataatgattgcccattgttgttggat

SEQ ID NO: 12337 - DNA, 402 bp, Saccharomyces cerevisiae
atacgataaacggaagaatggtatttcggccattgaaagtgtttcttcagtcggcgtttctattccgattttgtactctatgttatgtgttattattggcatttcaagtaacgaagtgaagtttagccgcgcgtttatatgtaaactatttatttgggagaatgtagtattacgagcaggtaatcaaaccatgcatttattacttatatatgcgagggccaataagagtttttatagtagtaaatcccactcagttgcttgtctatcagtaaatcgccttcatcgacacaattttgtaatacctccataaggatacctagcgtccagtttgattttgaattattggaactcaaaatctgtgtcaatcttaggagatcagaaccaggattatcaccgatcaga

SEQ ID NO: 12338 - DNA, 426 bp, Saccharomyces cerevisiae
attgtaaaaaaaaaaaaataatgtccatcttataagcattttatttcttttaggttatattattacacaaacagagctgctttcggggtacgagtatacgctcttgaatgataggaaaatatatacaatttcagtaccacagtttattagatttttgtaattcaaaatttattcattcttgtctctcaaccactgaggcgctcctctgcacacagctattagctttataaggaatttcaacgcccatgccaaatccatcctcgccgtaacgcttgaactcaaaggttttattaaaccagtcgatcagactaatgtaatttttaagattcatcattttctttaacagagatttcttcaactccatattttcaagcatacagtacagatggtgctgagccaattgaaaaggcaagccaccaaactcta

SEQ ID NO: 12339 - DNA, 488 bp, Saccharomyces cerevisiae
gctcacgcactatactacgcaacattacatgatttcagtttctattattgaatgaacaggatttttccacgtggattgggcagcgcactgtaccataataacaaccagttataaaatatttcaattcttttacatatataaaaatacataaagactattatttttgtaagatggcccattctgtaacacttaaatttcttatcaaaaaaaaaaaaaataatacctttagtagctgttgggctaataacattgcaaattagaagcttactattagaagcttactattacgggattattgaggtaaaggttatttgaagcgtaaatcactgaaatcttcctgatcacgtgattggctttttttgccagaaaacccaaatctgtttattgccactaagttgaagaaacatataatcaacaattgttggcaattctaaggggaatagtgcaacaagaagccagtaacgccaaatagaggttagcgccaagca

SEQ ID NO: 12340 - DNA, 499 bp, Saccharomyces cerevisiae
tggaccacctagataaataatttgaagtagatattgtataataacgcccaagaagaaaaaatcaaacactcgaaccaggctctttctacaagctttatttacacaatatatataaacctatatgtatagatgcccacacgcacgtttggattattaccttcaatgacattgctaaaagcccatttccttcatagcatccaactcatcttgatctacgccaaactcatctccccctggcaataaatcataatgagtatgttgtccctctatatcattcatttcccactcttccaaactttgaatcagttgaacgtcttcttcagtcatagagcctttttccatttttctatgcgcatctagccatcctaataagagcttcttctcattttcttcaaggccaacgggcccttgtaccctgaatgtcttcaataatgcatccaaatcttccttaggcggcacaacgttgttaagtaccgtttcattattcccacgttcgtcc

SEQ ID NO: 12341 - DNA, 402 bp, Saccharomyces cerevisiae
atagaaatatgattgttttttatagagtgtaaattttaatgttttgtcgtgaagaagaagaagtaaataaagtagcgtggggatagcgaaatgaaaacattcaattatcaaaacaaaaacttttaactacatttatacctttacttttaaagtgccaagagtgcattggtttaaaatatacagtagttaagtatttatcagtacccccaaactcttattcttttcactcctccatctggaataatcgttaatttgacatgggagactcttatactcttacgtatttcatacacatgttctttgtcaggccccgtctttgacttaccaactagctctacccatgttccttcaccagtgttctcacttgattctgactccttcaagcaaccttccacggtaatg

SEQ ID NO: 12342 - DNA, 440 bp, Saccharomyces cerevisiae
aacgttccttttacacaaccatgatggaacttgcattgattttctttagccatataattatcgcatatatgtcattcataaaacgtttataaaacattagaatatttgatatatttgaatatttgataaaaaatttgataatttttgggattccattgttggtcaaagctataaaattatgtatgtactagaagttctcctcgagggtatagaaatccttaaaatggaatcggtatcttaccataaatgttccactagaatgtcatcagatgaaaaagacgaaagaaacatatgactagctcgcgtggcgtaatggcaacgcgtctgacttctaatcagaagattatgggttcgacccccatcgtgagtgttttttagtattttttttaaaaacaattgttcctctctaaattttaatcagtttttgatcatgaagggtt

SEQ ID NO: 12343 - DNA, 439 bp, Saccharomyces cerevisiae
accaccatcctcgtcatcatattcaacatatctcaatatatctataaaactaataatataatataacataatatagtataatagtataagtttaaaggcatcaataatttttttctttcatatatattctgctagcatacatgttatcctattcgtgtaagtttagtatgatgatgtgcatgacaactgcacattagagtcttccaccgggggtgacattgtcacttccgttcatcattgctacttcttcgaaatcacctcttcttcttaacataatggcggggtgcaaaccctgttgctttaagttcttgaatatgatcacaggcttttcgttcaattctaacagcctctcttgatccccatagcaaatgaccaagacatattgtctccaatcctgatctgctaagttatgtcttttcattgcgtttttcaagatccg

SEQ ID NO: 12344 - DNA, 428 bp, Saccharomyces cerevisiae
tgatgatgtgtcttttgtacattactcatgaaaataaataaaaatcttgtagatcaaaacaatttttttattattaattattagtatataatcagaatatttacgtatccttgaatatgttaaaagactaatacataaagagcatcttagcattaactttttacttctctacaaagtctggcaatttgactcattttttttttttagttgagtgtctcctcgtaatgccatcttgtcgcttttgcataatagaaaaacaggaaaacattgaaaaaataaaaaaataagggaaatatgtatcgtatacaaaaatacagctaaagcttgaactgaagtagaaaatgataccaaagcttatagtttttggaggcaatggatttttaggtaaaagaatttgtcaagaagcagtgacttcgggctaccaagtc

SEQ ID NO: 12345 - DNA, 417 bp, Saccharomyces cerevisiae
aattaaggtgtgtatatgtaatcaggcctgtttgttagcttgtgcacatttgttaattaataatttatttaaaaatgggcaaaatataaatgcataaaagatgacatagagatatgtgcacaaagctatgtaatcatatttaacattaatatatattatttcgttattcacaattcgtcatgaaggccagcgtagtttacggttcctgctactgcattatcatcgttgacaatgtttgtattcgaattattattcaaaggtgctgcaattgtttgcggaggggccactggattaggcaaagaagtgatctccacgttaagtgctgaaataacttcactagatagagagacgtcttcggtaacatctaccgtaccagatgcctgcatttccgtcgtaagcattcgggaaacaggagta

SEQ ID NO: 12346 - DNA, 412 bp, Saccharomyces cerevisiae
tcataccaatgaattttatacaggcttagaatcgtgtaaatatttcagtaagcaagttaaaatgtgatctaaaaccccttaggtagttctccttacttctaaagtgatcatactgaccatatgtgacgtaacgacgctattattaacaatccaaaaattgcgtcactgggaaaaaataaaaatgcgaactctgtggatcgaacacaggacctccagatatcttgaccaaagttttttcttcagtctggcgctctcccaactgagctaagtccgctaacataagacggaacttcatgggtggtctgtcttttatatatgcaatcttttatttttattgcgttgcggttttcagtattcataagaaggtgaaaaatgaaacagatcgttgtgatcaaatcgctcaaatcggatt

SEQ ID NO: 12347 - DNA, 446 bp, Saccharomyces cerevisiae
gcctaaaacagcaaatttatgtagaagtgtgattatatattccttaactaattgttaatcaagttctagcatcatcttcctagcatctatgtgtatagtacatgtacacctagtaaagaataatactgtccaaacatccgaatcctgccgccactccaccttcatttgaagtattaaatttggatcttagtaatgagccactaaattcgttcgataaaacttgctcgtcgttaaatagaacgcaaccataaattcctagttcactgatgattggttcgttgtaagatttgttatcacgtaatataatattattttcattcaactctggttcaatcaactccatgagaatatatgcatcccagtgacgttcttcgatacctttcaaaaaattaggaatattttctttataaacattgtttccgccaccttcccgctgtggttttaac

SEQ ID NO: 12348 - DNA, 406 bp, Saccharomyces cerevisiae
aagttttcttgcagccgtataaatgtggccctattttcaacgtccaagttattttctgcgatatttgaatgacacttttaaatgcgtatataacagctcttagagctcagaggaagctttatcgccgccttttataggaacaagagttatgtacaaaaagccatcaaaacttcgcaatttagaatacaaatcatacaggagcatatgccaaggaatttcaattccttgacaaataaccatgacatcattaccattgattccttcctttacgtccagaatatcgccttcaatatccttcaacgtaggattgactccagtcatactgatagttggttgtgatattcgaaaagttcctgatgtccttgaggtttgaatgatgagcggtatatgtcgcggtcttgatgaa

SEQ ID NO: 12349 - DNA, 452 bp, Saccharomyces cerevisiae
ttattggtcagcctcgtccaaaattgtcaacctaggaaaaacaacattacgagcaatgaaatcttgagcaaagttcttttctgcgacatatttatttcaaatctttatttatattattatatgtaactacgtatatatacatacacatggaatggaatcatagatgaaatcgatgaacaagcacgttatttcttaaacgaatatccaatcgatgacgactatacgaaaaagcggcctcaaaaaagaaccgaattgacaggtacatttttctttcacagatcaggttggcaaaaaaatactaaccgtatcctgtgttactgtcgttagaacaggaatcaagatgagcacagtgaagttatctgatagtccctagactctcattgactttttgtaatattaggacacagaatatactaagggttcttctcgagaataaatgaacacataagcaa

SEQ ID NO: 12350 - DNA, 421 bp, Saccharomyces cerevisiae
accagattctgataaaatgaaggtaataagaacttgataggagctaggttgtaaaatttttaattatgtaccatactaaaattccgacgttatttttattcttcaccgtgctttatctcttcctagacaatttaagagttgaaaggacaacagagggtgatgatatgaaaaccggttcacttttatatatttgtcttttatgtgagtaagtgtgttctatatatggatgaaatatataatgcatttttttttttgggtaataaaattaggttgttcttttacgttccttaagcttcattctcctctctcttcttaacctactctgcatcatgtagtaggtgcctcgtctaattattgtttccagtatggactggttgtattcggggtactttacctttactcgttcgtgcagttgattgat

SEQ ID NO: 12351 - DNA, 476 bp, Saccharomyces cerevisiae
taagccgatcccattaccgacatttgggcgctatacgtgcatatgttcatgtatgtatctgtatttaaaacacttttgtattatttttcctcatatatgtgtataggtttatacggatgatttaattattacttcaccaccctttatttcaggctgatatcttagccttgttactagttagaaaaagacatttttgctgtcagtcactgtcaagagattcttttgctggcatttcttctagaagcaaaaagagcgatgcgtcttttccgctgaaccgttccagcaaaaaagactaccaacgcaatatggattgtcagaatcatataaaagagaagcaaataactccttgtcttgtatcaattgcattataatatcttcttgttagtgcaatatcatatagaagtcatcgaaatagatattaagaaaaacaaactgtacaatcaatcaatcaatcatcacataaaatgttcagcgaa

SEQ ID NO: 12352 - DNA, 435 bp, Saccharomyces cerevisiae
gcaacacaagaacctactctctctctctctttctctctctctctccctcttcgcttttcccccatgcactgatggcgcttgtatatagcatttgaaaaataatagtacgtaacgcagaaaacaaaccaatgaaagtagaaacccggagaaaagatctaaaaaaacaaaaaaaaaagatggaaagagcgcatgtatgtgtagatatgtacatatatacaactacttgtatgttatttgccttttgtactgttaagctattgttttcgatggccaattaaagtaaaacaaaccgctcactctcgggtatttcccgaaactgtcagagccgtcccggcccaccgattcgcccggcaagacctgcttggaagcagcacaaagccctgcggcctctgtacacctcacgctaaatagctgctaacgatcaacacctgaccg

SEQ ID NO: 12353 - DNA, 459 bp, Saccharomyces cerevisiae
ttctgatggtgaaatctttttgtaacaataaaaagggtgtatatatatatatatgactactatagcttttggttcaatttttgtttagctgataacgcattccgctggtaagtcattcgaagtgtcacttccaggggtgttgggccttgacttcgattttgcgcaaatttcaatgaactgatggccaggctcgtgaaaccattcaagaacctggtagtcagtgttataggtataatgacctgatgatgaacgaattgacaaccggcttggtgtaaaatggtgccgtggtataaaaatatatgtagggacagttatctgttcaggtgtcgttttaccaactaatttcaaaaggtaggatttattacataagttaaactcagcaaactcaaatcttccgtgaatttgtatggggaatggtctcattatagcatcaagagctctgaaccctgacaagtcgct

SEQ ID NO: 12354 - DNA, 446 bp, Saccharomyces cerevisiae
ataatttaatcaaatacttttgggcaattaaaattttagttaacaatagttatgcaatgcgctttatgttcatatgataccgtttataagctattgccatatccttatcttattgcttccagtagcctcgagtcgaccactaaaaagatgtcacttaagacggaaattatgtagctgcacttcttttttaacaagttcggtcggcccttcaagttctcctttctaaagcctcattatttattgcgtagatgctaaatgttatcgcggtttagcttgcatgttacgtttccgttttagaacctggtcgagtagcgaataatgtcttcagttgatgtactgttaacagtaggtaagttggatgcctcattggcgttactgactactcaggatcatcatgttattgagtttcctacagtattattaccagaaaatgttaaagctggatc

SEQ ID NO: 12355 - DNA, 433 bp, Saccharomyces cerevisiae
aaagtaagacagtgccctttatagatcttcaaaaaagtaatgcaataatattttcttttaggaaatgtgtagatagactatttaattaaaatttccttatgtttttttttttttttttatttttccgaattaaagtcactatttttgtacaacttcaacttcagccattcagaaatcttgcaatcttgcattaacgtagaggcgtatgaattctcgtaataattaattagttttcctgaattgattaagtcaaagtgcccgtcagtcttctctttcagcatctcaacacgtaaatatatcagaggaagcgtgatgttattgataagatttaaggtatcttttgttaacatatgaggggaacacataatgcatactgttttgttgcgttgactatgtgatactagtgaggtgaatgttcctactaactcacgga

SEQ ID NO: 12356 - DNA, 427 bp, Saccharomyces cerevisiae
tctataatgtaatggaatgaagaaatattcttcatttttgataactagtacctgtcattcacgacatgtgaacaaataaaaacatttatttaaaaattttatgtattcaaatattttcgggaaagagataaaagtaacgacacttaaaaatttaaaaaatcacaatactttatttactcagtcttttgatcagctccggcacctccttgttgttgcttctttgctgagcccgcaacaaaattgtaaatcaataggcctaaaagtaacattttccagttcttttgaaaccaagacacctccttaacctcttcatcttcttcgaattgtgcagtgcttccatccttattcttactagcttttttatcagcataagttttggttttcttctttaatttggtgactggtgcagtaggtcccgcttctggat

SEQ ID NO: 12357 - DNA, 458 bp, Saccharomyces cerevisiae
tctaactaaaaagcctcagctcgagacatggcatcaacaaaggaaaaaggattcattaccgtcttttgcacacaaaaactttaatcatcagtaataaacatatgtaactttttaaccttaaaacatactaatctccgtactttttttaaagcatccacaatccatatggatatgacgcgaaattagctcggcggttaattattaaaaaattgaagctaaaatcaaggttaacaaaacaactcattcaaaataacttactcattcatatactgccaccaaatggaatatgtcccatgaatggctcataagcgcatcggaaacaatgagaagcattggtaatggggaaggtttgcgggataaaggtgctgtcgttgccaacaatgacggagaatttaacgaaggtgatacaaatcgtgaagaggatagctctaccattttctccttcgattttgacgagg

SEQ ID NO: 12358 - DNA, 483 bp, Saccharomyces cerevisiae
gagtaaacgctgattatgtcacacatatacgtgcaaacgctctctctctctctcaagctatataagtggcactcgtcttatttattatttttttattttggctggttgttcatgttcaacccaacctcataaaggcactcaacttcatattttgacacaaatctatgtctcgccaaagcgcattcaaatttcagaatggaaatagacacgaacgagcctgtctgtcagatgttcacaaaatccttattataattttatattctactaaaggaaaaagagaattaggaaaaagaataactcattttatgtatatacatatattttgtacatatctataccaagcaagtatagtgcaatactgttcttcgacgttattaaacgtaatagcattttcttggtatcctttgaatcttatatacaagtacgagtacatactgcgcagtaaattgatcctgatggtgtgtttagatttcgccagaagcg

SEQ ID NO: 12359 - DNA, 469 bp, Saccharomyces cerevisiae
aaatggtcttgattgatacatgcatatatattctctcctcatcaccaccggagccccttttttttttcatattctaagaaagagtcaacaaaggaaagaaataaataaatctgtttaaatgtactctattcaatcactagtattcttattccatgtatttactgactttgcaaaagtccaaatatctgtaaattaacatgctattataaatatatatatatatatatatttgaattttctattttttcatctacaaaagcaggttatagctccgttaaaccctttgctcattgaattgtccttcacggttttttggtggaaaacacaacatggaacataacatttaaacatcgttctcaatccatttcatcgcagtaacatatttggtcgggcacatacggacacgtatatgttatacagataaatatagcttaaatatggctatatttacacaacacaatgctcgtgg

SEQ ID NO: 12360 - DNA, 497 bp, Saccharomyces cerevisiae
tggacttggtcaagatgaatagttgagactgagaaaatattcaagacactatgtatgtagtcaattagcatgtagtaagtaatcaaagcacttaaaatatatttttaccatcgcatcgttgtgatgcctctcctttgtgattaactatctactttaaacgttctattttctatgttctaattacgtatgtattggtcttttctctccgatggtaacaagaagcgtttcgggaaacagtggcacctccttgtcccttaaatgtcgaactttaacagtataagtacaaagtgaaaaaaaaaaaaaaatggaaatatctatgatagtgatatgatagaagagctatttgaatgctatgttgtcatatttagccttacaaaagggaaaaggcaaacacagtcttttgttattactataggaaagatagaattgatattaaaacagtatgaagttattgcatttatatgaagcgagcttgaagagaaggcccaaaactacga

SEQ ID NO: 12361 - DNA, 415 bp, Saccharomyces cerevisiae
caaaaatgtccttaataaacgccttgttatatctttatcaaaatggtttttacaactatcgaatagtgtgaaccgataactgtgtagttgtatattaatagaactttacttttgcgcaggaacaaacattttattgcgacataggcataccttgccctcagagatctttatattcttgttcctcgtggcccaatggtcacggcgtctggctacgaaccaggagattccaggttcgagtcctggcggggaagaatattctttttgtcactaacacaaccattctataaattgaagagaaaaattaaatggccaatattctacgtgcttgttattagaaactcgcaacaattgttctgcaaggcccctcatttttttttgctatataaaataataaatggtcacgttggcataagtt

SEQ ID NO: 12362 - DNA, 427 bp, Saccharomyces cerevisiae
aataattctaaaatccataggtaagtactgaaagcaattttgcgttccgtcaatgcatattatatatattaatcttaaccatttatgtaaacaacatatcatttcattttgttctggccacattccctgttcctctcaatatagtgatgttttataagggatattctttgcggctccattataaatacactttaccatgagagtttcctcaccagctatattactcgcgccaactaccattcgacgcaaggaacaaaaaagcatctagataatagtagagaggtggtgatacaccctcaggttgctatgacgatatattctccgtaaattctttcttacgattattcctttagatcggcaagagatttgggcttgaggaagcgataaaattctttgttgacaaaactctcccttagtgcttgtgaaa

SEQ ID NO: 12363 - DNA, 472 bp, Saccharomyces cerevisiae
aacttcgaaagaaacagaggagtctgggcatatgcgcattatgaaatttattccttgcggccctataatatttttggggcttatttatcaaaacagtattgtctcctcaattctttagtttatttatttctttacgataaaatcgttaacaagctttcaagaagcgcatttatacgttataaaacccacaaaattgaatacaaaagcaaaaccttattgtcttaatgagccgcacaaacgcacaaacacttaaacaatcacttttgatccgagtttccgctctcctcgctctagttagattctaatcttatataagttatataggataagtgatattctgtatgagaaagagatgaattgagagacagtccctaattcaaagaaagtcgaaatgtaaaaattaataatgtatattgtcaagagatgttcgaattagttgataattgttggaattttattgttgttaaaggcc

SEQ ID NO: 12364 - DNA, 488 bp, Saccharomyces cerevisiae
gcatcttgggattcggagaaccaagaggacgattgttttatttttgggtttagaaatgtggagaaataattaagagttataatgtttttgcaaaacaaaatgagtattatattacattgagttccttcccaagcatcgggttgtttatttctagatatacgccaactaatacatttctaacttcccaccttcattacatcataacctgaaagtgaacaacctcctcttcggtgatccgtactccagtttatttcatttttctgtaaagcaactacactatatttattctctatttattttatatacctattgtattttaattaatcgttattttgtccgcaccttcttcgtaatcgaatttaccttgtaaacgagtcgtcatgataagcatttgctgcattactgaacgtttatcttagcatgacattaaagtccgtttgtctaaaatatcacccaattatttccgcggtgtgagcgccagataaggt

SEQ ID NO: 12365 - DNA, 481 bp, Saccharomyces cerevisiae
accaagtgaacatcagaaaatgctttttgctagcacgtatgtgattaaaatttttgcgtaaaatagactgttttataatatttggtgtacaacatgggaccttcagaggtactttcggaaatcacgcaaatattatgcactagtaaccctcaatctctaaataacttatattgtcatctgtaaggcagcaaaatccaagatgggcaatgtatataggtatatagtttagtattgtcatctcatagaatatcaactgcataatatacatgtatatataatttcccattcatttagaggcttcttttttcgtctgtatcgctgaaccttatgccggttaaatctaacaaaatttttttgaactggaggaactaaaaaaaaaaatattaatcttgactaatatactaatcagtcactttacatcttaatgaaaccgaaagaatcactgataaaatgtccgactccgactccgactccgattatg

SEQ ID NO: 12366 - DNA, 411 bp, Saccharomyces cerevisiae
catcagtgaataaaggcttgtaaatatagatatatagtaaacgaaaagaagcatatacgtataattatttgtgggaacggctctagaaaagaaaactttgcctttaactccttaagcttggtaggttgaggaagatatattacctccgtgcccagtccaattgatatgaatatccttgtctactggcaaatgggcagaagcacattcaggtaaaattctaaatgtatgagcgccaaaataatcacgttgcgcttgtaacaagtttgctggtagcctctcagatctatagccgtcgtaaaacgctaaagcagtagagaaagctggagttggaataccgtaagtagcagcaagggcaatagttcttctccaaccggattgggccttagtaactgcagaagcgaagaactcgtt

SEQ ID NO: 12367 - DNA, 468 bp, Saccharomyces cerevisiae
ttacctttatacctttattttgcccttgccttttacttttttttctgtttaacctcttttttgcatactttagttctctgctcagttgtttatttttcagtagtttttttgcaatttttttttttttttttaccaaagtaaatttgtaacacctagtataatattctgaagtaacaacaaaagattatgctgattctcctttcttttatctttagcggtttttgaatccatactcgacattttttgattttattttttgcacccaatggttgtcctggtgaaggatgatgggtgtgatacctaagcgtttttgatgaaaagtttactatttaaaaacatataaattgttttacatatgttaagataaaagaacacaaaaaaataaaacggttgaaaacgaaaacaagtccatggatgtttcaaaaaaatacatgagcagctcagagtagagcagaaatcagacctgca

SEQ ID NO: 12368 - DNA, 492 bp, Saccharomyces cerevisiae
gcctgatcatttttcgtgtaaatttatagcgccatgtaaccaagtattttagaacgtcttttatttaaacctttaaccatacaacacttgcccaaggaagaggaacagaaggattttttaatttgtaaaaatgcgtttaatcttaacgaaacataatacagatttcatgtgcatttcgccctttttttttatgacaagcaatatcttccaaagtttctcaaaaaggtatgatgtaagatacagtaaatgatatgtaaaaaaagtacaaactccacttataaaaccatattgaaacagcgaatggttataatattttacataaagattaatagaatacacttacctaagaaaaatatccgtgaaaacaaattacaaaattaaaagtcacttatcacattagaaactcaaatacgaaaacaaaacaaagaaaagtaacaaaaagtggtttgaagacggaaatacgatcattctttccattcccaacatgtcatg

SEQ ID NO: 12369 - DNA, 403 bp, Saccharomyces cerevisiae
catgactgctgatatactgaatcgtattttttttctagaaaatatgtatactatgtgagagtcaatttaaataatattaatgataaatgaaagtgggcagttataatagtaatatacagtgttttgttaataaatctccgactctcgattggctattattagagaagaaaatccaagattgaagtaaacgaaaaaacccctaatcgaaagtaattttttttggtttcttagtcaaatcgacgtccttaaagaatgaaccataagcgctatgttccttcttcttagtgtgagtaccgaactttatcaaatcttcaggaacaggttgattggcaccattcaaaacgttaaccagtccaccagccaaatgcttttcttgttcagtgaacagagtgtgtgctgtgcc

SEQ ID NO: 12370 - DNA, 471 bp, Saccharomyces cerevisiae
tggggttaagatagcaacgtatatagactttccttattttctttagaataaaaagcataactaaagttgtaaaaggagcagaattatgaataataaacattgatgacaatagtggaaaacgacataaataataattttataatataataatgataattcaccgtcagagggatttgtatgcaaatgattgatgacgcgagaaaaaaaaacgcgaaatttttcttcccaaagcttcgaagtttttattccgtccacaaagtgaaaaattttcagaaaattttccagactgtgaataaacaaaaggttggcttacgcatttggcttgtcttttttttttttcacaggttcttagtaaataattgtataaaatatttatctggagtcttctgtttgttgtttagccttgtttgaagttttatttaacttattaccccagttaggtactgtgtattttccgcatatctggtgtct

SEQ ID NO: 12371 - DNA, 425 bp, Saccharomyces cerevisiae
gattaaatcattttcgtttgcatattaggttaaagagactgtgattatatatacatgcacgttagggtgcagcatacaactcagctttatagtctacaacgtatttataacgagcattggaaacaggttacaggacaccaaagggtttgggtttccaattttgaacccttgaccaattttttactggtgtagctctgttctcctcttgtttattttttttacctactgttccgaaactgctcattctctgtttcaaagacgccaaatcgcctagtatatcattggtatcagcctttaatgccggactcacttccttcttcaatggaacggaatctttttccgcaggaataaaatcatacagctttatttcaccttcattaaaccttaatgataaattgtctatgttttccttcagttttgcctcg

SEQ ID NO: 12372 - DNA, 489 bp, Saccharomyces cerevisiae
tgaaatagctacgcaacattgaacttaatactggctaaatttagttatccgccttggtaaacaatccgtatcctttatttaaactgtcttctcaggaacattacttatctacataaataacattaaccctgtctacgtacagtatatatttgcgtgtggttgtcaaactttagatgaaacgatactcaacgaatactataaaaccagaatggtaagggtaagatagcgggagcaaaaaatcacaaggatgcacctatttagataacaaagcagcgaattgttgaatgttgatctcgcctgatccatcactaacctctcttagcatatcatctacttcggcatcagtcaatttttcaccaatggatgttagcacgtgtttcaactcagcggcggagattaaaccatcaccgttcttatcgaatactttaaaagcttctagtagttcttgttcagagtcatttgatttgagttgacgagacatcagagcca

SEQ ID NO: 12373 - DNA, 495 bp, Saccharomyces cerevisiae
gtgaacaaaacacaaataagacttgtatattaacgtgtatatcgttcattaaagcatattttgacgtatttatactttatacatttatatatttctttcccgtttcaaattttcggttcaaataaagttgcatgtggattattatgttcccataaattctagtttttattattttccttgcaccgtatacctttatagagatttgttcatgaatcttcttcttgtgaacgccaaccaaaactttgagggatattccttagaatctgtagagctatagactctttctaatagtctcattgccaattcttgacggaattgctgaatataagtcttcaacaagtccatcgaattatgatcttgtactggaacttggtaaacattattcagagggaaacccggtgtacctggtaaagtaaagttgtccaaggccacattggttaacactttgacggcttcgttaaatgacgttgttattttcaaatgggctaggcaatc

SEQ ID NO: 12374 - DNA, 486 bp, Saccharomyces cerevisiae
acaaacaattgattttaaagtgcttaatatatacccaatttgcatatgtaggcctctacctaatgataattagttaatttgtatttaatgtccgtattattttgaaggtattgctagatgattcttccgggcgcctcgccgagacccttttattgagcaaacggatgattaatggataaaggcgtataaaagctccaaccccttttttggagtatagttttattgtccaaaggatatactctcaattataaatggaaaagcacatcatgagtgaagttgagagcagagaaaaggagcctgacgcaggattgtccccagatatcgttcaagctacgctaccatttttaagcagtgatgatattaagaacctctcgcagacaaataagtattataatacattactagattttgaccactctaaaattttgtggcatgaactatttcataaggcatttgggacattaaagacaaatgacgagcctttcc

SEQ ID NO: 12375 - DNA, 490 bp, Saccharomyces cerevisiae
agatagggatacggactcaaactagttgcaggtgttttaccgcagctgtatatatcttgtaaatactttgtcaggttctttgtatcacttcaatctatgttcatctatctatctgtttttcttaattactaagcatttgcggcaatgcgatgactacataaaaaaaaaaaattcgaaaaatttcatgagccttattaacatgaagattctagtcaacagtaggccatctgtgtttccattaatcgctgcatgtcatcgagcaagaaaatcgtcatcctctatggatcggagacaggtaacgcgcatgattttgctacaatcttatcccatcgactacatcgctggcatttctcccatacattttgctccattggtgattatgacccacaggatatcttgaaatgcaggtacctttttattatatgctccacaacaggccaaggtgaattaccaaggaatgtcaatgcattaaaaggtgaaagacccgtca

SEQ ID NO: 12376 - DNA, 448 bp, Saccharomyces cerevisiae
tggtaatcatttgaaaaccttgcaatgtgtgtgaatattgtaaggaattgagaaagagagataaaaaaagagacagaagtatcacttccttttctaatttttctttttcattttttttttaaattcatctatcgtttatctttatctcatatatatttgcttctctctgaagcgtcatcatctatctgtatttttaatgcaatcatagtataaaaatttttaaccaaattcaaaaattataatattttaaaagtttatgcttttgtccttttatattcaagtcatttggccattattacgcttttttttttattaggtaagtggtttcaataattaaattctttagcgggaaggctgactatctatagtattgaagataagttaaattaatgtttagttctgatatttcatttttattattaattaaatttgcactattcgccatgac

SEQ ID NO: 12377 - DNA, 409 bp, Saccharomyces cerevisiae
aaaagaaaaagacacagctaggataccgaacttatgggtcgttcaatttaacagttacattgtaaatagaaaaaaatagtaaaaaaaatgaaagtcaaatgattatgcttgtcagttcaaattattaattgggcttaagggcgtaaacatgcgggaataataaacatacatacacacatacataaaatccgatgccatccactcgcgagattgcttttttcctttcgtttctctttcaagaaaatcatgttgaaaatttctatgatgatatatagtagggaactaaaccaaataaagaaaagtcaactttagtgcacgaaatcaattcttaccagcaccagctctgaagtaaatgatatcaccgtcttcaacgacatagtctttacccttttgcatcaacttaccagcg

SEQ ID NO: 12378 - DNA, 493 bp, Saccharomyces cerevisiae
tcacattacaataacaaaactgcaactaccataaaaaaaaattgaaaaatcataaattaaaaaaaaaaaaatcaattgaatttttttttttcatgattacgttttgacatttttcctttttttttctcttattacgatttaccttttttatttatttttttcattttagtattttattcttcgttatttatgtatagaaattttcattttcatttagattcagatttggttatcttttttcattatatatcttttgcactaagtttcaacttaagttctattttttattttttttttctgggccctggagcaatagatatgggatggcttactgcatctcttcaaaatttcacagtcatgctcacccttaagttctcaaccttttagtttttttttttttttttttttattttgtatggcatactaactatacaaatatttatatgtacatttatacagtaacctattatttaccgatattcaccggtatttt

SEQ ID NO: 12379 - DNA, 423 bp, Saccharomyces cerevisiae
tagcgtgtatgtggcacgtactaaaagtttggtgaccagactatctcttcttaagttcattttcactctgaaacttataaatgcatacatacagaaattactttcgattaatataataatatatttttaataaacaatgaactaatgcccttattgtgttttgttattaaccttttcatcaccatttttttttgctagcttctacggcattcacttacgtgctgcaaaatttcgcagcatggaagaaattgttcgcgaagaaaaaagatttcgctcagtgatttgtagtgacaataggtaccagtgttatcactaagtatatcttttagtatatctcttcgcttgaggagggatcaaaaaaaaacaaacgtaaacgtgcacataaacgtcaagtactttttgcaggcattaatattcgtctcc

SEQ ID NO: 12380 - DNA, 455 bp, Saccharomyces cerevisiae
acatctataccctttatatgacattcacatgaattcaacagctttgtaataatcaacaaaattgcataggatgccacctcataacttttgagcacagcatttccgcgatcatagtatattttagactctaagattgaataaaagtatgatacatcttaagtatacatatatatatgtatatatatatatatacatgaaagtttacctcctcatcttacgtggacgagattcatcgtcaccgcccatagttgttcttttaccattctgggcgaagtattctttctttttctccttatccctttgtgatttttcttcctccatcttagctaattttttcaatctttccttacgttgactagccttctgttccttcctcttgctgtctttggctttcgaaatcgtcaatactttttgaatgaatgatcttgccttcttttcatcaccacctagcacca

SEQ ID NO: 12381 - DNA, 416 bp, Saccharomyces cerevisiae
tttttctatcttcaacaacgaaacgccttacacacacacacacatacatctacatacatacatacaaatatacatatatgtaaacttgtatattcattcctattaaccaaaaagaggcaattaaacttttccctctttttctacgtcatttactcaaaaactctaattccttcgtctctgttctgccattttctccagaaaaaaatcgacgggaaataaaaaaaaaaagacaacgaacaagagaaaaagttcgcgaattataaaccacttctataattaacaggaaaaggaaggaaaaaaaaggaggaaatagaaaactgcaggcctttattcatgtttgatcttaagacgattctcgaccatcctaatatcccgtggaaattaatcatttctgggttctcgattgcccaattttc

SEQ ID NO: 12382 - DNA, 457 bp, Saccharomyces cerevisiae
ggagattgataagacttttctagttgcatatcttttatatttaaatcttatctattagttaattttttgtaatttatccttatatatagtctggttattctaaaatatcatttcagtatctaaaaattcccctcttttttcagttatatcttaacaggcgacagtccaaatgttgatttatcccagtccgattcatcagggttgtgaagcattttgtcaatggtcgaaatcacatcagtaatagtgcctcttacttgcctcatagaatttctttctcttaacgtcaccgtttggtcttttatagtttcgaaatctatggtgataccaaatggtgttcccaattcatcgttacgggcgtattttttaccaattgaagtattggaatcgtcaattttaaagtatatctctcttttacgtaaagcctgcgagatcctcttaagtatagcggggaagccat

SEQ ID NO: 12383 - DNA, 418 bp, Saccharomyces cerevisiae
agaaaaagtatacataaactcgaccaaaaagaattcgccatttcatgtatataaaatgcatttttatcgattggcggatgaacgtaaaagggagagaaatatttttatgtgtatgtaaaaaaatgtatatgtatattccgaaaaaactattaattttgaaaaaatgaaaaatggacttacagaccaaatcctttatacattaagatcagtgcactatcactttcgcccccaccggctaaagattcaattttttccttttcaacaacgctaactttatcatcattaaatttgtaccatttattttcgtccagttcgtcccttatgaaagcttgatagtgtccagactcagaattggcaccttgatgtgtaatgacaccgatcaagttataaacacaagatgggttttcacctttttcca

SEQ ID NO: 12384 - DNA, 472 bp, Saccharomyces cerevisiae
atgtgtcaaactaggctcaaaaaaattttattgtattctaatatttaggctatccttttctttcagtaaaaatgtttatgtgctacatacaaaacccttcatgatcaaaaactgattaaaatttagagaggaacaattgtttttaaaaaaaatactaaaaaacactcacgatgggggtcgaacccataatcttctgattagaagtcagacgcgttgccattacgccacgcgagctagtcatatgtttctttcgtctttttcatctgatgacattctagtggaacatttatggtaagataccgattccattttaaggatttctataccctcgaggagaacttctagtacatacataattttatagctttgaccaacaatggaatcccaaaaattatcaaattttttatcaaatattcaaatatatcaaatattctaatgttttataaacgttttatgaatgacatatatgcga

SEQ ID NO: 12385 - DNA, 409 bp, Saccharomyces cerevisiae
tgagaataatttcgagcgccgatccaaatattaggtttgctttatctttttttatgaaataagttcatgaaatatgaatactataccactacgcatatatatattttaagaaaattttcgaatgaaacttgatgaaattagtccattaaaagtgtatgggtaatcgaagagcccaaactaccgttagtataatactttgtactttgtactcaatacttaatactaattaaagtctggattacagtgtcctatgataattgtgttagcttttcatcttttattgcgactacagttaaattttatggtttatttattcctcgttgtttcgatgcacgatgcgagtaattgcaggatctcttcattgtgcacgctgagttgtggtacaatgtcctcgggtaacggtatcgta

SEQ ID NO: 12386 - DNA, 466 bp, Saccharomyces cerevisiae
tgtcacaggaatgtttactaaaagacttccattcttggctttttttctttttgtcattcataattttcagttcatttccagattatttagttcattaattgttattcgtgtattaaagaattatgtattaaaacgcttatttccttcttttgtttgaatgtgttgtaagcagttatggggcactatatcttctgttaatgaatatgtgtgatactttggcttatcttacttgctcattcgtggcttcttgtcacgccatacgttacgcgtttctcttcctcttcgcgtgttctgaataaagccaagtggcaatgtctcttccaccatataacatgaagctttagcaagcttttagctctagacatagttgacatatcagacctacagaaacataggaatcggtaaatgacaaagaaatcatttgtgagcagtcctattgttagggactcgacattgctggtaccaa

SEQ ID NO: 12387 - DNA, 498 bp, Saccharomyces cerevisiae
ctatcattctcatcatttgtcatacttaaagaaaataatattaagaaaaaataataaaaaaagaaacatagttatgagaatacaaaaggaggtttccaaaaagtgggcttttttaattcgagtaaaataattatgaatgtatacttaaatatattttgtatctgtcaatatagagatgctttaattggtgttttgacattttggaatacatattgggttgatttcccaagttctcgctgcaatcagataaaaaggaaaaaaaataatggttgctaagagattcgaactcttgcatcttacgatacctgagtattcccacagttaactgcggtcaagatatttcttgaatcaggcgccttagaccgctcggccaaacaaccacttatttgttgaagaaaaagcattatttatcgctagacaacgatacgtccatcaacaaccgttagttctttcacattgatatgcggattacttatctgaaggaaaggaaaaaggcgt

SEQ ID NO: 12388 - DNA, 475 bp, Saccharomyces cerevisiae
aacctctccgcccgtatattttttttaatatgttaaatagtgatagaactgataagcctcattttcttttattgggctccaagacgcgaactgttcgtagggtaaccgtttgacacctaaacgacctttcagcctcacctgcagtatttcttcaacaacgcctgtcgctatgttaaataatagcaatcgtttgtgatcaccattgtcgaatttgacgcgcttaaacaaaaaccattgttttggcctcgttccctgcattcaacaaaagagcaaggtatgccgtcaaacagtcgttaaaagagaaggtttataaactatcttgttttgtactttgctgtcccggatccagttgggtcttcttttcaacctgtctgagtccgatctttctttccctacttgaagctccatatatctaagtcatctaagtgtatcctgctagattacaaacgaaaatgtctcaacacgcaagctcatc

SEQ ID NO: 12389 - DNA, 441 bp, Saccharomyces cerevisiae
tctccctgttcagtactttggtaaaagcacgccatggaaaattatttagaacttccttatacaaaactaaatatttgagcatattctatattcatacatagatacattctttgaatttcaagactcttatttctcattttgaaagccaagattggaggaaaaatcgtaaatttttatccagtcagtaacaactgttggccagtcgaaaactctatcgaaacagcttctatatgtcagataagatagatttattaaattaaatatattcaggagaggaaagacaacatgaacgaaaaaaaaaaaacagtgtagagaagcactacaaatattttctcttccaaaaaatataatatacataaaaaaattagaaatttatctttgttaatgcagtagacttttaattctaaaattttgatttaaaagttgaatttgttttcgccg

SEQ ID NO: 12390 - DNA, 499 bp, Saccharomyces cerevisiae
ggctaattttagtagaaaagaagcaacatagggaccttttcttcgttgttctggttacatttatctgtactatataattttgcacagcctgtagacaatgccgcttgtccacaatcatgtaaatataaatattgaaacttttcacttgtttaaaatttatggcaaaccactttaatacttttttctttttaggtacaatatttacattttgatactgtccatcagattttagtcactaacatctaagttaaggaagtaagagattcagactccggtaaggaaaaaaaaaaaaaagaaaaaaaaaaaacaaactctgaaatgaaagcattagaagaaaaagttatatctcatgtacaatttgagcaaatttggaccgatatgatttgaggttgtatgataagaagtgctatttatgattgtttaaaaagatgttattttattaaacaattatacaaaatatccttttttttaataatggcttacatatttttgaaaaggg

SEQ ID NO: 12391 - DNA, 426 bp, Saccharomyces cerevisiae
tgattggagcacccttactaaaaaaaatattcattatgtagaaactcatttcatgtacatacaaaatcaaaaataaaacaacaaatagctgaagcaagaaaacgctactttacttataaaagaaaacgttatgcctgaatagtcagccttttgtataaatcctttacactcaatggcttactaggcagtgaagaataaagaacatagtacagcttatttctattgaccattatagactcccctcggacaatctttcgtacagtagcaaacgagaaataatttgtcctcatttgcgacaacaatagattgtatggtctgaacatactcttgaatttaataggattgttttgaagttctaaggttgtatgcttgttagaaaccgtggttttgagctcaattgaaatgccaccgggtagacgtttagga

SEQ ID NO: 12392 - DNA, 497 bp, Saccharomyces cerevisiae
accctacagcggtacatttctttgctacgttgctaaggaaactctttaaatctgacatggctgagaactgcagagttgcagagttgcagactatcacatccgtacatatgtataaaaaaatccgtgctttacatactaactgcttttcttttttccgttcgaaaaaaaaaaatgtcgtgaggttgtcggaaacctcagaaaaaatagatagaacaaaacagccttacgaacggtatgttgcattttaaaggctacatgaactgcacattaaatttgccactgtaataatcttccatatccccatacaaaaactacgcaaatatggtacgtaatgcctcattaggattttaaaatatgaaaaaaatggacgtttcagcgaggaatgaataacaagaaatagctaatttgaatatattactggtgtttcatatctatatataccgcagaaaaagaaataaaacgcaatatatctttaaactggctccaccctgagaata

SEQ ID NO: 12393 - DNA, 414 bp, Saccharomyces cerevisiae
taaaattgatatgcgagctcttcatctatttaagttgattttttggttgtaaacatatttgtattttattcttaggtttgttaattcttctacgcttaccagatatagatgctatatgttattgcattacgcacattacccggtgggacaaattatggaaatattccaaggctataaattctttggtgaaaggaactgaaattatgtccagtaatgcaccagaaatggacatataaaactattaatgcattttattacaattatcctaagaaaatatcctatatataattaaagtaaaagaaataagatcaaaagaacaaaataaagtcgagtagaattttcctacttgactatattagaacgaaaaatgttattttatcaaagtaattggttagtagccgacgtgttatccgt

SEQ ID NO: 12394 - DNA, 401 bp, Saccharomyces cerevisiae
aagttctatcattagtatatggggatatttaaaaaagaatataacgttgcatatgtaaaaaaaataaaagtaaaagaatactacaagtcgttgataaagaaattttacgttattaatatacacactaaaaaaaatctaatctaataatagaaaaagttttttgaaaaaaagaaagctgttaaatatataggatgagatggagtgatgagaatcatttcttagatttcttagatttcttttcctcagaatcaccgtcttcagactttcttttcttctcctttttctctttcttttccttcttgtccttcttttctttcttttccttcttttccttcttgtccttcttctctttcttttcctttttgctgtcatcctctttcacttcttccttctcagtttcg

SEQ ID NO: 12395 - DNA, 475 bp, Saccharomyces cerevisiae
cattattccgtgtggcaataatctcaatgtataataaataatatttctcttcatatatatgaccggactcgtaatagaataattgactggaacaatagcgcatattgctttgcttctatacgtagttgagttttcactcacgtacagctagagaatctcacataggagtatccctgtagttagttccgcgcggttcgatcacggatatactttcaacaatggcagtatgaaagcctgttataaaaaagaaggaaacaataaacgaagtgcttttttgcctcctaaattattcaatttgacaactgatttccagccattcattattcagtgaggagcgacaatgtttggagtcaaggatgctatattcaagattaaacgttccattgcaggcacagattcttctgattccactgcttacacaacggcaagtgaatcttcacctcaattaaaagattcccataacccctttcgaaat

SEQ ID NO: 12396 - DNA, 401 bp, Saccharomyces cerevisiae
tgccagtatttttcagctaatttctcgtcattccctcttttttctcattctgttttagaatgtacaggttatgacaaccattaccttctaggatattttgacatttctctcttagactttttatatataatatacatgtttcaataccaaatataatgtagcataacataatctatctttttactcatagacctttactttcctctctaaaagccgtgtcgcagtaactggtgacgctaaagttctccggcgtttttttatgtatgagctgggcatcaagaggcttttgagattttccaagtagtaactcatctttctgagtgtgctatcaaatacatactaaggagaataaactcttgttattacgtattcttcatccttatgggtagagagcgcactgt

SEQ ID NO: 12397 - DNA, 496 bp, Saccharomyces cerevisiae
tatggttctccgcaattttatgttctcgcatcactgcccaaattcattagcattagcagtacaagctatcctatatataaggcaataaaaaatcttataaatactatcagcaagatttcaaccttggaaaacatgcattcaaaggtcataattgctgctctatttacagtcgtccataatgacatttctctttgattattttcttgttttttcgctcttctcaagtggatgttacataacaaacaaaacagaaaaaattgtttaaatataaagtttaaaagttatctttgattccgcacctgaatttttggattgaaggccaaaggaggtttatcagggagagaaaagctctctatttatttttataaggaataattgtgcatgtacaactatacaatatgtctagtgtaccttataattcccaacttcctatatccaaccatctagagtacgatgaagatgaaaagaagagcagaggctcaaaactaggcctgaa

SEQ ID NO: 12398 - DNA, 493 bp, Saccharomyces cerevisiae
catgaatagatcatgttaagtatcgaaaatgtcacttggatacaaggatgttggtagaaagtctaataaaataataaattaatagtacaacacaaatttaatcttacgtttaatcctgcgctattaattgaaaatatatgcatggagaagaaaaaaaaagtgtccctaatttaccattgttatattttctcgattaatgggctcatttcttttcactaaaagctataaacaagtttgatgcattttaatgggtaatcctcttactgtgcttttttttcctatcttgttctatatgtcaatgcctttctgtatttttatttatagcttcgccagtcttcgtttacgatatgttttatataatagaccactcagcatatgtatagttttgtatatttatatcatttattagctgacggctttaacttcatatttcgatttaatcatgctactgcttcaccatttgtccttttttttacagaggccacgaaaggaa

SEQ ID NO: 12399 - DNA, 426 bp, Saccharomyces cerevisiae
ttcaaggtgtaatctagtatggtttgaaaccttacaatttttcttctttgttcctttttccttgtttcagtgtatattaggttgggaaagagggatttttccataccatatgactgactacaatatatacatgtataataacttcataatctaaacctatcagttcagtatcaagtcagctattccgccctatgcataaacctacaaactatcattcacacacttttcccattttttttcaatactactttacatccgaacattttagcaacccacaccatatacctttggtgcactattgattttcttcctgatgtcagctttttgtgctttgacaaaaaaatcgcgtctacgtccgtccgttctccctgaataaattaggcgcgtttgagcccagcaggacggagctctagtgacaagccctgg

SEQ ID NO: 12400 - DNA, 421 bp, Saccharomyces cerevisiae
aaataaggttgatgtagtgtagtctaatatagtttccgtatactttttttgtgtacgcatgtgtgttaatagggaaattcataattaacttaaggaagcatttttttactattttttcattacctaaacataattttaattttaatccctgtgtgggattttagggtgtacgagatatgtaagttatgagcatatttttccttagttgacgaataacctttaagtcctaggaggttcaatatgcaattgcatgctattatgcaactcaattgctcaaggggctattcaggtttacataatacggatgaaaaagataaagatctcggaaaaactgaaaggcactcttcggaaaaacctcttttatggggggtgttctggggcagaaaccaaaacggcggaacgcgtccggaaaaacatacat

SEQ ID NO: 12401 - DNA, 441 bp, Saccharomyces cerevisiae
ttccgctaagagtcttcagaatatacatatacacataacacatacatattttttatagatatttctatgggtaaagttacgtcaagggtactctgtccattctaagttttcatgaagcattgttattcctaaattcttcatcaagcacccaccctttacgctctttatcaaactgtgctatggtttttaataatgctctaaccttaataacgtcttctttatcagaaagactgacgccaatgctgttaagtatgctaacactagatgagaaaaagttattctgtttctgtaaatatgcccgaatattttctagcgttttggtattggaattgatttccttggatcttgcgaaggttataccatcgtcgtaattttcttggcgagcttccttggatgcctctttttgtgattttgtaatattgcctaaaatggcagctgatc

SEQ ID NO: 12402 - DNA, 500 bp, Saccharomyces cerevisiae
tatactcaatgtaacaatataacaaatttttatcttcaaatcaaggtaaaaaaattcatatattctcactttctttttcttttcttgactattcatctacatatgcatttcacgcgtaaataggttgatctacaaactttgaatgaatttttccattggctcgttgccatttaccaacgaaatggtttttttcactgttgcatttggatgtagcaagctttccacaataaaagaagctacatcctccctgttaatggagtagttaacagaagccttctcttctaatttgtcaaggggttgcaaaagaccggtacctttatttagttccaacgatccaggctgtaaaatagtgtaatccaaattagagtttctaacctcacgatcagcagatctctttgcaatatagtattcacgcaaacccttaatgttataccaaaaatctctatcctccgccttgagcgctgaaacaacaacgaaccttttgataccagccttttcgc

SEQ ID NO: 12403 - DNA, 494 bp, Saccharomyces cerevisiae
atggatctatataacttgaaatatgctctattatatcgtgatttaatgacggctgttggcatttcggtctttaccaaggtagtaggatttgtatgctgaatgtgcgccagtactatcgaaccatagaaacccatatattccccaatattaataattctactgagaaatgggtgaattttgaaataattgttgggattccatcgttgataaaggctataatattaggtatacagaatgtactagaagttctcctcgatgatataggaatccccataatggaatctatatttctatgtaccaatattacgattattcctcattccatttcatatgtttcattatcctattacattatcgatccttgcatttcagcttcctctaacttcggtgacagcttctataataacttatgtcactatctaacaccgtatatgataatatattgatagtatgactactagttgatagacgatagttggtttttattccaacat

SEQ ID NO: 12404 - DNA, 412 bp, Saccharomyces cerevisiae
taagaattttgattagtgttagagctaaaacgtaagaaactaaggatccgcccgagaacggtataatggacggaaaagaatgcttctcttttgtaatatagatgtttaaagtaatcaggagggcagtatgtatgtgtaaaaaataaataaatatatatatatatttgaggaaccagatctcaaatgaaaaatataagccagtatattttttgcattgtagccactgttgtaacctctgggcatataaataataatgtatagcgcctagtatcaaactaaactcgccatgttggtagtgttacactcatttttagcaaatttttttttcttatcaaactcatgcttttcttgccttactaaagaagtatacagcaccaggccaacctaaacaaacgctcaatactgcactcca

SEQ ID NO: 12405 - DNA, 405 bp, Saccharomyces cerevisiae
agttaaacccaaagaaaatataaaacaaaaaactaaaacatactcaaatattcgagactacattaataataataataataataataataataagtttttaccaaagaaaaagttgtcaaaagtcatacatatatatatacatatttaatgtatatatttaatttatttttttattttggttaattagttactcatagatgaatggtaatgaaaggaacttcaacatcctctccttccttgtcatctgcgcaaatttcgagaatcattgtagatacatgtgccggaatatctttcttagtcactaatttaaccaattgagttattggtagatttagtctttctttcaatttctttggagggaaaaatgaggcataaagaagagaaacgccataagaaagcattgtt

SEQ ID NO: 12406 - DNA, 454 bp, Saccharomyces cerevisiae
acgaatagatagaataaataagtacatacaatttttactagtgatgaatatcagaacgcagggtaatgggcccgctatattttttcttcgatatagggagagccacattcagaatattcagagtatttgcatgtagaaatttattctaagtgcgccagatatatgccgggagaggtcattagaaaacatctgtttgtgttttaacttgaattacaataacaataataccagttttatatggggaatataatgtcagctagttttgcgcctgaatgcactgacctgaagacgaaatacgatagttgttttaatgaatggtatagcgaaaaattcctgaagggaaaatccgttgagaacgagtgctcaaaacaatggtacgcttatactacatgtgtcaacgcagctctcgtcaaacaaggtattaagcctgctctagacgaagctagggaggagg

SEQ ID NO: 12407 - DNA, 425 bp, Saccharomyces cerevisiae
atataaactcataattgatagaaagggacgattaaataaaaaaaaatttagagattcttaattaagtctaagaacatcctcccacacgccaggagtggttaatgttcaagattggtattagttatacacggtaaccaacaacgttggtaaggtctttttcttctatacatgaattttaagatcaagcatatattttaggcttgcatcttgtaatgaactaactttcataaatagcttttcttttttgtatgaggtataagatgaaaaatgttaaacatgatacaggatttaatataaaatggaccaaaataaggagcaataacgagattcaccccaatgggtgagatgagaaacgccaaggtagtgaaatatttttgtgcaacaatttcaaagataagatcggtgttctcccgcagtagtccact

SEQ ID NO: 12408 - DNA, 437 bp, Saccharomyces cerevisiae
agtatctccatatcttgtgggagcaaaccctttcacacaaatccactatataaaacaaagcacaattgcacctctgatcttttaatcttaattaaataagcgtgattaaagtgttcatgcaagtagataatatataatgatgataagttcgaaaatgcccttataaaaattaaaccgcgtgctagaagtaaacctccttcaacctgcctcttgaacgaataagcttcttacaagaatctgcgggacataatttggggccataattatccggatgagccgaaccctttagttgagctagtttctttttgggcatcttagattttttttttgcattgtcaatcctggcgaaacacctaccacaaaatgcatgaccacacgatgcaataaacgttcgttttgataaatctctatcaagcattgatggtctggctagggtt

SEQ ID NO: 12409 - DNA, 474 bp, Saccharomyces cerevisiae
ttcgcgaaatagtataaatgaatagattttaaagaaacatgaaaaaacaagatcagcatcgagaactgtagtacggagcagagattttgcatgactaaacggactcattttccttgtagtagaaataaatgctgaaaataggttttttagtgagaaccggaaggtgttactttcatggtatattcgtatatacttttataatgtaatttgaagagctccgttcataaaaattgtcattctgggcttcaaatgaataaataaacccgaatgacaatgaaatctcgaaattataatagtggtacctagtgtagtaagtataaaggaaccttctctgttgtatctcagaatgggatacctcagtatgacaatacatcatcctaaacgttcataaaacacatatgaaacaaccttacagcaaaacgaacagaatgagcaacatgaaaataaaactctgccttccttagctaacctact

SEQ ID NO: 12410 - DNA, 433 bp, Saccharomyces cerevisiae
gaaaagcaataacgatatacaagaaaaaaaaaaagttcactgattacatataacatagtatagttttcccttcattcgtgtattgttattatttaacaatcttatgaatatcactgctgttgacagttgattaaatctgctaaagcatcagcaataaataaggtactagctgtgccttcagtaggaatgatgtccatagacttttttttgatcaactacatctgtacatattttattcctttttcgggaaactgaataactaaaattcgaaactttctcttccgaaaaaatttccaggcagtattcccgtctagttaatcactcggaaggaaacaacgagtgaggtttcgtgtcattctctagacggagcccagtgagtctacgtccgtttgggcagcctgatccttttgttagcttggtagcaatggctagc

SEQ ID NO: 12411 - DNA, 462 bp, Saccharomyces cerevisiae
cgttcctaactccaaatgtaggccttatattttataaacttaatagatatacgctgtccacgctcctggcggtgtaaatgatagacagatcccaaatatgttagcaaatcataggaacaacaccatattgtgaacacgtaaaatttagaatacgccgcacaattaaggtgtgttctgtaataatttgattattgatgatggtttaggaaccaatattcatataaaaaaatgatcattctataaaataccttatcgtaacacttgtaccatgctactaacactgtatatatttctgacccctaagaaaaagcacctgaataagctaaagaccaagttaagctttgcccattgtctaggaaatttctgttgaaatcaggttggctgaaaaagtcgtacgaaaattttggatcaagcagagccatatttaacatgattattcctttccaaccgtcattcacttga

SEQ ID NO: 12412 - DNA, 491 bp, Saccharomyces cerevisiae
tgacaaacagtatgttgcgatggggttgcatgtatatagatacatatagttatcattggtaattatttcatatttaacctaaatctaaagataagagtgtatttctagttatctcatttttccttgcatttctaccatttgttgaacttgttgatgcatcatctcttttaaatcggacacatcattttctaattcctccacttgttcagtcttttcacctaatagttgtaaggaggtttccaatttactttgcatctgctcaactctttttaagagatcatctttctgtttatttacctcattgaatttatcgttttcttccagaagtcttaaaatctcatcatttgcttttgtcttttctttcagtaaattatcgtataattcctttgatgctgataattcaccttccaatctttttaactccgtacttaacttgttcaccagatgagcgcttatgtggccgttagaattcgatagctggacgctagctc

SEQ ID NO: 12413 - DNA, 446 bp, Saccharomyces cerevisiae
gtcactttcaaggacagttcacatagcatagaattgtataatacagaaataacaatatattagagtttagtagaattctgagtcttttctcaaaaaaaaggcagaaaaaaagactagataaaaaagtatacttactgcaactaaaatgacagtataatgtaactacataagattaaatggaaagaaaaaggaaagaatgaaaagaacgaaaactaaataacctattaagtacataacattataaactaacctactctttctttaattccatgtggtcattgccaacctttcgacacaatttttttacaatggcaaacattagctttttattctctgcgccaggatattttcttctgatgaactttccaaactctttgatattgactttgccatcaccaatagcctcgatgatatctttttctgttattgtaggcgctggagtttct

SEQ ID NO: 12414 - DNA, 454 bp, Saccharomyces cerevisiae
atattagcactgccacaatgtatagagtacacaatgaagaatattatcattcacaaatacttttaatcgctttctttcttgttcgttgtgttcacaagaaaagggtttattacttcagggaactttctgctcttagtttctatattttcgctttttgctgaaccagttgctttattggtctctgcgtctaccctcttggacctagtaatacattgaatactatcaaagcttgcaggtgatcggagagtcgcatttatggtttcatgcggtgatatataattagaaggacggtcattaaaatgtgcactcctcgtgcgcacagcaaagttatgcagtgggtagcactttcgagttttcaaattaagcattttgctgtcttcgtaaatgtttcctggaatatttctgaggcccgcgatacggcttagcctatttatttccatagacactccagggc

SEQ ID NO: 12415 - DNA, 493 bp, Saccharomyces cerevisiae
gtgactgaagaataaatggggagaaaaaaaatactacaaaaatgatgagtgattttcagaatttgataaatacctacgtatctgatgtgtatacttctcttcccacaaattgcaatgtaatgccactattgcaatgtgctccagttttttttttctgtgaggatacatgattcctcttacatagtgggaatagaagaaaactttattcatgcattttacccaaaagtttctcttgtttaatatccattcatatcctccagctgagatttatgccaaatcgttacattttccaaaatagagccatcgggaacagtaattacatcattttcatcacatattataatgaccgtccctttcagagttatattacgaccaaaaaacacatttcccatcacagttaaatgctctaattccagaatattaggaatatctggtactcctatcttaaaagtctcataagttgcaaactcatcgcccaagtcgattgaaggta

SEQ ID NO: 12416 - DNA, 457 bp, Saccharomyces cerevisiae
ggctgatcggataattacaaccaattgcgtgcgcaagacttcattgggttggctgggaaagaaaagcgatgaacttagcaaaaaaaaaagctacatcaaataaatatcagccgtacactagttacgtatgtctataaatattcttttcaagattcacacttaaatatgaagagaaaaaagagagaatccaagaagaatacggttacaaaccatctcaatcctgagttgtgaatgcttgatatatatacatcaaggcgaaaatgaagaataacaacgagctagcaagagtgattgttcttatgctaattcttgttgccaataatttcccacccaccactgctaatccagagcaaatggcatgaccaataacagcacctgcaataacataccaatagtcgctgtcagtagccatggcaataatactaatttgtgaacggtcacctagctcgcctaggaa

SEQ ID NO: 12417 - DNA, 452 bp, Saccharomyces cerevisiae
ccctaaatgaactttatcttcttacagtttcaacatcttgtgacctgatgattttcctcaaatgaacttttgcgttttcattgagaaaatttcattatactttattttttttataaatgggtaccaaggcattaaatatagatctggtttactaatctgaagaaattgttttcaaccacataatttgtgcaatttggcgctatacaaagcccatgttggctacattagtctttgaatcctttagattgcctgaatcaatagctcattcaaaatattttggacaatcgatagttaactgtaacatgtgctgctatatagtggcaatctagatgcatgtatcttatatgattaagtataaaagaaccacagcaaagctaaacgtaaataagtagtttagaaagtactggatatgagttaagaatctgttaattgagcatgacatgaaaattttg

SEQ ID NO: 12418 - DNA, 451 bp, Saccharomyces cerevisiae
cgtcaatactaagtttaaaagctcaaaaatttagaaaatattcactaaaatcatacatttcggtaatgttcttgttttaaccatgtcatttgacttatttttttttgatggtttttcacagaatcgcatactccacgtgagaacaagaaaaaatgaaaggaataaggactaaatgtcttatatatatggatatttatttgttttattttgtatgtaaataacttttataaatcaaatcatccaatttattgacttcataatcatttaatcatctgcacccccaccgcgcggtgtggctgacatttcctatgaagttctcaacaggggagggtaacgtagtaccttcgaagagtttgtttatttactatattttatgctcttcttcagaagggcctgtgatacgcatgtttctcaaaaagacacctagtgcagctgaaccggcaaagtaaag

SEQ ID NO: 12419 - DNA, 448 bp, Saccharomyces cerevisiae
ttgccttagccacgtaatatgtgcctttaaagatagagaaatatttatttattaagttttagttctaaggtgtgttaaaatacctctcaaataaataagttacacacaaccatatatcaacttgtaagtatcacagtaaaaatattttcatactgtctatgcaacgaaggagtcactttcctccttccgattgagaatatcttccctttcaaattccctccatgtcctcattttaatctttgagtgatcaaattcaccttcattctcgtcttgtgcctttttattacctcccgcaatagttctcgtatcaccccatgagaagtcatcaaatttccagtacgcatatgaaggtagtacgaaattccaaataggcaaagcacaaatatatacgcacatccaccataggtacgaccatctcgtagcagttataacaacaattaagccgggc

SEQ ID NO: 12420 - DNA, 438 bp, Saccharomyces cerevisiae
taataaacattgataaataggcgtgcttcagcatatggatatttttcactcagttacccgaagaaaacagaggtgcgtcataatgcaaatgctaaatgaatgaatataggatgttagattgctggtacaagcaattttgaaacaaaaatcattacgaacagaagaaagtggagctgaagagcgtatatagttgttcatagctgtaaaataatttctaaattactatttagaacctttttgatatccagcatcgctcattagagattaatttaccaaaacggaataaaccaaaaaaataagaatagtgaacacacaagagaagcgcaaaagagtaaagagctaaaatgaggtcaggcgatgcagagattaaaggaattaagcccaaagttattgaggaatattctttatctcagggaagtggtccttccaacgattcat

SEQ ID NO: 12421 - DNA, 475 bp, Saccharomyces cerevisiae
tgtgggcttcagataacttaacattttgtgcattcatctgcctttaattcttaattctcattttacactatagaagaagacacgagtacatctcgtttcacttttatactgacattcatataattaacaataagtatagtttataatagatacaaaaaaaaagtcttgtattaccatgttaatagttacattgtgtataactctcgtagttttcaaaagtcaagtcttgttgagtaaaaaagtttattttacccttgggtttcgactcaaaatattggattacgatctaagcaaggtgttgcaagtacaagctaaacgaaaagaataagacaaaaaaactgaggctcctcaaactggtcaccaaaattgaacttcaaatttagtgtttctacattttttctattttgtttcatttttatatccctttcatatgattaacaaaacttggtaaattatctggcctgtcaacccttac

SEQ ID NO: 12422 - DNA, 412 bp, Saccharomyces cerevisiae
ggcctgttctaagacaacttaattatatagaatttaataaagacaaatgcaaaagtttttttaaagtatggatgtataataataataacgataatacgaacactattgggactaataatgatttatagttttttttacacaggggatttaacgttccgcgaccctttttcctttaatttaaccccagttccttaacgtcgaaaatttccgattccgttaaggaggagaaaacctaattaccaaacgaagcggggagacgcattaatgagaacaataaatgtatgaaacttttagcaatctaaatgatactataccaagacaagcgaacactggctagcacaatatttgggcggaacgaaataaaataacgaagatatacataagacacaaaggaaaaagcgttccattgcat

SEQ ID NO: 12423 - DNA, 404 bp, Saccharomyces cerevisiae
tttaaatttgttctctgcctcctccttcaattattttcctttccttcgcatattgctactttttagcttgaacttcttttgttaatataaactggtactttactttttaggtacctggtccacggcgccttatccttcttttaattcatattattacctactcttattctctccctttctatttttttattttttgatttttataagttacacttgtgtacatgttatttctacttagttattcatactcatcgttaaaagccgttcaaagtgcctcatctggtatacttcaccggcgtacctctgttcctcctacctcttgcagcagggctgaataaactttcgtccacatcctccatcactgttgatatataatactctccgccactatgcgtccatgaaac

SEQ ID NO: 12424 - DNA, 497 bp, Saccharomyces cerevisiae
aaccatgatttctttttcgtcttttgtatctttcttatagaattattttttttgtgggtgtcaccacgctagcgcttatttttaactctaccactttttaattttgtaaatgtatattttactccttcatggcgttcaactggcctatttgtgatatataacctgataataccaatgatttatttttttttacagattccttctcctaaatttgtccaaacaaaacggctcaagaagccccgaataatgcactacagcggaaattaacatttttgggatatcttcacagaatactaaagcaatcaaagtggctcatagtattgagttttacaaattacttgaaaaaaaaataatcactaggcagttgcataaagttgaaactgagggaaggaactggggaaatcatgggtgatataagaacttttgttttcgctatagaagatacggaaacaacacaaggtttgtgtaaaaccattggccgttcgagttcatttgat

SEQ ID NO: 12425 - DNA, 458 bp, Saccharomyces cerevisiae
gcgttaagcctcggaaacttcaattttattactgattcatttgataatttcacttgttcgatttcacagtttgagaagttatattacgaaataagaaaaatttttaaaacatgagaccattgctaatcttttgttgttatactgtgttagaaatcctcgtgaaatccttgtgaaatcctatgtggaatatttagatagtaagtaaagattgtgtatgtatttataagatgaataagcgccaggtgctaaacagagttcacttcacgttaacgccagtccaatttttgattgcattccctgttttttctacatctttgttcaaccattttttggcatcatagtagtattgcacagacgcggtacttaatctctttgtttctttccaaacacgatcttgtctttcggtaaagtgtggaaaggtgttcatttctagattatggatgagacccatggtgttc

SEQ ID NO: 12426 - DNA, 496 bp, Saccharomyces cerevisiae
acggattgaacacaccatgtatacatgtatataactattgaaaaatatcgatattcacaatcaagtaatctagccatggctatgagtttattaattctagtatgcactgtatactctctgcggaagaataggagtttttccccggagtgagcgctgaagaaacacatgacgacgtgaaaaaacacttgtttgatccagctgaggtataaacactgagaaatatttgagggtcaaagaagcactaggaacgttacagttggaatttgctagtcaatcgagtttccaatttcgcaacctttattatagtactaatcttataagccatggatcgcaaaaaaacacttataaactcaagtgtttctaataataacagtaccatcaagggcctacagttattcattgcagatcttcgttctgcacaacaagcacaagagcaggaaaagagaatacaatctgaaattgtcaaaattaaacagcatttcgatgctgcaaagaa

SEQ ID NO: 12427 - DNA, 472 bp, Saccharomyces cerevisiae
ttgaattgccactgttctacccctataatattgtgagcatggataaatctcaaaaacaatggcgtatagatatataacaggtattaaatcttagtatttaagaattacaagtaacatgcattcctataaaaattaaagagaaaaaaattcgattataaaatagtacaatgtccagaagcttggtttttaatagtatataataaagataaagatagatagagaacataactctaaactttaagagtgaattttttttttttagtttagtttttttttttttttttttttacaataatgtattgttcttggaaaataacacaatctgttcaaagtggacagaaaccctaaaacaaaaataataacggggaaggaaaaaaatagcaagtgaaacataaatgaaaaaaaggaaaattttattggttaataagaaacgatcgactatggcaaggccgcagaagaaccggacttgctc

SEQ ID NO: 12428 - DNA, 469 bp, Saccharomyces cerevisiae
tgaatgccaaatttacgaatatcaattgtataacactgctatcatgtatgtatttttatctactagtacaaaaatgaaaccgaaaataaataaaaaaatatcgagaggaagcgtgaaaagctaatgaacatataatatgaaaatctgcagtatgatggataaaaatcctctcgaaaactcaaatacgttttttatattcaccaggcgtttcaaatttattctggatccacagtcccttttttctagatcttgccaaaaattcataatatcgatacttatcttctctatcatcaaattctgtgtttactttaccctcataaacaaccgctaatccatccttgagcatttctaagcttaagtctttccacccaccaaaccagtcccagtatgacactcgagctacacaacggttgtactgatctatagataaaggcttgacccatactttctttcccaaaattcggttttg

SEQ ID NO: 12429 - DNA, 477 bp, Saccharomyces cerevisiae
tgatttaagtcattgtatggtcatattatcatcatcatttaaattttgatttgacactttgatttgaacacttctttttttttttatttatgttttgtttaactgacggtgtttttttttttacgttatatactgatacatatatagacgtgatttatttaaataaaagtctatgaaaaaaaaaaaattaaaaaaaaaaaattaaaaaaaaaaaatctttgactattcaatgattgcgcttaagcgtattcgttaacattaacgatatactcgtaaacaaaggcaatggcagataaatgacctgggacatccacgtgttcattaaccgaatgcaatgtcttcagtaaatcaatatcaatgatagagccaacaaacctataaatgttcttggacaaattccagtagtatttagtatcggtgttaccagagaataaaccagtagtcacatagaactcttcgttgttttgtagaacaccg

SEQ ID NO: 12430 - DNA, 422 bp, Saccharomyces cerevisiae
accaatccgccattcatttgaaaagacaagtctggcctagggttatagtgttcagacttgaggttgaacatatccaaaaaaaaaaattcctatgatgtcttaaatacgtatacctaataaaataattctagactatattcaacttactgtaacccttcacctcactatcacagctgacgcatgtagcaaatcctttataacccagagatatcctacaatcatcgcataatgcaaggcatctacagggccaagttacaatatttcttttattaactttgcagattaggcaggagagatccatttcctccacttcgtcgcaactatcaaaggcaaaatcaaacttgaactctaatttgtcatcgtccttcatatttaaacgtttgtacatatacctggagtttgtatgatgcagaaggcgttca

SEQ ID NO: 12431 - DNA, 421 bp, Saccharomyces cerevisiae
tcctcgtagtccaatttacgtgaagtagataggtatattacgctttagacaccatacctcaaataaatatattcatgtatataatttaatcatcttctatctataattaatctcgatgttgataaaggtcaccttatacgttctatgagtgaaatcgagtgaaaaagtgaaatttaagaaagggctcgaaggatgtactgtgtaataattacacctggccacattcagtttggcaaaagcgaacgaggtacagtgtaagagatgtctagtgaaagagcctgtatgctgtgtggcatagtgcagaccacaaatgagtttaatagagatggttgtcccaactgtcagggtatttttgaagaggcaggtgtttctacaatggaatgtacgtcgccttctttcgagggcctcgtaggaatgtgta

SEQ ID NO: 12432 - DNA, 490 bp, Saccharomyces cerevisiae
aaattttgatttctatgtagtgcagccaatcaattttaacttcatttagaataaaaatctttcctcttctgctttgaagccattaaaacgaaagatctaggcggtactatttctccattctcagccgtacaatcatgcaccgaaaaggaaggcaatgtattgaatttttcgccgagaacaaaatatttgtaaacactcgttagattccgcattgttaagtggcatcacaaacacaatcaagattaagagaaaagtagctcgttgagaaagattcttgtacatatcgggatacttctgaagtctaataaaacattcaaataaagacagactggataaaagattcctgaacgtcaaaacttatatcttcttgtcccttggaatgtctctctgctcttatattgttgctgttgagtggtctcatgacaataaagtatgtcactgaattgaagactactgaaccatggcagctaatacaatcacgcccatccag

SEQ ID NO: 12433 - DNA, 418 bp, Saccharomyces cerevisiae
taggacatattttcgtttcctttttttactcatatcttacacaatatgccttgtatatatcgcacgattatgaccttgcgcgtgtggaaaacatgcgactgctaaggggagatccacacacacacacacaaaagatcaatacacatttttgacaatatatagcatcaataaaatacatataagcgattcacatagttcaatatgaaggttgttaaggaatttagtgtctgtggtggcagattgatcaagttgtcacataactcgaactctaccaagaccagcatgaacgtcaatatctatttgcctaagcactattacgcccaagattttccaagaaataagcgtatcccaactgtgttttacctttctggcttgacgtgcacgccagacaacgcctctgagaaggctttttggcagt

SEQ ID NO: 12434 - DNA, 496 bp, Saccharomyces cerevisiae
aaggaggagtagactaccatgtataattaaaatatataaacacatagatatcatcaatatttcacgtccttttttaatgtcctttgaaaaagcgaaggaaaaaaagtttcatctcatctcatctcatcacatctaacatatggccataaaatttcgacaactatagtgcacatatctaatacgatgaagaatctgaccactataaagcaaacgaacaagaatgtcaaacaagaaagacgtaaaaagtacgctgatttggcgattcaaggcacaaataactcctcaattgcttctaaaagatcggtagagttattgtatttgccaaaactgagttcggctaataatttccaaatggataagaataataaactgttggaatattttaaattctttgttcctaagaaaattaaaagatctccctgtattaacagaggttattggttgaggttatttgccatcaggtcaagattgaactccatcattgaacaaacgccac

SEQ ID NO: 12435 - DNA, 455 bp, Saccharomyces cerevisiae
aggaagtgaatggtaacgaaaaaaaaaaatctttctttatatgtctctttaagtactccctttcagttatatgccttttattgtctgtccctattctaatcctctactcgggccatcattgttaacgtaatatttgccctagggtaaaaacattaggttgattaggccataactcattctgccccacccccacacatagggttcaggaacttggttttcaaccctactgcattgtttcccacgcggcgctaccaaaatatatccaattttcttttttgtcacaacagcagcaaccccttgaaatggccaattcttctcgagactttgctcccttaatcttttcttcccccccggtttcttgatgattatatatactaacctcgtatattacacactgtacttgaagtcactcatatccgaatactacttctcttaacttccagtcaacccgacac

SEQ ID NO: 12436 - DNA, 461 bp, Saccharomyces cerevisiae
aggggaaataaaacggtggcttcttcatctcactttatatctttacctgatcccccttccaggatcctatcttattttctcattcttttagtaataatatacatgtatatatatatattgataacgagtaataaaaaaaataaaaaaaaataatacatattcgaaaacaatactgctttttagttctcaacttaaaaagtttcctcgtcgatgatcaagttgttgctcacgccaacctcaccttcgtcgttctgcattatcacatcatggttactaccttcgttaccattgacctcgccattgctgttcgcatagccgccctgattcggcacagttccatgttcacccagatttttatcattcaattcatcctcaccatcattcatttcaaatccttctgcagtagcatataaaatactttccaccttcttgacgaaccgtaataatgctcccccatttcc

SEQ ID NO: 12437 - DNA, 483 bp, Saccharomyces cerevisiae
taaattagttgctcttctcttttgttcccgagtaaatcgaattattctattaaagggaaacactatgttttgagtcatccaaactttcatttttttcagatttcatcgcccgatcgtcaaggaataaaaagggaagggatgggatacttgcattggaacccagaaagtacgtaaaagatgaagatcgtgagagattggtcaatggataaatagttctgtaattatgtctaagtatcaaattaattgcataagataccggcactttctcaggacatctaatatctcgcagatccctgatttcacgaaatactgcattggtcccgtaaatgaagaattggcaccttacatcatggaaaccatgaaggcatacccttcaaattccgaatatatcaatccgcagcattactatcataatagaacggtattagtagaaaattacttaaaacgaagtccaaatccagtatcattaacgcagttagcgca

SEQ ID NO: 12438 - DNA, 481 bp, Saccharomyces cerevisiae
aagatgtaaatctcttcgctgttctccgttcgggtgtttacaaaatattctcattttctaaaatctgtaaataatacatatctataatattcttttatgtatatgttaattttttgtatcattttttccaaattgataaaccaacacctccgatcagtaacgttttctcagaatcagcatcttcatcattggaaatgatttctaatgatcctgtatccgccacagtggtacgctttttatctaccagtgaaagcttgcctgcggtaatttcccaagcgcgtattacttgatcaaccgatgtggtaatgacttctttgccaccattaatcaacataccggacgttattgtcgaagaagctgctgcagcgataaagtcacttgtttttaacgttactttattcgagtcatctaatttcaggttgcttaaccctaaaccattatcatcaccccctgtcaaaattgtggcggaagttcttgtagc

SEQ ID NO: 12439 - DNA, 444 bp, Saccharomyces cerevisiae
tttggctcttcgatttgctgtaaataaattatgatgagagacaaaagaatgaacagctaatttcgactgtaatgaagaaatgtaataaaaaaattcatgatgctatgtccagtattcaagaaaaataattacaaaataacagcgtacatatgaatattctttgtttttatcttgtataactatcacttaaaacatatttatatcgataggtaaatgctatatcaatcgctctatttacttgatttttaatatgtgggtttttttttgcttgacacatacgtaacggtaattgccagctaacgatcggtacaattttcagaaaaattgaaacagagagaatccaccaaatattcaattgcaaggtgacgtacttcagataaacactttattgtaccatcttaagcggctatataaagtgtcatatacacccttcaccaaatacgc

SEQ ID NO: 12440 - DNA, 433 bp, Saccharomyces cerevisiae
aaacggatgaaatcctgtatattcaaatttatataaccaggacgttgcagtgctaataataatggaataccgctaattttcctcctgttttttcttttttaagtaaagataaaatagtatttcacttgcactattcttctatctccgtaatcggtctcggtctaaaattactttgagatgttcaaatacatggggctaataattttaagggcttgcaaagaacttatatgtcacagtgataataagtaaaggataaacatgcgacctgttagacaaatcgcacatgtctctaaagggtaaatttttcgcctttttacctaatcctaacacatcttccaataagttctttaagagtatattggagaaaaagggcgccacaattgtgtcaagtattcaaaattgtcttcaatctagccgtaaggaagtggtcatt

SEQ ID NO: 12441 - DNA, 470 bp, Saccharomyces cerevisiae
aaataaggtcaaaagcaaataaaagcaagacaagctacggtatgacaagttttcggagaaataatattctttcttcctcagtttacaaaacaagtaggttggtcatttcattcggatatattctaaggaatgaaatgaacattggtgtttgtttctaatataatcttaagatattttaaattgtttctttccttttttgcctttctaactattacttcaacttcttttccgtatatttccgttttttccatttggcagattaaaaaaattgtgcacgttctggttttaacgtatagacttctaatatatttctccatacttggtattttttattcactttttttatacatatttggtttttttatacaatatcaaaaatcaataataattaatttaataacaagaatatgttgctgtgatgactcttaatatacaattgggaagcattcaaggattggtacgacgtttgc

SEQ ID NO: 12442 - DNA, 464 bp, Saccharomyces cerevisiae
ttagtctaaaaattttgctagcccatcaattttttttttgttctaatgcaaaatataacatgggtaagaaaaagaaaaagccgttcctcagtacgtaaagagatttgatcattaacaagttgggctcaatatacacagtcgatagtctatatgtgcatatgaaactggcgcaagacatgaatgtagatgaaatatttctcaaacaagcggcagaagctatagcggtaatctcatcaagtcccactcatacggaccccataatacgagagctactccacagaattcgacaatccagcccattgagcgcagttataccagcaccagaaaatgttttaaaggctggggagccggaaaatatggctagaggtcttataaggattccagaaacacaaacaaaaagaacaggaggtaacaaccatagcaaggaaggcgcacagctctacagctgtgcgaaatgtcagttg

SEQ ID NO: 12443 - DNA, 402 bp, Saccharomyces cerevisiae
agcaaaaaagggccgcatgtataaatgtatatagtcacaatattccatagacccaggcacttccctacaccacagcatacaaaaccgttatggtgtgtgcgtatcattatataataatggggtttccttgtacagagtataagcatccattagctcctcgggaacctcaatatcttcatcgtcctccaacttttctgtaatcagtgatatctgatcattgtaccacttcaattcgggtactttctctactgttgcttgagatattaagcgtgggagttccgtttcagcagaaccagtatctgcatcatcaatactgttcagtaccgttatcacgctcgatacttttctcaataatgtagtgtattccctttttagagtcccatcctgtttgataagctcatc

SEQ ID NO: 12444 - DNA, 496 bp, Saccharomyces cerevisiae
caaagtcaattattttcaacttttaaaattacataactaattgtttgcatttatgaatagaataaagaaaagaatagagcagtaaagaaaaaaaaataattgtaagtatttttttttcgttttatatctagtacttacacgtagtatatacaagtatgggctatagatataaagaaaaataataaataaacgagattgttaagttagctctctatttcttaccatgcttctttttattgttggttttgtttttgctcttagagttggaagaatcgccttctataaatgttaacaactcatccacacttttgttagccaattcaggtttaacgtcatccttcttttgacggtgattggtttttttatggccagctgaatttgatcccgttgtcgacatttgatcttgtgcaagttgcttcttttgttttaaatccattattaatgagcttaaaccattaacccactgtcttgattgggctgagtgcgtgtgattcat

SEQ ID NO: 12445 - DNA, 498 bp, Saccharomyces cerevisiae
caaaaaaaaaattgaaaagtaactacaattgtcactagttattattggccaagtcataaagggaccttgtctcgattttatataccgtatatcggttctttccaatttttttttttttttttttttttttttttttttttggttgtaatattaaaagaataaacatttatctgatatgtaattgcatttataaaatgtacagtaccgcatttaaagtttgctgataattaaatctagaattttatacctaggatcatcttctgcattcatctttttcaaataattgtcttgtaaatatgaacgatactcatttttcaatgacttcaccgatgcgctatccaatttcgatatatatgcaaaatacttcttaacagacaattgtaattgatcaatatcgagtttctcaactggcatatatctgatatttagagtgatgtcaatcattactgttttcaaatacaattctggtagatccttacggagcgaaaggtcatacat

SEQ ID NO: 12446 - DNA, 474 bp, Saccharomyces cerevisiae
ttcccattgataagactaaaattacggaagatacaaacgacaaacgcgctaaaggcaacggaggtgatgattttattattgctcacacaactgatgttgctgacagatggcaaatccttttcattttagttattatcattgggtgctttttggaaaaaagatgaactaagcctctctttatttcgtccattttattctagcttttacattatgctttcacctttaccaaaaaatagtatgtatttcttttccccttgctataaatcaaaagtacgtagaaacataaacaggcgagaaatacatatgcatatacgtctacactactaatttaatttccactttcttaatatcagtcaatcgaaaccactagctttcacactaagactagaccctgtttaactaatataaacttttccagaaagctaaaaaaaaggtcggaaaaagaaggtatacgtttttgcgacgactgagatc

SEQ ID NO: 12447 - DNA, 426 bp, Saccharomyces cerevisiae
cttctgcgtcgccaagatgttaatcatgaaacgatctagttcttcaacagtttgccagcgaccattcgagctaatcttgaacaaaagtaatactatttaagggtgggcgcgggttgttataccgttttgagacgatctactataacgttatatttaattatataagtgatgaatttaatgtcccgtccacaacacgaaatcgcacctcatttcaacgcggcaagtattaatgttctgctttatgaaagattccatgaacccttttctaccttttaaattcctcttttcactcttaatcacatgatattacctttacataggaagcgccagacatctttttgccgagaaaagccattatgcaagataatcctgtagcctcatatcaaggataaatgccactgcaaaaacgcagtcgttatttgggac

SEQ ID NO: 12448 - DNA, 438 bp, Saccharomyces cerevisiae
gaaagtctgatgaaatttttctttcccgcaatatttttgtacaattgtaatgtataatatatctctgtacatcagtattaaaatacttaagaaagcgaaaaagacgcctgtattgtttgttgttctttttcttcaaaattatcaagacgctcgattcaattatcttcgctcatagtaactcgaaagagtgtaggtgaatgaatagaaaaagagagcgctgagacctttgtcctttacggtctatagaggtgtgttaaaagcagacttttgaacatccacagaaattggctcaatgacctatccgaaaagaatacctataaatgcgtggtctgaagttcatagggtggcaaggccactaattattactttcgacgcatataatacactatacgccacaaaacttcccgtcatggaacaatactgcattgttgggcgtaa

SEQ ID NO: 12449 - DNA, 427 bp, Saccharomyces cerevisiae
tgcagcagcaaatgtagagtgacttagaaacatgtgtagatcatttcaaggaaacgttacgtttagagacaatgtaaatagtacccagttaaagtatctgacacacgaggaagtacaaccaatagcatttatatttacttgatagatttgcgtaagatatattatttaaaaattgatagtcctatttttttttacatcaaaagataagattgtattatgttataaatttaaacaatagagtgtacaaagaagataaaagtaataataagaaaaacatatgtaatattgaaaatctttcactttttttagcttcttaacggttagacttggcaacacgttccaattcatccttcttcttgatagcgtaagaagtagaggaacccttagcagcattgatcaattcttcggccaaagtttcagcaatggt

SEQ ID NO: 12450 - DNA, 444 bp, Saccharomyces cerevisiae
gacgaataaatagacactcacatgtatattaatttataaaatgctattcatatcataattcaccacccttaatatatccttttgtccctcttttgatttacatattttatttttgcaatatgtcacttcacgaaaattagtgaaaaatagaaaagaaaaagaaatgctttagcttttgaaacacgaagatcatcaaaaaactttaagaaaagcaactaccccaattccgcaagccaaccaagcatttatcagcacatcatgtccttcttcaacttcaagtatgttcacactgttgtcgttttattttcttctggacctgcgttatcattttactaactagccaacacacctaatcaaatcatttgatcctacgtgtatactttgcaaaacagagcattcggaagaaactcaaagaaaaataaaaaccagccccttaatgttgct

SEQ ID NO: 12451 - DNA, 441 bp, Saccharomyces cerevisiae
tcataatcggtgataaaaacaaaaaatttgcaattaacaaaagaaatttatagcatgtttaaattcttatttctttttaccatttccagtccttttggtccacttgtaatgcataaaagggtaaaaaggaatttgtttaggaggacatgctatttcagatagtttctttttattgattatataatatagtgtacaattttgaaaatataactattacacacatcttttcatttggtcacttacatttgtataaacatatagagcgcgtctattaataaaaggcggtggactctggactatcagattcctccaacagcgcttcttcatcgtcgtgttttccagtatggttttttctgaggaactcgagtccaaatacgtacttgaatctttgaacgaaagcagccggaaataccttcactgctacttcatcggggcagattc

SEQ ID NO: 12452 - DNA, 408 bp, Saccharomyces cerevisiae
aagcctactggctagtgttttatcttcgctaacttcgtttgtttcactccatcttttttctttaattcactcctcaaatggagtttactacgttgatagaatttaggacaagcatatgacgctctccttccttttttgttttctaggttaattcatttttcatacagagtagttaatattggttcttttcatatatgtacggtacgcagattaattatgtaaacttaaacttaagggatcctttttgatgctaacaattgtcgatgttgaactacaaatttatgtaagaggtcgttgttaaggattattattttaaaaatacacgaagattgattattatttcttacatgaggttatgaatcgtgctccaaaagtataccaaaaataactcctgaactgctaggcaca

SEQ ID NO: 12453 - DNA, 468 bp, Saccharomyces cerevisiae
tttgggcttattactgattacagtttttatatgcattctgtccgtttctttgattttatcgcttattttttacttaggttggcaattcagtattctttagcgtttcttttttttattttactttccgtatcaacaataatatttatatttatgtacagttttacattgtaatttagtttctcaggaattcgtcaaaaatgtaaaatcatccattgaaaaccttcttccctgaagaattttaagcataactttatatttttaaacaaggtggatctagaaactttgtattaattacaagaatttataatattattcgggagcaacaatatggatttcttgccagtaaaaccctacctattacttccctctttattattagccgggtcacactaaattgaaaaatttgttctttcctgtttttggagcaacagaaaagtataaatagagctagtgttgtccgattggcaa

SEQ ID NO: 12454 - DNA, 476 bp, Saccharomyces cerevisiae
cttctatgtctcaacgttagcatttctacattgtataggtataaattgtttttgaatccgtacgtcctacaaaaaaaaaaaagaacatatatatgtttgtgtggtgaaacaataatttaagacacccagggggcggggaaagaaaatatatgctgctcaggcaaaattaatattgtaatctaattcgtcaatcatgtggaccaggtcatgctcactgatgccatcagcctcgttttgccaaattttccgtatcaataatctagcattttggaaattgtaacatttatatcgttttaaaatgtcgtcaaatttggcttccaaatctatttttttctccatatcttctacctgaatgcatacaccgtaaatgaaaagtgggaagcataacgatccttccaaaaaagttccgatgaccttgtctagcttcgagtccaatttgtttctcagtatctgtagttccagcgaatctttgtcaa

SEQ ID NO: 12455 - DNA, 450 bp, Saccharomyces cerevisiae
taaaacttgctctcacacataatagactatgtaatattaaaagtcatacaaaatgtacaaattttctttcgtcaatcatttgaaattttttgaaatatatcttgtcactcattcatttatttattcgtttctattttcctattatatgctctataatctcgacaaaacgtcgtcaacgacttgttgagtagaagccttaccacctaaatctggtgtcttgatagaaccctctcttaagttagcatcaacagccttgtagatatcttgggcagcttcgttgtggcccaagaattccaacatcaaagcagtagatcttatagtggcgattgggttagcaatacctttaccagcaatatctggtgcagaaccatggcatggttcaccaatgacaatttctggacctacgttggcgcttggaacaacacctaatgaaccgactaaagcagcagc

SEQ ID NO: 12456 - DNA, 445 bp, Saccharomyces cerevisiae
gacgaatagacactctccccccccctccccctctgatctttcctgttgcctctttttcccccaaccaatttatcattatacacaagttctacaactactactagtaacattactacagttattataattttctattctctttttctttaagaatctatcattaacgttaatttctatatatacataactaccattatacacgctattatcgtttacatatcacatcaccgttaatgaaagatacgacaccctgtacactaacacaattaaataatcgccataaccttttctgttatctatagcccttaaagctgtttcttcgagctttttcactgcagtaattctccacatgggcccagccactgagataagagcgctatgttagtcactactgacggctctccagtcatttatgtgattttttagtgactcatgtcgcatttgg

SEQ ID NO: 12457 - DNA, 409 bp, Saccharomyces cerevisiae
tattgcaattacttcttctcatgcactaacaagtgaatgatagaaatatgttgagttcctaactgcctgattttaaataagtttcatattataatcttttagcatatatatatatatattgatcctctctcttctttattttctgccagtaacccatgtgtgaagaagaaaacataaataaaaaagcagtagcacatggacacattcacgcccgaacactcctaaaaagcagcccacacaagaaagtagatataatgtaggacacccagcttgtccataattgctaatagcatactcaggataacatatattaatgacgactcgtttgctccaactcactcgtcctcattacagattattatccctacctctccagaaacccttcaatataaaaaggcagatgtccgct

SEQ ID NO: 12458 - DNA, 467 bp, Saccharomyces cerevisiae
tcaaggaagcctccatcattacgtcacaagtgttatcgaaagcatgcagcagtgcatatattttcctagttggttgcttcctgtacgttaggaatcttcaaccaccatccttgtatttagttaatattagtatatgtaccaaagtaaatatactcagatgccatctcgatatacgcaccgtacacgaaaatgaaattaaaaaaaaaatgttggagcacaagcaaggcagcatcagaacgtaccgtcagttggtaccaagacaagtccatccccgtaggcactacaaattatgggaatgagaaagtatacaaaatataaactgtcttatcatgaagaagagtcgcttaggaatttaaactttcaaatcgcattacgcaattctctaaaaacgcgaacctttccctgatatgtaatcagggaatttcctcagaataatattcgatctaagaaaccggaaacgaaatgaa

SEQ ID NO: 12459 - DNA, 456 bp, Saccharomyces cerevisiae
gctgtgttgattgatgtttttgatttacatcttttaaggattttttgatatatccattcttgtacataaattatatacacacagcccaacaataaaaaggaaaaattaatacgaagggtatatatgtatggtataatacttaagttcactacaacggacgtttatagtcagaataaatcgaggagatcctgtgacactatattgccgcccgaaacatcgggattgtttttaccaccagaagatataccgtttgagtcgccacctagtttcagctccttcaacccttgtacagccttggtatcatttgtatttatttgtgtggcatcctcagatggtccgaaatcaaataaatcatccaaatcgcctaaagttgttaaagtattcagcattcctgcatttgtatttgttacatcatctctttcatcaaaatccaatagcacatcatcgttagccttg

SEQ ID NO: 12460 - DNA, 477 bp, Saccharomyces cerevisiae
ggggttggttcttgtatagttgagattttttcacttacctgtatatatattggtttttgggttctcaaaagaatttgtcaaatatgtttatattttattcccgaattatgtagagttagcagtgtatataatggaaaaaaagcaagtatgctttacatttagtattccttttaacgcaagccttttgtatacgggctgtttactgttcaccggaaagccgtgacaaaagagagtgacaaaggtatcgaaatcacaaggtatatgctgtgtttgtatttatataagctttgcctcacaagtaaaagtggatcaacaaactgagaagaaacaaatgggacccattgatgtcgtaataatatattcattggtgtatgaaattagattaaagcttttacgtattttgaggtattatgtactgaattctaatcctttaacactttcttaactattttttcgacttcatcccaatcatccgtt

SEQ ID NO: 12461 - DNA, 421 bp, Saccharomyces cerevisiae
ggcaatatgtatataaatgcgaaaagttttggaacatctgtaaatagccattgcttcatttgagtttcttattccacataccacttacatattcagtaaaaactattcatttgtttttcattctgaagtatatatattaaatttattaaatagtttttcatgaaaaaagttattgaagcatctccctttcaatagtgcattaactctcccattctaacccatctttccgttgaatcgtcatagaacaatgtttctgacagattggttttcctataacgatctttgcagcacaatctgtgaaataatttccataagccggtaagaatagtcctgttatagctgatactaccttgtacataattcatatcactgagctttgcttcatcttttagaggctgagacttctcaaaaccttctgcgc

SEQ ID NO: 12462 - DNA, 494 bp, Saccharomyces cerevisiae
tgtattaaataacatgcttttctgctcaaatttttttaaccgccgaggcctgcacactttcactacgtgtataacgatgctgcagacaaagtaatggggtgtatgggtgtgggtggcaaaaaaaacctagcaacgctctatgtttcttttcttttttctttctttttttttttttgccgtttccgatgggccactcggtgaaaacatataaaaagggctctacattcattttttcatcgatgagtactttacttgttatcagatttattcattttgtttctacttgttttttttttaaatccccacgaatctctttgccttttggcttagatcaagtgtagtatctgttcttttcagtgtaacaactgaaatgacctcaatgaggctcattaccttttaatttgttacaatacacattttttggcacccaaaataataaaatggacgggaagagactttttaagcaagttgttttccgctaatgtcaggtctca

SEQ ID NO: 12463 - DNA, 439 bp, Saccharomyces cerevisiae
gctctcacaaggtccacttcgttagaaacttgttaaccaatggaccaagtgttgccattgggtcattcttcagtatcaaagaagactttgacccactaagaaaaatttcaaaagtaaattataaatatagcattaagtacaaataacatatcagcttatgaatcctttttttcaattttatggtttcatagccaataatcataacatacatagattaataatattcaagtcacatgacttttttttttttcttttttctttctgcgttaagcaaagaaaaaaattttcagttagcgatgagctagatattttcgaaggtgtaacaaatactttctttattacctttcagaatcagacttatctaactggccaccaaagtacgaataactttgaaaatgtcttcgttgagtgaccaattagctcaagttgcttccaacaa

SEQ ID NO: 12464 - DNA, 466 bp, Saccharomyces cerevisiae
gcttttttccttttggacttttttctgccttcaacctcccatgttttcatttgctcaacacaagtcaacatgtacattataccgtatttgatgcagggacgcaataccatcatattcttgatatagactcatttttctcaaatcaaatttgtatcgatttcattttgcattatacaggattccttttcctttctaacatttaatacgtaactactaatattaatatatacctccttcaacggatcaacaaaccaaactttatcttattcaaatagaatttaacagatccaacgccttagttaactcatctttggcggtgggcaggtcttcataattcaatgcgcttatggcgtatttggcaagtttttgaatttgctctattttactggccctgtccataatttttgtcaactcatcctttgtatacgatttatgctctgctgcagcaggttctgatggtgcagaa

SEQ ID NO: 12465 - DNA, 465 bp, Saccharomyces cerevisiae
tgatatcatctcaaaacatcggtaaatacctaaaaccaagaaaaggataaagagtttgtatatttactgttgatttatagacatatgctcatatattcattacgaagaatgattcttttaattgtcgatttccttgaagtacatctatcatataaaatcattttctttttatattttggaatgtttttgtgctaaaaaaatcattattctgggcgacatacagtaaaataatatttaatatgaaacaaagcgtatcattttgtagacaccgatatcacgtttgaacaggtgaataaaaatgctctgaatcaaactgacccagcgtacgtaataaagaatcctgatcattgcatactttcataaaccagcctttgaatttacaatcttgtaaatagccttcccaagtttttgatattgaattattatgcatgtccatttttatatccccagtgtttgtgtgcaact

SEQ ID NO: 12466 - DNA, 420 bp, Saccharomyces cerevisiae
tatctatgataaacagagaaaattagctctatcctctttctataaagtatatttttgttaacattcacttgaatattgtcgcgaaagaatggtttaattttaattccaaatcatccaaagaaccgagcaatgcaatttcccatttacttttattattttgactaaaatcatgaatatcgtccaatattgaacatgaaactatttcattttgttttacaaacaactcgactttaatatccttcacaaaaaacgaaaccattgaagattctaaatctaaatctaagtcgtggattatcttcttagcttctaagtccttaaaaatctgtcgtcttttctgtacttccacaagttgcaggaagactcttttagcaaataaataggcgtcatcatgagatatcactagtcccccattggtgtcat

SEQ ID NO: 12467 - DNA, 468 bp, Saccharomyces cerevisiae
caggtaactatgctcccttctcctgtaggtcaggttctcccttctcctcaggcagaaattcgcgtaaagaactaccatgcaatgaatgaccaatttaagtaaaacacataaataatacttacttacacatatacacactagctgttttaacctgtaacaatactgccttgtcagagtgcgcacggccttttactctggtgctccaccatcttccacggtattcgagagtcgccaagctcaggggcgcatgcagacaatgggcggggagcaccttcttctttcacagctaaaggggtctttctttctcctacttttggcatactttttcaggggcagaagtccttattacgcacgttgctaccgccggcttgctgttacacctggtgccatcactattgccattgccattgctacagattcaattccggcgcttgcaaagtccaaagttctggtgtcggtttgttctca

SEQ ID NO: 12468 - DNA, 431 bp, Saccharomyces cerevisiae
caagcttaagttcttttcaaacatttgaactaacttaaaagagaaatttttttgatttaaattctagtttattaaacagtaaatatatttatacattattgtaatacatataattatgtgtttttttaaagttcagcatgttgggtagtgatatatcctgaagtcaatggacactgttgctttttgtataccagcaggaaaaaaaaaagcctgagctgcagtaacgaagaattgttgaatgcgtctaacaagaaagggagcaatcgataacagggacgtgcgccgctaatgtcattcagattattcacgaggacttctcaacgtctccctcgccttaactgggttagtcccatcaggcgatacgccaaacaacctcaatacgatgaagcagagttgtttgcagagaacattaaccatggcgcatataaagc

SEQ ID NO: 12469 - DNA, 466 bp, Saccharomyces cerevisiae
gcgttctactctttgtcaaacccttttatagctaaacgtttacttaatttgtacaataatatagaatagaaacatagttgatgtttgaacctttacatattcctttcaatcgtgtcgagcgatataagtattacgattatgccggcgaaaactgaacccgttttagacaatttcaatcaacatactccactccgtagtgagtaacttttggagtaatacgaagtaaccaaagaggtcaaaacggaactatataccccaaaataagcatcattcaaatggtcgaattaactgaaattaaagacgatgtcgttcaattagacgaaccacaattttccagaaatcaggccatcgtggaagaaaaggcttctgcaacaaacaacgacgttgtcgatgatgaagatgactctgatagtgattttgaagatgaatttgatgaaaatgaaacattgttggacagaatcgttgc

SEQ ID NO: 12470 - DNA, 468 bp, Saccharomyces cerevisiae
acagaattactgctattctcttccaggatcaaaatgctttgaagggaaacgtctggctatttaatatatgcgaatacaccttatatacagacaatgaacaagagatataaattataccgggtgtggtattactatgctcaccaaacagtttgcataacctctactggatttgcattatgttttgtggtccaagctaaaactgcaggactgggcgtaacaccaattacttcactatacggggacaaaaaagaacacctaggtaagttgttggttcctttagttttatatcaaatttagcaagtcatgacggcaaatttctttgtaagctttgtttaaaagatggatacaaaaggacgactttcctttcaatctttcgtttttgctttttattattccatagcaatatagtgatcatagtagtgtaatttttagagtttaaaaaacacgaaagtaggatgaagtacaaaa

SEQ ID NO: 12471 - DNA, 408 bp, Saccharomyces cerevisiae
gcctccgttaataagatcaagtttggtatccttgtaaataaatatgtgtgtacgtggttaaatagtatgtttttagcataatgccttattttgtaccaacaaaaacatgatagttcccacatatcttttcgcctggggaataccaagtgggacaaacaaaacgttaaaaattaaatcctttagagtaccacaaattcgcaagaaacaagatagttgaattgtcaatcatggctaagataagtatgaatgtgcccagtgtaaagatcaaaaacatgccaaaggtaaggttaaaaagcactagaaagactgtctccacgaaaaacatgcgaaataggttcaattcatactcgaaaagaattcgaaggacgctcacaagaaagagattttaggcaaacatgaaacgtatgc

SEQ ID NO: 12472 - DNA, 457 bp, Saccharomyces cerevisiae
ttcgatatgtacagaaagcttcaaattacaaaatagcatttttttcttatagattataatactctctcatacgtatacgtatatgtgtatatgatatataaacaaacattaatatcctattccttccgtttgaaatccctatgatgtactttgcattgtttgcacccgcgaataaaatgaaaactccgaaccgatatatcaagcacataaaaggggagggtccaattaatgcatatttaagaccacagctgaataactttaaaacggcagacaaaacaaaaaataggtcgaataaaccttacctgcctagaaggaatgacagcagctaataagaatattgtcttcggattttccagatccattagcgcaattctactaatatgctttttctttgaaaaagtctgcggtgatatggagcatgatatgggcatggatgatacttcgggatacacgaggc

SEQ ID NO: 12473 - DNA, 430 bp, Saccharomyces cerevisiae
tcacatatgaaagtatatacccgcttttgtacactatgtagctataattcaatcgtattattgtagctccgcacgaccatgccttagaaatatccgcagcgcgcaaaaggcggcctcgcattggcccaattagctccggtgtaaaaagggcaaacttatataaggggattaatgactttctatgagaatgccaaaaaatgttaggctaaaggaagggattgaaaggaatatagttgagctatactttcttgaaatactggagtatacatatttatagggatgttgaacgtgctattgagaaggaaggccttttgtttggtgacgaagaagggtatggctactgccacaacagctgcagctacgcatacccccagattgaaaacttttaaagtttacagatggaatccagacgagccaagtgctaaacctc

SEQ ID NO: 12474 - DNA, 416 bp, Saccharomyces cerevisiae
tgttcgtctttttattgcgcttgtaaataagaaatccatatactatatagtacacatgctaaaaaaaaaaagctaaaaatctcacttatttgcagtggtctccctctcctgccatataaccccactggtattttccaatgccttattgttggaaacctgatctttataccattcctgcactttcacagggtcattgccgtggataatacaaaacttgaatttggacacctgcttgtcacatgatgtaaaatctccatatctgtaatagcttctaaattgccctccaatcgaatagcaactcgtcagttgatcaaatgcctctcggcaactcatcgttgtcggatattttgtactcatcctttcctgtttcttcctcaagctgctctcttttaccctaatagaaccatcgcctccct

SEQ ID NO: 12475 - DNA, 477 bp, Saccharomyces cerevisiae
agcgactcaaacaaattaaagaagaagttgagacttttatagtatttattatttaatctgaggatttgtattatttttttatatagaatgaataaatcagaaaaaggaaattatgaaaagaaaagaatgaggagagtgggagatatttaatgttgttagctatttatctgtatggaagttattaccttcttttaagatggtacaaatagcatataggtgggtttggtataaagatcatttagtttttgtcatagatttttcaattgtgcataggaccagtttatgttacctctatcatacttatatttttttatatacaaatttttaaattaccgatattatatataggcaccgatagtatagcccaccaaagcgcccaaataacctccaacaacaataggaattggccaattctgccaatctctatcccaatccaaaggaatgacaacacaactaatccaaccccctacaacgata

SEQ ID NO: 12476 - DNA, 427 bp, Saccharomyces cerevisiae
cgttaatatccaaataaaagcaaacaggcacgtgaatataacaacaaaaaaaaagcagacgaaaagctactgtggaaatgatgcggcgaatacaaaaaaaccttacatatacatatgtttattgtaataaacttgcattatactcgttatagacatatatatatatatatattcatatatatatatcgtctgacttccttttgtcgaacctaaaaaagggcacgaattatgacagagtattgaggggatgttatttcaagcaccggcaagtgaagcgatgtggacgtcaatatattgtgttattcgattattgctacggccatcgactcctcgaaattatttacgttcggggctgacaacgcaagaaagaaaaaatgctctggaattgtctgatggtttttccgctctttacggctcaaggctagga

SEQ ID NO: 12477 - DNA, 470 bp, Saccharomyces cerevisiae
acgcttaagtagttataaaaataaaagaatgctgatatcttatgatgctatcataactatcctttatttcacgtatcaatatctacaatcatctaacaaacgtcgctcttattttgtcacttaggtttaatgtacaatatgcaaatatttatgtaatccatacccaaaaaaatagcacgcctaccataaaaaatattattaaccatgtttttatactgatcccagatcttctggccatctccatcatgtttccaaaagtccttttgagttttacagaagtgttatggaaagtatcaccaagctggtcaatagtttgattgctgcctctaatctcatcacccatcttcaacgataatgacttgagtgcttttattctctgacccatagctcccatctgttcctcactttgagattcaagagatgccaaagtactttgggagtagtctaatttatctgtgctccctagcgct

SEQ ID NO: 12478 - DNA, 436 bp, Saccharomyces cerevisiae
tccttaatgcttgtatatttcttcttttactaaaaacatataaaaactatttacatatagaatatagaataatgcgacactatgaccttcttcattttctctttattcttcaccctttatttgaaatttcaaggtttactttcttcttgttagtatactattagttaaaaactctagggcagaacgagcatcagattcaggaagagaatcccgtagattttgtaatgccttgtccctatattcctccgctagtattttcgtcttcgctataccattatggagtctcacagaatcaatagttttttcaacatcacccctctctgaaaaattgcgtgaaattagtggacctaaagatgggtcttctttccatgcaaacaagactggagcagtagcaatacctaattttagatccgcgccggatggcttccctaaatct

SEQ ID NO: 12479 - DNA, 407 bp, Saccharomyces cerevisiae
aaaaatcgaacgaactcataaacgtcaattatgcgtgtgccttatttatttagttgtgcgtacagtataatgcacttatttatttaccaatcaaatgatttttttaacttttcacgatctatataattacgttaatttcgagtatataacaatgaaaatatatatctacgttgttttaaattgaaaaaagaagaacggaagttctattaatgagccgagaccggtacgtttgttgaaaatagtttggacttaattactgacatactgttggctttgaagcatttaagactgaaaaatagtcatgcaaaagtcatgctttaatatggtgggtttcagttggatgcaagaaataaaatgaaattcgaaggccttttgcaattaaacaaggcatcgtcaaccagacaatg

SEQ ID NO: 12480 - DNA, 444 bp, Saccharomyces cerevisiae
tgaatagtgggcaactaatgtaatataagacatttgaaagtccgatcctacaccctctttgttagaagcattgtaactttatttttttttataatactctaaatgcggaactgtatacactttgcacagtttgtattcaaattgtttgcataaatatataaaaattgccacgaacacttttagattccttcgttagtctcctttgtatattgccgtttgcaggctcatgatgataaatctcgctatttcggtgaagaaaaaaaaagctagcttcgaacttttcaaaagaagtataatttcatttcaaaaataaggtccaaagaaaagaaactagcagacctgaccttctgttggtaaatattagtatgatgcttggagagcatttaatgagctggtctaagactggtattattgcatacagtgactcacagtcctcaaatgcca

SEQ ID NO: 12481 - DNA, 406 bp, Saccharomyces cerevisiae
gccaaacattagcgtgtattgtactataagttttttttaaaaaaattaattatttagcttagtcattttttttttttctgaggatattgctcttatgctggggtgcttcctatttgtctcaacttgttctaattgtactaaggttatcagctatttacttcatgcaaaccttaatatctatagattctttgaaaggaagccttacccatttacctctggccgttcatgaaatgttgaaattattaaattctacagaattgataatacataaaaataaactattaaagtatcagaaaaatattttatatcttaaaattcaaatatgcacagttcagtagaaagtggaaggtctcttgtaggagaaagtcttggtggatttttggactctgtgaggcaatgggaattt

SEQ ID NO: 12482 - DNA, 479 bp, Saccharomyces cerevisiae
atgaagagctcatgcacaggcatgtacatagatagatatataaccgttaaatagcacgtttttccagagactgagtcatgattactgccaaaaacccgcacatcacatatttttttgcgataaccagcagaagatttaggactagagtacataaagatgagccactgctagatatgaaaagttgaaccgcattttcaaacgttcaaaccaaccgaatcatgaaacggttgcaattgtttggtagatcaaaatatttctcgctggtctccagtgctgcgaaggaggaagaagaagaggaagagggctgtgctgatgccaaaagccttctacatagtacgagccatgatatcaaatcgagatcactacgcttcaacgataaatcgtccctcatgtgtttgccaacaaaagttctactgttaatactgcgaactttggacttcaatacattagtaacactatgccaagtcaattcgaggttc

SEQ ID NO: 12483 - DNA, 402 bp, Saccharomyces cerevisiae
tttttcgcttgctcacatttatgtaatcgatagactcttattactgtttgaacttcaaaaacagcaccttttactaaaatcattaaatatttcttgaggtatgcataattctccattaaatttcccctcaattaatgctaacgcagcgctccctagacagctgtgatataaatcagcatcttcttcgtcatttttactaaagcctccagttaatgttttttgcgttcgatcaagcaaataatttgtgactagttcagtttggcatagcattttccaatcctttgttagtaagtgtagtgaatttaagcaccaaaatgcgtaacacgtatcagcgaacttgttctcccttccctggaaaccgccatcatcagattgatcatagctggcattcaattcgctttc

SEQ ID NO: 12484 - DNA, 467 bp, Saccharomyces cerevisiae
cgttgatgaatatttcaattcacttgtaaataacgtaggtaaatatcaaaattaaagtctttcaccggaaactgattcagcatatttcagcagacgcgtcctagattcacagcaaacttcaatataagcgatacattaggagtgttcgtactttagatctataagaactatattttgttacgattcagccgtctctaaatgtgaactaaatatttatactgttatttgagaaaccgacagatagtacttaattttatcgatcatctaagaatagcatcggtattgtggtgacatttattgaatttcttccgctccagaataaagttccttttcacttcaaaaaactgccaccagtaaagttgcaccagtggtttttgagcattttttgtcaatgtcgcttaaccgttcttgaactgtatcctcttgacgtcgataaaatcatttgtaaaaaccaggccaaatcatca

SEQ ID NO: 12485 - DNA, 471 bp, Saccharomyces cerevisiae
gctctaccgcacccactcctccatttcacaagccgcatcattgctgctattgtaccctcttggccattcgcgtgcgcgttgattgccgttattatgcagatattttgatatcgcttgccgtttggctcatctccgcgcccttaaaatatatccgcttctgttgggaaatgccgagcataaaaatgccgaaaatataaaaagaacaagaacaatacccttcgagggaaacgctattttcctgtccacacaaccttaattaattcgcacgtctgtgccaccaagtagcaactggttcgtattgctttatctttcttgcttgttattacattgctgtaagataacaagcagcgttttactctacggattgtttataaggattttgttcctcgaccccttatatttactcaccttccccctactctaattctcctgatttcagaacaaaaaaaaaatgactccacttttgcaggc

SEQ ID NO: 12486 - DNA, 401 bp, Saccharomyces cerevisiae
cacaagataataaaaaagataatattttcgtttaaaatttcagaaatattgcttacatcaaacgaaatagtaagcgtaaaccatatatcctttcaacgatatgtatcatttttatagtcttttggcggtataaaaagaatagccaaaggtggaagtcaggttaaaccaaaagaaactacccgcaagggatgtatgcatttgaacataaaaaactattcactattttacaaatgtcaacattaattttctttggtgaaaatatgactctataaagtttcatcacaaccttgcgtaaatataatctgtttgatgaatgttgattgtttcatatatatctcttgattcaataagacgcaattccatttctttcatttccaaggcggaacccatttttgctttca

SEQ ID NO: 12487 - DNA, 452 bp, Saccharomyces cerevisiae
cgccaaatatggacacttatatactaaataaaatagctattatttaatcactgattgtatttaataggtttattcttgcacgactcattcaggttcaagtcacatattaagtagggcctattgctgattcaagttgatatccacgttttcactaatttgataacgatacgctgcgggcgcaaatcaaacatctgaaagatttgaatagcctttagtcccaaaaaaaaaaaaaaaaaaataatgtgaaaaattatctacaaggaaataaattgataggtaaagttaaagaatcacggcatgaaattaaaaagtgtattcagatcagttctaaagtaccggaaaacaaatttgagtttgcttctattaatcacctattcgattattacgttactctatatctttgatcatgaacgttataaactcaatctaccaaaagaggatgagcaccctga

SEQ ID NO: 12488 - DNA, 411 bp, Saccharomyces cerevisiae
tttcagacaaactagggtgaggattcttcgttttctgctctagcatgtcttatattttctttctccaatcactttttttatccaagtcctgaaaatactgtgttgtttgtttctctctagccgttgattggccccatattttttttattttctcactgggagccactaatctgttactttttttccactcttattttttatccatcgtttttttgttttttttttctttcatggttctaatattattttacaattgtactataaaatgcctttgctaatattaactaaaaaactaaagatttcactatgattataagcaattaagattttcatcttttagtgaaaagatgaaggaattattatctacttttactatattttccactatttttgcttaattgctttaaccga

SEQ ID NO: 12489 - DNA, 495 bp, Saccharomyces cerevisiae
aatctatgctatctatctttagtctatatatatatatatatatacatacgcataccacatcttcaaacgtgcatatagaatggagcctgcgtttctagcaatacacatacacctgtcaaaaaaccttcaccgcctccccctatttgttttatcgtcaattaaatctttaaagatttgtggaaccatgtctatcaaccattcttccttagggataactagacagtccctgataaattccttcgacgttagcatcaattgttgataaagcacatatttgcttggtctctgcgccttttccttatgattaacgaaaagtatactggtaggatgaacactaacgttcagcccacctgatgacctacccatggtttgatagccggtggggcctaattgtacaatattcatcggaaacccgctgatgaagcatcgagttattctagcatttatgtagcccgctatattgcctatcttcatcctggcttggtcgttcttttc

SEQ ID NO: 12490 - DNA, 487 bp, Saccharomyces cerevisiae
taaagtaagagttctttagacattcatgattgtaatgtaatttaattaaaatactaagtataatgcggctccaaaatactgaatcaaacctttgattcgaaaatattttggaaaaaataaatgatttgattgacttgtcagactgccatttgtacccacccatgaatccctatccttccaaaatggaagcacataggatgggtcaagatcatcgcgccattaaatatcgcaacaaattccaaaggaagttatcacaattgcaacggcaaagcaaaattttattcaaaattatagatggccgaaccgctaaggattgcggaccaagctaatttaaattcgatttcatttcctcactctggggtacaaaggttatggggctcatcaaccaagttggattcagtggctcttttgaagagtcaaagagtgacgattcctatagaaatgatcctactgttgaatgtgttagtcaaaacctgaagctggtgaa

SEQ ID NO: 12491 - DNA, 400 bp, Saccharomyces cerevisiae
tttgattgacgtttcataagaatacaatatataattgatagattgtacttttttttttgttaccctcaggagaggcagggcgaaaaatgcagaatcttggattttttttaagtagatctaagtttgtttatttttcaaatactattggcacaaagggaagggcttttcagggattattcagattcgagttggtggtgaaattgtgtgtgcgtacatccttatatcagagctttcctttagtgacaacatttaaatcgacgtgaccttattcgggtagtcaaacaccgaaccatattctttgcccttaggttactttcccttcattttatcagcttagtcgattaagttcgtgtctatatcccgtcaaaagttcctaatacattgcgggtacaaatgtcct

SEQ ID NO: 12492 - DNA, 437 bp, Saccharomyces cerevisiae
ttacactcgtctttatacgaaactggctccgttaatcacgacagacaaccttaattacattacataataataaataaatgacaactgtcttctttacagcgtatgttggagcttactcccgaagcataaacccagttcttctagaagaattgacagcagaaaggaaaggggtaccgaaggcaaactcaaccttaaaagttccgtaagcaaccgagcctccgcgaaggttgcataacttaaaagaaaaacatagctcacccggtgataccgttacaacgcgttaatcttaatgctatgactcggaaccacctgcaaaacagcgctaacggaaatttccatggaaatagaataagggacgcagcagggtttttttttttggcgagcacacgaaatataaaattgcttcgggccagctgcatggaagggttaatttcgcc

SEQ ID NO: 12493 - DNA, 436 bp, Saccharomyces cerevisiae
aggagagtttgctctcttctgcatttccacatacacatttgatgttaatttacatacgagtatactctcgtacacaacatatatatatatatatatgtaatatattcatagcacttacttattaatgaaggccataagccaaacaacatctcaccatttttcttcagggttttctttaaaccttaggtaatcctctttgttgaaaagcgaaatttcggtttcattctcaatgccatactcgaacagcttttttttgtcattctctatgtctaaagtccagtcgtcatcgtggtcaaaattgatcacgagattaaccgtcttggaaccatgtgcgtgcgtgtatatctttaaagtatcaaacttaacattacggaatggtctgaatgaaccttcattttgaattttgttcaaaacgtcattgaacaggtcctttgca

SEQ ID NO: 12494 - DNA, 472 bp, Saccharomyces cerevisiae
aaagatgatggcaatcctataattacgctggttcttgggaccgaaaagatttcgtacttgtaaataaaataggtgaagaagaggggcaaaaagtagtagattaaatggttatactgaatttataagtaagtttaattatattttttaactatatgatgaacaattttgtactaatattgcggcccgttatgagtattgctcttgccataaaagtgtgttcactgctttgtttcctggtactgcataccgcttaatattgttatcgctcaataaatttagtttctggaagctttccaaggacttaccaggtagcgggcctgagaatctattttttagtccatcggctacaaaaatcggtagtatatttgttcttggtaagtaagctttgctaaaggaaagtgtcctttttctgtttgtattcttcttcgaattccacctgaaatgttggacattcagggatgtgtgtaaccga

SEQ ID NO: 12495 - DNA, 481 bp, Saccharomyces cerevisiae
acgaagcataaccaacgcctgcacttaaaaaaaaaaaaccatatagagtaatatataaatatatatatttgtacaatttttttctttatttttaaaaaaaaaataatacttgacataccgtaataataataataataataataataataataatataataataatacaataatacaataataaaaacaataacaacagcaacaatagcacaagaacattaacccaagcaactagcaataacaagaacggtaattatcaaaacaaaatatgataccaaatgcggaaaaaatcggcacatatccataaaacatacacatcgtgcttagcgatctacataccgtggaggaatgggtggaacggttactgacgacggccgcgcggggttttgtgttgggtgtgatgtccggatgcaacagcagcaaaggagaggcgcagcggaccttccttactttctttttcttcttttcttttccacctcccc

SEQ ID NO: 12496 - DNA, 434 bp, Saccharomyces cerevisiae
ctttaatgcgatactgccgtagcgggccttcgtatagctcggccgagctcgtacaaaaggcaagcagtgtatcggacagagctgatataacacaatacgctcgtagtcgatgcatgccgtggctgctctcggtcgggtataagtcttagacaatagtcttacctcgcatgtataataaatcttttgtatttaatctattatatgtttctatgcttttttttcctattgttgtttgcttttccttttccttatttctttctagcttctaattttctttcttttttttttttttttcattgaaaattatatatatatatatatatcagaacaattgtccagtattgaacaatacaggttatttcgaacaattgaaaaaaaaaaatcacagaaaaacatatcgagaaaagggtcatgtctgctgttaacgttgcacc

SEQ ID NO: 12497 - DNA, 490 bp, Saccharomyces cerevisiae
tatggaaagaatcgccatgtttaactcttcttaattttcactaagaaatacaacagcaccctgataatgaacacacaagaactatgtaagattttcgtagccagagaatatcctctggtagtggtgccctttatatattttgttctatttttacaccagaagtatcacactactctaaattatgtctggtaccctacgtgttctaaaagaatctgggtgagagaaaaaggaagaaagtgctcctttttttttttttcaaaggtgcctcggtccgatggcttcgcaaacaatagatgccaaaggaaatgatcttctctttttcgcttctttatttttttttaagttacgacttcgtgcagcctgggatgtaccaagcttgttgttaaacgagcctgacttcttaatcgcttaatcttagttgaatttagtagttccagtttgtatggctgctatttttgagtatttggaatcatctttcgttcagcgatct

SEQ ID NO: 12498 - DNA, 424 bp, Saccharomyces cerevisiae
ccatgataaattcaccacatgtatctatatatgttcatgcatataccatatatattttgttattcatacgatagacctcaatcgttttgttgcctttcaaaacgcacaattgtaaacctagcttactatttatctatcgcggtccagaatggctttcctttttaaattcatcccagaagccacgtcggagtaaagtattcggccttgatgactatttcgaatcgaaatgaaagaataaaaggaactaggaggttgttccaacaattttccatgccgtaatttcatcggttattaggttaccagcatttatctcagtttatttgagtcaaggtaatttattttcattcattactgtatggagtaaaaatgaattccatttatgtattcgcacgaagagaaatttatcatccgtcagagacaccaa

SEQ ID NO: 12499 - DNA, 408 bp, Saccharomyces cerevisiae
gtttgattatgaggagaagtgaaaattttcaaaaagtgtaaaaattagtatagtcggaaacgcatatatatatatcatagtattgataatgtttctgccaagattgtgtccgttatcgcattttctaacgggtaaggtatgtactaggtgagagcgggatcttatttcaacatgttgtgctttaatgcttctttattcaacagcctgtcaacgtcatcaccgtattttgcgttaccttttccattttctttgaaggcataatcaacagtaattctgttgttggcgactaactgattgttcaaagattttattgccaaatctgctttttcaaagtcctcaaaataaacataagcacactttaattttccgtttgataggtagaaaatttcgggttcccttatgagctta

SEQ ID NO: 12500 - DNA, 422 bp, Saccharomyces cerevisiae
tttggcttttccgcttagcttaaaactataatccattatttctgtacagagttatcaaaaaccggagaaaatgatgtttatgtaaatgcattgatatttatgaatgatttaaaacttccccttaaatgtgatttctaaaagtaagcaattgttagcagatgataattttttgctacacattacaaacataaaaacacatggtctcagtagatagagtacatattctaatcactgcttggccccattaacttgaatagataattttgaagtggccttaatacttctggtattctttcaggaacttctaaattctgtatttgcaactcttgacgagactttgctgcatttctaaacgccataacaaaattaaccactaaagtgacaaataaaactatagaaaccaaaactggaccaagtggtgc

SEQ ID NO: 12501 - DNA, 439 bp, Saccharomyces cerevisiae
ggcataagaggtaagacagttagtggccaggctaatttataagatgtgaaatgagatggtgttggtacgatggacaaacagcttgcataaaaagacaaccaagttacgtatagtgaacgagtgaaaataggcaaaccttctattcactaggccgcttcacatgaaattagatgttcgtatcatatttacgggtatcgcgtaataaataagttattaatctattttttgtgtctacttatttcaattggctatatatccttatttatcatcatcgtcattattattattattattattattactattaccattacccttattgtttgtgttggtggatagtatgttaggacgcttttgttttcttgccaatttgacttcatattcgtggcaacttaccaatccatcaagaactaaaggttcaggctttggttcttccttg

SEQ ID NO: 12502 - DNA, 439 bp, Saccharomyces cerevisiae
tgggaaataagatagatgcagagattttttatggcgtatatgtatatgtagtatgtatttttttttttttttggccaaataatagataaataccgcctttttacgtagttttttccgccacgaacgtttctatacagttatccagtaattcctctatctgcttctcgtcaaaacgagtcacttttgagtgttccgttacaggaatttggttcagtagccatttctcttttatcgatctggtcaggatcaacaagtcttgaacatttttaatcaattgcatggtctggttattcaccatcatcacactggtcgtggccacagcgagctcagaattttcttgtgcgaatgaaccctcgtcatcatcatttctatcggctatcgtagtcatatttatcaattccgccagcttcacggacagaatcgtcctggtttgttcgag

SEQ ID NO: 12503 - DNA, 446 bp, Saccharomyces cerevisiae
ttatcaaaaagaataaaaggaagtgcattagaggtcaaatcgttttataatataaatatcattacctttaaatcttagacctactgaagaacacttttaccatatataatgctactaattactccaaaagcgttagcttcagtccatgttttactatttttcttttttttagaaataaaaataaaaaaacttatatcttatatgtacacttcattaaatcctgggcaaactcacccctcaagtatgccttttctggctgccctagggggagctcaagcaatttggccttcgaatcgcctattgaaggattgtttttctccaatatttttgatacaatctcttgggacataacattacaacatgcggccacttcacgacagtgcttatactgatcataaaatatcttcataccactaattaatgaatcgatagtctcctgcgtttca

SEQ ID NO: 12504 - DNA, 491 bp, Saccharomyces cerevisiae
cttttggccaagtaggcagaatattgggtgagaggtggaaggccttaactgctgaagaaaagcaaccctatgaatctaaggctcaagcagacaagaagagatacgaatctgaaaaggaattgtacaatgctacacgtgcttgatctaacaactcaatgttctctacctcccatacaacgtacttttgaaacttcagaaagaagttgagtaggttgcattatgtgttattattattactattatcattattttacttatatatccttcttttcttttatgtattctcttcctttttcgcacaacttatgctgattcttcaatatctaattatttagcatttttcttctccatccgacgcaccaaaacgcgaaacgcgtaactttttttttttggatttcaactgatagttttcgtactttgcttcctctggtacataaaattatatataagaaacacttttgctttagccttcctttctttccacttgcacc

SEQ ID NO: 12505 - DNA, 476 bp, Saccharomyces cerevisiae
aaagttgaaatgaataggaggttagtattttttttttacaataatgaccattcttgttgacttttcatacactaattattatttatattttgtatttaagtacttactataacgtcgacatcaacgcatacatgccaaatatctggtgcaaaagtttttatgcgttcaagcttagatctcacaaactgaagtttgatgccacggtttctaattaatgcaattgactcattaatagcgtcgagttctacaatgacattcttttcgaaacttccatcctcaattgcatctatgtgtacattttcatgtatatgcattgtcactttttccaaagaagctccttgtaagtaaattaatttgatggccaatggccacccttgtttgcttgaaggcaggagacctaaattaatatgcctaatacgtaaccgaaatccgggattctgagataagaattcagtaagcctttgaacgcacatttc

SEQ ID NO: 12506 - DNA, 464 bp, Saccharomyces cerevisiae
acgctttcgcaagatctcaatatatacatgtatacgtatatgttcacattatactccatattcttgtaaatatataataaactcagaaattgttgtccttcattcatgttgatatttatatgaaacgctgactgggcctttcaaatcttcatcggtttgaaatttgaattgtaaatatgttttgaagatacgatgaaatgaaaaattgacggcttaacgagaagatgagtgaaacaaggatggcacagaacatggatactacagatgaacagtacctgagacttattgagctactctcaaactatgattccaccttagagcagttgcagaaggggttccaggatggctacatccaattgagcagatcgaactactataataaagactcattacgaggaaactatggtgaagattactgggatgaaacgtatataggtcaactaatggcaacagtggaagaaaaa

SEQ ID NO: 12507 - DNA, 426 bp, Saccharomyces cerevisiae
agcctttggtaagaaaagtgtaagtagaattagcatttatttttctccatattcttattctataggatgtaaataatatgggacttttttatatatatatctacagtgtagagtctaatatgtataaacatcaaattcattaacgaagacaaatctggaaaatatccaccatccgtatctaaaccacacaacttgggattcgtgagcatttagcatagtggcaaacgctagtacgtattgtgcatgtgtattcataagtgaaagcttgtctttttcggcggctgtgttaggcggaagcgcctgaattattctacggaatggagaaatcaggtcgtaaagtatttttaggatttcccaaataaaggagttgtactttaaaacgatgttgttcttgtagcttctcaaataaagcgcagtgacatgagg

SEQ ID NO: 12508 - DNA, 456 bp, Saccharomyces cerevisiae
gaatagaaaacgttgttgaatgacaagtcgcctttcagtttagcagtttgagcgaccattcatctactcgatcaatatctcagtgataaataaattgtcttgattctactataacccttttgtaaaataaaaaaaatttctacgatggaccggttttgtttcctagggagtaatgaacttggcctataactaagaaggaggttcaaaaatttaaatatgttcatttttaaaatcataacactatatatatcgacaccgtagaactaactactcgggaaacccattgcgtaaaaatataaaaaaactatgaaacgtcacgaaaaaatgatggttgtaataactgctagcaagggaaggtaagtagtcgaaagaaaaaaaaaaatgcatacttctaaaatgttggggcggaagaagcaaaaggttaagcaagcgcgttttcaactctatcaagggcgg

SEQ ID NO: 12509 - DNA, 500 bp, Saccharomyces cerevisiae
gccaagattaacataagacaagtttgcaaaatccccaacttcacttccatatgcatattcatttaggtatatatcgtatatttgagaaaaattcatatatgaaacgttattaaaacatgaaaaatagaatgtgttatcgggcttaactatattctgccattcaatgcgtgtttcttgaccatctctcgcactacctctgacggtacatagaatgggttatgcttctttgtctttttcgtgtgctcatattgtctttggttctcgaactcaacctcctgggttaaatttatattaaagaacaagaaatcctctatgctatcattattatcttgagattccatctcaaatagttcagaaaatccggtgttcccgaggtcatcgtattgcaatttttgtttgtctacctcattactcaaattgctattggaggtgcttttgatagcatcactacatttattatgaagcatatccattaactccgtcctgagttgttccgacgt

SEQ ID NO: 12510 - DNA, 413 bp, Saccharomyces cerevisiae
accggttaacatcatggcatgggatataaatgaaaaaagaaaaaaaaactccgacgccccttccatcacatcatgtactcttcgctgaaccgggtttttttctttgcaatttttttttcgttctcctaaagcatacacaaataaatccttttttttattttctatttattttgttatttatcatctatatagcaataatatactttgtttttattcgtatttcacacttttctttttccttatgcaggcagtgtaattcattggggaggatgattttcatgtgcgcatatctaccggctgcaagcagccggtcggtggcaaatccggcgcttccccctcaaaaaaaaaaaaaaaaaaaaaaaaagggaactctcagaacgggggaggttgaagagcaggccaagggaaatatt

SEQ ID NO: 12511 - DNA, 425 bp, Saccharomyces cerevisiae
agggaccgttaatgattacaatttttttcttcctttgtactatgtataccaatgtgatatgatatagatttcatataggatgtgatgatgtgtatcacccggcacggctctaccccgccctgtggggtgtggagaaaacgccgcgcagagccttgagtaggaaggggctgggttctccccttcctgccggggtccgcccggcgccaagagtaagagagcgaagccggagacgtaatatgaaaaaaattttgaggggaaagggcgtccgcaagggcaagggcaaggggaaggggtggcgttttgtgcttcaaggaattatatttcgttgttttccgcactatggcggcattgtggcaagtaactactttacggagaaagactagaaaatggttacaactgccactattaccgcttcgcattctctt

SEQ ID NO: 12512 - DNA, 411 bp, Saccharomyces cerevisiae
gtgccattggtaagaagtaaaggattaacgggtgttcgaactacgcaattgattttatacgcacaaacattacaaatcgaagcaaaagaagatgaaatgatatgatatactgatacaaatatgtattaaataaaacataagtattgatggaaacatggcatagagaagcgaagatgcgataatatcaaataactatatgtgagttgtggaagaaagaaacgatcacattattataataaactagctatttaaatgtttattgaagactgttctgcccccttttattcagtcacggtattggtcaaaaaattctttatggaaactttcccatttcttaatccattccagaccaggtgccaaaaatgttgttcttaaatggtaagtaccaggttcttgaccaaacccagaacc

SEQ ID NO: 12513 - DNA, 407 bp, Saccharomyces cerevisiae
agaaatacccttctttccaaattgatatagaatggtaaatgaaggcttggtcaattgtatcatatagaggttttttattgaattacttatacaagagcgccccgcaatagaatatatatgtatgagtaaacaaatttatatcttgcagaaaaatatctaacttattattggtgcgttttattaatattcctatattttacataggaggaaattacatgcatgaaacctaaagggtttggaagccagcggcaacataatcatcgacagtcatctcgaagatacttttgtctttaagtttactatttatcttgggaaatacgttcatatcagattttgtaaatcctctcgaaaaaagacactttccatttttttggtttcttctactgcaagaggtgcaggctttgaaa

SEQ ID NO: 12514 - DNA, 483 bp, Saccharomyces cerevisiae
taattctaagttactcgccttttacaagctctataaatattcttttccgttctttagttgtcttaactttgtacaatatgaataaccatcgtttctaggctactaaaaaaacaccatactacataaacaaatatctaataatgaatactcttggcattcgtcttgtttctcgaggaatatcggccgagtttttttcattttgacaggttatataattcaaaatctatctgactctgaaaaagtggtaataaatgcattgacaacttcttctctttattttacagacattaatccagcactacaagtggcatataacaagatgctaagaaacattttggtgagaagtactggcagcaatttcaaatttgctggcagatatatgaaatcatcagctcttttaggatactatagaagagttaactattattcgaccaagatacaaaccagactgactagcgaaaactatccagacgtgcatcgaga

SEQ ID NO: 12515 - DNA, 482 bp, Saccharomyces cerevisiae
tcaccaaaaggagaaccaatatcacccaagaagaaatcaataaaaaagactttaatattaccacgttaataagaatagttatgaagatttcgatgtttcgatgaaatactgaatctcgatctttttttttcatttatgcttgcatttgtatgtcacgagttttccttgattctaacttttacatatacgtatgtatgtatgtatgcatatgtgtttttgcatatctaaatgaaatatcaactttattatgagggagttgattattgtaatgtaattttatataacttctttttcgttagcggaatttctttccgtttgaatcgtatacaaaatgtatgtatccattacttatttacaggataaatgaaaaaaaatgcgtaacgtctgcgtattcgatgggcttacatgccggggctcgtgcttattcatatttcttcacttggctgtacgcaagaaatccaatggctttctttctgccactt

SEQ ID NO: 12516 - DNA, 412 bp, Saccharomyces cerevisiae
gatagtgcttagtctgtaatggaccatttcgtcttctttttgtacttcttcctcgaagctgaatcatatttacccttttccaggatcgtccttgtatattgtgaattattctaaaagtagaatatgttgtactttaaaattgttatagttatcatcatctatttttccattttataaaatttttacgttagacagttatgtattgaaactgcttcataagttttgaaaatcatcccagtttggtaaatacactaaccaaaaaaaaaaaaagctctaccacataatctttgggcgtattacaacatgggaaacacgacattattgaaaatacaaaaaaagtaaagtaagactcgttcagggcataagtcaatggccctgtaagaaaaaacaaagtagctaggctcataagaga

SEQ ID NO: 12517 - DNA, 498 bp, Saccharomyces cerevisiae
ataaagaatgcacggataaataagtaaataaataaccatacatatatagaaccatagaaccacgtttttgtaatgaacagtctacctgtatctcatcatttttctgtgttaactattattattattattatcgaatggagggtaatattatgtataggtaaaataaatagatagtgccatgatgcgcgaagattggcaatgggaaactcaagaaggcagcaacaaaaaaataaaggtggcctattaatcacaatctattgcctatatgtgctaggttatgggcaaattcggcacgacaaataaatcaacggagaatcttctgcgtgataaattcgtacccgagacatctccaactaatattcccactgatgtactcatcaagcaagggcaaataacggattccaccgaatcactaattcatggaggcgcagaaaggtatattgttaacgctttaaagcctatagaattaaataaaactgaaggctttttcgaagaccc

SEQ ID NO: 12518 - DNA, 437 bp, Saccharomyces cerevisiae
gagcaggtgagtagtaacatggaaacttctaatgcttttattcataaaaaagaaaacgcgtgctatcgcgtaactaggttgcaattaactacagatcgtgccaaatacgtgcttttttatatggtttagaaatattaatcaactgaaacttaataatatattcgcatgtttttggagtctctgggatagcacttcacctatccttggaaacttgaaatggagaagttttaactaaatgacttttttggcaattgctctcttataattcagtacactgttgttaatgtaagtttgtagataaatacaatatgacaagtatcaaagcaggctttagttttcagcagttcaattatcttagaatggatatgaattagttaaagcggctcgacccagttagacttaatttgtcctcttcattcaccatttttgcagcgata

SEQ ID NO: 12519 - DNA, 412 bp, Saccharomyces cerevisiae
aagagaaagatagaaattcaaatgcctttcatggagatatatgtatatagataaagataatattaggaacaaaaaaaactttctgttatactagactagtaatcttaaaacaataacatagcaacaaggcatgtaccaaaaagaagggggtccaattgcatgcttggatttgctgagttcgcgtattttgaaatcactcttttcttggagtcttcaccttcttgcgttaaatctttgtaccctttttctatgattgtaccatcctgtttaacattcagcgtattttccttcttaccagaaatacaagtgaatttcccacccctgatgattgatcttccatttgatgggtttgtccatttattgcaatccaacacgtttgatgaactcttaataaaagcgctacctttcacca

SEQ ID NO: 12520 - DNA, 420 bp, Saccharomyces cerevisiae
tacatacaaatacatgccttactttcgatgccagcatctggaaagggaaaggcaggggcagagggacatattacttatctatttatgcataatttgtgttatatattggtatgataacttgatgttagagaatgtgctattctgtttcttgaaaatctgagttaaggttgataccgctttgatacagcgggtgtgacaggtttatctgtgacggtgacaggggcagtagaactactggaagccgcaaagtcagaggatactgtgagtggtggtgcccacaacgtggatggtctcagtttgaccctaggacttgcagaagatcctgtgggaaaatccggggaaggcggatggctacttgggttgagcattactctctttgtgaaaagggagggagggagaagtttggggatgagatggttg

SEQ ID NO: 12521 - DNA, 434 bp, Saccharomyces cerevisiae
gaaaagctcattaatatttgagcacttagataaagttgcatatgtgtatgaatacattctgaagcagccattaattattaatttattcaagggcataatcagtccaaaatttatgtttttacaattattttttttctcgttgttggtttctaaatgacctaggagaattatgtatagagattagaagcttttcgacaatatagacttcataataacgaaatgattttacttatgtctgcaattatttcctcatgccttcctgtattatcgcttgttagtcctagtacgttatttgcacgcctgttccgactgaattcgatgagagttggaatctatgtcacatttagcaccgtataggctaatattctaataagcgtgacaaaaaattggagtgttttacttgtaattgatgaatatcaattcaatgcccccat

SEQ ID NO: 12522 - DNA, 402 bp, Saccharomyces cerevisiae
attataatatacctatgtacagggcggttatttatttacacgttcgtagtatagcatataagcatatttctgttcattcaagacagttgaagcggtagattcctttatggcggtatcagatatttgccaataaggataccgcagggcgtttttgacttttttatatctgctttttttgtaatcattatgtgcaacgttttgctcgcgattcttgttaacttcattgttgacaactggtgctcttctgaaggaagattcatcctccttcccgaaacgaatttcagtcttgcgtctgtaacacatatagtgtccactcgaatgagaaccggtgtgtttcacaacacttttcaaattatatttgacttgcctgttttctgttattgtcccactctcagccaatgt

SEQ ID NO: 12523 - DNA, 496 bp, Saccharomyces cerevisiae
aaataagatacattgccgctgctccgcattacatatcatatagagtgacactaagtaattaaatgacactaagtaacgaaagatatctgtaaacaacgactatataccagaattagtcatattctctattgtattcaccctacacagccgcattacacagctgctccggacgttttacgctgcacatcaatgactaataccactgtatttgatccacacttagcgcaaaagtcacctgggtggcgttttccgctcgcgctccgccggtgagagcgagaaaaaaaaaagggattgggcggtaatgtaaggaaaacccactagttaaaatcaatgagataaggaactctctttttttcccgttaatcatcttttccttgttcgtttcgtgtatctgtaatgaatcttatcggagtaactattactggaaagccataccgttaaagaagcaagcatatcattcgtattcaagcatctgtttttctttttaaccgctcgg

SEQ ID NO: 12524 - DNA, 478 bp, Saccharomyces cerevisiae
tcccaactctaatatacaggcatctttatataattgaatatagaggcgacataaagtaagaataaaaaaaaaaaaatctatccataattcctcttatcttctcagcacatcacctaaaagtcattttgatacaagtactctttaaactgagcgaaggctttaccacgatgagaaatagcattctttgcgtctttgctcatctctgcgtaagtcagtccatgactatcaaaaggttcaaaaattgaatcccagccgaatgtagtgggtccccggcttggaacgatcttgcctcttgtaataccttgaaagaagtgatattcaccccgagaatcagcaaaacaaatggtggtaactgcttcagcgtttttattttcaaagggttccaacattttcacaattttttccaatcccatgctctttaaaaaccattttatataagcacctggtagaccgttaaattcgtcaaatctcaacgcag

SEQ ID NO: 12525 - DNA, 401 bp, Saccharomyces cerevisiae
tccttgttttatatattcattgttccaattcaaattgtttactatcatttacgtattataaccagtatttccctttattggtcatggaagattcgcgttacccttactcgttaacagtgatattatttgtatatgtgatgaaaatttaagaaaaaaatagtcgacaacacgccgaataaacaaagggtttcttcaatacctgatatagtagctagagggcagaagtttgaggtgatatctttctgagtgttgttatttttgtaagtcgtaacacggaactgtttgcctgttggaattttacgttactattctcatcggtataactagcttatattcactttggcaataggttaaaaaaagctcgttcatttttttaaaaacagcaacgatgtcacacgaag

SEQ ID NO: 12526 - DNA, 444 bp, Saccharomyces cerevisiae
aagacagtagtcagcgttgggcaatctaatgttataggtgaagttttactactttaatgtattcactcacaactttcgaccttatgtaattattctatgtatttttagatatgtccatacaatgcattattcttgtaattataacacatattaattaaacaatgggtcaaaaagagtcgagtcccttggtacatattatgttacattactgattaagttgaataaaagcatctaactttaaggaatctgctttattttgaagaccgaaaactacgagtaaaaataggagttttaatgcggatgaatgtctaaccccagagatgggttctccgataaaaactgagaagcttcctgttcacagtttttataaattattttgtatggctgggctcttgcaattttcagcgtttttttattaagcgaaaaaaacagaacaggggtccc

SEQ ID NO: 12527 - DNA, 464 bp, Saccharomyces cerevisiae
cctcaaagacattctatatttcaaccttatttccatagcatagtcatattaccacgtggagcatcatgaaaaaaactggtaaaactcgtcaaaaagttctaaaaacataaagtaatattttctatatatttccgttgaaggagctaatacataatccatacaaaatagatcattatgcctagatgttattctattggtgtttgtcaagtttaagaatgtttaaaacttttctattgtatcattttctagtaattacatgactcgagttgagcgaatcaaacgataaggcatcgtcttctcaatatagggaggtgatcgggaccagcctagcataaagaaagggattgaaataattataaaaatcaaaataaaacatttattgtctaaatgtttaaaattccaatttctttggtttttcccatgagtactcttgattagtgaagtgaccataagaagcggttggt

SEQ ID NO: 12528 - DNA, 497 bp, Saccharomyces cerevisiae
tttcaataaagtgaaacagaaaaatgtacatgacacaagctgagggtcgtaaaaagcatctttcgcaattgtttcaacctcatgacccctgtcttgactatgtattcctctttacgtcgggctactcgcaaaatcaagtagttttaaacctttagtatgttgcaaataaagagcaaaaaaagaatttattcatcccaggaatctcactacatttcgtaggggaagaaatgtagatttgaggttcatttggctcgtgagaacgacttgaaccttattcatactttatataatattttaggagtattgtagcattatgtatatttttcttgcgggtgtgcactgccgaaatagctgctgaatatccagattaaaaaactaaacaaaaaactgtttcttgttcgaatagtaaaagaaggttttcccaaatgctattgttatttagaaacgctggaaatacagtattttttgaagaactatccgttttacccgaacctatt

SEQ ID NO: 12529 - DNA, 421 bp, Saccharomyces cerevisiae
ggaatttacattatttagcaacgcacataatcacatcaacatgtatacatagtttggagacttgagtaaatagtagtgagaggatatatggatcggttcaagtcaaaggattgtaatcatcctctttctcctttaaaacggagagcttctatagttttcaagcttccattaaaaatttcagtatttagttcggaaagttacataattgcaatgtctcataaaggaccatgcttcttttgaaagtgaggaatctaaggctgaaaatgccaattcttaaaaagtagtataaccagaaaaaggaatccccataaaaggaaattcatgatacggtcattgtttcttcatttgtttaatacgttgtattcgagtgttctagccaataaacgattcaactaaaacacttctggttcgcttttaggga

SEQ ID NO: 12530 - DNA, 488 bp, Saccharomyces cerevisiae
gaagttgccgcagtatggaatcacttttctatgccacagttatggtatgtgttggaagacaattaattatcgcattatgtttgctgaatatgaaattgtgtattctataatttaaatgatgcccaatgtaatttacacaaacagtttttttttaaagctccttgtacgcctttatacacattaaattaatattagatgcacaacatacggtacgtttaggaaactcaaattaagctttatttttttacttttttattattgttactattattcttattatcaacattatcgttttcatatctttcctgagtacaaatatgactgaaacttacaaaaaaaaaattaattatttattactattaatgattagatgttacgcttttttataaaagtgagagtgatactcggtttaaatcatcgtccacccttcatccgttgtttcagcaggtgtcagtttggttgcatctacattttcctctttcttgcgc

SEQ ID NO: 12531 - DNA, 480 bp, Saccharomyces cerevisiae
taaatgtttaaatgcgtaaaaatgcccgacatcaaagcatatagaacttttttacctaatcgaagcttttctaaagtaggtattatggtagtcttgaaacccacaaaaaatatgaatgtatcatgggagggaacgaaatgttttcaacagcggtaaaaatatactatatttgtatatccagttcatctttactattctctattttttagtgtaacttacattatgagactagcgacaaaatctcctttttaagcgaaaagagaaaactttcgaaaaaccaaagtattttgaaaaacgacctgaaataaagggaatttgaagaaaactaaacagtgataagtcatcaaagaagatgctatccgtagtagcgatcccgaaaatatgtgtcacaggtcctgcaagaagatgcttttttcatactgcaaaaaaactatacgcagatgactataaaccagcagctatgtcctccaatgcaccttc

SEQ ID NO: 12532 - DNA, 474 bp, Saccharomyces cerevisiae
tagttttagcctcaccgatatacttatataatattcattgaaatagaaagacatttacaaagtagacggggatatttagccccactcatataaattatgcattataacttttataaaaaaaaagaaatcacacttaaataaatgtcttaattgcacattccatgttcagatatacactatcttaccttttgaataggaatgatggaaaaaaaattatgcttccaatcggatttgaaccgatgatctccacattactagtgtggcgccttaccaacttggccatagaagcccgttattacggtctgtgatccagcaaatgtcagatataacgaattgaagttgcttttcccatcaatgtttgtcaagttgaaacgctgtagcacacactaagcattaacgactatattacaagtaaagcatcaaatgattacttaaaagagtaatcgcaaactatattgaagttggcaaaggcac

SEQ ID NO: 12533 - DNA, 487 bp, Saccharomyces cerevisiae
ttcagtgcactcttgcggattttcatatttcgtttcaagtatcgttcacgttgtaaattcctatcgtgtgcatttctctttgtgggagaaaaatatcttacataacttggctctcaaatcaagttataattgttgtataaagttgtactcttaatgaaaaaacaaaatattatattttggcttccacttgcagtcttttacaaaaagaaaaaatacttcgaaatttaagcaatacaaaaatacgtacgtccttttttcaccttatatatattcttccaacgtatttacctctctatttggaaataccaaattcttcgtataaagtatcacctaatctcttcagaccttcagtcagtttctcaggagagacagctgcataggtacctctgaagaaaattatgtttggattactgacttctttagattcagcgggttgaggaggttccgtctcaccctcactcttgaaccaagaaccgggaaccactaa

SEQ ID NO: 12534 - DNA, 471 bp, Saccharomyces cerevisiae
ccacgccgatttattagtaagttcatttcacatctctgctaatttctaatttctcttcatacttgtataaagttctatgtcaataaattcttgttcaaatgagatgttgctacataaaaaatatgaatagatatcggcggctctagtacccattccccaaaacacgatgtcggtatattaacagcacgtgtattttcttttttgaaggatacattaatactttcttcctaaaactgcacttatagtggggtgtgaaagggcccttcccgtattcaatattaaagcagcccttcagattgcaaaaaatgcacaataaatttgttaatataagccacaagccaaaaaaaaaaaagtgatgcaattgtatatacttaacataaagattttaagttatccgttaccattgcatacagaattatccagataatactgtttactatgctcatcgatcgtttcatattggtcattgcc

SEQ ID NO: 12535 - DNA, 480 bp, Saccharomyces cerevisiae
atgtaaagtgataaaaatatacacgtatatatatatatatatatatatataagtacgtgagatctatttgtataatataatgctaataaaatagtatcaacgatactgttgataaaggtaagtcgatacctgttccgttcgcatcaaatacaaatgccacttattttgtagaggtattaatgcattatgtgaaaattatgactttttatcaagcaaaataaatttgctacttgtgccctttttctttctttttttttttatttgatatgcgtgcctttagcatcctccaatttgataaaagtcggcttgctattagtcgctgacaataagttgtaattggtgttagcttcatttttaattttttttgagccatacaagccatcgacatagtaattatttgtaatcttagtctcataatcgagtatgattttttcaaagctcaataacgccttctttaacgcatcgcctacagcctctttt

SEQ ID NO: 12536 - DNA, 416 bp, Saccharomyces cerevisiae
gaaggcaaggccgaaaaaaaacacaaatctttcaattgtttaacatattagttttgtaataagcataagtgtatattatacatagcacaagatggataatattctctgaaaaaaacgtgtagtttcatgactcgcatttttttttttttttctttcatgttgattaacatacttgaattctgtatttaagctgtataaaaagttgttctatttcatatacggcgattttgcataattaagaactttgccttgtacactattttactagggtattcttccaagatttctcttcttattttttccctttataagtcattgtagcaacataatttcctggaaattttaagggaatatatttctttccgcccacaaacacaaagggcgtttagtaaattatgcggcgatgtataaaagag

SEQ ID NO: 12537 - DNA, 466 bp, Saccharomyces cerevisiae
tgagaaagttgtatatggccgtctattttttttcttgcaggatttagaaactaccacaggaaaaccttttttaatatcatattttttgatattattatatttgagaaatgaatctcgattattatgagtcaatttaacaaaacctcatataatgtacagcagtataaagacaaaactctcttacgcttaccatagcctcaataacatgtcacaatacgaactttttatgttcttcccatatattttattgtactctacacacacagtattgatcatatagtaattaccttactatacgctacctttaagcacaagatatagacgataccatacatgaatgtcgatcagagacgtatggtatagcttgtgtcacattctgctatcgtatatggtatacatggcacatactttaaattttaaagtaatgtcacttgattaagatctttcctatacgtcaaggtctcga

SEQ ID NO: 12538 - DNA, 448 bp, Saccharomyces cerevisiae
caaatttgacggagttgctcaggttttaaatattcgtaaatgactgttatttccacgtgtctttctatgtgtatcacctgttatacgtgttggaccttacatctaaaaaagaaggagaacgcccacccacatccaaatatgttgcagatcctactatatagcgagaggaccgagcttctaagaaagttacaatgaaataaatataaactaggaagaatagaaagtaaaaatatacttatgtatttgcgtgataaacttgcttagaaacaaaaatagattgtaaactaaaaaaatcatttgatcgtagaccaggtctttaaggatggcgtatgagtgtaataatgactcttataagtagacatctgggaccctgtatcattgttagatacgttccttggttgaaccaagttatggaaagtacccgtcaacccagatccaaggtcttttg

SEQ ID NO: 12539 - DNA, 402 bp, Saccharomyces cerevisiae
tgtgttcatgtaacgaaaaggggagcgttgcatagatagaccaccgccccttttaatttttccagcgttttcaattgttattcttcttcttcctcatactcacccaatacataacatgtatacacacatacatagataatgaagaaaatagcagtggtagaaaaacttaataaacatatggaatgatcttgtaaggaacttttctttcgtattcttcccaattttcgccatatttcaggcggcacttgtgctcatcacgttgttgacggtgtaataacaacgtggcgaagtacaacgagtagtaatatgtcaagggagtttggaaccaggtggccaaacaccaacttaatgaaatcagccaatcgccaaagtaattgatatgctgtgatttagcccaccacc

SEQ ID NO: 12540 - DNA, 458 bp, Saccharomyces cerevisiae
acttgacaataactatataaagcaaataaattaaataagcataataaactgtaactctctaacgggtgcaagtataagcacaacacctcaatcatttgtgagcaaagaaaatgatttatagctgcacttagaaaataaagcaaattaggtgaagtgtctttttattttatttttttttttctattaacaaacaaatgtccatgtatatatatataaacgagagaaaaatgatagtgaaaaataaataccagttggaacttaaactgatgtatttaggtagcagaaggatagagttacagaaggtgaaattgtcaatacagatacaaaaaagaaacaaaaagaacttaaaaggacacgtttgaactcataattcaccaactggtcgaattagtaatcgaagtggtgttgtaccattgtacgttacctggagaggtagtggtaacagaaggtgcaccggt

SEQ ID NO: 12541 - DNA, 435 bp, Saccharomyces cerevisiae
taaaaagggcggagcgagccattttatttcctgtccccttcatctttgtttatatccattctagaacatgaattagactactatgtgtgtgtgtgcgatacccttttttgaattctttctaccttttatccctcactatgcctttcttttatttgtttcgtccgttcgctttactgtaaatgaacgttgttactacttagtgtgcgtgctcaagttgaattgtgcttttttttttatggttatgatatttgaactaaaacgagtgtgtgtttcgtatttagacagatcccgtaaaatccaaattgttagcttttttccttttatcactattatttttttccactcttaacaatgtgtgtgattgttaagtctggctgatgactcctcatgataactcatgtgtgtgtaaaattgagtttttcatggttgttttca

SEQ ID NO: 12542 - DNA, 476 bp, Saccharomyces cerevisiae
attttctacgataaagtcacaatatttggtatataagcatctgtacaataataataaaaagcttgatctcattgaaagtgcaggtatatataattgtctcctaaaaactccttacatcgcataatatctgttgaagataccgttccgatgggaaaaaaaggcaagtttaactggaaatattcatatgtacttactattttataacgacattagtgaatcagaactatcataacagtcaaggagactacctttttttggttgcaaccataatattatagaaccatggtaaaaaagaaaacgaataatgacaaaggaaaagaagtaaaggaaaatgaaggaaagctcgatatagatagcgaatcctcacctcacgaaagagaaaatgacaaaaaaaaaacagaagatgatagtctacgtgcaacagaaagtgaagagacgaatacacataatgctaacccaaatgaaacagtacgagc

SEQ ID NO: 12543 - DNA, 403 bp, Saccharomyces cerevisiae
aaaattgattatttactcctttcaatatgtacatagttttgaggttttttcaaatttttttcctattttttttgttaattgaaagttactgatgataaattattcaaaggtggtgttaattaagaatgaaagtacatcttcctatactatgaaggagaggttcatataacacgcgcaattggcacgtcttaagtatcatcagtacaatatagtggtatgtcaggtaaatataacatgttcagtgtaacaactcatattttccacgtatatattggatctgtaactcaattgcgtcattgtctacatattgcttttaacagtttcattattctgttactgttgcaattatatataagcgtataagagatgtgcctaagtatacgatgagaacgcacataatgtt

SEQ ID NO: 12544 - DNA, 480 bp, Saccharomyces cerevisiae
taacgctcatcggttcccgatgctaattctaaaaaatatatacagtagtcataatagtaataataatataatcataatttataaattcagtaagaagcaaaatgtagtttaatatagtgtacactaatacggcgcgcggttaatatcttccataatatcgatttcattatcatactattgacaaatacttctattattaattaactatgtagtttcatttttttttttctctttttttgtcatttctttttttagcattcatgtacaattttgtttctcgcgccatcagttttagtggccgtcttgaacgacttgttgggcaacaaggtcaactattctcttagttgagggcaaggataaccacgctggtatataggcttctacttggtcaaattttcttgtctttatcaaactgaatgggtcagtaaatggacctgtttctggagtgataaatatactgctgctatgctcgtgaccctt

SEQ ID NO: 12545 - DNA, 428 bp, Saccharomyces cerevisiae
tcgtaccatcaactcttgaatattgtgaaattttcgccattgatttccgtctttgtaaataggtaatgcgtaactatttagttaaatttttgtatattttttattctatgacttcacttatccattatttccatcgtcaaaaaaaggaaataaatactgttgctcgaacgaacagcaagataaagtggaaacgaaaagtaagcagcttcctcaatatgccgtcaaacgtacgttcgggagtcttaactttgctccatacagcatgtggagcaggcgtacttgcaatgccgtttgcattcaagccatttgggttaatgcctggtctgataacgctaacattttgcggaatatgttccttatgtgggctgctattacagactcgaatagcgaagtacgtacctaaatctgagaacgcctcgtttgctaaa

SEQ ID NO: 12546 - DNA, 465 bp, Saccharomyces cerevisiae
ggattttacctaatatgtattattttggaattagcttgaaatgtgaaggtatcattttactgttgcatattggataattggtaaagttacgcaaagtattcaatatcatcttcttgcattactcgaccattgagaataatttactatatagtttgaatacgagattacacctcgacaaaagtagttctattatttgcacgtaacaattatcagaaaatgggtgaacttcgtattaattgttgggatttcgttgttgatattaggtatacaaaatatactagaagttctcctcaacagtcttggaattcacgaaagggagttgatagttctgataataaaatcactttgtcttcctttcttttatactttgtcattcattattctactacattatcaatttgttagaatgaaactctaaaacatcatctgtttagtagtatttgcgttactagtcaattatgatcg

SEQ ID NO: 12547 - DNA, 483 bp, Saccharomyces cerevisiae
tgatgaaacaaaacttactattctgcttttctgtacatatgtgtaaaccctatattgctatactcatctatattcttttgaaaatgtataaaagtgacgattggagatggtgcaattttctacgcagcatgaaaaatatctaaggaaggtaaggtacataccaagtaagtcttataatatgttgttgtacctcactttaccattcttaaagtctttaaaagaaattaccttacccaatttgcacagcaaaggtcactgacctatacgtgcccttcatcagattacatcacgtgaaatttcactgggaaagagcgcgagggctttccgatgactttctacattaataatcgcaaacaaagcaatcagcacagcaaagagtacaatttcgaaaattgcgacagagcaacgtaagtatatcgttgttgatagattccactccaacctgcaaatgctgcttcttccaagatgtcctgtaattgggcg

SEQ ID NO: 12548 - DNA, 473 bp, Saccharomyces cerevisiae
gcttgagagaaagttatgaggtagcaataatgaagtagcgaaaaggagagtgacgacactcaagctatgaaaaaaaacgcaaagatacaaaaacgatctcaatgatattgatgatagagatttatctgataaattagaagtggtgtatttacatgtttttgtatatgttttggaattgagcgtaatagaaaggacggcagtccttatggtttatgacaaatacgaaaaaaatactacacaatgctttatattatgttctcattattatatacgaatacgtacttctgctggtgcattgtctgcgctacttttttgaatttctatttttatttttaccattatggttggtctttttctttttgatgctatccttaaataatttatctaggtcatattcatcctctccatcgtcttggctccctgtaaattccttatccttagcatcccttttctcgtcttcattttgttcgcct

SEQ ID NO: 12549 - DNA, 463 bp, Saccharomyces cerevisiae
aaagaccgttaatgtggaggtacgctgtggtcttccatcaataggctttgcgctgttcttctctcctcttttgtaaatagtttacctacttgcgtatatgtatatatatatatatatagatatgcttatacggatatatacatacattctgtttgtttatactctttgtcctactctaacagccagctctttagtttaagaatatgatgaaaaactcagtttgggaaaaaaaaggaaaatgttaaagtataaacaatatcgaaataagttcatctaccacgcacacttcaccaagttagcaagatgaacttgaagcagttcacgtgcctatcatgcgctcaattactcgctattctgctctttatctttgcttttttccctagaaaaatcgtgctgacaggtatatcaaagcaagatccggatcaagaccgtgatctccagcgcgataggcccttccagaaat

SEQ ID NO: 12550 - DNA, 466 bp, Saccharomyces cerevisiae
ttgctagtgagcctagataacgaagaaatggtgcggctaagatattgaacagttgagtgggatactacagaattttgataattaagatagttctcatctgcgctttaattattctttttatgtgtataatatatgtttattgccttaatttaaatttaatatttgtattttcttttttttgtttaatttgattacttttgcttatgaaatagtatatatggttgttttacttttttttttatttatttgatctaagttttatgtatgcagattaaaagcaagttttaattaattggtatgttggttttgattatgattatgaggagtaccgctattgctattgtttaaattactactgttgtgttccagttcattcacgcctggatcagttttgaagtatacttcatccggcaaagtatctgttgaaattattgaatatttgatgagccaatttctcattggttgg

SEQ ID NO: 12551 - DNA, 475 bp, Saccharomyces cerevisiae
acgcacggcatcatcttatattaataattctatcatcacgcttatagtgtttacacattttttcccatttacttcgttctttaatatattaaataccataggattcataaacctttttaaatgtctaagagtacatttttagcctaactattcggctttgcattattttgtttcagatgtgttgttatcaaaaaatattaccacaataaaataagtgtttacatagagtttgtttcgaggtatctgtgttttaacattattaattctcttgttagttaatggccattcacacattcttttaatatcaatttcaggttaagcggggcaaaaaatctgttttccaaaaaagcttatgacttatttcccttaatggaactgcaaatacacctaaaaacataaagtttgtaaatgccaagaaaaatactatttatccaattaataaacaagttgtgaaaatcttaggtaaacacccacg

SEQ ID NO: 12552 - DNA, 500 bp, Saccharomyces cerevisiae
agggggctttgacgtataagtgtcggtattttttttttttttattgatttttttttcactcttattttttccctcatttattcatcatacatttaacgaactctatttcttttcaaaatccttatctacctatttttttttctttattttctttcctctgtcagttagtcagtagtgtgtaacttaaataaatcatatatcggtgtttcaatttctagcattctgtgtaaacatcagatgaagcattgcctttcttttcaatgaactctatgtagttttttcgatttgcttgcgtactatttttcacgcgatagttgaagaaacgatagaaggatggcgcaatatacaagttaaaagcaaatagatatctaatcaatagttaacatctagaataaagtgctggaacttagatttttttgtgcaatatgggactgatattaaggtggaaagagaaaaaacagttgtctagtaagcaaaatgctcaaaaatccaggaaaccg

SEQ ID NO: 12553 - DNA, 427 bp, Saccharomyces cerevisiae
tcctctaactaaaaattaaaaattccatttttttctattttctttgaagatatcgtaagacgttctaggcgctttatccagaaattgttcaactttattgttttgtatattagataaaaagttgagcctttaaaaactgcataatgtttcctctggctgctaatgtaccaaagctaatggaaaagaagattgtttggcctggaaaactttctagacgtggctttattaccagggttgtgtaagattatgtaagatggtcagtatgtagcacttacaatggacctttcttctattcccaaggtttccatgagaaaatttcggcttcaccggtgtacgtgggcagacgattcctaatatcactattcaaaataatacagcaagttttagaataaatactacccatgcaccagcgtgtagagttgccaag

SEQ ID NO: 12554 - DNA, 440 bp, Saccharomyces cerevisiae
ttttatattcttccagtttctttggctatagtacttatttaacttttatttatgttttcgttatattttcaacatttccggaaaataaaaaagcgactttttgaggatattatcctatcatctgttgagaaacctaagacagttagtttctatgataataccatctgaaacgtaaacagttttaaatttagcaataaaagctaggtaagaagccgtgaaatttcagtcaacatacagaaacggtatatgtggctccaatcagaaagttccaatactattaagatgctgacacaattaatgttggttttaaaatagccttgaagtaaaagaattcccttgcaatagtaagtgcagttaagggaaaatgtggtaacatattgtaaactaggaagttaaaaatattccaaataaatctgagtgatagtccttgcaacaacgcc

SEQ ID NO: 12555 - DNA, 445 bp, Saccharomyces cerevisiae
ctacacaagcacattgcatagaaggatttttcttctctctctcacgatctgtagaacaacatagtttctttatacgttaattaagtaaaggggaaaaaaaaaatattaagccttgaatttaggaggttacaaacgaaaaggacaagaaagacaaaggaaaccgacaaaccgtttactcgatatgggcttttatgaaggcgatgacaatgatgccaacaccaaggcatttaatgacaaatatatcaaagatcaaaagttcgcaacggcacccttctggaacctctttccaaagttaagggatattgatgaatacgataatccactcctaccactgcccttcaatttcaacttcagagatcttggagatagtgcacttgccatggcgtccggaatccctacggtgaagcagtttgacaagtgcgaagaacttaagggccagtctgca

SEQ ID NO: 12556 - DNA, 486 bp, Saccharomyces cerevisiae
tgactaatgaaggaatgatattatgtggtattactttttttttatcatcactagcttcggctaagcccttgcattttcaatattcaattaccaaataatatatatatatatatatatatatgtatgtatggtataccttgtgttactgatgtgttttttgttgacgtcatccttttgatttactcacatgcttagtaaatgaaggttgttgaggcctaaaaatcagctaagatttacacatcgatactaatcattgaacgcccctatgggaacacttaattgaataaatatctgcccaacttgctgaacatcaaaaacccaaaaaaatagaaatctataaaatacaacgccagtgacaactgcgagaaacattgtgagcaagtgaacgcactaagggcaccaattactagacctgggaaaaaaacggttaaagtgccatcaaagaacaaccacagaacaatgtttaataagctccatgcaccagct

SEQ ID NO: 12557 - DNA, 434 bp, Saccharomyces cerevisiae
gatttgacgcccttacgaatagaactttacgagtattagaatgttatgaataaatgaaattggtttcgacggtatagatgaataaaggtattttgaaaattataaaaaaaagttttaataatatagatttggtaaaataaataggcgtatatacacattgtatactgttgatattatcaagtttttattattaaagagctctttttattttttatttataggggaaaatgaccgatattcctagtcttcaagtcactattatttttttttttattcataagtacaattgaataatattattgatttttttattattgttcttattctttttttatcatttctatataaaatattatatgatttagtttatcgtaaaaaaattaaaaaatacagaggaaagcaaaagtaaaacttttcggatattttacagggcg

SEQ ID NO: 12558 - DNA, 478 bp, Saccharomyces cerevisiae
tgaaatgtcaaaggcttcgctattccaatggttatgtatttatttatttatttagcaatgtattttactttacatcgcttcggctgccttcatttacagtgtgtctataaaacgtataacacttattctttcacttcctatgcaaaatgcttaataattcattagaccctgaagttccattcgaacggacgtcgaagttgggctcatttattgcactagacctgttttgcagcatatttagtagtttatttgaggaattttcgttgttatcagatgccaaggaatatccgtcagttgcatatacattattattgaaggcgctgctgtttttattaccatgcaatatattcagtaattcatgagaactgtccttatttgaaatattctcatacccatcattaagaggcttgggctttaagtagtttaataactctgttgaattcttatctaattcttgattatttgtagcgtcgttgcg

SEQ ID NO: 12559 - DNA, 427 bp, Saccharomyces cerevisiae
gttctctttatcatctatatattactcttatacactatacgactctactctatgacgtatagcattgatatatattaaggcacgacaccgatttttcttatcggagcgatataaaaagctgaagaaaggaggatagatgaaacagcatggcgcatagaaagtgttcaagctcactagtaaaggcgggaaatagaacattgagaacgtattttgataatgtcccaaggtagaaaagctgcagaaagattggctaagaagactgtcctcattacaggtgcatctgctggtattggtaaggcgaccgcattagagtacttggaggcatccaatggtgatatgaaactgatcttggctgctagaagattagaaaagctcgaggaattgaagaagaccattgatcaagagtttccaaacgcaaaagttcatg

SEQ ID NO: 12560 - DNA, 482 bp, Saccharomyces cerevisiae
tagactccactttgcttctatagtcctatctattgttctttttattcctagcataaccttattgtattgttctttttctttttcctttttcttttttttttttttttttttttttttttcacatctttttccacggccgctcaaaggggtctcacactggattaaaagctgaaaacaagaaatggctctttcgataaggttgcaacattttgattactacgttgattagaataaaaagtaccaaacacatttctcaaagcatatagatatctaagattataacgcaggagtcgttctttcattcttagagttaaaaagcaaatagagaagaaaagaaacaatggctggtgcaattgaaaacgctcgtaaggaaataaaaagaatctcattagaagaccatgctgaatctgaatatggtgccatctattctgtctctggtccggtcgtcattgctgaaaatatgattggttgtgccatgtacg

SEQ ID NO: 12561 - DNA, 451 bp, Saccharomyces cerevisiae
tcagaagactaaattacggacttgaattcgtgtacataaattcgtatataatatttaatgtgtaaagctagtgacgattttatgtaaccagcagctacacttcatggcattcaaactatagaccttttctggcattacgcctcaagcttcttttttcccgagaattatcttgtagttgcctaacgggttctgagaagatctctatatcatcacaattcctatcacaatctttagcgccattgtgtaattctcttttcccaaaagatttatctgtcctatcttcaccttttcttgtcaatgtattctcctcactcagatattctgaatcatagtcatcgctaacgtcaatgtcaacttcattttcactttcctcggaaacgtcaccatttacatcactcgagtaatgcaccgtggttcttctctgagagcttgttcgcaaatgacgtccttc

SEQ ID NO: 12562 - DNA, 494 bp, Saccharomyces cerevisiae
atctaaggttatacgaggtgcaatattcatgtatattagtttactttttttgtcggaagctctttccctcatacactattgttgtgtccgtgtcgtgtcacttcaggcgtcggtaaatatgtatctgcgcatcgcacacaaagataaagcctttttaaatataaacaacaccttctagatatatcttatcaaaggatacaaccacgtttctcaacaagaaggacctaatagaggaaaattattatactgtagctatcaatattttataaacaaaaagacagatatattctcgcgtattgaagtcgggaatccaacgaaggtaaaataataataaaatacgaagcatttaatccggtcaaatgtacaagaactattattcaaacacagaagtttataaaaagcataaagactctggaagtttgaggaagaaagctttgagatcgagaagatcatcttttttttcatttttcaatgactcgtctagttcgaatgga

SEQ ID NO: 12563 - DNA, 471 bp, Saccharomyces cerevisiae
ggccgataaggtgtactggcgtatatatatctaattatgtatctctggtgtagcccatttttagcatgtaaatataaagagaaaccatatctaatctaaccaaatccaaacaaaattcaatagttactatcgcttttttctttctgtatcgcaaataagtgaaaattaaaaaagaaagattaaattggaagttggatatgggctggaacagcagcagtaatcggtatcgggttcgccactaatgacgtcctacgattgcactcaacagaccttgacgctcacgccgtagcgggcgacaagtcaaacggaacaaccgttgccgttcccatcggagtccgacctaggccgaactccgtgaatttctgataacaacggtcggtaaagactggttccccagtatatttcttctctcaggagcaggggccaatgccaaaagcgacattaacccggaggacaaggctccactgtgtt

SEQ ID NO: 12564 - DNA, 418 bp, Saccharomyces cerevisiae
ctctgaattttcccacagcgcccattcgggactttcaaatatgtgggtaatttaaataattttttatagatataatagagtggatggaataaaaccctttcttttcaaataatgtgttaagcactttgagaaatggttgaacctttcactttgatcgatttgcatttatataataaacctcgggaagagctttaccgaaaaaggaaaccgtttgctgtgacaagtaaatatagagtaatctattataaagggttaaagcaatctcgattcaattgaccgcgagcaaattaacaacaatccagttataaaacattaatttgctgatcacatttgaatcaaaaaaagtaaagagaaatacttataaccgtcaatggctgtcataaaaaagggagcacgcagaaaggacgttaaggagccc

SEQ ID NO: 12565 - DNA, 474 bp, Saccharomyces cerevisiae
ttttaaaactgtagcaatctaccaatcgtgttaatcaaaatagtctgttttctcttcgagaaaataaggaatatatcatgtaaatatgtttaactctttattcttctttcgtcctgccttttatatattttgccacatcgcttcttgcaagtagatgtataaaaatgattgatttccttattattttctatagtatcttcaacttcattatggcattcgttttcgtgttataagtatttcagacgggctaatctatcacttcataaatctacttttccaacttacaaaagcggttgcttttcttcgaaatataaagcccaccaaccataagaataaagaacaagagcaggagcgaaacgaaagagaagataaagattgtacctttttgctcctgatttttttttgattacgctacggttagttgagagaatgtccactgctgtgactttttttggccagcatgtcttgaacaga

SEQ ID NO: 12566 - DNA, 475 bp, Saccharomyces cerevisiae
gtttttctttcatggtacccttatgccttcccttttcttgatgtatattatatacttataaaaaccgtagtaaattttattaaaacaatgattacaggaatccgtatttaggttatgcatcgttgtcagtaagaaatcagatgaatgcgatctgaaactttgcttatactaatattattctatcatacctcattttcttgcttcgattaatgcaggacgccggttccgggttaggatcaccgagaaacagaaagcaagcaaggcttcagttacaattcgaagaagtactaagggggttgtcgtggaaaaatcttgaatcagaaagcggctgactggagcattactaggttcattactcactggttctactcatgaaaccttacttatttgacctaaagctaaaagacacagagaagctggattggaaaaaaggcctctcctcatatctcaagaaatcatacggctcctcacaatg

SEQ ID NO: 12567 - DNA, 470 bp, Saccharomyces cerevisiae
gtatgtagaatagatcaaaatggcaataaattaattacaataataaaatctctcgaaacaatatatagttacgatgacacactagaaatcgagagagatatataataagtagaaagaatttttttttttttttgatcagtgcatcttaacccttcttttgtctccatttttttcagttgggaattaggataatatccctacagatagttgaaattttcttgaacaatcttctccattctaaaggatcaccagtttttctttcaaatccgacacttttcaactcttcttcaatctttatgatggaaatgctaccgcataattgataacccccattacttttggttttaatatttataataagtgggaaaacgttatcataacccaataattcgcacaatctttcaaaattcgcaaaaaggtcgggttttactctaatttgtgataaattcaaggctttctccaaaatcggt

SEQ ID NO: 12568 - DNA, 450 bp, Saccharomyces cerevisiae
ggtcaaggccttttctggtctttttcactcctttgacaaatgacagagactgtccatacattcatcacatgtaactatattatatatgaaactcattttaatgcgcacagataaaaagcaaagtaagtaatgaatatttgttatgtaaaaatgacctcatacatgctagtatttacacgaatttaattgcttaaatttcaatcatccttaccctttggtttaccctctggaggcagaaacttttgcatcctccttattgcccaattttcgccaatgactttaacatctgggtccgatttaccttccgtggtgttgaaccgcttccaccatgagggggatttgaacctagggtcttcgcgtggtaatttgcgaacttcatttctaatttcagcaacatgggctctcagttcagcggctaatctgcttcttaaatcttgcgcctctttacca

SEQ ID NO: 12569 - DNA, 404 bp, Saccharomyces cerevisiae
gtcatccgcatcgcatatacccattcttatctcgcacatttaaatatatactatatataatactgttaaatgccaaataaaaaggattttcattacccgaatcgatacttttggtagcataaacaaataacattgaaacaataacaaagtgtaatgtggccgcacgaatctttgtctgtaacagccttaaagatttcagtagcactgccatggataatgatggacccagatctatgaccattggggatgacttccaagagaacttttgtgaacgtttagaaagaattcacaatacattacattcaataaacgattgcaactcattgaatgagagtaccacaagtatatcagagacattgttagttcaattttatgatgatttggagaacgttgcctcggtaatt

SEQ ID NO: 12570 - DNA, 400 bp, Saccharomyces cerevisiae
tgtttctcgttcacgtatttatctctacaagaatttgtagctgcctgaactcggctcctctctctctccaaaaataaagtgtgtagtaatttgcagtttttttatatattcctacgagttttcaaacgttcaaaagacagtatgttcaaaaattgtgcatacacacacgtatgcacatatatacataataatacactgtaataagcacatttgtaggtgctcttgcacttggtttattactgtcactgacttttctcacccggccgagagtcgtgcgaaaattcgcatgttaaagtgagaaaatagagaaaacaacacagctgaaaaaagtattggtaacagttcaatacgtgatcaaatatacagcacgtcgcgcagaaccagacgaagcggagaatat

SEQ ID NO: 12571 - DNA, 453 bp, Saccharomyces cerevisiae
taatatagcatttagagataggattttaacataaaaaatctactacacgatcatacttctgcaattgttaaattccgggttctttaatactttaatgttggcgcacaatattttatatctgttgtaaaatccgcttacaatataagtgaaattgttccattttgtttcataggaattcttactcaaaaaggatgttttttaatattcatataatatttacaaatagctctctgaaaaaaaggatttttttttacacctaataaaactgtcattcatgttaagtaactaaagtgcttcacaactgtacttaatgaactgaatcaatttccttggcaatgcaaattcttccagacaagaggcggccgcggcggtatctctagaaaatttggcagccgcacaaaagggtcctactgatgacgggctggcaaacggcgctctccaaggcacaaactt

SEQ ID NO: 12572 - DNA, 458 bp, Saccharomyces cerevisiae
tatggtgggtgaaaattttgtaattttttgcatttgtgtcgatatatatatatatatacatagacacagagatagagatataattatgcaagtccctgttaatgctagtctgagatgagtacaggaattcttcatttagattgtctcggctatgtcacttttctatcgtttcacctgcacatggctttgtcttgaatactgaagccgttattatagttctatcttcatgtttttagaggttttttttaaatgagtttattaaaattaaattttgaatgttatttttgaataaaaatataaaaaaaataatattaataatttttcattaactgctcatgatatcagtgcattagaaaatcttttggttccacttttcctataaaaataattcaagttttatcattatatcatttttaaatatttgattatcatcgcccgctggtcaccgcatttttaaa

SEQ ID NO: 12573 - DNA, 421 bp, Saccharomyces cerevisiae
taccagaaagtctcagtagaatacacgtcacagaaagctagtaaaaaaaaataatcaagcatataaaagtattaatatattaaaaaatcttcatgtaaaccaattcttatttacctcttttcccagcaagcgggcaacttctttaagaaaagtaatcttttttgtacgtcgaattatcaaagcttggttactatatttaacattattgtttagtaacagtatcatcttaaaagaaaattttttaaaattccaatataggagacaatggtaataattacatacaaatagctatttatgtaagcaaaactgatatttttatatacaaatcgtttcaaatatctcttagacttcagcgaatttattgctacctctaatgaatccgattgcttcttctctattgacctcaataaccgtggaaatc

SEQ ID NO: 12574 - DNA, 430 bp, Saccharomyces cerevisiae
ccgccatctctactcactccataatattacatatagatataggacaagcccgcattttcatactgaaaggtaaacttctattattatagtggtatccaacgttcaccgcttccagcatagcagaaattacgtgtttttgcatatgttatgctgatcattgtatgcttactaccatttttctttgcttcgccttgccttctttgacgtttttttgaagcaaaaaaaaagtcaagacagatgtgcttacaaaaccatgtaaggctcattttcaaagaagctactaatagaaagagaacaaagcgtttacgagtctggaaaatcaatggaggccaagatagatgagctgatcaataatgatcctgtttggtccagccaaaatgaaagcttgatttcaaaaccttataatcacatccttttgaaacctggcaag

SEQ ID NO: 12575 - DNA, 498 bp, Saccharomyces cerevisiae
gactttatagacacacaaaatatcccttcccactcatttaacaatcaagataatagtaataatcacaaatttagaaagtaattatgcatatatacattatatacatatagtttatgtatggtacggaactgattacaacatctctctaacaacggcctcgtgagggaaatcgtcatctgtaggatttttgataatgttcgtattctggaactcttggtgtttagtatatgctaccgcataactgattgacgatatcgttagcccgacagctaccacaattagactcgtagccatcactgcaatggaaatatactggattatcgccattgctagatagaaaagacatctccatccatttgtttcaaatctcttgatgaattcaatgaaattatcgctaaggggacagattttcaacaaaaatggtatttcaatgaataggatcactaacccttggattatactaatgataccaaaagctatcaccccactaacgtggaa

SEQ ID NO: 12576 - DNA, 442 bp, Saccharomyces cerevisiae
tattaagtatataaagagccacgattatcgttagccaatcatttttgccgtgtcgagtagaattgtataaatattagcattgtatgaaatttgaatgaattaccgcaaaagtattatacgtaagcaatagaaacaaatatcagattcaagttcaccaaatcaatattaacagcttactatattgtctttttttatggaagaacattaccgtgaaaacccggtaggagaattttgttcggtcggacttccccattaggcgtatattaagggcctagaaaataagacaaaacggcttcttatctaagctgctgtgagtgacagcatgtattaactgaatcaaacggagccctttgatgaacatggcaatccaaacaattaaatacattttttggctactgccgatattagggcttacacaagcacttctacaaaacccagggga

SEQ ID NO: 12577 - DNA, 465 bp, Saccharomyces cerevisiae
taccaaaacaccccataggaaatatataaataaacatacctgtaaatactaaaaagtagaacacagttcgtcacatatattgctattattgtattaattatgtttatatttacccgggaatctcttcacaattttcagtacctctcgcttttttccaatttttcaatttttttttttcgagtttagtgaaaatgagtattctacaacaaggcatcaccagctatagataatcagcgtaagtgcataagatcttattttcaccacgtaagaaatacgttgtcaaagaagcgtcgataatcaaattgctatgagcgaatcggaagccaaatctaggtcggctacaccgccaagtaaagctaaacaagctactccaacaactacagctgcagctaatggagaaaagaaattaacaaacaaggagctaaaagaactaaagaaacaagaaaaagctgcaaagagagctgc

SEQ ID NO: 12578 - DNA, 405 bp, Saccharomyces cerevisiae
atcgatcatgatagttaagggtgacaaagataacattcacaagagtaataataatggtaatgatgataataataataatgatagtaataacaataataataatggtggtaatggcaatgaaatcgctattattacctattttccttaatggaagagttaaagtaaactaaaaaaactacaaaaatatatgaagaaaaaaaaaaaaagaggtaatagactctactactacaattgatcttcaaattatgaccttcctagtgtttatattctatttccaatacataatataatctatataatcattgtgtagacttccgttttaatatcgttttaattatcccctttatctctagttttatcataaaatatagaaacactaaataatattcttcaacgtcctggtgc

SEQ ID NO: 12579 - DNA, 466 bp, Saccharomyces cerevisiae
aataacgattaaggaatgataatcaaaagaaaaaaacaatctacctacatatatatgcactcaacatacataaatacacacgcattattgtttctataaacttccaacagacaatattcccatacaaacatcaactaactgatttcctcttcatacgcgttcgcttcacgtgatgttccttttccattgaaaggagagctcatcacaagagttacaatgggagtggcggcgcaccgtctgctgacaagaataagtgtaagaccagctaccggaagaaaaaagaaaataaaatggatactctgtgtctccgaatgcccctatttgttgtatccattgattgttatcctgtcttcttctttctttagtttaaatctttagcgattcagatccaattgaacaaaaaaaaggctagatcaaaaataaggggtaaaacatcatcttgcggggctaacccagatcaaaagcg

SEQ ID NO: 12580 - DNA, 448 bp, Saccharomyces cerevisiae
aacagcggataaaataaaggttttaatattgcattatgtataatgagtatgtatttttatgctattcttgtaaaagtttggcttattatttactttcatggaacacttagtaaaaataacttagaaaggtcgtcttttctttattctttagcatttcaataccgaactaaatatccgtttttatagtttagttggttttgtttaatttctagaatcctgttcggcgcttttgttaaaagtaaaaaatgaaaattcaaacgaaatgaacctaatcacgttagaatttaaatcttggaatatgttaaatataaaacaagaagagcaagcaatactatttctgactaattctctatacacataagagcaaaacaaaatgttcggtagcaaacgtctgaaaaatgttaaggaagcatttaagtccctaaaaggccaaaattcagagacaccc

SEQ ID NO: 12581 - DNA, 481 bp, Saccharomyces cerevisiae
ggaagatggtgataccaatgcatatataatgttgtcttgaacccactaaagaagtgacgcatatattacttttttgtatttagtaacacaatttttctatttttatatttccttgtatagttagtaattttaatttttttccttctttatctcagctcttcgaccatttggtcaagaagttagtttttttctcttattttatttgacaatatactaattttattatatggtattgtaaataacatttgaggaataaaaagacagtcactctataagctttatcagcctgacatttttttattattacaaatatatcgttgaaagaaagaagcctctatacatctcgccctctttctatcattaaatcaatggaggtttactggcaacgttatatttctacaattttagaccatcaaacctgaggaatatgtatatctactttctccctttcctcttctttaactggttcaccaccctgaaa

SEQ ID NO: 12582 - DNA, 458 bp, Saccharomyces cerevisiae
atatattatgttttatcatcatgcacgatcgacgttatgtctgacatataccaaacccttttcgaagatttccctttactcatgttgaaatagtttttatatatgcacacatatacatatatataaaatctgtaaatataataaaatgtgtacattgtaaaagaatccaagcacaactattattagcattatgagtatttttttcaagccgccgattgatattgagatccttttcgataatgaggaatctcgcaaacacgtagacattgcaacaagatcaagtaattccagttacaaatcaatgaaggaaagcttgcccgtctatgaagatggcgaatcccttggtggaattgttactttgagagttcgggatagtaaaaaggtagaccacttgggcataaaagtgtccgttattggatccattgatatgttaaaatctcatgggagcggtaattcat

SEQ ID NO: 12583 - DNA, 457 bp, Saccharomyces cerevisiae
tcttatcattcaagttgcccttctgtttctcttttactttttaccttcttctttatttatatttttttttttggaaacctagcgaatattcttaccaggtctgagcttttacacacgtcatgttaacaaagttccacaagaaagttctttgcaggaaggttaaggcgaacgctttgctctatctataatgaagagccaaaaaatacataaccaaaaagatcgagaaaaggtcgagatatatttttatttaaaaattcttattaatattagtactattcatgtcataactgattactatttctatctctgtcagagatggctagctagaggttgttgcgaagttacttccaaaagattctagactgtgcttacagcatccatacacccacccatacatactgatttctttttttaaagacgtcgatttttcgaaaaaagtaaattctcggcacaggga

SEQ ID NO: 12584 - DNA, 489 bp, Saccharomyces cerevisiae
caatgataaaatagcatatcgttaaaaacgacaaacgcgtacaaagagtttctggagtttacttttttttcatttttcgtttttactctttcgtctccctaatgattttggccaaccgttggttgttacgtgttatatgtttgttttaggagctggggcctacctttatagttagttgtataactcagttgatctcataagtgaaaagcaaaaaaaggatgcaggtgttacagttatggttgacaactttgatctctttggtggtggcagtgcagggattacatttcgacattgcagcatctacagatccagaacaggtttgtattcgtgattttgtcactgaaggtcaattggttgtcgcggatattcactcagatggttctgttggtgatggacagaaactaaacctcttcgtgcgtgattcagttggaaacgagtatcgtagaaagagggactttgcaggcgacgttcgtgttgcgtttactgctc

SEQ ID NO: 12585 - DNA, 412 bp, Saccharomyces cerevisiae
taagcattttgtactttaaggcagaaattgcatcaaatatatatgtataaataaaaattttatgtttgcgtgattgttggtgataagaagtaaaaaagtacacctaaaataggcagcagttggccagcacgttcagaaccccgtatgatataccttctttcgaataattatcgattatcaaatgtatagatagcagtattataatatatactatattctatacatatatgaagggggttggtgcgtgtatatgagaaaaaatttttttattgtaattattttttttttttaaacttttgactcattcagagcctctagtgttcaaaatcaaagctacaatcataccatataaccctaaaacttcagagaaaattagaatcaaaacgataccgacaaaaagccttggttggtg

SEQ ID NO: 12586 - DNA, 460 bp, Saccharomyces cerevisiae
tttttctgtcgctacttcattcacacaaatcatctcaatatcccttgtaaataaaaggcagagtacagttttcaagtttatatttcttcagcgcagtctttatatttatatctttaaatatacttagaactgaacagaacccatggctttttgcaaagctttcaagtagctcagtcgtttcttatattgattattcatatacaaatatctcgaattccaattattcatgactgcttcaaaatagttatcgtcaaagctccaaatttcgaccagcttatcctttatttcgttatgtttatctatccatataccaagctgtctggtgaagttcatcaattcctttagcctttcttttagttcgaccatctctacatctttcgcatcttcgtatagtagctctagccccaatagtggcttccattcacttacaacaatatttttaagattgagggaagcgtgc

SEQ ID NO: 12587 - DNA, 436 bp, Saccharomyces cerevisiae
cgtgaggagtgaactatacatagcgaaaaaattacgtaacggtttatagaaattctagtatgagaacagtaatatatgagaaaaagttgttttcactttgtgttcgaaaaaataagtatttgaaaacgaaaaaatagtttgtatgtttgtatataagttgttattatcaaaaattagagggaaaaagtaactaaatatatattaaaaaaaaaaaaaaaataaatgtatgttggaatgaaatagcgtagtaaggataaaggtgtaatagatatatattataagaaataatccggtgtcttcctggtgacggttggttcaccgggtctcacagatggatcgtattgtaagaattgcctattatggttttcatccacctccataatagcggcctggttaccacatctataacaataatttggagcactgaaaatggtga

SEQ ID NO: 12588 - DNA, 480 bp, Saccharomyces cerevisiae
cagcattaaaataatgtatggctttaatcagctttgcttgatgcttagaaatcatttgatcagtgaaatacaacggatattgactgtcgatcactgatgtactaccataatacattagtctatagggtaaaggagccttgaaaatttggatggctgtcaaatggagaaataaaaggtaataacccaactggctgtttacatattctctgtgctttgtggattcgccggcttgtctaagtaatatctctatattcaaaggttttagcttgagcctattaataacatcatttacgctagaaggtttttcaaagtaaatatagcctctatctgaattaaataaatccgttgaatggaagatccctatcagctgatacagtttcttaaacctcagttggtccaacctatcttttatttgcacaaatctagaatatatgcttccatagtcatcatttatagactcgtcctgcgacatcagagaca

SEQ ID NO: 12589 - DNA, 444 bp, Saccharomyces cerevisiae
caattgttattgtgtccttccaaaaaagatgagaattttaggtgataaatcgcctatccattgctgctcatttaatggaaaggttattgcattcagggaaaaaagtaacgggagaaaaaagagaaaagacctcttttttgttttctacatacgagcatattaattatttagcaggaagatatacttgatctaaacagtatatatatatatatatatatatataggttgggaattaatcttgaaatttttttagtcttacgttatcttcagcagtgacacgctaaatgcccgtatcttactttacattttgctgtcaggttttttgatttctttttcatattttatgcagtagcgaaaagagacaagactatgaaaaaattttctagcgttagtaaagtattaatactgcaattagttaggatagcagaacgaacaaatggcaaa

SEQ ID NO: 12590 - DNA, 431 bp, Saccharomyces cerevisiae
gcaactgagcaaaaagcatacagaagctatagcgttattgaaagataatattgttgcgattattagttgaaaataaacaaaacaagatatatattcatatatatatatatataatttacacatgtatattaaaaaatgccgaataaaaagtgctacaacaactaatttctgagcttgagaataaaccattcacattttatttcttttggtgcttctttatcatttataaatcggtggtcttgactttttattcctttctagtctaacaatcatccattctatagcgtctttaacaccttctccagtcaatgcgcttattggtaaaaccctactatctctagcgcttatatgttccgcaatcttattaaatacttcttttatatcttgtacttccattctatcttgtctatcttgtttattggccagcatca

SEQ ID NO: 12591 - DNA, 411 bp, Saccharomyces cerevisiae
tgcgcagtacgctctaagttttctttggcctctcgactacttttctctaatattcccactccatacaaccttttgtaaatagcaatgaccatacatatatatatatatatatatatatatgtattctcagtatacgcaatcaatgctttggtatatttggtgtatttggcatacttactcgtataaagcgatctgaattttcagacgcttgtattgacaagaaatactataagcataggggctaactagcgttcaaaggaactagtgtagatacaagactagcaatcttcttgcctcaaaacggtaatccgcaatgctacacttacaaccacaaaaccttctcatccaaaagacactgaatgaagcgatagaggcacttcgcaagggttcgccgttgaccatggacagaat

SEQ ID NO: 12592 - DNA, 450 bp, Saccharomyces cerevisiae
cttgtcacttctcatccaccctgagaaaagggttttgtaagatagaataggagatatagcaaacttgggaaaccatttatatcattaattccagcaatatagttccgtttgtccgtattcaatgatatttacatgattgcttttacgaagattcaacgaccaaaatcacggagcgggtaatagcctggagtttccggatgaaaaatttaacggcccagaaaaagaacaatagctgcaaaaaagaaagctatacgagatcgagatagtgagagaggttagcataacgagaaaatttttgtcgcattcgtggccaaaaagcgatatttgagaagcattgttattatatcaataaataacaaatatatatattgtcctttttccaataactatataaagaacaagaagcttttgaaactttctcaaaaattttcgttcaggcttcctcgttaa

SEQ ID NO: 12593 - DNA, 413 bp, Saccharomyces cerevisiae
atataaaatgaaaataatatccaaagaaaaaaaaaatcgcatttagccacacccctccctctatttttttattttgttaccatagttttatcaacgccttcttacacctgtatagagctaaataactatatatatgtatgcgcaaataattcctagaaaatcgtcgatttttataaattctaaccgccgattaacaatatcatacgcgatctaaatttataataggcgtgaagcaaaggaagttgataaaaaaaaagtaaagaactcctcatagggggctcgaacccctgacatttcggtatccttgcttaagcaaatgcgcttaaaagccgaacgctctaccaactgagctaacaaggatgagttcttcgaattttccagtctaagatagacaacccatcaaactgcatggt

SEQ ID NO: 12594 - DNA, 454 bp, Saccharomyces cerevisiae
tacgattgacttagattcgatattataatatagcatgaatacgcatatgtaagagttcataaataccactttttttatcctgaagaataacatggcttaaaaatcaaaaaaattatggataacaacttgattatttgcggccatttatgcagtcgtctaaactaaactactctagtatatagtttcctagtttatccatttttagattttcaacaccactggaaagcgcctctataatacgttcgttctcctcttcttgtgcatcttcactgtcatcttcagaactttcattatcaagttcggagtcatagtattcatcctcctctgaataatcgccctccccattttcttcttcggcctcgtcattagacatatcgtcatctgaattataaacagcatttctcatgctttcaacggcagtttccaggcccctatctcctggatgctttttgct

SEQ ID NO: 12595 - DNA, 479 bp, Saccharomyces cerevisiae
atgccaatgtaattaacactctaaaaaacatgtgctgcatacattttattattactctttttgcagtagttatttgcatcaaaggtaatttctttcaatcataaataagttaatactgtattgataaaaccttattcttttcttttgtatactctgtatcttaaagtaattctaggtctaaagaaaaatgaaagaagtaatgaaaactccgagaaacaaatcatatcattggtcgtcatccgggttggatgtcatgcagctgcattccatttcttcggcaaaatgtacgtaatattcgattagaaccctgttttgcaactgattatgctactatgtatttatatatgcatacatatgatgatattatatttgaaaaatgatgctgatttttttgaaaaaaagatctatcctcctttattcccttcttgttttactgtcctttgcaaacgttcctcaagagctcgacatttcccgtctaa

SEQ ID NO: 12596 - DNA, 436 bp, Saccharomyces cerevisiae
aaattgtactgagaatttatagggaaataaaagatatttttgcaacgtactttacatttcaataattaatgcgacatgataggatatactgtttgctatttctttccgtaacgatatacgattttttcttttctttggagttccaaatgaagaatatatcttgttgggaaaagctatagtattaggtttacagaatatggtagaggtttctccccgacgatataggaatctacaagagagagcatgattctacacgataatactgcaatttcttctttgcgttgaagtgtcaccattgcctatccttttacattatcaatgtcaatgttccctcttctaacaaactgaatgacttttctacacgattcatattatcttcttgcgcagtaaattatgttaacgtaatagtagggtctcttgtgcttcattattttgt

SEQ ID NO: 12597 - DNA, 431 bp, Saccharomyces cerevisiae
ggacagccatcatgaaattaaacaatgcctgaaaacatagatgattctagcaagttggtcaaataagtcagtgaataatactgtttccaaaacgattgaaaagaatttttgagtgcatgacacttttgttcgtttttgtttcgtttatccaaagagaaaaaggaagcaaatgacaatgctttgaattttcattgttgaatgttttgacttactttattaaaggacgtttttgcgcttccacagaactaatgttactgttgttattctatgtaaatatgggatgggtgtaggtatgtatatttatataatagcatccattgataattactgctcacagtatttccaattcgaagctattgataacctggagaccatattttcatggttgagtcccatgaacctgtacatacagctaacccatctggactcga

SEQ ID NO: 12598 - DNA, 497 bp, Saccharomyces cerevisiae
ggtagccattttcatttttatgcatttctatgatgtctaaacattagatgcattcgtgaactttttcttgcagacgagatagatgtaattaagatatcctatctgccggatattacatatataaaaaaagaaagcttgcatgcacagtttccttactattcatgctcacacaattctaccgaattagcactgcagtgtttagaaccgtgctcaaaaagagctaacagagcttgtgaagaagcctggatgaaaatatactacgtttatataggttgatttaattatacaatgatatcatttacgccttgcttaatgatatcctctagtagatcgctttctagatcgtcttctagtttttcctcattctctttcaaacggcgatgggtgaagttgcttatctgcaactcctctaattttaaaaccttcttcatggcgtatgcatcttcaccatcctgatagtagcttttctcgatactcaacacctcaaacgccaatgt

SEQ ID NO: 12599 - DNA, 432 bp, Saccharomyces cerevisiae
catgtgattaatatcagaaggtaaatggcaagacgaaatttgcttgtttataatacaaaaaaacatacataagatataatatatatttcaatagaaaagaaaaagtatagaaaagtgaataaacaaaagaaacatgagaaaaatagctcgtcttctcaactgggtatctattgacctcttaattctggttgaatgttttcatcagaaaggtcttcttcatcatcggctttccctattagtccagcaacatcttcttcatcgtgatgaggttggctatgatggttattatgatgagttgtgttcttattatactgcgattctacatccacgtccaccattacatcgtctacgtcatcatcattattctggtgtagattctctacctctttcaaatgcgatgacagtaaccttaactgttccgccacttcatgt

SEQ ID NO: 12600 - DNA, 459 bp, Saccharomyces cerevisiae
ttttccaaacactttccattactaattgtgatgtaatgtataatacaaatgtcaacttacgtgatagaaaaatagatcaatataaatatatattgttgtttaaatttacttattttcgtcatatatcctaatataccatccgaaggacattactatactgatttacatgaacgcttgacataatttgaaatttagtttctttcttaaatttttcaaaagtgttgccatgctactaggtaagcttttatctgcttcaataatggtttcatataagtttgaacttttttcatcagcgtcatcccatttagtttctataacttcaatgactgtcgccactgaatcttcatccattagcttcttatcatctaaaaggaaaattgggtacaggaatttcgccacaagcaaaaccaagtaatgttttggtaaataagggaattcaatcagcaaaagcaataggcg

SEQ ID NO: 12601 - DNA, 409 bp, Saccharomyces cerevisiae
agatagaggttcctgacttgtcggacaataatacatagaaaactggtcttctgttataatcagtcattggccaatcaaaaatgacagtaacagaacatcacgctacaatcttaatcttaatttataaaaaagctaaaatctttacaggaggaagacaatgagatgtgaagaatgaccacttctccttttcttttccatttcttttcttccacactcctagtattcccggtagtattcttttcgcaacctaaaatttcacgtagcagagaaaatcggagtcttgaaagtgttaaccataaaatttcattgataaaatgatcttcgaggctttctgctatccaaatccacgtttctttttatttatttattaaaaaccataaagtaaaaactttgttaaggcttggaagcg

SEQ ID NO: 12602 - DNA, 473 bp, Saccharomyces cerevisiae
ttttagacaatatttttttttttttttttattatgtatatagttaacatgtataaagtaatagcagattctctctaaaaatataacataacatttcatttcaattcgtactaaataattttttatataacagatacataagatatttatatagaggaaaacgaaaacaaactaaaaataagctgttaagaacagatatgttttatgccaccagagcacacaaagctgcgccaacaccggacccatctttggctagacgcaaatgtatcttacgttcaccctcagtgccaattggacttaatgccaaagcatgtctcagcatggatctgaatccaggatagtattcgatgacataaccgtcaaaaccaatttctacctcaccgtgatatcttttgttcaaagcgtttgtcttgattaggatggcggcaatcggaacggctgctagatatgcagaccttctcgtaatggaacgga

SEQ ID NO: 12603 - DNA, 403 bp, Saccharomyces cerevisiae
taaacaaatgttgaaaacttcttcgaacgtaaattaaatggatgtaagaaaactgtattacataagtcatgaagtaggcatgcaagtatatacctatagatgcatataaatcagtggagaaggccactatccttcagagatcaaaaaacctttttttatcttgaaaacgccctcattccttttggacgttttcaaacttttgttcatgcgattgcaaatttgagcctcttctatctttcttgaacactgggggtatttcaccattatcaattaagtcatcaatctcatcgcctggcttaccccaattacccttgccggaaccttgcttcttgatgtgatttggagattcaccgtagttaccagtgtgcgaaaagtactttggatcagcctttccttcacgttc

SEQ ID NO: 12604 - DNA, 455 bp, Saccharomyces cerevisiae
aagcatatataccaaaaacaggagtgttttatattcttcggtaagtcttttttacagtaactggagtgcgcgattcagtttatctgtggttaacgatccagcacctcttcgatctttggcatccacaaattatttttctaaatatcctacatatccgagtatagagttagaacctgtgtaaattattcagcagtatttccgtatttttcacgccattagaaacattcgacacaagcagttttatgaaaacatttatgttactaatatatgtgccaacaagcgcatccaaatggggcgcaacattattatttaatcgtaaacctacaccatattttcatcagtaaaaaaaggctttttcatgccccaactttgtcacaaagcaatcatatcagagaacaataaaaaagaacaatcctgcgaaatacgattaccaagatcctgaaccagcgttcatt

SEQ ID NO: 12605 - DNA, 466 bp, Saccharomyces cerevisiae
agcatcaacacataaatccttgcttagctcaattaaatatactagtaaataagtatataaacaataattttgcattttattttactggaaactcttctcaaaaccaaattgcgcaaggattgattcagtacaattatgcaaactcgaaaagtaaataaacaaaaagatacagttgagtgaaaggtaaataaacattattctacttgattttcctctgttttttccatttttcttttttgtcttttcgtgttctagcgtgttcactttttcagccatgtaattacttaaataggaagtttacacgatgttctcgcataaaaagctggaagtgcagaacaaagaggaagaaaataggaacagagaatttgtttgtttatttgtttgtttgcttgtttgtttgtttgttttgatttgaagtcgaggtacttattcgaaataattattttgcccagggttttggatagtt

SEQ ID NO: 12606 - DNA, 441 bp, Saccharomyces cerevisiae
tttgttagaaaactcgcatcgtcaataacggcgcatctctctaggcctgaaaaattttgcgatgagctcaaaataagatactataactttatgcatatattgtatatatattatatcaaacaaataaggacgttaacgaaattttatatggccttatttaacgtagaaggttggtctattaagacaaaaaccgtcgcttttgataacaagactaataagtcttcaaaagataaaaaaaaaaataatagaaaaaatggcaaacttacaagagaacagaagttgaaagaagagacagaggctgagttgaaggaacaagtggaagacattccttccgaaggatcagtagccaaagacatcccaaaaaaaaaccaagagaaaagtgatcaaaatgaaacgagcaagaaacgcaagcacgatgaagaagcccctctgatgcaagta

SEQ ID NO: 12607 - DNA, 468 bp, Saccharomyces cerevisiae
tgataatgaaggtaaacatcccctccccccccaaaaaaaaaaaacgagaattcctctcagaggatctgtttttctctcactttattcacatagatacatacttttttacaattcctgttgagtttatttattataagaaatattggattactattattattatagcttatgcaagccattgtgcggcttcttacgctttttgaaattgttgacctaacaacttggcacattattgaatttcatagagactgcttgtaatttagttgccaaggtatctcgctggactttacatgtaaaatgaatgcggcaagatacccaagagagttgattatgccaaaaaaaaaaaatctataaggatatccctggtattttctgaagaataaattctagcgtagttcagaagaggtgcaagtacagtatgaataatggtatgccttccatcatcgtggcatacaggttcaggcatga

SEQ ID NO: 12608 - DNA, 402 bp, Saccharomyces cerevisiae
tgacaaagaatccgataaaatgaagatctcaaatatacaaagaggaaacttcaacgcttcatttgaaaatctgtacagatcttacaatttgggaatactaccagatcgatcctcagctgcaaatactttactgtcaagtatgtctatggtgacaaatatcggcattattgtgtatggctcaataattttataaaaaaaggaactattggttcttagtattttcttgctagaagacatattcttaccaatcctttcataagctaattatgccatccatatagcaagagaatccggtgggggcgccatgcctatccggcggcaacattattactctggtatacgggcgtaactccataatatgccaccacttacctttaacatgttcatggtaggtaccccacc

SEQ ID NO: 12609 - DNA, 427 bp, Saccharomyces cerevisiae
gaagcttttttccgaaacctaacttttttctgtgtactattattattttcataatgcagtttatccttcacataattaaaaattcatattgtataaactaaaacaaacactaccactaaatatttggccatctatctgccatattggtcgtaacacaaaatgcccaatggagcctggtaagttccttattatttaaccctaagaactttattttgatcattgcgtgcaaaatgatattgtttacaagttttttttttccagcttctttacatataaaagggaaggattttgaaattataaatggcatctcaaatcgtctctatatcttttgttaattggattttttaaagggtcaggaagttttttcctttttatatgatgaatatgagtgcatttggctcgagttgctgtttggcttttgccaaat

SEQ ID NO: 12610 - DNA, 491 bp, Saccharomyces cerevisiae
acaggccagaaattttgaaaggaaatcaataggggttaacgattgtcatggttttttcagctagtctgtgacctgtacgaaagtgaatatcttattacattataagtgtatccatgggcatccgcccaatacaatgccaacatatcaaacataaaattggctgattgccactctcacattttttctttatttatttactcaaattttgtaattttttgttagacatataattttatatcattattcttattattcttatatttaagggaacccccctggaatgaaataagctaatatagtatgagggaatcctgtataaatgggtttaccttgttattctatgcctccctttcaaagacgtatttcttaaaaacttctccatttggttgaatactatgaaaaaaaaaaaatcaactagaatagatatggaagataaaaatgtgtaacaaaaaagaagaaaagagctggaggtatgacaatagcgccaatgg

SEQ ID NO: 12611 - DNA, 488 bp, Saccharomyces cerevisiae
cgcccataaatcgtctatattaaaaaaaaggcagcataagagcaactcactgcaaagggaattgcgcattccacgcaaataaacaatgtaaataagaatacgtactgtaactgtgtcacactagcgggttgttttatcataattgtttgggattaatcctgaacaaattttctatatataaacactggttcggaataccaatgaagtatacatattctggttcaacaactgtttctattcaaaaactttgaatgtttgaaatgcgctacgtctatttgtttgcaatttgtattaagtttgtttcaagctccgaactaggaaaaatcaacaatctgctgcaaggaagattgatatacacagataattccgttgcgacaaatgtattagaatccaaatttccattcttgaaatcaacatgtgttaaagacgcactaaaattatttttgccacaatgtattgcaaatggacttgaatccattgacgctgaa

SEQ ID NO: 12612 - DNA, 500 bp, Saccharomyces cerevisiae
taacacttacagagtcctatcaggaaagaataaaagccgatcaagcttcattctcaggtaacaactggagcactggcgagctttgctctattatataagataaaatatgcactaaaagtttgcatttctttacataactaaaactaagacattatgcatagcttacctgatcaaaaagtatgtaaacttgttaacatcttcacatgtgattcatctggtcgtactttcttgcggtgcagtgtaatatttctacccacgtgactataattgagcttgaaaactgtggcgtttttccaccgatgggtccacgccagatattaaccgaagccaaaataccgatgaaatttctgagatagctcttgtaaacgacgtcaaatcttcatatgcaaggagatcttgatttctttttggtagtcatctgtcgtcttgaggcgtataagaaggaggttatatctgtcctttctacaaagtattttcgagaatcttgcttctgccccttt

SEQ ID NO: 12613 - DNA, 469 bp, Saccharomyces cerevisiae
ttaattagttgatagactttttccgtcataactctatttaataatgatgaccaaaaagaggctcgttcgaatcatttcgcgttgaatttgaaattcgcggaggaaaaacacgcaaagagaatcggaaaccttatcgtcaaatcattgcaccttgcaatggtgggtaatgatacatcatcgcagtaacagtattcatatattcgtatagttaataagatcacttttcagttagcttatacaataaaagatattaccttttgtattgttagttgcaacatcctttttttataaactttgacaggcgatattacgtttgtcacttcggtttccccacacaaagaacacgttacttggcaaattcagctcttatgcgaattttttcaggtgacaacaaggtagttgattccctcgcctctaaccctggattaatgagtccatcgaattttggcggtgacttcggttcacgact

SEQ ID NO: 12614 - DNA, 433 bp, Saccharomyces cerevisiae
ttttccagataggtacaacaattgaattataaaaattgaacctgtagtaagtgactcattttttttgccaacacgaaaggaactctttgtgaaagctattggtggcaccctctgttcctttcggacttctacatacttttctagatagttgctcttttttttggggtatttcaggtgtcactgcccagctatttttcatttttaataactaagataacgtttgatatgtaagttctaagtatgtttctctatattttaggtgcacatcataatatcctatgtattctaatttgcaaatgaatattttgaaagagaagtattttattccggaaaaagaaattcgatatttttctggtatattaatgctaattggtaagtaaattcaatattgtctagtgcagactcagatatagtactgtcgttttggccgaat

SEQ ID NO: 12615 - DNA, 456 bp, Saccharomyces cerevisiae
caatcaaatatacaaaacaatacgtacaaatacatacacgtcacatatacataagctccggatacatcatacaagaaatgatcttaaaatcatgctcttacccgttctgtaaatagtgaaaaattttcatcgcgaagtatgaacgaaaaaaaaaaaagaaaatagatgaacttttagcatttaattagtggcaaacgcctacccctccttcccactttgctgacttacaaagacaccactacattaaagagtatctcgtgtgttcttcttttttttccaaaaaaaaaaactcctattatttgcataaacacacgttcactggtacaagatgtctattaatatttgtagagataatcatgatccattttaccgttacaaaatgcctcccatccaagccaaggtggaaggtagaggtaacggtatcaagactgccgttttgaacgtcgctgacatctc

SEQ ID NO: 12616 - DNA, 452 bp, Saccharomyces cerevisiae
acttctttcattcattttctcttggctttcactaggtatatctattccataacgactatgttttgtatttgttaatttacataaaaccatatcagtacatcaacgaactgtaaaaaagaaactttagcataattattgcggatatttaaactcacttgcaggtaagagcaaaaggcgattgatttccagtccgcctcttgtcacgtgatttagtaagaaattttgacagcaccctcggtttaatggaaaagaggggcgtttttcgatgaacccgaggggagactagagaatcatctcggttgaatggagcattatttttttagtagcgcccgcccggagaaatggacgttggcgaatgagccatgaattattaaccgcccatgtctaccagataccacatcgtatgacagtaccagcctagtcccggtaaaccgcaaacggaccttaattgt

SEQ ID NO: 12617 - DNA, 494 bp, Saccharomyces cerevisiae
atctaaatctacatcgttctcaggacgacttattactgctggtttcgaaggaataacaatgcatttttttatcccaccattttcctcgtttattacaaaaagcaatgaaataatatgtatatgtctacatagagatattattatagtaataatgcattttctatttgattttaatttaatttattttattttttttggatgtttaaagttgaaaataataaaatgattaactattgacagaggggtaagtggggttgttacctttttccttttggttaaaggaataaatgttttcttataacataaaaaaagctatagttatataaacaaggattgcgaattcttagaaacatattccatggttattttttttattttttactgcattcaattatttgaagaaactgtccatcaaacataagtttcttgataatgtgctgtttgtagtgaactagaattgttataataatatgctgcaatttttatcagattgc

SEQ ID NO: 12618 - DNA, 425 bp, Saccharomyces cerevisiae
tgattaaatataacacgggataaaaataagggtatcatattggaaagccgatgggtaaaaattattgagttaataaatggagacaatattaaaaatcaggtaacaacaaataaaaggttataaatgtactgctgtatactatataaaaacttttagcatgactaattaattttcatactactatgttaaataaaccaagtgattgcaacaccaatattttattattgatcttcagcgcatagagtcgattcgtagatattatcacttttgacgtttgtgatttctttttcatgattgattaccgatgatgctataacaaataaaggtcaaattttgaaaacaatgaaaaataagtagtaaacaaataaatgcacatttattgacactagtagagtgtaagaggaaagtaatttttagaacgcttt

SEQ ID NO: 12619 - DNA, 458 bp, Saccharomyces cerevisiae
taatgccttgattttgttttatcttcgaagctatatacatgtaaatacttttttagtacctagcaactttgctaggtggcatataaactgatttagcacgatatatcgttgcatttgttctgtttgtagtatgtacatgtatacagcttgttgtatttgatgtgctactgaaacagcgtagttgctagtgctttatcccttttgacggaaatgaacaaagctttatagcggaattaaacttaacgaaactggagaaagcataaaagaggaaaagggcagcggtaactcattaaataatctagttggacgagccataataagagaaatagacggagtagaaaatgcgctcctccatgtttagatgtgtgagtcgcgctcattacagcacaagtgtcacagaagatttcataaatagcattctagcaagggctcaagaggcaacagcaaaagcttcctcc

SEQ ID NO: 12620 - DNA, 427 bp, Saccharomyces cerevisiae
tccagctaatcttccggtttttagtaactggaaaaaaatacatgaacttaattatttattatatacaatatttacttttttacgccttaatccttaacggactatttgttatgccttatagaactagaaattatatgataaacatgagctacacgagttgacagggtgaacagattactatagcatctttctctcatgaataatttttaaaatgtataaattttgtaacgttccgaagggtggagtgaaattccattcaagaaaccaagcattgagacagaacagtacagagttcagttgttgcggaccgagaattgtaacaagtagccccagaaacattcatatgacgtctgtttcaaattaagcttagtaaaagtacacatttaccataaaaaaatagtaccaagtcggtggcctgatatcctta

SEQ ID NO: 12621 - DNA, 484 bp, Saccharomyces cerevisiae
ttttctttccttacgcacagtatgtacacatataaaatgtttaagaatgcctgtaaatattactattttgtcgcgcaagtagctaaacctttcgtctacacgaaacttaaaatttagtgctacatgcaagggaatatgtttatactgtacattctcgtcttcctttcattgatgatatgcatcgcgattgctttcattttgtgaacaatcaattaactaaaatgcacaggatagtaaaatctatatttacaaaaaggcggataagcaaacactgaaaatcataatgttttttgtcacttcggtccttcaagcttggtagttgataaattgtaaactatacatcgtttaatgcgacacatacagctcccttgtggtgtccaccgtactgtctgacaatttctctagttgataaatcccataatctcacgtaatgatcggacgatgccgttactagatacgcactgtcagcactaaatgcgcaatc

SEQ ID NO: 12622 - DNA, 498 bp, Saccharomyces cerevisiae
aaacaactctgcagttcaaatcactcttcctgtatacgccttagaaagatattagaaatatcttttactatttaatcttcaccattcattattcctcgtatataaattggcccatttcagggcgtctgactggagttgtatttaggctttacccggcgttcttctgaatttatagccagcaaggaaaacaacgtcaaaattggtcctcgactgacgcattagtaagattaatatttagcaaacactatgatctccgtaacaatctcttcagctattccaacacttgatgatgtcagtcaatagatttacttcaggtcgactccctgttttccttagaaagtcccctttttactactcgagagcttatttgcatcaaacatgtgttttcaagcaaaataaagaaactgcacaagattcgccagagcttttagcaaaaagctcacatctgaattcgaaaccactagatgtaagcaataaagcaccagtgaaaactgctca

SEQ ID NO: 12623 - DNA, 448 bp, Saccharomyces cerevisiae
aaaggcggtatttatctattatttggccaaaaaaaaaaaaaaatacatactacatatacatatacgccataaaaaatctctgcatctatcttatttcccattatttggacaaatgcttacgtgctaatgtccttaccctcgagtcgaatgccgggctcctaatagggtctgtaatcttataaaacgggttcattagtgtctttacgtatagttcgtgtacctcttggtagaatgacctcatattattgtcgtcaataactacgctactgttggctgagttcccatggatcatcacgaacttcatcccactatagctaatataagccgttattgctagtccataaaaatgatcaactttacctagataacaattatcagtattgtttacagctctagatcgaaggaacccaccaccgccattggatccgtttccaccgttcccatttaa

SEQ ID NO: 12624 - DNA, 440 bp, Saccharomyces cerevisiae
catgcatagaaagtcctactataaacttaaataagatcatcattataaactttcttttacacaagtaataagtacctttttttatctcaaaacatgaatgttgagcttcgaggtttaattcacaaaaaaagaaaatgtgctccaggggaggttcgaactctcgaccttcagattatgagactgacgctcttcctactgagctactgaagcatacaaaggatgttggggaagaaaaacaaactttacatcaaatatttgcggattccatggttattaaaggatatagcaccgggtatacaggacatactagaagttctccaggggatcttgtaatccacaaaagagaattgatattttcacataatattgtcattattgtttccccaatttatatgatatcattcattattctgttacactatcagtcctggcatttcagc

SEQ ID NO: 12625 - DNA, 486 bp, Saccharomyces cerevisiae
tgagttaggcaatactgagatgtttactcgcaatgtcactgtatattttaatatcaaataacgtcagtttttattagaaaaagagcgggttaccgtttatcctgaacagaaaaggttcattgaaaaagagcccttcagacattggctaatgaaaagaatatgtaaaatcaagaacaaattaacgaagctctccttcgttaacagtccactacctaaatttatgattaatgtggataaatagactggttaaacatccatcctacagtgttctgaggttttacacgaagaggctctgcactgtatcagtgaaatcgctgcgtgaatttggtgtactgccgaatagcacaatatgtcattctgtctatccccgaagaacgtatgtaatgggtagggctgtcataaatgatattttaatcaaaaaatcctattcaactcacacggtatgtgcaattgatcgatcaaaagatgaaaataatgggagcgctt

SEQ ID NO: 12626 - DNA, 428 bp, Saccharomyces cerevisiae
taaatttgctccggtacgcagggccaaaaatatttacatacatacataattcgacgaaatttcagaagagacactaaacaatcgtacatctctctactcgatgtgagccacgcgtcggtttttcttaccgtcgtggctttagaggtgaggctgcgacaccccatacatcttacccggcatttaatttccatttttcgcaggaatgtgaatatgataatagacttcggtacactcttttttaggtataacatatatcaattgttcaacaacaattattcaaagcgcaactctccaaaggtagttattctgataatttgaaccaaaagtccccagattaagtcttaattaaactgcccttgcataccgctgtaaacgatttgtgtgcagacatcaattgctgaaacgttctgctttggttgtgcttttga

SEQ ID NO: 12627 - DNA, 444 bp, Saccharomyces cerevisiae
tagtgttagaactccaccttctgtgtaatttctttctgaaattagtgaaaaaaacgcgcctttcaaattttcatactagtgattggtttattgcagattatttatttctaattgtacatattcttgttattttatattatatgaaaggggtaaatccaaatgccactctacatacagattctgtaactggcataacgaccagaggtttcactttttcttatgattttaactacttcgcctcttttcaatcccaagtataaggctacaggatcagctctttgaattcttggcaattgggattccttcaatctatacctttttaaaagctctcttttctcatcactactcaatctgatatgctttggaaccaattcgtggtgagtaatattaaccactaaggcagcttcattaaaagtttcaatggtggctggtggtatagaaggc

SEQ ID NO: 12628 - DNA, 433 bp, Saccharomyces cerevisiae
gaataaaagtacccccattttccattcattaacgttataatcaagggactgtaaaccagcaaaagagctttgtcgtcattatttaattaaccacctgtatatattgcttaaattttaatgtatgactttaactttgaaaacgcatgaacgtgctgctgacgttctactcattggagttgtattctttttcttgtcttattctataattgcatgccgtgaatattgtatacaagatatttatgtggaatcatatattaggcagcaattcgtacttttcatccactgcatatctaaaagtttgccaacagaaatcctttttcttggttcccattgaaagatgcgatataatgcgatttttctatttgtggccaactctgagtttacgtgctttaattcttcgaataccctaaactggtttttacgctgcatttcc

SEQ ID NO: 12629 - DNA, 402 bp, Saccharomyces cerevisiae
gtaaaagtgcaaaactagaaagcccaagagagggcaaagaacattctgaaaactccctgattcttccatacctattaccatattacatcatttttaattagtagtcttttaattatctattatatccggtatataaaatatccttgcgccaagtgtatagctaataaaatgtaaaaaaaaaaaaaattaggaacaaaaaataaaaaaagcgaaaacaaaaaactccgttaatgaatatttcatgatcttgttaaacctaggtcatcgaaatccccttgtactttactcaggtatgctattttcatccctattgcttatttcatcaggtacggtggtggatatattaggagtgaacgtactggtagaattcgaaacatcagctgctgtagtagcggtggcatt

SEQ ID NO: 12630 - DNA, 447 bp, Saccharomyces cerevisiae
ggacgcgttaaggacattcctctttattcaagtatttatctatggatgtagaacgcacattatgaataaataactgcacttttttcgggaaaaaaattaccaaaatagacatcagctttatcatatgtctccttgaagtatttgaacgaccacctttccgaagacaatgtacctagtaacctacaggctgcccttaatccatacatccacgcacaatagcacaatctcggtgatggctggtttttttaccttgaaaaacaagaaaaatggctgatgtagttgaaaaaggtaaaagagatggcagatcaggggacgattttgtagaggaagtatctatatatatcgaccatattgaaaaaaatatgaaataacatacacacgtgtaagaatatataatttttgttattaacacgtcgtaaaagagaaaagatcgtgctttcatcacgc

SEQ ID NO: 12631 - DNA, 437 bp, Saccharomyces cerevisiae
taaagaagcaccaaaagaaataaaatgtgaatggtttattctcaagctcagaaattagttgttgtagcactttttattcggcattttttaatatacatgtgtaaattatatatatatatatatgaatatatatcttgttttgtttattttcaactaataatcgcaacaatattatctttcaataacgctatagcttctgtatgctttttgctcagttgctcaatggttctcttcctctatgtgataaaccaaatagtttggtaagccaaatacatcgtagtttaatctcttcgccatcttagcaaaaccttctgtttcaatcaagtgataaaatgggaaattagggaacatggcaccgtctctgtgaacttctgctttgaccaaagtacagcctccaccaacaccatccagcgccatctcttcacctggtacgccat

SEQ ID NO: 12632 - DNA, 463 bp, Saccharomyces cerevisiae
ggcacagaaacaaagagcagaagacaaaaaatacaaaaataaaaataagataaaaagaaaagtcattattaccattactgaaatatgtacatttaccataaaatatatccgttatatagaagttataatattaagccatcactttgttatcggtttttcattcctcctggggttgcttcgactgggtacgtaccttatgtcttctaggcctatgcaacacatgtacatcaataatttcacctaaattaataacaggcttgtacataaattctattacaggttttatatcctcttccaccggtgtatccagggcatcagcgtccccattttctattaacaaattaggtacctggggctgtttttctattttcctagctaataacgttttgggtcctgcatttaatgagaaaccgtttaatgttaatgtttgaaacatcaaatagtgccttaaattggcgatctt

SEQ ID NO: 12633 - DNA, 434 bp, Saccharomyces cerevisiae
tttgaattaatctactcttaacactgttcaaatgtacgtgtaacgttttgacgctaaaagattctaaaaaattactttttaaagttataccctctgactttatgtgacatcagcatcctaagtacctaccgttcataatttgacgcttttccttatacattcaagcatcgatatatatgatttttatatatgtcctctattctaatacatacttttttacttttgaaataacaaaatattctttttatttttgcgagttgaataattaaataagagatcaaagatatatagagagaaactttatttctcggaaatcttacttctagtcgtagcgttcgatgtagtctgtatcaccaatacattctgcaattgtcaattggtcactaccaataagttcgttgattttaatagcaacctcaactgttcttcgtgca

SEQ ID NO: 12634 - DNA, 412 bp, Saccharomyces cerevisiae
aacacttttatccattttttttcgtataagcatattttacatctttatatatatttattttttttttttttattttggtagaatagattacatatacaactttttcataatgtcaaactatagagttttatttcacataacggaagaagcctattggagccatgagtataataaaatatgacctcaacactagccactagactctcgacatattctatttcattaatactgcagcgcatcaaaattataaaacgttgttactcagctcccgtactcagagattaccaacaagatgctatagatgcatgtgtgaattctattcgacagggcaccaagagaattggtgtatcattagccactggtggtggtaagacagtgatattctcaaatcttatcaatcaattgcgccaaa

SEQ ID NO: 12635 - DNA, 481 bp, Saccharomyces cerevisiae
agaaatcaccacaacgacacttaatcccaaaaaaataaacattactgtataagtattcattttctcctcttctcattatgtatatatgtacctatatgtatgtatgtatgtgcgtacgatttttctaacgttaacttcatttctttttgattatgtgccctccttgagttaagatgtgtttgtccagggaaaccttgtcaccatcgctgaatagtagcaaatagtattttaatgttctggagaaccaatagctaggtaaatcattgttcactttttcaccgttttcataaaattcctttatttgccacaatcctttggcaccactgtttagttccattaattcttgcattaagattccaaaagactgcttacccatgcttctccatttttgttctccactgattctgtacatataaaatatagattcaatgatattcgaatccaacaatcttctggattctaccttgttgacccaaaatgg

SEQ ID NO: 12636 - DNA, 403 bp, Saccharomyces cerevisiae
aattaaagtatgacagaatcgtttgaagggcactattaatcactcccgcacatatcacataatactaagtatccatttctaatatttcattactcttttcggcatcgtatattgcgatatttgattaaattttcttgttcattttttcctcttttctttcgcctttgtcgaaagaaaagaggaaaacaagctgaaaattgctatgcattaaagtagcagatttactttgttgagttggttctgatcaataataagagtaatgaaagaaagcaaaaaaatggctaaagataatttaactaatttgctctctcaattgaacattcaattgtctcaagacgagcattcgcaggtcgaacagacttgcgtgaaactattggattctggatgtgagaatccagcggat

SEQ ID NO: 12637 - DNA, 409 bp, Saccharomyces cerevisiae
agcttttttttccttttttttttctggcccagagacggattattgttttcagttgaagttgcgcactcggcatatgatttatagattcccaatatattgtacttcgttatatatgtgttacgaatatttttgatttcgttttagagagttttgattagaggaaattatagctttttttaacagtgaaataaatatcatacatcaaaagtcttcaagaattacgtggtgtggcttaagttgcgtttcattttcccgcttcaatacttgaaagttatcccacaatcactgctgacaaaaaggatacaagaaaggtttataggaaagaaaaaaggcggaagggtatactgaagttagtaattttgcttcccaattgaattaaggccgcctagttttgacgggaggagagaga

SEQ ID NO: 12638 - DNA, 447 bp, Saccharomyces cerevisiae
tattcttcctgtaagcacagcgcaacattgtctttcttattgttaatatataagttaaaagccgaatttttcatttatttatatagatggcgtgaagattattacggtcagataccttcgcctatttatgtacttgcatgcgtttagattttattggaaaaagtattaatttatcgtctatcgactagtattcacgttactagtatattctgtatagttaatgatagagcctttatttaaaatggaagtccaataactatttcaaaatcaaattatatgtcaaagatgttcaacaaattgggaaggcaagaggcgagcactaggcctgatacccttcttaatgccttgacatacacgtgtctatttcttttttcttgtcgaggtattgaggtattgaccaatgctgaatgcttgataatgtaattagggatcgcgtacgacaagttt

SEQ ID NO: 12639 - DNA, 449 bp, Saccharomyces cerevisiae
tgattatttaggaagcacctcagaatatattttccatagaagcctaaattaagtatgcattcatagccccatgatacttttttttttgactacttgtattggaatctaattgacctaactgggcattctgggtcattggtatatgtatcactttttacgtaaaaaagtagtggctaatataaaacataaaatctacaagaagggtgaagtgcttttcgaattttgccactgcaagtaattggtgcaattgaaatacgagatttcgttctctaagaggatataaaaataaggaaattagccctacctatccttgtgttaaaatatgagcggagaaacgtttgagttcaatattagacattctggtaaagtttacccaataacactttccactgatgctacttcagcagatttgaaaagcaaagcagaggaattgacccaagtcccaagtg

SEQ ID NO: 12640 - DNA, 424 bp, Saccharomyces cerevisiae
taaagtatggtttgtcgttttgttcatcattcaagggtcatttttatttccatttatgatttcttgagtacaaaaggcaaaaaaaacatgtataattatacacaagaaaaaaaaacaaaacaaaagaacactttcacacaagcaagtatatattatgagaattttttcgagtcttacagaaccatatcttgcctctaaattttagtctaaaaattttgctagcccatcaattttttttttgttctaatgcaaaatataacatgggtaagaaaaagaaaaagccgttcctcagtacgtaaagagatttgatcattaacaagttgggctcaatatacacagtcgatagtctatatgtgcatatgaaactggcgcaagacatgaatgtagatgaaatatttctcaaacaagcggcagaagctatagc

SEQ ID NO: 12641 - DNA, 442 bp, Saccharomyces cerevisiae
tagaatgcattaaccagtgttttttctaactgtttatggtactagcctttgtgaacatgtatagtaaagcatatcggacgtagttttttaagaaccttgtttattacactttgacggttaggagttttattggaattacctcactttgcacataaacctctagaaaagaaggtaatacacaatgctttcgatcgatttgataaataatagtaattcatattggcataatgctacatatacgtatatatattttttttactcttttaataatcaaattaacttaataattgttgagaatctggtgaaggttttctttttcttttattttttattcttttttttcaggcaagttttatatttctcttattcagaaagtctacgtcaaagagtcattgaaagcttttatcttagataaaactattgggcttccaacagcataaaa

SEQ ID NO: 12642 - DNA, 437 bp, Saccharomyces cerevisiae
tgaacattaaatagcatagcataacaatttttgccagtgtaatatatattccagcaaacctagaaaaacattcagtttcatatttagaagaataaaaacgtatgtattgttggtcacacatatatagatgccatttctatctctatgttcttcttttcctcaatgggccctttggtttgttgaatttcaaattgcttttgtttgggagatctggattggatccatgatcgaggctatcttctttatttgttgccataagtaaggacttgtctagttccacaaaatcgccaatttctaccactttactaaatgcgattttttgatcatttttcaagtagttgataaatccattcttgttagaagcatatatcattctatctttgactttgctgccagagggacaagagtagataaagaaacttgaatcaccctgcctg

SEQ ID NO: 12643 - DNA, 459 bp, Saccharomyces cerevisiae
tacgagaataatttctcatcatccagctttaacacaaaattcgcacagttttcgttaagagaacttaacattttcttatgacgtaaatgaagtttatatataaatttcctttttattggataatatgcctatgccgcataatttttatatctttctcctaacaaaacattcgcttgtaaagtattatatttaggaaaaaaataatcgataaaggctcatccgaagatcagttagattctttttgcaagtcctgaagaaattttcacactactactataaaaaaaaaatatcataaaaaggtacattacgtgcaaccaaaagtgtaaaatgattggttgcaatgtttcacctaaattacttccctagttcatcatttagaattcaaaatatcgatctatatatctttactcatacccactattgttagctcctttcaataaatgttccctttgcaacctt

SEQ ID NO: 12644 - DNA, 499 bp, Saccharomyces cerevisiae
ttcggataaatatacaagtaaatagactttttaaaataataatatcaatgctaataaatcattcattaatgaccttgtctgcccaagtaggcaaaacaaacgcactagaatgtatttgaggattatagtacttcagcttcccttgttcttgctcagatatctttctttgcggaatgttcaacggtatattggcgttattactgcaaacaattaaacctaattggccagatgtataggttggaaccatggtatagcaatattctgtattaggaaatacctttttggctgtatttttcaaatcatgtaagtattttaaatttaaccaaaaattttcagagctttgcataataacaacgccattaggatttaaagcatctttcaatagttcgaaatacctctcttgaaaaaacgcttcagctggaccttcaggatcagaactatctgtaataatgacgtcaaatttcttatggacgtcggaagcacctatatcttgtaagaa

SEQ ID NO: 12645 - DNA, 434 bp, Saccharomyces cerevisiae
gttaggaaaacgaactgtaatgaatataatctatatcactcatctgtttttgttaattttattttagccaatatcattataaaaagaggaaaacatgcacagaaaaagcactgcttactgttatgtcttagtttgtaattgaaaatgaaaaataaaaaaaaaaaagaaaataaagaaaaaaaggttgatccttatgtaactttttatttacgtagaagttaataaatattatctcattgttttatctatttttcagtatatggatacatgtaaagttcctctatttatgtatattttatgcatgactattcgcgtttgagattgtgatgatctgttctgcgcccttatttttattattgttggctatcaatgtctgtagtattacatccagcgaactatctacttcttcaatattcatttccgtaccttccctg

SEQ ID NO: 12646 - DNA, 451 bp, Saccharomyces cerevisiae
tgaacaaaacggtgctcttagtattattatataaccactacggttggatggactgagggtaagggtaaccgtataccttttatttttttttttacattttgaactgggaagaaaattttttttgcgagggattgacggctaacgccaaaacactccgaagagaatgagaaaagcttgggcatcgctcgaagtcatcgaacgggactatttttgtttaaaatttcaccagatctgcttgataagggtagtttagcttgtgtatttgggaaaggtacgcaaaagatatattttactaagatctttaaatatttttagcttgaggtaatacatgctaattttagttgattagagattctgaaaaattcgttttagttagtgtttaagaatagtggcgtttatcgttttgcccatttaataattaggaaaaaatatgtcagggtccttttggaag

SEQ ID NO: 12647 - DNA, 485 bp, Saccharomyces cerevisiae
ttatagtgatcatgtgcggccctgtacagttgtataaatgatgtaaaataattgaattctcttaattttaatatttataagatatatactataagcgtaaggaaattccaaagaaatttgttttttagtttgcagtcttgtgctccaactatttccggtccttttcgaatttcatgtcaggagcattccttattgcagacagcttaacagaaaaaaaactgtgaaaaaaataaatacctttagatattaaagccctaaattgatatcaaattttttccatatttggattttgtattccttaaagcccacatcctgtgaacggttacgctcaaataatggccaagtaacctacgatccaatagcgacgtttatatatcatatagaaaaaggtcatccagaaaatttgtgtcaataagtatcaggtcttttatatgtatttatattattttccgacaattttcaatcttgcgcccatagtttcaatt

SEQ ID NO: 12648 - DNA, 437 bp, Saccharomyces cerevisiae
agtggcatttggatttacccctttcatataatataaaataacaagaatatgtacaattagaaataaataatctgcaataaaccaatcactagtatgaaaatttgaaaggcgcgtttttttcactaatttcagaaagaaattacacagaaggtggagttctaacactattagtcatcggccagtctcgcacaaagcaccacatcggtaatgcccttccaccatgacatatcctttaaatttactgtttggggtgggctaacttcggtgcctgagctacccagaaatgttgatccaatagttattataagactgttgacaatatcgctcctcagcaacaactgatttattacattggcacctccttcaaccattactgaccttatattgaattcttcttttaatatctcaaacaatttcttccaatcgaccaatttcgt

SEQ ID NO: 12649 - DNA, 416 bp, Saccharomyces cerevisiae
ccaccaacattcattttcacttccgccatagatatgcctatgtacacatgcagtctcttctgtattccttaataatgtaaccataactgtttacttactaaaacctaatcaaacttcaggacagttttctgttgtggacccagacccacggaaacgttgaaacccaaacattaatatattttatttttttttttttttcggttaatgaaaaactaactttttattgtgcactacggatgcctcgcgtcaccatccgctggaaattccaggactctctcacctgcgcgataatatacccaaaatgactagatgtcacaactattctattaagaaaggaaggtgttcacgttgtgaactttaatattaaggaaacaaaacaagcacacgaataaccaatcgtttaatcatggctgtcg

SEQ ID NO: 12650 - DNA, 442 bp, Saccharomyces cerevisiae
ttttacgaaaagtaaatagttgcgatcactgccctgcacagttagtgcaatttgtatattattaacagacgaagcagcagcggccattgagcctttatgtcatcctacacggataattttgggctgccgaggacagtaaaaattaatccgccaccgctgaaaatttttctgggcgatcatctttttaatgtcgtgtgctccaataaaaatacatagtatatattgtgcaaagtgaaatcagattgtaattcaagaaaggtcattcaccctgagccttatagaacatagtcagcatataagtgttgagcattttgagccggggcatacaggtatttgcggcgtaactacaaaatttctggttcttccccctttcgaaccgttagaagggataaggatttttgcgtacttgctgcagccgcgaaattttcaaaggccggctatt

SEQ ID NO: 12651 - DNA, 429 bp, Saccharomyces cerevisiae
agcagatcatgagtagaatatcaaaaatcaagaattctttataatctttatagaatattgtttataaaagtttttttccattctagcatataatttttttggaggaagtcttttctggaaccttcacatggatcttaattaatgaaagtagacagagctcataagatcactagttgtttataaactgaagatgttccttcttattgacttcaacattatatcgctctgaattagttgatctgtaacttcagagtttctttaccagaataaaagcgtcacagtttttctttagtttatatgtacacaggttggggtttactataaactataaaaaagaagtgttgtcgccgctattttaaggtttatacacaattttaaccaaaaaaaagaataagttgagcaacgttggaactgcctctgcaacgaatt

SEQ ID NO: 12652 - DNA, 404 bp, Saccharomyces cerevisiae
gcttgactttcttcaccctccactttttttgcccctcgttatgagtgtgtttgcaatttgtaacttttcttttatatttgtatgtatttttgtactaagcaaattcacatgaaactttgtttaccaacttctcttttgttttcgtcccaaacacgtatattactgggaagatatacatgcctatatctatatctataaatatacatatttatatagtattatctccgagttctaaagctccagatgcgaagaagacgttcccgaagaagacgttcccaaagaagagtcactatactcatcatcgtcactgctctcttccgattcgtcttcatcctcgtcactgctttcttccaccacctttataattttccttggtttactcttcctttctggaatgtcggaaa

SEQ ID NO: 12653 - DNA, 433 bp, Saccharomyces cerevisiae
agagcttttaatttttattttttttcacttgtatttttgacgggctattaattttaaatgaaacttttctacatgatggaacataaacataaatataggtatagataaattgttcttctttttttttttttttctttaagagaaagagtaagtaaatatatcttaaaattacaaagggcttatgcatcatttcagttaaaattattgaagtaccgctccctgaaattatcttttgaacgttttatgccatgattacttgatccattgaaagtgctacccctattaatataaaccagtagtctccttgaccatttattgaattcttgaacgcagttgtattttagctctagattttcgtgcattgggacaatagtttcaatattggcgtcgtttgcagtgggcatccagaaggctaatcttccgccaatcggta

SEQ ID NO: 12654 - DNA, 499 bp, Saccharomyces cerevisiae
ttgaagaaataagttgaataaaggaaattagtcaaaagtttctggtagcttgctcaattattagcagaataattgtttcgtttatatatatttcccccattcagtttcacttcctatttgaagtttttgtaaccctcgactttgtaaaatagatattactaaattcttttagagaacaaaagtattgtacgtattcgccatataaaaaaaaaagagtatatgtggtgactttttggtcattaattgttaagagcaagcaagtagaaatcataatcatatttcgagttttttaaaggtaggaacaatatcgataagctgttctccagtctcgacactgtttgatgaccatatatcattaattcttgtaacactacatcatagatttctctttatccttggattgaatctgaaaaaattttgatagagtcttttgttcaaagtgtcacttcttcatctgtcactcttacgtatttttttttttttggctttgcccataaga

SEQ ID NO: 12655 - DNA, 466 bp, Saccharomyces cerevisiae
atcctagagggcccataatcataattctaagcataattcattcaagatgaaaaaatccaccgccatatatgaggtgtttctataggaaatatctatatacttttatagtcctaatttcattttacataaactgttttaatcagtttctaataatctatgaagataattcactgtttcttgaggggatgctatccagagggtacatccagctagccttgccttaaaatcatttgctgatcccaccggtgcaaactgatcgcctacgtgtaaggtttcagagggttggataggagattcagggttataaaattgttgcaatgaacgaacaccaagatctttccccccaatatcacaccagacatcactaccaccatcaaaacaactaaattgaattcttctagatggggcaaaagactctaaagtgttttgaagggttaaaactatttcctccagttgttccctatca

SEQ ID NO: 12656 - DNA, 448 bp, Saccharomyces cerevisiae
catgccccatatggacaacaacgttcacactggtcggtgcaagggcacacagcaatctcagagtttctttcattggctgcatggagcacaaattcaatcttgtgctttaaagtatctgcgcggttatggcaagttctccatcagtctcttattccagcaagcattcttttacggaacttcaatgcatctaaatacatatgtacagatagccaaaactaatagagacataataaattaaacaaaactgtaaattttaaaaagagtatatatagggctcaagaaactgcgtaaatataaaattaatgaagaaaatctgattgtcaactaaacgacatcttccatttctatttcatcttccaagtcagcctccgcgtctccttgcgcattgtctccagcggaacctgtttgctcatcagctagttcacctaaggttgcctttctctcctcc

SEQ ID NO: 12657 - DNA, 420 bp, Saccharomyces cerevisiae
tcttgattgaagagatcaaagagaggatttaatttcatgcgcattattattatctacggtcaatttgttaaatacttatatacttttattcctacgtcataaattttctatttacttttcttatttttcctttcactcaatatggagtggaaagagaacaatagagggattaaaattcgtgggaaaaatcacgctttttagatagatttaatttacatcattgtttaaaaaaaaagaccctgaaaaatcacacaaagaaagcacaagaagaagaacaaaaatgggtcttttttcaagaaaacgggaccatacgcctgctgtgcctaaagagaaacttattccatgtgataagatattcttggaccctcctgccaagtatggtaacgcacctctactggaacccatctccgaagatcaaaa

SEQ ID NO: 12658 - DNA, 415 bp, Saccharomyces cerevisiae
gtccatttggttttcgtaaaatacactacgtaagatttcattatatattcaaaaccgaagaactttatttaattaattctattcaatattttttttttcccattaaattgtgtagtggaagcaaaatgcactgcgcttatgtgaaaaagttacacaatagggaatacatggaacagcagatcagaactgcaaccctacagattagatatggagaacgacaaggcgtcacatgcgagcccaagcattggagtgaacgaatttgtcgttcaaggggagatatccatagacgactccgaaaggtctgtcaagagtgttagcgttagcataagtgatgatgaggatagtaagacagatgtacaagataatatggccacaccgtccacaagatcgaaatttcaaacagatctggccattg

SEQ ID NO: 12659 - DNA, 463 bp, Saccharomyces cerevisiae
tagcgtgttacgcacccaaactttttatgaaagtctttgtttataatgatgaggtttataaatatatagtggagcaaagattaatcactaaatcaagaagcagtaccagtattttttctatatcaagtagtgataatggaaatagcccaaatttggcttccgtcgacacatagaacgtttgagagacattatcaccatcaagcatcgagccgcccaaacctaaccgtataagttttttcacgtttttgatttttccttgcacacttcgatattactctcacgataaaagggccgaagagaatatttttcttgaacatccagaattttaattcggagaaatttcacaagccgccgatttaagggtcctgtgttcttaataatcagcctctctcaaagcaggtaagaggcagtctttcttttaacaataggagacattcgaactaaaacatcagccccaaaaatg

SEQ ID NO: 12660 - DNA, 476 bp, Saccharomyces cerevisiae
agtatgtttcagtatgagtacggtgaatttcctataagtttttaaacttttagatttttctataaagcatgttaaacccttcttgacatcgttttcaaacggcatctttcctacggaactaggctgtttttgagatatccttatttaagttcctcttggcacaatgttattcccgcatttatatttagttaacattatgtgaaattcgctcataaaaagagccttagctctttcttcattttgcctcaagaaaactttaaaataaagtaggaatgccaacaatacttttcttcagtaaaagacgaatattggcgtagaattttaccggtaatcatatatacttggcttagaacactgacacatgcatttttctctggacccttgcacaaatcatcagtagcgcctgaatcaaaaactaacaaaataccatatctgttttaaacaaataagtatatcgcatgaagtaagtttcccgc

SEQ ID NO: 12661 - DNA, 415 bp, Saccharomyces cerevisiae
gtcaagaaaatgatatacaaaatgggttcaaaaaaaatttttatcgaatattttcctgtaataatattgtttcttttagaaaaattttggttttctataatatatttattctccatgttttaattttctcagctattaatgttcaacttattccttataaatttgtcattcatttttcatatatatcgttaatatataatctttgcctgttctgaatcctttttcaacgaccaaaactttaaaaaaaataagtaaaaatcttacatacatcgtaaatgaaaatacttaggattgtaaatcatcaattatactaaatagacttttcaaaacgttcctttttatgttccaatcatagttcaagaccccttcaccagaacctaattttgtattcttcagtccatctccgtacgcaatt

SEQ ID NO: 12662 - DNA, 492 bp, Saccharomyces cerevisiae
gcgtgatggcgtaaataatacaaacatttgtaatttatagaaacctattaagtattcagttagattccttcagctgcatgacgtatagtttatatggacatcatacgtatttttatcaatatagagactagcatgtttttacactttttatttttgttgttcaattaggggcctcgtccatatatgtatatatattacataatctgcaatcatcaattaggggaggaataatcggcagaggtataaatacaaaatttaaaacaattcaagtgaatgaaaaggtgaaccaacaaacagaatattaccacgtatcaaggaaaaactaataatagtatattggcgcatttagcaggatgttctggaaaaaggatcccaccgtcagttgggaaagaaaaaatatcaatgacattgattttagtcgttttaatgtggccataattggtggcacaggtggacttggacgtgcaataagtagagagctggcccaaagaa

SEQ ID NO: 12663 - DNA, 497 bp, Saccharomyces cerevisiae
tatatacttccattattctatgattatagagtttgtttggtatttgtatatcgcacgatacaagtaatgaggggtgcttacacaagataaaagataaaaaaatatatatatataataaaaaccatcaaaaacaccattgaaaaaaaatataaaaaaaaaaaaaaataaccgaatatgaatatgaaattaatgatcatgatgaagttaatttttactgagaaacgtcacctaatgtcgatgaaacgatgataatgaatgaatgatgaggctactttaagtaacgcaatgtaatcaagccaaaattatccctcttttttttttttccctcttttgagattttatttttaacctactacttactttttttttttgaacgttcttttcccacatacttttatatatggtatttatatgtacgatgtttaatcacagagatgtttctaccttactcgatattgtttttgcattaattgatatcttgctcactgcatcattgg

SEQ ID NO: 12664 - DNA, 435 bp, Saccharomyces cerevisiae
tgtactatatttccgtcatctcggttatcatcgtcacttacaacgaggtgcgaaaatttttttcttctaaaggtgagaagaaaacatgaaaaattttgaaaaatttaacgatgagatggagttttcaagtaactttatgtagttgaaatacatattagtactccgttgcaatatataacgccgggcattctccacgtatatacataccgtagtgcacaatgggctcctctttggatttggtggcgagcttctcgcatgattccactcgttttgcattccaagcaagcgtcgcacaaaagaacaatgtggatatttatccattaaatgaaactaaggattatgtggtcaatagttcattagtgagtcatattgactatgagacaaacgatatgaaggtttcagatgtaatcttctttgggtggtgtagtgatttga

SEQ ID NO: 12665 - DNA, 458 bp, Saccharomyces cerevisiae
acttgatagctcatgtatttacaaaccttcgtaaaactagacatgtataatgaaaaataaatcgattcaaattaatttataaagcatatagaactaaaaaaaaataagtatagaaggaagttgctcattaccctgtatgaattagtgtatgtatttaaaaaccaagggcacctttcattacatcttttccagtctgctcaacagcctcgttcattgtttctcccatggcggtagcatagtcgttgaatctatcttcaacggcgtcccatctagtttctacagctcgagaaacatttcttagtaccccgtaactactgttcctgcccttacgggtgggcttggtatactggtgttccggatggttcgcattattatcgtctgaagaacgctccgagaaacttccctcagcaatgatgctctctttgtatttggatgcaggtctattcacgccacccaat

SEQ ID NO: 12666 - DNA, 454 bp, Saccharomyces cerevisiae
taaaataaagacatataaaacgtgtattagatagaaaacggaaaattgactaatgtttttattcctattatactcagatcgtcaaatgttgcctttattttctattgaagggattttatggcatctcgcgaataataaacaaacaataatagtaaaaaaaaaagtgtaaacttatgtattcagcgcagataaaaggaaaaaaacgagaagtttgacgtaaagaaaaaagttcgaaaacttttgtagcagttgaaagttttgtatgctatgtcaattaggcctctcacgttaaacggtttagatgagccagaaacctcttttgaagaactgaatacaactctacctcgctttcaatcccatgaaacattaactttggaagaaaacgtgccaccattgagtacatcaacttatataccgcctccatcctcggtaggtacttctgacactggcacgg

SEQ ID NO: 12667 - DNA, 444 bp, Saccharomyces cerevisiae
agacgattgaaatccttcatatctataacgttacatacaatatttggtagggtagggtatttgatgtaatatttattattaagaacttttgtcgtgctaaacgttgtactgtacaactattagcaagatatttatgcacgacagtaatctatagttgtaactctaaatcacacaccatagacaaatgatcacttgcatattctccaacatgtggttgtccatgctttgtcatttcattaccgggcggcattctcaaaaaacctctgcatttaactttattttctttttcaaaatcgccaagggtttccacttcctgacaattactttgtgggtcccatttctttacataaaatagatagtctaataaaccacgccaagtgtttgcccaatttgaaatttcaggctcacctctatcattatcaagacctgcattttctggatgaa

SEQ ID NO: 12668 - DNA, 402 bp, Saccharomyces cerevisiae
cagcggtatacttatttttactcccccttctgtgttttcttctttttttttttttttttttttttggaatttactgttgtttctttcgtggctgtttcttaatcttatacgtacctttatctatttccgtacagttgtaatctatcttctttagatcttgccattttttatgcggtatatcccaatggcattttttagctacgagactggccacgtcatcacagaatcccaacaggtttaagtcaaactctgcatgtgtaaccatatccctattgatcaaaatctgcggaacatgtgaaggtaccatattgacaatttcagacacaggagccactttcaaacttgttcctatacaaatcaatagatcgcattccagtatatctttgcggatggtcttatgaa

SEQ ID NO: 12669 - DNA, 492 bp, Saccharomyces cerevisiae
ttccgcattcaataaccttatgtatttttacgcgtcactgcgaacggatgaatattgccaatgactgctgcgcactcttaaaaaatataatgacaattataataagaagtatgatactttttctgtaaaaaatatatatacatatgattcacgtgaaaatttttatatttttaattaaatttttataatattataaattattataatattgatatttaaaattaaaaacaaattattaatggttttgttttccgaaatgttttttataattattacttcagaatagttattttcacgaatacgagatacagggtaatgaaaacaggtgttatccaaaaaaaaaaattgatatattttagatactttacatacagaggcaagcttcagctgtagccaggtacataatattccctataaagtgatcaatattttttaacgaaaaattaaaaaaaaaaatccttgaataaaggaatgaaaatattgtaacaagcg

SEQ ID NO: 12670 - DNA, 478 bp, Saccharomyces cerevisiae
ttgttacgccttaacttttgttctcttttgagaaacagcctgtatggttcgccgtttattttctaagcaccgttttttattcatatttttataatgcaactcctatagaatatagatgtttcgtgtttttaattcctgctatgactttgtgtcaatggtatgtgaactaacaactgtgtggtagtttgggatggtacgtaaaggtgttcgtgattatataagcaatcttaaaatatttgtatcgcaccatgaggtgcccaataatgaaatgaaaattactattatgaactatactaaaaagatgaaacttttttatcaatcccaggttcttttacttattatttttggatataagaacaaaatcggatttcccatgctttttctcaatgcctatatgaaatcttttcgaaacagccagtacatgtaacaattatgatacgaacttgatcggtaacccataaataacaggagctgcgcc

SEQ ID NO: 12671 - DNA, 499 bp, Saccharomyces cerevisiae
tactaatcgccgtctcggcaaagcaggttgaacgttgaagtttgaagagaataaaatgttattagtagcataggggaccagaccaaaagtcgtaaaagagcaatatacttttttataaaacatacaattatacaattagtccccccctcaagaaataaaaagcccctgtgcgagggatatacataaacattgagcattaatatttacaactcccaatgagcaataatgggtttattacataaatagaacggcgaaagatttagtttctagtatcttcaccgtcagtaaatggcatctacgcatctccttctttcccttcttcttcttcttcctcttcttcttcttcctcttcttcttcctcttcctcttccctggcagtattttcaccaattctcttgtttaagacggcctgtgcgattttacttgctaatccatttttttcctccaagatttcgttttctacctcaaattcggaggaagaagaaggtgcaacggatgt

SEQ ID NO: 12672 - DNA, 421 bp, Saccharomyces cerevisiae
acttttcatagcatcctccttgtcgaagaaaaaacaaacagaaccacaagctgaacaagatcattatttttggctttcttcctctcatctttttatattcgaatccagtacaataaagaaaaagcaaaatacactacgcactctttgtaatcagccacacaaaatgcagaatttattttttaaacaaaaaatacaattgtacatagacacgtctttatctttcctattactactattcttttatttcaataactattactttctaagtatgacctacgcttctttggtaaataaataatgatccgtttatgaaggacatgcgtggttcgtcaccttaggataatatcgctctggacgaaagctcatcccaccgagatagaaaaaaaattttcgtttcttttttctttggcgaagattttga

SEQ ID NO: 12673 - DNA, 428 bp, Saccharomyces cerevisiae
atttagaacccgcatttgaatatattcgtctttttattaccctgttgtatgattatataaaattatttacatcgatttatattaacttttatccgataaagcaacaaaataacaaaagtatgcgtgcaagaattattaacaaggggccttaccatgtaaaactttcttcttctagttcaacgtcaatcttcaaggaagagtctataccttggaccactgcatttctaaaatcgtcgttaaacgttgctggcccgcaggaataaaaggtaatattattattctctagttctgagagttttatttccgagcgcactagttctttcaaatcaggtcttttattgagacattcaacagtgatttcgctttcttctttatcatcaaaaccttttgtactctcatctgaatttgtgtcctcaacactggaacca

SEQ ID NO: 12674 - DNA, 432 bp, Saccharomyces cerevisiae
ataagaaaattctagaaatagagagagataattatacttgtatatataatttggggcagataagactcctgatatttaagatttaaagtcaattttgccattgttatatgatcatgtcctgaaatatgacctcttgtatttggttacccgctttacaccctgcaaatcacactagtctaataaatatggaataagactgaaacatataaaagatgtaacttctaggatatctgaaagagcaaccgtacggtattcaacgtttagatttgatggacggccttagctttgttgataaagggaaaataccagatggttacaaaaatgaaatagatcaattagtaaagaaggaatttgcgaatataaaaagagagcctgttcatcccgaaatacgaggtatacttgcgaagagaaagggggccgataatagtgttt

SEQ ID NO: 12675 - DNA, 491 bp, Saccharomyces cerevisiae
aaatcacaatcttccattttatttcaaactagctttaaattccatcttcttcccctcagaacattccggtatctcttgttggacacatctaatgtatatgatgttttcaaattctaaatgcctgttagtttatcagtaaccacagtagacgctatatatattagttccttttctatataggtattatacaatacaatcaaattcattgcatactcaaatgtccaagtattccatggtgtaagtgggtaaggctcgcttctgagaagttccgttatcaaaggttgagctagcaaacccatgctgaaaacctttcgtatcaatcaaattccacaattcggtatttctttcagcaatctcaacttgtttgtcaatatataaggttaagttctccaatagagcaccttctaatgaaaatagcccgatagaatctagcacaagggacaagagttgaaatagctgcgtgctttggctagggttgaagcattctggtg

SEQ ID NO: 12676 - DNA, 482 bp, Saccharomyces cerevisiae
agttaagcgtcgccaaaaatattctgcaaacatatatattcatgcacatgtgtaacaatgtaaaaaactttgaaatgaaaagaacaaggagctgatcgaaaaaatatttttttgattttcatttaatatagatttatatacttttatttgctctttaagagaaaagaagtcgtagtgaactggaacataacgaaataaagaggagttttaaaatgttttttgaagaaataaaatcatccgcatcatataagaagaggaaataagaaatataaaagatagataccttaacccattagaaataaagtgatagataattagattaacatagcggcaacagcagcaatgaaaacggattttcctgcctctagaacattaccagaaccttcagagaaagtagaaataacggcggtagaagttggtagagcagaggagactgtttcttgggacacggtcgaagaggcagcactggaagagtgagcctc

SEQ ID NO: 12677 - DNA, 427 bp, Saccharomyces cerevisiae
tcatgattgaggtgcagttttttacacgactgccacgaacaatctctttttgtcgcaaaatgtcaacgcgcgccaaagtgggaagtggcagatgaggtgtacagaagaaaagacagataaggtttataatttcacatagataattgagaaagtttgaaatatataccgctatagctctgaaaattatgcattaacatatattagaattgaattatatcaaaaaaatactaagaaaacatcataatgacagtaaaaaaaatagctattctttatacagatgaagataacgaatggagtaaaccatggggcaattttgttgatatggctatcaagctattagaacagaccaggaaattggaatgtatcgcagaagatgtcgaatatgaagtgttccacgtacaaaaaaacgtgttccctcaattgtcag

SEQ ID NO: 12678 - DNA, 500 bp, Saccharomyces cerevisiae
tgttgtaacgctatgtaattccacccttcattactaataattagccattcacgtgatctcagccagttgtggcgccacacttttttttccataaaaatcctcgaggaaaagaaaagaaaaaaatatttcagttatttaaagcataagatgccaggtagatggaacttgtgccgtgccagattgaattttgaaagtacaattgaggcctatacacatagacatttgcaccttatacatatacacacaagacaaaaccaaaaaaaatatgactctacaagaatctgataaatttgctaccaaggccattcatgccggtgaacatgtggacgttcacggttccgtgatcgaacccatttctttgtccaccactttcaaacaatcttctccagctaaccctatcggtacttacgaatactccagatctcaaaatcctaacagagagaacttggaaagagcagttgccgctttagagaacgctcaatacgggttggctttctcct

SEQ ID NO: 12679 - DNA, 444 bp, Saccharomyces cerevisiae
acaaacaaattaatcggatgatggttattttcgttcgtcaagatctgcacgtaaaaccggcttgaagaaaattagctgagccgggcatttcccagcttttttaatatataatacaaaattaggcaccctccctttaaaattctgtttaaaactagatctggtcataaaacatagataatattgtacgtacaatatggtcacaccgttaggaaaagtaagatctcgctgtgtctagagaatgagttttctttctttttgacaggaaaaaaataagttctgataatgtaaaagttatagaaacaatgtaaaataggatacatttctatattaatatgtacctataatatatgcagattggtatatgtaattcaaggagtatgcatagaaatagcaatccagcgagaataatttaaaaggagtcaattcatcctatgcagacaggca

SEQ ID NO: 12680 - DNA, 492 bp, Saccharomyces cerevisiae
aagattgcatagcatgttctaatattattcaatagatattagaccactgtatataagttatatatatatatatgattatttaggtgtaacttcacggacaactgtctagagtataagattactggaggatcattgatgatttcctttaactcttttgggtcatctaaaatatcatcaaagagcgtatgcgaaaagcgcgttaagaatagattacttcatgacaaaatataattttccagctcaaaaatgtttgtttttttatgtagacactattttcaaactatctttgttaaattactcatcaccatcgttgaaatccagattaatccaacttggccatgctaactcctttcttaaaaaatctttgaatatcgtaaacaaaaactgttctagttctccaacacttcttaatactgagccctgtccctgatattgttcccctatttcggtttcaatcttcatacttctcacaatggatattcgctccaatgg

SEQ ID NO: 12681 - DNA, 427 bp, Saccharomyces cerevisiae
ttcataagttccttttcagttcgaactaatgtaacatatatataaaatactacatttaaaaaaaatacagtacattgtacaaactaaaatcactataaatagcgaatacttttcttatatactattattattatacatttgtatacaccttttttcattaatataatctctaagtgatatacgttttcccttaaaaaaacataaagaatttgctggaagaaaagtgctgcataaacttaaatcaagcacaagtttatatattgcaaaaaccttggaaaacctaggttctttatttcgtattattctgccccggtaacccattatggttttcagtctctccattcatctagcttcaaattgaaccaatctcttagtcctagccttcaacaggattctatgaccacagtccttacaacggactgcatca

SEQ ID NO: 12682 - DNA, 471 bp, Saccharomyces cerevisiae
acaagcagtaaataaaacgtatagaatataagaaggaaaataacaatgggttcttgaaacttgatatactttttcctggaatgaagacgcaaagaaaacctttggagaaaatcattgcaaatttaaaagctgtgcttcaaaaaacccatgtgagactgaaacatggtccagtggtcttcatccggaccggttcaaagtcctgctctaccttcaataatttgtctttaccgttaaaacacaggccacgctattttttttgttgcactaattttcatccttaagcgaccaatttgctcccctttggaaaagctcacgaaaaaacgtggcaaagaaaacaataccgatctcgtaggatttgggccactgttgtaatcgcaagtagagagcatcctagataagagctactatattttgtataaggtcgtttcctgcacaataataaattatctacactgaaatatggctggcgac

SEQ ID NO: 12683 - DNA, 484 bp, Saccharomyces cerevisiae
ctacagagtagacctccgtattttacacatgtatgtacgtacatatgatgtaacaataatatgataatttaatgggatacatgtattatcgtcacttcccacgtttgcgctttgacatttgctccccttatgaacctgaaggaatataaatcatcgatctttttgctacacttttcctcccttattagaaaatagcagtaaaattacaggctattcaaaccctgaaacatctcaattatggcttggactagtacattaccagcgcatctactgaacctgatcaaaaactccaaatatgttcacgtggccacctgttctaaagactgcatcccttcagtggcattgatgaactatatctatgtgccaggtgaaaaactgttcggtcaaacagataataagaatgactacattatatttgtttctcctcaggacacacaaaagttttacaacatcaaggagaaccctaaggtcgccctgttgtttc

SEQ ID NO: 12684 - DNA, 454 bp, Saccharomyces cerevisiae
tacttctataaacggttagaaacaggcttgatttattatgtacagtaaatataatgttatttgtgttttttttttttaaatttttttagttccttctatgtaaaaagacatgacaacagtattctcagtcaaatgatttcaaatacacaatgttaaattctctatctgttgcagaaataagaagagcgtaagagcgcaaagatttttgcagaaaaatagagatgaggtacaaaaagtaggtaatggaaaaaagcaaataatgaatataggggaacataaatgttatggacaagagtagatatcaaaataaaacaaaataaaatagagtaagtgaaagacaaatggaggaaaaaaaaaaaaaaaaaaaaaaaaaaaaaatagtaaaaagtgaaaggagaacgatgataacactaatcacacctccgcattttcaaccaatgctgcaagtttctca

SEQ ID NO: 12685 - DNA, 449 bp, Saccharomyces cerevisiae
gagtgggtataactaaatctttagacgtaaagaagaaaaaatgtatatatacaagtactataatatcaaactaaaaaaacgaaataaagagggatgcaacgaacttggtcatctgttgtcaaacagcgcttgtatgttcattagccgaagtgactttggctcggttccatagcttaaggagttcagtaacaccggaacctactgaaattatttcgtaagctagctctgagttatatttgtcccttttacctttaatattaattagattagacaataagtttagtattatcttataaaaatccaatgtaatattatttttccgtaactccaaattgactttgtcattggtaggtagtttgtactttaactcgtattcctttattgcattaccactggtattatagatacttaaataaatttcatctcttattagctgtcgccattgttca

SEQ ID NO: 12686 - DNA, 486 bp, Saccharomyces cerevisiae
tggtgcaacaacaataataatagtaatagtaacagtggtagtaacaataacaataacaatatcaatatcaatatcaataatatattataatactaataatgaataataataatagcaataagtatagtatagtatagtggtaatatataagtttctttctcttccggtttatttacaagtcatatacaaataaaaaaaagtgatagtaattcaatggcttgtattcattgatacttggacaagtccggcatacttaaaatttccttctctttattttcactgaattcttgtagctgcttcagcaatttagaattggcccacttgtcaggcaaggggctggttttgaaattttttgtggcccaatagtatatgtcccagtccaactcattcaatagcgaatcgtattcttccagttcctcttcgttcatcttcttcaaatatttggcagcgaacccagatagcagcaagtccgtctccaagatccct

SEQ ID NO: 12687 - DNA, 466 bp, Saccharomyces cerevisiae
gccaccaccacatttttagagtagtatatagacccaaaaactgtaattatctttttaaaaaagtaaaatgacttacgaatgattctgatgattttatttattacgactcatatacccagcgtaagaagtgatcaatagaccgctactttattcggagaaagagaaaagaactttccattgtaatgtatatataacaccaggcatgtgtcaaaaatgtgagactaaatagaaagaaaaatacgaggaacaacaaataatacgatcttgtgcatattttttccctttttttttttaattctttttttctgaaatttttcatttgttcactgtttaatatctatccatttttgtttccgaattttcattaactttattacttatttacgatacaattttccctttaatctagtacgaaatgacaacaacctcaacaaccagtgtagatggcagaacctcctcgactttg

SEQ ID NO: 12688 - DNA, 489 bp, Saccharomyces cerevisiae
cccattagataaatagacaacctgtacttttttatatttttttagggaaagagaagggtctcttatatttaacgcttattatgtgatttctcgaaatgtcaagtgttacagccatatggctgactgtgtttacgttaattagttatatataaacgataagccattctgatgttatcttcttgtacttctaattaataatatttactcgtcagaatttcgactttaatgagaatatagatatcttcctagttttccaaacattagagaaccaaggaaataaaaatccatgaaatataaaaattgggaaccgtcgataatatctttgtagcaagagatacaacaacccaccccaatgcagatgcagctcattaacatggatattgagccgtcaaaaaacaaccacagtataatattcagaagcccccatgcccctgccgcctgcaaagaggagttccactgtattttcctgatcccaaatgtgactcccaa

SEQ ID NO: 12689 - DNA, 424 bp, Saccharomyces cerevisiae
ttctttaaggcgacgcacctgtttctacacacaaatatatatatagccaattttatatatacgttcctatatatgacccaataccgcacttatttattctttaagatctttataacccaaaatgccgattaacacaaacctatatttactaggggcacattttttatttttttgcctttctgtaaaatacaatagagaaaataaaggaacaaacaagaggaaaaacaggaaaagatagcgcaagagtaatcatattcaacaaaatatcagtgattttttacagatatcaagataatttctttccggatacttattgaagctattatttgttactggcaagaaaaagcaaacataggcggtcatttttcttttgtataaagtaaatacaagaagaattattttcgaggaataactaggtgtgcag

SEQ ID NO: 12690 - DNA, 495 bp, Saccharomyces cerevisiae
cttaaatgagaaaaatttcgtaatgagataaaatttcgctccttttctgttttctattttctattttcccaacttttgctctattcagttataaattactatttatccatcagttaaaaaacaagatcttttactggtcagctaggaaagcgaaaatacaaagactttatgcacttagtgatatatatgtatagatatatccatttttacgcacttatcatatatcttagttatctaaatacaatctagttattcgtacacaatcgcccctgttatccctatagtgggaataaagtaatgcactgtgacggggttcttcgcccgggatagggtaaaaggatattgccgtttcaagaaacttcggggataatcgaataagataccgagaaagctattgttcgttgtgcacgtaggatgtatattgaacaagcatgaccagaatctgatgcattacgagaaggttacgggatgatatcagacctccgaagtccatgt

SEQ ID NO: 12691 - DNA, 474 bp, Saccharomyces cerevisiae
cacatccaagtacagtaaatttgtcatgactattggatgctactgagttgtggaaagactctaattaatctatattagagattaaataattatttataatttttgattataaacatgaaataatcatgtatgttttatatgtaaatacgctataccacttaaaaattaatgaaaaggatatttatgattcacaaataattaaaagatcaccttttttcgttccatcagaaaatcttatgttcgaaaaaagaagaaaaagattagtaacactgagaagctgcgactaaatgttatttttttgaataacaatcaaaagtgaaattgtataaacagaagaaaaagcatgaagttttgttttcattattatttttatactatgaaactctataaaatctgaaataagtgaattctacgttgataaaaaaagaccaacaaacaactataaaattacaccctgattcagttgtacgatga

SEQ ID NO: 12692 - DNA, 484 bp, Saccharomyces cerevisiae
gcatttcgttcacttaccaaacaattaaggtttataacctaacctacaaacattaaaaagacattatgtttaagaatttttttttactttttttttttcttaaagctggctccccttagacaaatacgctatataaatccaagacattacttctttccctttttgcatgctttgatatttatggattcacattagaaaaattataatatttggctttatttttcttatttaacggtatactagcagaaatggctttagaaatgatcgtcgtttctctttatgattatcaaaggaaaaataaaaatcgaaaataagaattaagaagtgcaatctaaggcgcatttcccggatagtttagtagtttttttctttagttgcatttgtaccacaactggttaataatgaaataactattaataaatgacccattttatctacttcgcacattatgtcgaaatctttaaggaacatcagatgcaaacca

SEQ ID NO: 12693 - DNA, 455 bp, Saccharomyces cerevisiae
caggtaaagttttcttgccttatacaccacctattctggcatctgcgggatttcgcttcctattttacaaatattttattgattgacgctaattatcactgtaaaaggcgcactttttatatgtagtcacatccggtatttaacatatttacgaaacagtcttaagaatatcgacatttgatatacttatgtttaatttatctacatattacaatcatacgagaaacacgcaaaaacaattacttgaatacttcgaaaggagaccaatttggatgtacaacccttttttcgcccttttccttcgatatgttattgatagcttcaaagtcctcagtagacaaagtaaatattttcctgttcgttttgattcgatcgggattcacagattttggcaagacaacataacctctttggacgtgccagctaataacaacgtgtccgggttgaacgttatt

SEQ ID NO: 12694 - DNA, 496 bp, Saccharomyces cerevisiae
aatctcctgaaaatctcccgaacgtaaaaagtataaaagtataaaggatgatacatgtaaatacagtaatattatcttagtttaatgactacatatggtataatatgtgaaatatacatgaattaatgcatctgtggggcggatgagtctagtctctgtatgaatccagctatacatcaaatcgtatccttttatttacagggcaagtttgtcatatattttaagttacttgtagtttttttccagctcaataaatttttcccaaatttgagacattgtaagtttctcgaaactctttctattatcacgttctcgaatgttgtatttctgtaactgtacttcctcatcacccacgataattaaataggaatagtttttcaaaatggccgacttgatcctataccctacgggttcgtttcttatgtcgagatcaacattgaaatgccaatcatttaaaggaactggttccatgtcgtcggcttccagttcattacgt

SEQ ID NO: 12695 - DNA, 471 bp, Saccharomyces cerevisiae
agtagatgatagttggtttttattccaacagtgtatcaactagtggtcatactatcaatatattatcatatacggtattagatgatgacagaagttatggaaagcttcgaagttagaggaagctgaaatgcaaggattgataatgtaataggataatgaaacatataaaacgaaatgaggaataatcgtaacattagcatgtagaaatatagattccattttgaggattcctaaatcctcgatgagaacttctagtaaaccctgtatacctaatattatagcctttattaacaatggaattccaacaattatcacaaaattcacagaatttccagtttaatatcaagaataggtggataatacggtaatcgtatggccgccattgttatgaaagacagttattcctaagtatattgaatataccagggtcactatcgagaatgtagaatttcccataaggaaagccatgag

SEQ ID NO: 12696 - DNA, 448 bp, Saccharomyces cerevisiae
aaaaaggtataacacatacatatagaatatgtaaaaatatataaataaataacatgcatttataacccatggtactattttcttccccttattcgttactatattcgtcgtaactactgtcgctcacgcacacttgcaaactgttctcgttgaataagaagctttcctctatatcatctataccatcactatcgtcgttattgccttgcccctcctcttctcctttaccatgctctaagatattcttttcagcctgcttgcgagtcacttcttttatgatacttacaaacagctcgcttctcttaatttcgtagattaaccagtccattctgacagccagctgtcttatgcggtttatcatatctgtcttagtctttgtgctaataggaacacattttcccataagcatcagagtgctttcaaattttttcaatttctcccatttggc

SEQ ID NO: 12697 - DNA, 482 bp, Saccharomyces cerevisiae
cagttgtttactcgaattttgcaatcaaccctaatttttgaagcctggttttagatttattctcttctttttcttcttgtgaacttcaattactaatgtaacttaatttttaatataacttttacagtttaataatattgatttttttcggtctggaccaatcgcgccgcatttctcactaatattactaacataccctcttctcattggctcggtacccctttcgtgacccgcattttttgttttctttgttagcccgaatgtctcacaatgaagatgtaaaattaagattatatatgaaaaattgatacaaaacaaaatagttcaaataatcaagttaaagcgacatcactctcaatttttgctttttttaggtttatagaatagaaatataacagaacgaagcctttagactctttttttttattggtatattgaacaaagaaactttttttttgtcctcccatatctcgtgcacacaa

SEQ ID NO: 12698 - DNA, 410 bp, Saccharomyces cerevisiae
ttttcatgtaaaccctcttctcatgtatctacgtatctatgtgtgtatgtaaatgtacctgtacactccccacaccctcattttgttactgtcatgtgaataaaacttatgtatattgctaacttactaccactgcacctcctaacatcaccatactacgtacaaacacgcctatttattttttctatgttaaattttaacgatgtagacacacctaatgatctgatgcgctttgcatatctcatattccttcactagcataaaaatccaaaaaaaaagaatatttaggccgaatggaattattcgtaacgtcatacgaaaaaagtttcaattcgtacaatgcctggcatgttcattcgaatataaggccgccgccttccagtcagggtagccaaaagtataatcccggg

SEQ ID NO: 12699 - DNA, 499 bp, Saccharomyces cerevisiae
catagcaaatgatagaaaaatagtcaataattgaacgaagaaaaaaaaaagaaagtttgttcataaaagaatatcatattatatatatatatagggtcgtatatatatcgtgcgtcttcttccttctctaagggtaaaattccttgtatttgttataatagtagtaactgccgagcccacccaaagctgtcaaaacgacagggacaggtttagtgaacctggaaggcatgcctcttatgacaccagcaccaagtagtaaggtcgatgcacccaatgccatttcgagcccaccatctctattcatatgtagcaagtaaccggcaatcccatatacactaccgaatactaagccagatactagagatggaatggagcccttacggtagtatcccataaggccaccggctgtagtcaaaagactcaatgtatatgctggatgttccatagtgtgatctgatgttcctttctctcaaacttcgtttctgtcttgtctcccgct

SEQ ID NO: 12700 - DNA, 457 bp, Saccharomyces cerevisiae
tgctaatgtaatgcaatcatgttttgtctccttcgttttgttctgccataatatttcgctcatattatttttgcttattttttcccctccgtattaatactttaaataacaatctaatggaggtactggactctatgtactattatatttacccttaaaatatcgtgttgattactatttgtataaccgtttgtttttctaactatatatgaaagaaaagtagttatagttatagtagttgaagatttaaaagctatttgccctctttgggattaaagtaagagctaaacataaattatgtaacagtttaattttccgaacattaattgttgttaaaggctttaatatcaagtatactgaatatgctagaagttccactcaagcatataagaatatctgcctaaattattatttatcactacaacttggctacaaattatgaacaatgaggccgaca

SEQ ID NO: 12701 - DNA, 421 bp, Saccharomyces cerevisiae
aatatcacaattaacattctacaaccaaaaagaaatttggacaatatttatttctattaaactgttctaggtaggtttcaaccttaagaaatttatacaatattatcatatatatatatatatatatatagcacaattcccttacgtttaccaaccatgaacgttcgtggaaatcaatgcattatgtctataagagtattcctaaaagcaggagaaagttcgctatcatttgccattaagtggctcaaacggtttgaggccactacgaagaaaaatcaatatatacaaaacggttggccactaaaagatggaaataaaaaaagaaaataaatactactagtaaacatttatagaacgtctttttgcaactataatcaattctgttcaccatattattctttgcaaatagggctcagtggtc

SEQ ID NO: 12702 - DNA, 476 bp, Saccharomyces cerevisiae
atggcatgagttcagagtcaatatgccataaatacagaaatgacggcaaatcgatgtatagtttattctttcctcctctaatgatataatcgccactgacacttttatatatatactaatgatacgatatgttataagtacaattttaattcgaacatttcccaaagaaaaaaaacttgatttattattatgatgtttatatgtgcaacacagaaagctctagctatagtaattaatgctagagctcccaaacgaaaaacctcttttagataccatgcaaaagttcttaaactattatttactatctgaaacaggatgaaccttacagtacccatgaactttactcctacaacatacgcaagtgctgaacccacgtaaacccaaagaaattctgcaatcctcgcaaatggcaaaacatcggcagggccataatactgtatttctttcattgactttgcataccgcgcaagatagat

SEQ ID NO: 12703 - DNA, 412 bp, Saccharomyces cerevisiae
tagttctatatcgcgacgtattgtaatattcattggttagtatattccggaatatttattactaatattacaaattgattggttggcagctccttatttgtgaacaaggccaaaaagtactgctacgagcttattcaagcatacatatatatagctttaattccaaaatcatcgtcacaggaatctgctttaaaatccagtaaaagactaacctagtcaaaggggacatagaatagcttacaagaggattcagtttggagctaacactttcttcggaactttccagcttcgtacaaaagtgcagatacgttaaaagatcagtttatccgtatgttttgaaaaggctatctagtgcagaagtctctaatttcaatataatagcttgctaaatagtcttcgaggcgttgcatat

SEQ ID NO: 12704 - DNA, 489 bp, Saccharomyces cerevisiae
agacacattctcattcgaaatattgtaaatactgctatgtcttctatgtacttaatcttatttatgcatttgaaaaatatttcagccttatcgtggtggtacatgtacaagaaaattcataggcaaaagaatatatagaatagagcgtatgtgttacttttctaagtcttacttcctgtttttgagtagtccctctttgacaacaaaatatgcatttttggattccgcggcaagtccagttgctttccaagatccgctaacttctcctagctcagcatcctgcttttggtggctgatgccttcaagtagctttgtgtagttcagctgtttcgtatttctttgcaccaaccgagcatcatattccttggtgtgcttttcaccttcgacaggtatgttatggagtttgttgatgaatgataattgcttggcaagtcgcatttgaatttctttaatatctgctccttccaagggaagacctgataaccgcaa

SEQ ID NO: 12705 - DNA, 462 bp, Saccharomyces cerevisiae
aaggaggagcaaatcaacctggagtgctagaatgagtaacttagaataaaagacgaatatatgcactttacacaactctttacctgtttgttattggctgcctctatgtaattaaatattatggaattaataaaaatatttttattcgtaactatcttagatatatattgtacattgtcaaaaagacagtagtaagcagatagaagctatattggatgcaaaatagagaaaaaagcagaaatattatgttgcaaatgtcaagtaatggaactgtatgtgatatttaaagaacaatttctatatgctggatgattatcaggtgtaagcaataagaaagaaaacgaaagtaactcccatccgtgggaaatttcaagaaaaacttagagtatcagcgatcgttttaacgaagggggattcgtaaatttcattaatcgaccaacgttggttcttcctcgttagcgt

SEQ ID NO: 12706 - DNA, 493 bp, Saccharomyces cerevisiae
aatttataactagatgaacgatagatagtttaaaaacaagcatttaacatagctctagattccgtacgcagagaaagacatagttgcatcatcgacacatgcaatatcaaaagtaactctttttgactgctggtgtaaaaaacactcacgatgggggtcgaacccataatcttctgattagaagtcagacgcgttgccattacgccacgcgagctaatatttgtttgatgttccagcagttatatgatctaattatgcgggaaaataattgaagataagtagtttgatgtatttttattatagtattatattttctgatttggttatagcaagcagcgttttttttcttctttaccataatcattgtaccaggaaattttgttcataattattgtgttgattgtcaatggtcaaaggtacaactaatgaagattaaatatggtgaataggaggcctgctagccaccgtacatttaatatgtccgcgtgttgga

SEQ ID NO: 12707 - DNA, 429 bp, Saccharomyces cerevisiae
taagctggtccgtacgttggggcagtttcgagaatagataaaaaaatgaaaaataaaaaaaaataaaaaaaacacaaaataatggaccgttactatgcccaaccaagtaacctcccaacttatttggaacattacatatttagcgcttaacattacatacatatttagcgcttaacattacatacacctttatcgacgaatttgtaactatttcttactcttgcgctgaggaacgccccagtcgtacaaaagcacctctgcatactaagaaacttaaactatcgccattgtctcaaaatagcaaaaaacgcaaaaagcataccgctgggcgcttatctatattaacctacacgagaaaagaaacatgattgactgcgtcagattcaaaaacctgcaaagtttgtttttataattttggcgttcagcaag

SEQ ID NO: 12708 - DNA, 492 bp, Saccharomyces cerevisiae
gacaaggattaaccattagaactgccggcatttcctgacaagtatatatattcgtaatctcaatgtatatttttttcatatataaacatgcgtacttaaaaacttaaactcatcgttactgcagtacaatgttctctaatggcatctctctaatggtactccaactaaagtcaacattctctccgtgcaagaatgcctttctctagttgcaaaaacgagtcaataaacatctttgatcgagtcgcctcatttttgttgactcggtgactaaaatcagtgccatttctgtccatgcctcgtgcgcgaatgattgaatcgaactaatcccgaacacaatcatagtatcgtatcgcccattagtgccgtgagtgtacgcgaggcaaaaggcaccatggaaaatattcccttagtcatcttggaaatcattgagactgtaaaggaactcgcaaacgggtaaccgatatttaccccacctttggtcgagaaattcca

SEQ ID NO: 12709 - DNA, 414 bp, Saccharomyces cerevisiae
agtcagagataaaagagacgtataggacatatacaatattcatacctttcacttcctccctatttcattcgaattatttagtagcgttatatatcgcactactttattcatatatgtatatatacagagtctgagaagaaggaaaagatcacacgttcaatcacaaaaattctttggctttctttgcgtaagcgtgacaatctcttaaccattgcttatattcctttaaggaacctatcttttcaccgtaataatctggaacaggattactgaaactttgagaagaggcatcgaccctgttattgatgatatgttttagaaactctttatttttgttgttgaactgtgccaattgttggttatgggaaagtttgaaaacttgcgaaccaactatcggacccaacaagtagccta

SEQ ID NO: 12710 - DNA, 428 bp, Saccharomyces cerevisiae
tgggcatagtatctcacgtatattttgttagattagatagttattcattatcaaaaaaaaaaaaatgcatgacctataattttacaactgctctgcagagacgagagacatctcgcaaaaaacagcatatgtcagcgaccaataagtataaaaaacacatattccgttatttggatatgcccattattaccgaagggcaatcggaatgacaatttttatgattggaattgtataatatacagataatttaatctatccttttgaagtgtgaaaagggcagagtaatgccggtattatgtaggataatagttttattatataacggtcccgaaaactctcttccttgcactattactctctttctcctgttggtcatattcgtcaacgaattcgtagttatgccttagattccattgttgcttgacgaa

SEQ ID NO: 12711 - DNA, 459 bp, Saccharomyces cerevisiae
atttgggtagtttaagggaatattgtatagtacgtgattctggctagtatgaaaatgcagtgaattttcttgtttcattttcaattttctagacctacataaatttgataagtttttaggtgataaatactaattataattgatcgattatatgttttaatctcgaaggagcagtggccgttttcttatccagaaccagttcttttaagactcgccagtttctttttagctgtaataaggaaaaatagattgatattagttacagttgtgcttcacgttgttaaaacgtacaagaaaagtctttaactgtagcaaccaaaaaaggtacttgatgtcgatattaagccgcatctctagatctaaaggctccactctactgctccactttactgctccaaagagtcggcttacagataggctaccgctacattaataactgtgctggaaaaccttgtttcc

SEQ ID NO: 12712 - DNA, 466 bp, Saccharomyces cerevisiae
atggcagagtaccaacactaccgtgcttgtttaagtgttcttattttgatgcattatttagatatatatctcttcttgtatagttttctttgaggatggaacgtactccatatacctagcacgtctattatgaatgaaacttccagggttaattactttacaaccgttgtatgtcaaatcaaattgtgcagaagtagtgtcgcaaagaaccattgtcgatggtattgggcaaagtgtcaaagtgtggtccaaatcccatgaaattgggcgcaaggaatcaagaaatggcgataaatgaccctggtctagtattgttttaacgagttttcttgtttcttgaaccttttgtggtaactggtctggttctttaactaattcatcgattggtacaatatcggtgtctttagacatcatgttatcgttttcagtataaacatcttcgctctcgttgaatgggaattccaaa

SEQ ID NO: 12713 - DNA, 443 bp, Saccharomyces cerevisiae
aatcagcaaatataactaccactaagcacttttggtgcacttgtgtatgtatacatcttaatagatagatgaattttggtgctgaggagagcatttttctaatcttgacctcgttgctgcctggctcgtctctccattaattcatctaaactagttatcctctccctagtccaattcctccaattactcgctagatcaggtgtaatcccaccataagaagtcggctcttggctgtattcgctattataatcatgctctcttcccacgtcatcttcaaaatccggattcatgtccagttctacctttgaatcttctccgtcgttatcactgtcaatatcatatgggtttctatctaaatgatgagcctcttccacaaactgttgtagggagcgtgacagtgaagtgggtctcattaataagtcatccggcacaattctctctct

SEQ ID NO: 12714 - DNA, 401 bp, Saccharomyces cerevisiae
ccaaaactggaacaccaaaaatgaggcagagaagataggaaaaagatagaacaaaaaatttgtacataaatatttataactctgtaggcttttcttctctcgtatttttactacgtggccacatacttggtaacctgacaaattggaatcttggttcaacgcatcgttcaacgaaccatttttttatttggtattcaatgacactgccgatcttgggaatattttcaagtttagaccgtgagccaattagcgacttgatttcaaattccattctatattcaggagaaaaagaaaacatcaaaaagtatcctgaattgccctccataccgttttcactactgctaccgttcgaagtagaagcaaactcctctgcattagttaaagatacggtcaaacacgcc

SEQ ID NO: 12715 - DNA, 458 bp, Saccharomyces cerevisiae
tactgatggtgcgttttgcggaggcttaattttttgaagtttatttaatactatcctacatatgtacattaaatacttccgtaacgtttatcaataagagtggaagatgcgcaattatattcaaaagattggccagtcaattaacttaaggaaaaaatttactgcgcggctgtggtcccatttgaaacggggacgttagtgttgcttttgtgtttccttcttcttctttttttcttttctttagaagtatcttctttgtctttcacctcatcgctgggcgagttgactttcttcttcttctttacgctcaaaggattaggagcctttggaccaagctttcttttcttagtgatagattcctttcctgatccatcaccactttcttgaagtttttcaatattaggatcattgagacccttatacaatttttgttcttcagtaatcttgcttgccttggc

SEQ ID NO: 12716 - DNA, 456 bp, Saccharomyces cerevisiae
atactattctctcttcctttctggcctcgtggctaattacggaaagttgtatactgactactatgtaatctatcacgttttgtcactgtctcgctcttttcaaacaatccataaaatcgaaactattgtcaaaacgtcagtacatcctacctgatagggactgtaccaatgtcaacgttcgagtaagtgataataaggaccgccttacccaccttcaggacactcggttttacacaagcgttatcctgcgcggattttcaatatgaaaacaactaagttttcctgtaacatcatatataccatttaaaagagtgccaaaaaaccgataacgattattttaaaggcgttttatataagagaagaagtaaagagaaaaaagcgcttactagaaatggggagaagggtgccaaagagataaaaaaaactcccagctaagtcactggttcaacgttccaa

SEQ ID NO: 12717 - DNA, 454 bp, Saccharomyces cerevisiae
tcataaggtaatgtcaacagcttaaagttgttctcagggccccacactttctagtttggcacgtcatttatgaaattcacaaattggttacattaagtactaaatctggtagccgaccaaaaaagaacaacaaatatacaattgtatgagtaaatatgcaatataaatcaaatgtatttagttaaagggccagaagtaaggctacagactgtaaaagaaaattagatggaaaccctcttcaggaaaaaaggacattataaaagatacagccaagaagtgggcgtttataaaacaattatataacatgaccgtcgattatattctgacaggaatggcgacgattgcatcgttatatttcatttcattcccaactcaacgatactggtatcaaaaagcctctctgttcattatttgtcccactacaagcgactctcttatttttggcggtctctgc

SEQ ID NO: 12718 - DNA, 490 bp, Saccharomyces cerevisiae
tgtaagccataaacgaaattttaaaattaatagtattcattttaatcttttttgaaagcttaattttatcatcataatttttcttccaaaacttcaatcttggtattttttttcgcattggtcttcattttttttcttttgtttttagctttaatgttgaaagcgtgaatatcaaaacacttttataataaatcaccactttgtaactatagagaacaattcatgctttatttatagatgccacgattaagcatcaatcattagttgagaggatccttaacgttaaaatccaccgcacttttcctttcaaaaagctgcattgtttccataattcatttcatggcaggttaatgacttatttgatatgaagagtgaggttcttatcaaatgaaattcctacatatgaattttttaaaagagagtttttcgttttacgatatttatttacttcatcatcgtttatcatttttcacgtagcaaattttgaagc

SEQ ID NO: 12719 - DNA, 473 bp, Saccharomyces cerevisiae
gctgtgtcttaaaatataccatccaataccttgatgaacttttcaaagatgactaaaataagtgaaatttcaacattaacttcgaatttttttctttttatctaacacttgtcaaacagaatataaggattacttgtcttctttgctacatattgctaccacttctattacacaatagtttcaatagcttgcagcgtagctaaactctaaaatttatctaaatcactcatataaaccgaacccttccccttccgcttatagtacagtacctatacatttcataaacatggcatggcgatcagcgccaaacaatatggaaaatccacagaaagctattcattgaaaaaatagtacaaataagtcacatgatgatatttgattttattatatttttaaaaaaagtaaaaaataaaaagtagtttatttttaaaaaataaaatttaaaatattagtgtatttgatttccgaaagtt

SEQ ID NO: 12720 - DNA, 455 bp, Saccharomyces cerevisiae
ccaaactgatagatagtcgcgtatacataaataacaaaaaaacaaattcaataacataaaataaaaatacttttacatacagaagaagaaactttatatattcgacaaaggaaaatgtaaaaaaaaaaaacacattattttaaaagaactgcgctcattatcgtcgttaacgattttattattacatgttgaacgttacattgtctttttgtcccgataggttgaaagctgaaaaagtataatgggtcagaatctgacagttccggtaagttctttggggatccttctcttagtcccggtacctttaatttgctccatgtatcttttagcagctgctctaccgaagcgcagaatcaattttctaaaaaacaacccacaagcattacacaggcaagcagcaccgttagggccctccctccattgtaatgaagtcttaatctctccacattgcccac

SEQ ID NO: 12721 - DNA, 427 bp, Saccharomyces cerevisiae
ctgcagtaattctttttgcactactttttttagtattttgtcgcatatatactgcttcaccatttgtacattagataattcttcactaccccctctatagcaatgttatagtcattgaatcatgctttgaaatgcctgttctaatattctcttcatataataaatgcgtgatgccgggtatttgtgcgcccttgtttggcgcaaaaatctcgaaagtgaaaaaactaataggcttcttaaagcagttatatctacagcaaaggaaatagctgctgaagactgaagatgttggcgcgcagtttgggttacaggttgatatcgaccagtcgtatcttatataataaacccacggttaagtcagtggtgtcgtcgtgtcctgcgggaacatcgcttaacttaaacatatggaagagcggtaaagacgcag

SEQ ID NO: 12722 - DNA, 417 bp, Saccharomyces cerevisiae
aaaacttgagcataaggcgtataagtattttactacaatcatgtacatacatcaataataacaataaaatgggtaatcacttaagaatcttcaaataatattctttacttttccatgaagttggctaaatagtatttagtactatattagagtattggaactttgaagaaccaatttacatacaatatgaagtgaaaaagaaatgaaaaccccgtggttataaattagagactagttaataaaagggaaaaaatattggaaatttaaagaatgatacgccaccgcctctaatcatcaagttcggaaggttttaataacccaccaatcttggcagctttttccctctctagtctattctgttccattaatgcattctctttatcttcagcaaacaaataatctgttggatcacctccg

SEQ ID NO: 12723 - DNA, 426 bp, Saccharomyces cerevisiae
ggcagtgattggcatggttcatatattaaatcaacgcagatacgtagatctataaagcttttgaataatgctaatgtattatatatttatattcttcttgtcccgcactctggtcttttcaattttctacatgaagagaaaaaaagactatagcgtccggcaaaaaaaaaaaagttatggtttaacaatacaacggccccatgggtttaaaataagggcactttcataaagtcacttatcactcaaaagcacccatgcaaaaacacaatataaaattaaaccaaaaccaggatatttcccaattattccacgatgaagtacccttattcgacaactctataacttcaaaggataaagaagtcattgaaactttatctgaaatatattctatagtaatcacactagaccacgtagagaaagcctacc

SEQ ID NO: 12724 - DNA, 426 bp, Saccharomyces cerevisiae
ttatttatgaaaattggcctgtaaatatatacataaataaatatatgcgtcaagctcttttattcggtttgtccagtaatcctcttacaatatatatatatatatatacgcatgtagcgtattcaagaacattacatttaaaaaatagagggtagaacaataaaaatgcacttaacaagttccgtaagtagaaattataatcagtctaagtacaaatttataccttagcttcatttcagttaagggcgatgcaataaaagtggaagaaaaaaaaagaagggaagaggtttgataatatatatatatatatatatataacattgctcagagaaacatacatcagtgatggaagataaagagcagcaagacaatgcgaaacttgaaaacaatgagtcactaaaagatctgggagttaacgtgctttcc

SEQ ID NO: 12725 - DNA, 476 bp, Saccharomyces cerevisiae
aaacaactatacccgcctgctaccatgtgagagttggcgttagcatattttaaatcaagctacacaatagctttaaggagatatagaaggtatgtacatccacaatatcgtatgttttggataaatgcgctactatgtaggtatatgtatgtgtatgctaggtcatgaataataaaaaccgaatctataaatttctcaatgtctcatcctcattcatggctcttttggcttcttctactgatatatttagcttgacacaacatattctatcgttcttcatagtttgtttaaacaatattcccgcgtcaagtaactgattgagaacgaaatcccatgatataattctcaattgttcagaaatattatcacttccctgttggaacaatgttttggctatctccatgacaaacttattactgccatttacttcaataagtaacttgatttcatcgacaatatcgcccagttcttgctct

SEQ ID NO: 12726 - DNA, 484 bp, Saccharomyces cerevisiae
atacaaagctaaacagtctcctcttttaactttattacaaatatgtacacgtatagctaaaattatataaaatgcatccgtttttttaggcttttatctttaacttatttacatcttctattaattcttcgagtaaagtaaactctgttcctaattctttaaaagcatcttctaccatcaagaaagtagaacaatcacttttttccttccattttataaagatcaaaatctccctgatcaaatgggatattgtattctcttgatttgtaccctgtggaatgttttttaagattgactcattattcattagctccgccttccgtaacttgtactcacaagcatctttactgatgttactaatatctcgtaaatattgtcttttcaaaccctttagaatatacatactcaaatcgtaatcaatattcaagtcaaattttttcgttagaaacgttaatatggcaggtattgcttctaaatccccgct

SEQ ID NO: 12727 - DNA, 411 bp, Saccharomyces cerevisiae
actttttattaagattacgtccctacaatttaattttgtatagcataacagatacattgacaacagcaacaagatgtgctaacattttccattttgaatgattaccaaaattatgaaaccaaggcaacatgtaatttttaagtttagtaatctttttcgggatgagatgttttgaagagttttatgctattaaagtagtaatatgatttatatattcaaataaaatgtaaattatgaaagaaaaatacgataagctgatagggtaaactagaaaccttcgttttcttcatcatccacatccagtttctttctaccgcccccatttcttaaggcagccatctcattagtggcaacttgctttctaaccttctttgtcatcctggctatctcttcttcagcgtcaactgcatc

SEQ ID NO: 12728 - DNA, 435 bp, Saccharomyces cerevisiae
cttttgcttcctgtttttgtttttgcataaacaaatatgtgataattaactagcatataaaacatatacatatacacagacttatttttttttgagcatctatatttcagagaattttgtttggcgttttttctctggtattgatctggcaattttccatgatatcttctaacagcgaggtgaaaaatttgttaaagatgagctaagcttgtaaattgtgtaagttagggcatcacataaaaagaaaactcaatcaaggggaacatgaatggaatatttgctattgagaagcctagcggtattacatccaatcagtttatgctaaagttgcaacatgctttaactaaaagtcaagtattctcgaaggaaattcaaagggcaacagcggaaagaaagcagcaatatgaaaaacagacaggtaagaaggccagcaag

SEQ ID NO: 12729 - DNA, 433 bp, Saccharomyces cerevisiae
accggaataatttttgtagagaatccttgtatcgtctaagtagtctagatgttcagctgatagattttcgttgtattgtatatataataattgtcggaaaacaaaaatacttaattgtaattgtgtgaccgaaaatgcctgatcaacagccatggcacatttgaatgggattttgaggagacaaaaatgaagaggttctataacctttgtagaagaacattgacctcttttcaatgaaggttggtggcatcgccagatgcagaaaggttgtctcatgaaataaaaacggacagaccatgaaggctaaaggaaaaaaataaaatgccatctcctagaatcgaaccagggtttcatcggccacaacgatgtgtactaaccactatactaagatggcaaacaactgtgaagtttttggttacatctgcacatctgg

SEQ ID NO: 12730 - DNA, 453 bp, Saccharomyces cerevisiae
tatatgacaccatgtattctttaccatatagcttcataacattgaccaatcaattttcagaaatgcgtcgcgcgtagttttgcccgatatccccatcccttcaggatctttaaaaggtgatgaaagatgcaccagatagaaaagttgcattaaaatgattagcagagatatacaaatattttagtaagaatacataaagtatctttgctttcacaaataggaacaagcacataaatacagtataatagacatggctgatcaagaaaactctccactacatacagttggtttcgatgctagatttccccaacaaaaccaaacaaagcattgttggcaatcttatgtggattatcacaagtgtgttaatatgaagggcgaagattttgctccgtgcaaggtcttttggaagacctataacgccttatgtcccctagactggatcgaaaaatggga

SEQ ID NO: 12731 - DNA, 466 bp, Saccharomyces cerevisiae
gcattcttatgtaccgcattaaatatattaaaaatcacaaatcgactggcgtaggatgtatgcgcctctttttactatcgctactattgcaggggatcttcttcaccggcagcatgttcacgatcccacctgcctcgcgctggttcttagccgctaccgcgctctcgtcagtgtctagtggctctgcatgcatcgctggcggctctatccttgaaccgaattgcgtttctgtgtcgatcgatacatacgaacagaatccgtctgttgatgagattagtagggtcgagccatcctcagaccatgctaaatcagttatgggtgagtaatgtatatttcccacaacgcataacggctccaatacatccgtgtcgtacacgagtacttcgttagtcgttgctatggcaaatactagcttatagggcagcttaagcacactcttctggcacgtttcgtaaaatacgggcga

SEQ ID NO: 12732 - DNA, 435 bp, Saccharomyces cerevisiae
ttttgagcataccattttcttagttatataaattactgtctatagtgctcgtaaagaaaggaaaatattcgtactaataaatgtctctataacagcatggaaagaaaacgattaggttttttatgtttagatgtaaaaattaatttttttttcaaatatgctgccgtgaaaacgaattcaaatagacgattacacaatattttgaataattacatgaagaaacattaattataaaaattggaattattctgtctctcagggtctctcattctgtggatactaacaccagaactatcgatatctgcaattttcccgatatcttgaggagtaatgataatagtttgagttctggcaatatcctttagttttttcactatgagagtagtaccaatcttcctgttaacctggtccatgaaaacgtcgaattcgtccaac

SEQ ID NO: 12733 - DNA, 455 bp, Saccharomyces cerevisiae
ttataatacttccaggtcgtgtatatatgtagatatataaattatgaaacataatatatgaaagcagtttgagcttattcttaatcatcaatagggtaacggtattaatctcattttttctttttttttttctttttattttggcgtctcgtctcaatttcatttttcccatctttttacaacttcaatatgaaaaacataacacatgaaaaataactgtcaacattaataatattccttgcatagtgcttcgattttccaaatataaaaacagtttcttttacaagcttatttaattttggttttaaggagaaagcactaataaaaagggcaaggactgcaatcaacaatctttattggcgaacagttaagggtcctctcgagaagaaacattaagacatcatcgcacaaaaaacatggcgcccatctttagaaattaccggttcgctatcggt

SEQ ID NO: 12734 - DNA, 462 bp, Saccharomyces cerevisiae
aaagaaaatgcccgtaattcgacaagttttataaaggttttactattcaatcatgtacatacatcatcaaaaaataaaaagacaatgaagcaataacggtaaatatactttagtctatgtattgacgtcaaaattacctttcttttacctttcttacctttttacatatctcagcgaccgttgaaaaaaaaaaaaaatgaaaaattttggtgatgacttcagcaaaaaatttcaggatatttctgacatttcactttattaaagcgccacaaaagctggattagtatagattcagcagttcccataggataaaattttcaagcgtttattgttaagatgaaagccaagccactaagccaagatccaggctccaagcgttacgcataccgtataaataaggaagaaaatcgtaaggagttgaagcatgtaaagatcaatgaaagttctttggtgcaagaaggc

SEQ ID NO: 12735 - DNA, 414 bp, Saccharomyces cerevisiae
aagagccgcataaggaagaaaagcatgtgccagttatgaacataaatacatttagagtttgccatgcatgtactgatttatttactttgatcaactcttttttacatatttatatatattcatttaaataaatcatcaatcaatttttcgacacagacactgaatacttgaaataccaagaaaaggataactatcctctaacggcgctcagtgaaatattatattttgattgcttgttcaacaattgtgccttattaacttattacatttatatataagtttatattattccatttccatttttcattcgtagatttaaacttttttattaattcttttggatcaataaagttcaaatctatcttggaccaaatttagtcattgcagatggcccgctttcttgccattcttgct

SEQ ID NO: 12736 - DNA, 496 bp, Saccharomyces cerevisiae
gatgcgtaacgagcgagtacttgacaggaaacgacaaaaacacagtgaacatactatctaaaagcatgttcttttccttttcatttttcatctttattatctagagtttgtatataacatgtatcctatattatcttatcctatcatcatcacttaacttgttataattctcccatatacttatgttttcgcctttgatatttactagtcgaaggaacttttttcgcagttagtaacgtcacgctcggaactaaacattaatgaatgagatgcatttttatacaacacttttacaggctatatacaactaagtgattttcaatacattaaaactaccagaatggacaccaaccgatataatgttggcataggttttccactgatgtggcttgttggattagtttatccacttgttctggaacgtccaagtcattaaaccttcttatatcgttccccgttaatttgtcagtaatgcgcttcaataccaacatggccc

SEQ ID NO: 12737 - DNA, 430 bp, Saccharomyces cerevisiae
ggtattttttctttctgctgggttttaaaaaactagtttagttacctcattggaactcaaatatttatccactttggatagtatatacgtcaaattcttttggtattttatcgccgagaagtcggtagagccagcatcagatgcaaagccatgcaaagactgatataaagactgttataccaaatgttatgatatgttcttgactatgtagtagctatatgtgcatgtatgaaattatttgggtgagataatattaatctttcctatctttactgcttgtaaagtgcgtaaagaatttatttttcaaaaaactttcttccttttcctcaatttcaaaggtgtttttactttccaaatgatcattgccttcaagagcaatagaatctgttagtttatgatttctcaacatgaatgcgcaacctaacaaagg

SEQ ID NO: 12738 - DNA, 470 bp, Saccharomyces cerevisiae
aggaaatctccaacctggacataaaccaaaaaaatttaatgaaatagattagttatagtaaaagtaatcataataataaatagataaataaatccaaatgcaattataaatagtatatgaagttatgtgttttctaaaatattaaaggtttataaacggggtcccgaaactatctccatttctttttttttttttacgtaaggaaaggcaaacaggcgacacaaaatcatgaagtcagaaaataaaataaaagtgaaaaatttcacaatagtgcctattatcatgatagaagtagagtagaaaagctagcaacaatgagaagctctggcacatatgagaatgatccttctggggaaataacctcaacttccccaaagcagtcgaagcagaaaaagcctaccaaatttagggaaagaatgcgcaggtggttacaaaatgggaaaaataacaaccaccaaggagaggaggat

SEQ ID NO: 12739 - DNA, 422 bp, Saccharomyces cerevisiae
gaaaaggggacataccaagaattactcagcctttatttttctttcttgtggctcttgcgttcatttttcgttgttatataatcttgttaatctttgacgggataaaagcgttattattttgtaatatacacattaaaacttattttttttcttaaatttatctgtatatgatgaaagatcaggtctagttaatgcacaaaaaggtttaacacatgaattaaaaaggaaaaagactagcttatcgtttctaaaagaaaatcttttaatcactgtccccatcgttattcattaatgcgtcgaacatattagctcttggagcttgagaaacttcttcgactttacgagcatttctttggttatttctgaaagaacctgttttcgtggaagcaaaactatctctttgggtgttttgcatgttcctt

SEQ ID NO: 12740 - DNA, 486 bp, Saccharomyces cerevisiae
tatgtcatacttttagcgctcattgttattgtatactatttatagctaacagtttattattagatttcctctaataagcgttataccagtgtagtaagtttatcacttcagctatgtgtcattttttttttttttttttgaggccttatatgaaaataagctttgaagaaagtgatactggaattattcaaaccaagaaaagtttttagaattacaagaataccgtagcacttgaaggaaagaggacagcatatccacttgataaacatggtatcagaggataagattgagcaatggaaagccacaaaagtcattggtataattggtctgggtgatatgggcctattatacgctaataaatttacagatgctggatggggtgttatatgttgtgatagggaagaatattatgatgaactgaaagaaaaatatgcctcagctaaattcgaactggtgaaaaatggtcatttggtatccaggcaaagc

SEQ ID NO: 12741 - DNA, 466 bp, Saccharomyces cerevisiae
cggtaaaataatcacctgaaaaaaactaggttaagcacaaggcaagggaaaaagccaaattacacatatacttgattataaatagattagtaaaacatatattctaaattaaaacagcactttaaccgatattgtatttttttttttgggtttacgtgatactgcgtaaatcttcaattttcagggctttgtccgcaaggggcccgtttatttatcaaaaaaagtaatgagattttcgaagaaagttcataaacctatagatcttgttacatttggcaagaaaacaataagtgggatctgcggtccaagcaacgcattttcttttctctaatcgacaagttcaagtaaatatttctattagtcatatatctctcgagcttatatattaataatgaaatcatttcaaaaatcttatgaattcgattacccatgggagaaagtcaccacggcgaactggatgaaatat

SEQ ID NO: 12742 - DNA, 486 bp, Saccharomyces cerevisiae
tcgccctgagagattttattttcttataaattttactaaataaggatttgtacttttgatagagttttttttttttctgacgtttgtttagttaatattatataatagtatttaggaaactaggtgggaggggacatcgcaacttttatcgtgacctacgaccagtgttttttcaattgtttgatcaaaagagaaaaaaagacaaaggaccgaaggatagttgcacgcataaactggagaaaaaattgtgtttgacatcggcgtttaggcttgtttgttctgtcacacatacgctgcttcacaccaattcatatttctcaggttaatttgtctcctctccaacttcaataacgattttgcgtgaaggtttaatttcattattgcaattttagcagagaaacgcacataaatatatatatattgattacagaaccattataacatgtcttctttgaaggatgaagtacccactgagacttccgaaga

SEQ ID NO: 12743 - DNA, 467 bp, Saccharomyces cerevisiae
aaaggcaaaaattaacgcgaatttgtatagtgcatctaaaaaaaataattaagtataaaaatagataaaggaaatcaagtgtttctttttttttttttggtttattgtttgacactggtgatttgcttaaccagcgcctccagcttcgcgttcgtgagagcgacgtcttttccccgcatcgccaccgtacaattcattaaatgccatattccgatcacgtattggaccttgcgcatgccgccctgctggcggcacatatcgaaacactttgctgaaatcgcatagatctcgcccagatcgtgttcgagcattcgaccgcctaagtagtttaccagtatttgcagcaacagagccttcttcaatttgaagcggttgtccgcaacggcttctccggcaacgaacttgttgctagagtagaactcgcggagcttcgacacgtactcggcgcgctgcttgtcactacatgg

SEQ ID NO: 12744 - DNA, 420 bp, Saccharomyces cerevisiae
atattgggataacttttgaatacaactattaattgtatataatttgacatgtaatataataagatgtggaatcaatttccctgtcttttttttcaaaagcgactgtgaagatacttagaaaatggcaaaaacggtagtttgcaaatttccgtagtttgtcgcgcgaatgatattagcggaaacaaaacgatcaaaccttataccatgaatataatggtggatatttattacggtaaggaaacactctgagccaggcttgtaaatagcggttatctaagcttgtaactaaagaaatcaatttgcatctttcgtccatgagtgtcagccttgagcaaacgctcggattcagaataaaagttacgaacgtgttggatgtagttactgaaggaagattgtattcgttcaattcatccaacaaca

SEQ ID NO: 12745 - DNA, 457 bp, Saccharomyces cerevisiae
taatgatgtaaaagaaaagagagggttttagaaaaggagccatacatgttccaatgggacactaactaaccaatttattttgtttgcacagttctatttattgctttagagtaaagttgaagaaaaaaaatcttcgttttaaaccgctatatcaatacatagtcatagtgtacccattcagacttctatgaacttccgatgcgaaacatttttttttgcctttttaccttttctgttcattttatctagcattccttaggttaatttaaacaaatgtataaacttgtacatatttcaaataaaaaactttcagttttatttcaagaaagctaaatttcttttggatgtttaattgataaagcgtaaatatccagaaaggtagtgatgtcatagataatatcattgatgaacattccatggatagcaagtgtcaagccgagtcccatccaaaccaatg

SEQ ID NO: 12746 - DNA, 582 bp, Saccharomyces cerevisiae
agttaatatccttcacttttcaccttctttctctacagaacaaaaaaagaaagaagagtaacaatttcaaatttatattccctatgaattgatgtgataaacttaccattattaatattattattcgattgtcagtttttcccttccttatttttatcgttatttcattattttttatttgtcatatcacatctcaaatcaactaaaaaactattattatattcttcaagcctaccattttcttgataaatttttttgaagttacttttattccatgttttgtttttatttgcttttctacttttattttcccctcttaatttttttttaaagcatttacctttcattatatcctatgaattctcattgtttctttcccacttttttaaattccattttattcgaatcgataaaaatttcaagatttttttctacatcatatattatatattattttgtttttatttttcctaataattctctttttttttttttattatgattgaatatgctttaaattaccaccctaaaaatttcagaactaactacgaaagtatatagcaccacgagtgagttaaattc

SEQ ID NO: 12747 - DNA, 470 bp, Saccharomyces cerevisiae
acggtttattgattttgtttccagcttggctctcttgattttttatgagcacgtgttatttattccttattcaaaccttcatatatgtatagatgtgcattgtttatacgttacctagcattttaatgaccctcctatttagttatcttttatcacattcgttaaaacctagaggaaaaaaagaaaactggaggatttcacaaatcttcctccaatgttgctcatttcaagcaaaaaacgaccccagtgagggttgaactcacgatcttgcgattaacagtcgcacgccttaaccaacttggccatggagtctttttgactatgttctcgagaaaatataggctctcttagtcctcaacattttaattatttgagtacaccaaccggtaatcgtgaaatagttaacactctagatccaaaaaatacgtatttaggtataatgggatgtaagaccgtttttatgagggtgc

SEQ ID NO: 12748 - DNA, 489 bp, Saccharomyces cerevisiae
tgcattataggccccaatcgatgaatatatatatagagattctccttttccatcatcttttttgttcgcaatcttttcatatatatatatatataaatatttattatagtccattgaatggataaacatttatttaaaaaaaaacaacgatcagtatttttttatttgaaaagtcgccttaattataatctacgaaattaactctgctttgctgccactaaagccttctgttttagttttctactagcatacttgccaacaaatggtaacagtgccgtattcaaggcaatgagtgcgactaaaataccataattccgacccatcttgcgtcttgtcacgtcaaaaaaaataaccctgtagatatcgatgacgttgtgaacgggcatcatgtacccatatctataaacattattgtttagcgctaatgggaagaaagaaggtgcaatattgagaatgacaaatgataggatccagaacccgagatactgg

SEQ ID NO: 12749 - DNA, 412 bp, Saccharomyces cerevisiae
gagcgatatagtaagagagagaaagaataaaggcaaaaatttaaaacatgtatacagcatacttaaaagtcctctaacaggacataagcaaagcacatgggaatagacaatacatccgcacataattaaaaatattttactagatagattttatacgaaggttcttcacactttttcatatatactttattgacagttaataaaagaacattatcaaatttatacctttgcgttttagacactaaattattgaatacaggaaagaagaggcacttagataaatctttagaaatttacttatttctttcatttaaattggccaatgcttttggatccattcaactgcggccgtaaaaatatcgatgcgcttgcattgtgttcaacctctgtctcgccgaatctttagctgaag

SEQ ID NO: 12750 - DNA, 431 bp, Saccharomyces cerevisiae
aaaacgttcccttatccttcggaataggataataacaaaaaccattatttattcattcttgcctcacttaaattcggcccttacggcgacatttcaataacataaatatgcgtgtaaccttattaatttataatgtctaatttattataatattccttcacctaaacacttcaaattggacctcacgcaatatagcgccttctagacccttgcccaaattacccagcaactctacgctttcattgagagaatcaagcgaactctcatcatcatcctgtgaacctttaggttttttaccgttaaatttataaatgccagaacttcctgcaaaaatcgtggtaccatcttcagtaccacatctgttagctagcaccaaaatcgcattctttccttggaacttccaaggctgtccaagggaggttcccaaaaat

SEQ ID NO: 12751 - DNA, 477 bp, Saccharomyces cerevisiae
tggtgaatgccttgatgacatcaagtgaacttttttcccccctttgtactctatttattttccatctttaatgatcatccacacaaattacttgtatatgcgttcatgtatagtatactatatacaacatgaaggactttataaattcttgatcaatctttcacactaattttatattaacagttctacactatttttgtttgcttgactgtaaaaacattctattttatgattagttgcaaaacttgaaaaaaacaatagaatttcatcacataattgaaagataatgaactctttcagtcagttagatccatgttttttgaagaaaagtttacgaacacaggatcttacaaaaggtgcctaaatttggaattgaaagtctattgctatcaaaacttgtcaaagataacatagcttggaacatcttatcctttatatgtcctgctaagtcatatcaagaggccccaatagtttcgt

SEQ ID NO: 12752 - DNA, 463 bp, Saccharomyces cerevisiae
tctcaataactcttcttccatattttcttcccaatatacataagagtcaaacaaaacgaattttcaaaagaaaaaagaaaaaaaccctgaagtctacttcatgattaccccatacttacgcgtggtttaattctatgtaacgattaacgtccatgtaatcattatatatatatatattgtaataatctctctaattgagtatcacaatctgctgcggttactctaacaatattttgcataaacttgattcttctcttcttatttcatgtttcagtggggcattttccattgtacttttgcaacaatagcgaaaaaaacaattttccgtaaagagaagcgtcagtcataaacggtgtatgttacccgaactggaatgaattttatcttaagactggaaaacaatttaggatagaactgaagatagtgcaacacgtctggtgatatcatgtgctttcaagcagga

SEQ ID NO: 12753 - DNA, 490 bp, Saccharomyces cerevisiae
gattgtaaatatatgctactttcttccttgtatatacatatatacttataacgctataacccgttcttgtaatatcggctatcacccggcgaaggtgtatcgcaagaaaaaaaaagctctctcactctaaaggaggctatgtgaacgtgggaagatcaagtgaaagaaatgtttgtaggccattttcttccagaacagatccgctcttgagctggtgagttagcacgataacaaacaaagatacagcgtcatgtctaccacactactttggttttcaagtgtaataggctacgtgattcaaacaaaatgtttgtctaacatacaatctaaaaaggaaatctccgtggggcccaatggtacaattgcaacgcctgaaactaacggcgacaacggaaactcaagttcattaaccttctatctgacctttatgtattttgcttcgtggctgctcttggtgcctgcatctcgactttgggagaagatgagaccg

SEQ ID NO: 12754 - DNA, 413 bp, Saccharomyces cerevisiae
ataaagcaatcttgatgaggataatgatttttttttgaatatacataaatactaccgtttttctgctagattttgtgaagacgtaaataagtacatattactttttaagccaagacaagattaagcattaactttacccttttctcttctaagtttcaatactagttatcactgtttaaaagttatggcgagaacgtcggcggttaaaatatattaccctgaacgtggtgaattgaagttctaggatggtttaaagatttttcctttttgggaaataagtaaacaatatattgctgcctttgcaaaacgcacatacccacaatatgtgactattggcaaagaacgcattatcctttgaagaggtggatactgatactaagagagtctctattccggctccacttttagtccag

SEQ ID NO: 12755 - DNA, 459 bp, Saccharomyces cerevisiae
aggacacagcagaaacagtattacaacaaacctacatatttatatattccatgcatgctcaagatgcatatgcataatatttacacgaattgcgaatatgtcacataatagagcagtggataagtactcaatgcaaaatcactcatagtagtcccattcttcaaatgcagtttccaataattgtgtattcaaattagtgggatacctcgtatacctcacgccgctcctagtaacaacatacttgtcattgaagctgacttgaacgtccttatgtatagtcctcccccaaaaggtattgtgcctcttggtgtatcttaaccaatgcattctcttgaaattatgaatcggacttggttgaataatacaatctacgccatcttggaaaaaatatgtggatggtacttcatctgataaccgcactatgattttttcaatatacgccttgattttgttttcaaa

SEQ ID NO: 12756 - DNA, 434 bp, Saccharomyces cerevisiae
gtttgatagtaagagacgtaagaaccttatgttaacatacctatatatacatatacgtcaacacaccaagaaaaaagagcagtgcgagttttcgtatgcatttgacttcaaaaagaagtcaacattaagtgccgtttttgtttcgacaatggattgtagtacagtgcccgtaggtgtatgactcgtacttgcgtgtaagtaaatttcggatttgttcggccgcaccttatctcacctgaaattttctgcgtcaggctgctttgatggtgtctaagagaaggccattaaaaaagagaacagatgttgaggttctcagtataaaaatattactgttgaatattattagctttatagagtatttatcaaagaacaggacttgaaaaacttcgatcatagatgaatagggacaacatggacacaacaaagcgcaaaga

SEQ ID NO: 12757 - DNA, 479 bp, Saccharomyces cerevisiae
tgatacttaagagctaaacgaaaagataagtatctcgctcaaccttttaattttgcacagttgaattctcgtctgatacttaagaaagtcattgcccacatatataacagtagtaataatgataatgatagcaatagttttaagctagctacttagttgcatttttcaatagtttagtaaaaaaagtcacgcaataagctctcaagaagccactaataccgtaatgatagcagtttattgtagaaaaaccatgttattacccttccctttttatttcttttcgcgttgcaaatcacatataacgaggtggcttgtatttgtcaaaccaaaaaaaaaaatgaaaatcgaaaaatggaaaaacagagagagaaacggaatctttgacacgttctcgatccacttgtttatcgaggtggtttttataagtcttactagatagaaagttcattttgttttgaaactttttggaacctctggca

SEQ ID NO: 12758 - DNA, 430 bp, Saccharomyces cerevisiae
agacattagctttgagaatttgtgccgctgctttcgagaacggcatcacatctggggttttatgatttaatttaggacgcacatagatagatatatattatggaattaagaaaagtttataatgtagcaacctaaaaatgttacaggtgaacattcatggaaaatgaaatgtttctcagccagtagatagtattgttgaaggtattattggtttgagaaagctactcctcaaaaatgtcacttgataatatggaattataatgtcgttatattttcaatcatttcaatacaatatggtaaaccgaaatccaaaaactttacaatatctcttatctattgttattcgacattcttcccgggccttaacggcttcttaactaatattaccctaaacggacaaatggcgaagggccccattcatttacgaaca

SEQ ID NO: 12759 - DNA, 459 bp, Saccharomyces cerevisiae
taatcacgataataataacaacaataatagatatatatatatgtatgaacatatatatacagatacatatatatatatatatatctatatatataccatcgcattttttccttaacgagaagagcacagcagagcttaagatggcatgcatttatagaacaacactcaacacatagcggggggagggttctggaaatacaaatggtagtgcaatttacagcctggattaaagggggatctgcaattgggacaaataaggtttgaattgtagtcgtaatactctgcaaacgtcatttcatgacggcaaactccgcaaataatcaagtgtttatttgcatcgtcaaggagatcatatttttctagcgggtgagaacttaactcttggtggcattcaaagcacgcatagtacttatcacaacatttaaacctgatggcaattacatcctttggaagatgcca

SEQ ID NO: 12760 - DNA, 447 bp, Saccharomyces cerevisiae
tgatgccttccttgttcaggaattttaccaccgcccaatagttttattatagtactctcaatatatctataccaacaaccgcttcaaatgtattatctccctttataaattctgcactgtattgtaatatgtataaagctctgtaccactttttcatcattgcatacatcgatagcgcctcttcaactttagaatttcctaaagggtagaaaaaccagatgattcaactcagcgtaatggaacgctctgtttgaaataaaaaacatctgtatcgctgcacggattagttcgataattcaacgacagttatactaatcttggtgatggaatgagtactttagcggaagtaagtttttgaattatgcccccactttttttttgttcatggtgactaacatgaattaggtttatactattattgaggacgccgaacaggaatgtcgaaaa

SEQ ID NO: 12761 - DNA, 421 bp, Saccharomyces cerevisiae
ctggcagagtaatagaaaggagtagcttatgattactcatgttatatatatatgtatttttatttataaatggcacagaaaagtaacttatttcacgttaaaaagacatctttcagcgaagtttccaaacacttcttcgatgtctgtgtggaaagtttctttcgtttatagttttattatttttttttgctttttttcccatggtaccatttcctttcgtgaaacattttacccaggcccacccaccgcataatcttaactgaatccgaatagggatttttcgagcactactgcaactgttgagtgagctaggagtagtgtaatttgagactttgtgaagggagaacagtcaatatccaatatcatattaagaaagctagcagtaccttaagaggaagaaagaaaataactggggcgaaga

SEQ ID NO: 12762 - DNA, 424 bp, Saccharomyces cerevisiae
agactttaacagacttgcacaattttttttatctctctctttttttctctctttttcctactttactttctcttttatagattctttatatagtcttttctcttgttcgcacattttttatagaggatataacaaataataaaaactatcgcagttgctttggcttcagggggtttttccttgcttttccgccggtttacgtgcttaatttcggtgttttttctttcgggtaaacctatggagaaaaaaaaaaaaaaagacctctatttattgagtacacaacatacacgtacaggtagataagcaaacaaatcagagaaaaagctaatagagaaagaaatacacacaaatcaaaccataaaaattctcccttaggctatgcataatgggaaatactgactccaaatccagttcgatcctgctg

SEQ ID NO: 12763 - DNA, 490 bp, Saccharomyces cerevisiae
ctatcttaaacactaaactacctcctataatcatgtagtgtactttaaacatttttttatcttcatagcaataatataagccttttaccacccataaaccataaagtagacccaaacatttttaaaaaaattttacgttataattttttctttgtcgttttttctgagcgcgcaaagtagcggtgaaattttgatacgaatgagatttccacttctgtacagatggaaatttatgttggccgacatatatcacagtcgtgattgaattaacaatttctttctcattaatatttattctaaacggttaaccactaaatcaatcaacaacaatcagtcaaaatgggtcgtatgcacagtgccgtatgtttattaacaccatagcgagatattaatgcaaaagttgcattgaatagttcgctaaatcagatgacactctaatgtggaattcaaaagtggatttctaatataatttgtctctgtcggatcacaa

SEQ ID NO: 12764 - DNA, 441 bp, Saccharomyces cerevisiae
tctgaagaataacctaccaaacttcagtatatattctcattgtttgattatagataaatgaacattatgattaattttgtgattgtactattattttattatgttgtatgctatatattaccctttattcaaagcctttctatttagccaacggtcttttgaacgtatgatggatgattctttctttggtggtaatgttttagaatcttgtgtggtggataacaattgaactctaaattttcctcttttcaccgaatctttccttaaattttttaatgtcttccttttcttagtttttatagctttagccaatgcctcttcattttcatctgactcatccaatttatcgaaagttacatgtcttgaagatgagtactgcgtactaccttcgtccttctgatctatattttttagcaattcctcaggaagctccgcaattac

SEQ ID NO: 12765 - DNA, 440 bp, Saccharomyces cerevisiae
aattattattactttcttcccctccgaatccgtaatatatttacggatatataatctcgtagtgtaaaaggtgtaacgagattattaataagttgccgtaatatattgtaaaatatattattattacaacactatatgcgggaaaaccctaaagtcataatataatattatccccacgagggccacacatgtgtggccctcgcggggtatggtaaatttaattaagttataaatgtactatagtattaaaaattattatgaataatttccccacccccatgcgaagcatgggggggggtataagtatggacaatccgcaggaaaccaaataataattaatatcctgaaacaaagtaagtgaaggagatatcttaaaatatatataatatatattttataaattattatgtaggatcctcagagactacacgtgttgcacc

SEQ ID NO: 12766 - DNA, 453 bp, Saccharomyces cerevisiae
agtggttacatttggatagcgaacttcagtttttattatacgtcgctttgtgtttctgcaaaacaaaacaaaactacaactacaaagtactgcgttggatttcaatcagtgctacattaatttttctccctttttacttcgttttacgcacaaaaatatacagataaatacactcgagataaacaagacatctccttccgctattttttgtataatttaatatcattattaataaaaagaattcctatacatatattcaaaaacaaatgttaaaagttttcttcgcccagtatatcttttgcacaactctctacctggaacaaggcttcagaaatatccgtaaaagctctcgcaaatgcaatgccgtgaacctctgtccaatgcattttttcactgtctatttcagagctgttcgccactgaaggcaagggtaattgttgctgccctgaactt

SEQ ID NO: 12767 - DNA, 426 bp, Saccharomyces cerevisiae
agctgatacatgggttagtttccggccttttctctgtatttaatgaaggtagagaaagcctcaaaaaatatgtactatataaaaaattaaaatgttttactttttattaaagttgcctaatcaaaatcccaaaaagttgtataattttttttcgaacttggagagaggatttgccgaaactttaacaccatctcgaatccacaccccgtatgaacccattaggtttgccatcaagatgtcagtaaaaagcctatctccaacaacagcaacctcttttggatttgttatggttttgtttctataaaaataatctaatatttcgttgtgacaacctggtttctttgtagagtgccgcaaaacaggtatacctgtcttatcttccaaaagttttgcttgcgaatagtccttatcagaattggaaccggc

SEQ ID NO: 12768 - DNA, 457 bp, Saccharomyces cerevisiae
tggtaatcaaaatgtatttagcgagtatatactctatacgagcaaatagagtaaattgtaattaataaatattgatatattatcgcccatatgaaatttttaaacgaaaggttacttatacatcaaataattaattaaccttaaacattacgttcaggaagaacaatgagcgtaaatggtactaattaaaataacggcggcagataatgaaaaatattggcgtaacccccacttgttattgccatttctgtcaaaccaaggttttctttccatcgcaaaacggacgagcttttccttttgtgcgctatttggagggtatctcataaaaagggtaaaatcattccaatatggttgtttaaaaattgttctttcatgactaaaggtattgaatccataatatccaccatagttaccataacctgaagtaccgatccctccaaatggagcgtcggtaatt

SEQ ID NO: 12769 - DNA, 461 bp, Saccharomyces cerevisiae
ataaaaatcccaatttattctcttaccagtagtgatcaggagaattgataatttcttcaaaacaccttaatattcgttctgtgtatttttatgtacctttcttaatcaaatttatcagcttcatacatgcattcccgtctgaataatgtactgatgattagctaaaccgtcatcaacctaccaaacttgcgcttgtttgagcctatcagaactccggataattccgacatcttatctttgactcgaattagcgataagataaaaacacaggaaccacaatgaaattcagctggaagaaaagtctaaattatagacacattttctgagatcaaatgctataaaggaatggaagtgcattttgctatgatatggggaaattatgaagccgatcaaacaattaattgtatctaatcggtctcttctttagaaaaatgaagttttttagtttggcagatgaggca

SEQ ID NO: 12770 - DNA, 410 bp, Saccharomyces cerevisiae
gtatcgctaatgtataaaaaaataattgtcatgtatatatattaattaaaatcatagccatgtggtcatcaagccatcgaaaagaagttgcttacttgtgtcttaatgaaaccgtatgaggcttttcgtgcatgcccttgtaggcaatgaaacaaaggccaagaacagttaaacacatcaaggctctggaaattgggtggtttaaatcataggcggtggttccagtggaggtggttaaaggtgtgtaggctttatcgttacggaagatgttttccaaagtggagccaacagacacatcgccatttctaaacttctcgactttttctgtgtacgcagcgtgcaaatctaagatgttactaatttttaagatttctagaacgaaatacaggaaccgtaattcatgctgaggc

SEQ ID NO: 12771 - DNA, 443 bp, Saccharomyces cerevisiae
aggagtagaatgagatgagaaagcacctacattacaagtactgtgtagacatgtatacttagcctagaatgcattgatgctaaaatacatcctgcccaccgggtaataattatgaaacgcggcggtgctctttgtggatttcggagaaagggggtggaggaaggaggtcgattttcattattcaaatattgttttagtataaagaaaaccggcgtgcattgcttcaaagagccgttcaaattagtaaccgtttgagatatcttgtcttactactcgtattccgcagataaagtacattttaagaaaggaagtaaatacacataaataaatagcaggaagaaaatgtctaacgaaattgaattactgcagaagcaagtctctgaattacaagacttagtgaagaagcaaagtctgattatctctaagacaggagagcgtgtgct

SEQ ID NO: 12772 - DNA, 489 bp, Saccharomyces cerevisiae
tgaattgaatcaaacgccgttcgaacgtagaggtcaatagtctatatgaataatatttttaaggtctactctactatgaattttgcataaaaatatacacatgttagaataaggaaaccactatctactaatcacggctaaccactgcaaacaatggcattatttactaatataattatgtgtgttggagtgagaatcaattatagtctaccgatctggtgctcttgtcagcagtatattatttttgagaagaactttccttttttttttatgtatacgtaatgatcagaattttttaataaagatgtacttcaaaagctttttttaatattcatagtagaatttagtgaataatttgataattgttgggcttccattgttggtaaaggctattatattagttttggaataaaaattcaactatcgtctatcaactagtagtcatactaccagtatattatcatatacggtgttagatggtgacatagg

SEQ ID NO: 12773 - DNA, 430 bp, Saccharomyces cerevisiae
ccttcttgtatacagcacaaataaaaggttcaatttacgttcgtggactgcccacaaaacagtatgtgacataaattgctgtgtatctcgcaccgctattatctgtatataacattctaactcacttttaacgatattagcattattgatttctttctttttctgctgaatttcaccaagcggaaattttcaaagcagaattttttccctaatttgctacaagtgctattctatcccacaataaaaggaaattgttgatgagttttagaaggattaactctagatactttgaaaatagaaaaggaagcagtatggaagaaaaaaaagcaaaggttcctccaaacgtcaacctttcgttatggagaaagaacacggtagaaagcgatgtccatcgattcaattctcttccatcaaaaattagtggggccct

SEQ ID NO: 12774 - DNA, 493 bp, Saccharomyces cerevisiae
aaaagaaaagacaaaaaagctaaactgcatagtcaagtttgtataattgagctgagtattattttttgtacacaaaaacattggctttcttatatcttctctatatatactctctttcattcatcgataaacgttacatttgttattcatagagaataaaaatcacagccgtggagaagaaagaacagagtaagatcaagtcgaataaagatgtcgttgggtcctcttaaagctatcaatgataagcaattgaatacccgttccaagttagttcacaccccaataaagggaaataccgcagacctcgtaggaaaagaaaatcactttaaacaaacaaagagactagatccgaataatgatcatcaccaccagccagctcaaaaaaagaaaagggaaaagttatcagctttgtgtaaaacaccaccttcattaatcaaaacaagaggaaaagactatcaccgaggtcattttttaggtgaaggtggatttgctc

SEQ ID NO: 12775 - DNA, 468 bp, Saccharomyces cerevisiae
taaagtacgaaggcgggcgaggaataaagacacgacttagtacaagtatagcgtatatattcattaaagaaaataagaataaaaagaaaagaagtttaattcttagaggcagccacacgtaaaagtatgtgtttctaattcacgtcgtcaaatagttatgtcattagaatgcattcaaaattctataggctgtccattcatgtcagttgaggaaggaaaagattgagatgttttattatcctgctttttttcctgctttttttcctgctttctttcatcttttctccttgccgttcttctttccctccgctttcggtccttctccttgttcctctggctcttgttaatctcatcctcattagtgtttttcaacagtttattgttaatctctatcaaagtctggttctcaatcttcagctcttctaaacgctgttcaagttcaaggttccttctttcgagcccatgaac

SEQ ID NO: 12776 - DNA, 401 bp, Saccharomyces cerevisiae
ggtctgtaaacttgtgaactctcggcaaatgccttggtgcaattacgtaattttagccgctgagaagcggatggtaatgagacaagttgatatcaaacagatacatatttaaaagagggtaccgctaatttagcagggcagtattattgtagtttgatatgtacggctaactgaacctaagtagggatatgagagtaagaacgttcggctactcttctttctaagtgggatttttcttaatccttggattcttaaaaggttattaaagttccgcacaaagaacgcttggaaatcgcattcatcaaagaacaactcttcgttttccaaacaatcttcccgaaaaagtagccgttcatttcccttccgatttcattcctagactgccaaatttttcttgctca

SEQ ID NO: 12777 - DNA, 406 bp, Saccharomyces cerevisiae
tagcttgataaaattactcttctgccaagcttttaagtatatgtatgctctccgttgtattttttatatgccattatagtacttgaagtataacggaaacccattgtaactcacattcctgtagtagcttcttttcttactttttgtaggctcttgtctcttttctcttgttatttatcagttaatatgtaagaaaaaaatcgacttcgggaattaggatacagacacctcttaaaaccagagataaagtaacgtagagaaaatagtaggataatgtgtgcaaaaagaagaaactttggtgtcttaaaatagataaaaataaccctactgccaatttgaaagggcccgaaaaatgtttgataagttaccttatgagatttttaaacaaattgcctggagaattccg

SEQ ID NO: 12778 - DNA, 414 bp, Saccharomyces cerevisiae
tgcaactatgtcgctcattaacggttattatagtgaagactacataataaagacatagataataaaaaagaatcgcgtttgaaccatgttttatttaaccatatggcatagaagaaaagtaaaaaaggtgaacaaaaactcattaaatttcacagaaaaagtctactctcttatgagtaacagtagtctttaaagcattgtaagcaaaatggcgaaaatttcttttttcttgggagcctgtccattgttcttttggttaatatacagcctaagcaatttttataataaaggtcataatcattgctaaacactccccttccagtgggtaacatactgctaacttcagactgattgtaagttattttgaatgtcgacgtattagatgcgtttccatgattcgcattggcatgataa

SEQ ID NO: 12779 - DNA, 495 bp, Saccharomyces cerevisiae
ttctttgcgtaatccgaacgagattctgtatctgcatgtaaactaataaacctatataaaatttaattatatttttttcagctagttctatttttgaatttgatcgctaactctgggcagttgataagcgcttcccagcttttcacgtgcgaggtggactaatacgtaataacgcgtacctattaggacttcgttgagttgtttttcttgtccaaatgcagaagcgggtccctacaaactattgtgtttgttcgtaaacgagcaggaaccctgttaaaggaaaaaagcttaacgctagcgttacattttagtaaggcggcaataaaaaagaatgcggagtgtattccatgaattcaattgcgcttactgctaagcctgtttctaaacatgatccccagggtgaatatctcccatagtggctgtgttattctgtctaaatgtggcagctaaataaggttttttccaagctatttttttctctaaacgagcgcacct

SEQ ID NO: 12780 - DNA, 453 bp, Saccharomyces cerevisiae
cctcgaggttaaacttcattactgccgtttaatatttggtgtttcttcacatttttttgtttttttatactattgtaatgtatttatatagaattaaagtcctcactataattttgtcatccctacagtatgtcataagcgttaatcggacaaacgttcattttaaaattggcctttttatatttatattactcctcataggatttaatatagaagtatcattcgttaaataatcattatatcatctgtgctttaaataaaaaagtcggccgtcgatgtgtttacgattggccagtatacttactcattcatgggattagttttatttcaacgctgtggtgggtacgatatgaaagacgaactcgacttgtcatcatctgaaatgatctcagaatttttgctttgagaaaaagaatttgattctctcatttctaaaattggggttaactgccg

SEQ ID NO: 12781 - DNA, 406 bp, Saccharomyces cerevisiae
acttccaacattttcctctcgtaaccagaactgactttttctacaacaggaattctttaacgagacttctcctccttcaccattcataagtttaacgatgttcttttattatctagacactccgaaatattcttaacatatacgtatatagtttactgaaaaccgaactagccatgggctatgaaagttctcctatttccttacttacatcaaatagaaatgcgcatccaagtctttctggcaggcacgctatgatgtgctaaattatgactcaagtgagtactaggcgcttttgtactcagccgcgcggggaaaatttcttccctccctaccaaagaggaaaaaatcatatggcgtcatattatcctatatacaacggtcgaacaaaaatctgctcgactcagaa

SEQ ID NO: 12782 - DNA, 417 bp, Saccharomyces cerevisiae
aatgtcgatcaggcacgttcgtgtaaacattacgattttggaattccacttacataagatagcttctttgtaaaagccgttcgaagatttcgtttatagtgatgctttttctggagagatttaagataataaggatatgtggaaggaaatgaaaatgtacacctacaaagcgttgatggtatggaaactatcgaccatagtttgttaaacaggaaatatttgcttgagggtaaagtgttctgattcattatacaaagccccttgcttataagaaaagaaaccaaatcagaaaaggagattatttcaaggtaggcatcgaaatggcaagtaaccagcacataggagcttcaaacctaaatgagaatgaggctatattaaccaaccgcgttgctgagctggaaaggcgtatgtcgatgt

SEQ ID NO: 12783 - DNA, 482 bp, Saccharomyces cerevisiae
taatcacacttgaatgtgctgcactttactagaagtttctttttctttttttaaaaataaaaaaagaggagaaaaatgctgtttattctgaccttttacataaatttttcttaattgtatctatctaataactaatcaatataataataataatactaataataataataataataataataatagtagtagtagtagtagtagtaataatgatgatgatgatgatgatggatgatcaaaagccacaaaaaagaatgctccgagaataacctcggcggttatttcacgtcccggaggaaaaaaagtttgataagaaagtaaaaatatgagcggtacgagaatcgaacccgtgtccccaccttggaagggtgggatgataaccactacactaaccgcccgggttaattgttattagttggtgaaactgatctcaatcactataacattatggtctcttaatagcaaaggccaaccaactgact

SEQ ID NO: 12784 - DNA, 450 bp, Saccharomyces cerevisiae
tcgggcaaactaagtctagttcagaagagcatacgtacttagtgtagcatcacccaatttatactctataaacgataaatgatataaatcacatctacccggcatctgggacttttcggggggaaggactcaaaattaaagggaagaaaaaggatctgcaacattttttacagaagtaatgaactggagaaaaaagactttgggataaagttggggaatacagcaaataacactattccaagatgttcagacaatcaattaggccacttgtttcaaatagactaaccttcattcgttataacagttctccagcctacacggctgcagtcagcctattgaaaggagatttgaaaaaggctatgattgccaaggatgagatgaagaagacagcaatcagaaatatgttatctgccataaaaaacaaagaaattgctttaaaagggaagagcg

SEQ ID NO: 12785 - DNA, 442 bp, Saccharomyces cerevisiae
gaagtataattaaatcgtcttcatcaggatccttatcgcggtcatacgagtgactatttacatagaaatggaagtaaccagtaaattttctattaaactttctgattcacgcaacttttgcacttaaaaaccgtatttcgccaaaacacttggcaagtccctcccttctataaagagtgtcacatatggtaatgtttctttgctcatttttctgaatagtgtcaaccgtttggcgtacatttcttttgactttttatcaaaatatgctagttggccaccgttctttaaaagcttttccttatatttgttaaagtactccactctttgaaaacttttggaatgtaattcgaacattatttctctcacgggatctacccattctttaactttctgatattgactcgaaggattacatttagtagactttgggatatttgcagcg

SEQ ID NO: 12786 - DNA, 494 bp, Saccharomyces cerevisiae
tagggtaaagtgaaatatcaacaactttgcatagtaagatatatatatttatatagataccttaaaaactgaaaatgaaaacttgaaagttaaggaggaggagaatgcgtctttgtttcatgaaatatttttttcattttcccaacttggcttgatgtccctgacagacctcatgaattctcttaaacgtttcttgtcacgtagtgccctcttagcgtattgagggttaccgtagtaaaatagtttaaattggctttgcttttcatcacagtgttcggggtctaagtcaatcgacaaatctagcacagcaacgctacgttgaaaataccacttgttcaccacattgtcttttctgcttctccaaagtatctcattaggaaattttttgaacatcaaattgaagattatatcagatatacccagcgagcctttcaagtgtggtagaacggcgaacttatcgagataaacaaaggaattttcctccgagccttcat

SEQ ID NO: 12787 - DNA, 409 bp, Saccharomyces cerevisiae
gttattatataacgaaactatatatagaatcaaatacaaatttgtaatgcatttagtgtaattaacctgttaaatttttgagtataaaattatagatggaacaagtgataaaaaagagaaaagggacccttcatagacctgctgcgataattacatccttttgaaaaagacaataattcatgtcgtttgttgccttccctttttcttttctttgaaaaaaaaagaaaatgccatctcctagaatcgaaccagggtttcatcggccacaacgatgtgtactaaccactatactaagatggcaaacttggattgttaagaaaaacatgctgggctatacagtacatttaccgcatatgtacctctagccaccacccgaacatggaatttattcgtcctgtagtgtcaagcg

SEQ ID NO: 12788 - DNA, 499 bp, Saccharomyces cerevisiae
agtgattctgtcattccagtccgcatttctaatcagatgagcattttctcgcatcgcataatatatatggactaagtaatttaatcatttcacagcgcgttttgatgcaagcgtttagtataaaatgaactgtatatttgtatatgtgagcgcacgatcgctccaaaaactactttagtaaactaacgtagttcaggacgactgaaagaaaatatagtgctttaaatttatcagacaaccaggaatgtcttatgtctttacatggatgtaatgtaagttgaatacttttacatatccatcagaagaagccctacgatacgctctaaatcttgatgcgataactctaagggacttttatcgccacgttctccgttaatgtccttgtgagattgcaaggaccgcagcaccgcctcatcaatgaatatatccaaatatttctgtatcattggtactacttcatcggcaattttcatatcattaccaccttcattttggctga

SEQ ID NO: 12789 - DNA, 497 bp, Saccharomyces cerevisiae
tttgaatttccaatatcctagtcacggagcacgagaggtaaagaatttagaaaaaaaaatgcgatgagctgaaaaaaattgtcaaatataaactacattcttaagtatacgtatatatcttgcgcattcacggcataatacactaaatagacacttaaaaaatcgagtgagaacattcacaatggagacctccaactttgttaaacaattatcgtcgaacaacagaaaaaccagggtaaatgcactcgaagcgttaaagaaatatctaaccgctaaacagttcaaggagaacaaacaaatagaattcaataaactttggaagggtctttactatgcaatgtggttcagtgaccgtcctagacctcagcaacgtttagccaatgaattaggtgaattgcatggattatattttgatcctaaggacaatagcactgcagatgagttgaccacaaacgataaagcatttataaagtttagcagagggttttggaaggtca

SEQ ID NO: 12790 - DNA, 449 bp, Saccharomyces cerevisiae
caattctttgtcctgcataccttttatattaattttttaaacaagatttcatatacataacggtacctatcgtaattattggcggctgcttgtgttgatcacgtcttacgggaaatatcacaatggaagaaaaaaaatacttctaacgaaggaaaagatgtcatccagcattgacctcaaattaccgaagaggttgataaagcaattagcatccaatcggtatcataattcggaaattaagggggaatcctctacatttggtgtttcttctttccatatattttgaatgtttttttcctatgaaaagtgtcttcaggaatcatatatgtaaagagatcattcaattaaatacatcatcgaactaagattataaacaagaatttaacaaagtcacttaatatatcaaaaagaaggcttttaggaactcaaaaatccgcatcatttgcaat

SEQ ID NO: 12791 - DNA, 419 bp, Saccharomyces cerevisiae
attactgtaaattttctcatctacccactgcttttttcgttttatttttttttacacatacagacatataaacgttgtagaattaaacgataaaatataatatttcttcacatagtttacggtatatatatgtctgggtcggtcaagtggtctaccaataggtcataaatttgagcagggatcttagcgatgaacccgacgcccagccgaatgatctcgtcagcatcaaaatccggaaactgtcgtagtaaattaacaggggaatccgatttgaaaaccttggatctcattttaactaggaatgccaccacaaagagaatattcatatggaatccatatgcaaacatgaaatcccacagtttaatgacctgatcaagcggtttattgcagctggataacgtgagtatggaaggcatacc

SEQ ID NO: 12792 - DNA, 465 bp, Saccharomyces cerevisiae
taatgaaaattttagccgtgacataattaccgtatagcccaactcaatacgtaagtttgtgtaaaataccattccaagatgatattatttagtcattttttttccactttctcaaaaagaaggaatacctttagcggctcttataaactataaatttctagaagatacataaaaggtttttagtctgatcataaaattttttgcttaacaaaaaatttgcccaggtgtttcatttgccagccacaagtaacagcgagaacaattaattgaatgacaatccaccacatagcacgagaattaacagcttcagaggcgtctctaaaggtagcttcacgatctctcatcaatttttgctctcttctaatttcgccgatcttggagtttaggacgttaaccttggcatgtagaatgtcaatagtggctttacccttagaatctaacttttcatcagagcccacttggaat

SEQ ID NO: 12793 - DNA, 421 bp, Saccharomyces cerevisiae
ttgtgaaagaataatacaaagagaaaagagatgtacgtcattacacctcaatttccactttgtttaggaggctttaataaagaagaactaaatacctaaaatgtaagttagctgttactcgtcatttccgattcaaagaattttgaaatctttttaaaacaatataactttgtaggaattggaacaacaatgtgtatataaatagtatttcaacgacaaatacaggttcaaataaataaaaaaatacgaaaatatacaaaaatgcaacaacgtttaaactccaaaataaccaaacatcccgcagtacaaaaaacatgaataaaacaacagaataaccaaaacaatactaaaacaaaacattcattctgcagctttgcaaattcccttacatagcagttctctaccgcattccattaatgca

SEQ ID NO: 12794 - DNA, 431 bp, Saccharomyces cerevisiae
tgtatttagaaagaaaagaaaagtggaagcataaatagtgcatatagatataggtatatatatgaattttttaataataatattaatgatgtttttttatcttaagaacattaaaagtaagcggcgctaacggaataattagaaacaatgtggtaaagaacgggggtgaaaactcataaaaccaagttataaagttctgccaaagcacggaatatcaaaggaatctcaataattccggcagcaccctttgatttcgaggacgattggctggacgaagtagcagatgcggcagattttagcaagctcgtttcgctagcagaaggggaggaggaagatgcctttgaagtcgaggatgatgattcagaagatgaagaagcggaagatgaagatgaagaggaagaagaggatgaagaggaggtgtcgtcgtcttc

SEQ ID NO: 12795 - DNA, 404 bp, Saccharomyces cerevisiae
tgaaattcatgcgcttgctatacacacacacacacacacacacacacacacacacaatatctatctatatatatatgtatgttctttattgtttgtctttacctttatatataaacatatatagccatataagaatataatattaccactccactgtattttgtatcctgcctatttttgctagattacaggacgcgcgagcctttcaggggagggaactgatgaatcgatcaaccaaaagaaagagccaaaggattggaccagaactgttactgttatagcagaaatattagtagtacgttaaagccaagcgtcgaatttcagcataattaagaggaaatgtctgaatatatggatgacgtagaccgcgaattcattaactgtttgttcccgagctacttgct

SEQ ID NO: 12796 - DNA, 491 bp, Saccharomyces cerevisiae
tacgtagaatttgaatgtcaatctgatcgttcatatgcatttttcaattcttactttttttctcgaagttcccgactatgttctgtttattttttctcctattcaaaagaaccggacagcatttttacttccttatatttcgacatcgtaatatgtacattttttagttcacaagtatttttcccctttcaatgctttaatcagccttcaacgtcatacatactttctattttgttcctgtgccatcgtataactttcctcgtttagtgttttcgcctcagcttaatgtagatcactgttttgacgttcttccatttttgggaacgaactaaactaaaaaaaagaaaactacagagtttcccatagagaacagaaaatccgctatcggcagcttatagggtcatataattatggcgcacataaggaaaataaatttatttgaatcaatcaacagacctatctgttgatatatgaaagagagcaggagcgtt

SEQ ID NO: 12797 - DNA, 432 bp, Saccharomyces cerevisiae
tgattaacaatcttatagcatggattctcgagtcaaaggaaaaaaataaagaaacctatctttatgaccctctacagtaatgttttgaagaatatagttctgtaattgtaggaaaaatcattcttatgtattatgtttactctaggatgttcacaaagaaaaaggcaaccgcttcactgaaatattctccaacaatgtatatatgcactctcatgtcattgacttgacttggattgtttatattaatattttaaaaggttacataatgatttaaaagaatttttcttggaaattttatttaaacaacaacaccagagttggaagcaactcttggccataagtcggcacattccttaccgactggaccagtaatggcagaacccttcatttcacccttaggattagcgatgacaccagcattgtcctcgaagt

SEQ ID NO: 12798 - DNA, 437 bp, Saccharomyces cerevisiae
tgaaaataaaatgccaagttttatagttatctacatatgtatatatttatcaatattatattctacaattgtgtatattatatggtaagggtgatatttaaggaagaaatccacccttctttaaggtttccactgcacatgttgaaatgtgtctgaatcttgatgagcccaaaggcgtgccaccataccatctggtcactattaccaagacgttgaatatgtttgctctttcaagtaaggtcaataaacgctgtccagcaccagcttcgccacagtcagcacatccttgctcaatgttctttggctgcaccgttatgttccttgacttgttaacatgactattattactcttatttgctttattgcccttctttttctgctcttgttgtaagtgcaaattatttgatacctcggccgttctccaggcatacatgtgc

SEQ ID NO: 12799 - DNA, 477 bp, Saccharomyces cerevisiae
tgtaatccatcacccccctataaaaacacctgtgcaccgcatatttccatagcgcgtgacgctaagtacaagaaacagcgaggggccgttaagtgcaggctttaccgagggcgccggctggcgcttcccgtggaagggtgtttgactcatcatcgcatcgcattacctcatgatgagtaaatagttgcgatttcacttatcacctctcgcggaaaaaaaaggcgatgacatgatatataaggctctctcgtaagacacttaactatccaacgttcattagattattcggtcaatttcttttttcatgcccctcctttttcttttcttttcttgactcgtcgtttctttttcttttttttttttttttttttcttcagaactataacacatagatacactcgaacatctaattgtttaaatactgcaaagaatacaaggtaatcgactcttctacataccctttttgcagatttgaaa

SEQ ID NO: 12800 - DNA, 402 bp, Saccharomyces cerevisiae
atacaaaaagtttattttcttatatcctaaagcgtttatagacttaatatttaaaagttaaatataaatgaagggcactggtatataagctattaaaaacaagaattttggctttcacgacattaacgtgtgagaggtttaggcaccattgcctttatgattattagtccctccagaataaactctacctttttttttcttttttttttttatagtcctaagcagaacatgactaaatcgccataaattaacaatatagtgggaataaggcacaccagaagtgccacgatatagtatatatacaatgataaatgagtacgttgccagaaaggtcgctctaaaggacatgcaaccatgtgcgatctgtagcaaaccatccactaccgtcctttacaacgcatc

SEQ ID NO: 12801 - DNA, 496 bp, Saccharomyces cerevisiae
aaaggatacggtacaaagattcaataattgtatcaatatttcgaaaaatactttatcaaaaaagcaatacttgaaggagaaaggaaaaaattcgctgtcttcttcacttttacgacaaagaaaaatgtgcccttttcaactaaaagtcatgaatgaataaataaatgattacatatgcgtatattttatagtgaacaacttctgacatattatcccgaatgtgagtaatcatgcttgtgctgtgaatctgtgttggtgtttggctgtgaccctgccaaaaaggtgctcgaagtgccggaaacaattccacttttatccaaactgctcgtagtggacgagtgggataacgttcttgttaaatattttccaaaaagtaaactgtttgggccaaatgagtcgctatgttctaatacaaattggctatgattggaccctgaggtgtgatgatcccttccagaaaagcttgcctttttattggggttcttgtgcgaaatta

SEQ ID NO: 12802 - DNA, 453 bp, Saccharomyces cerevisiae
ccaaggtaacaatcaaaaataatagcattgaatttaaaacgctctagtgcacgtaacgcatccgtctgatcagtggcgaacaataccgttatttttcatagtacctaagaagacacataccaatttttgcaagtgaaagtgcagaaacggttccactaacgatattactgcatgctctctattctaatgtacatatatatgttcctttatctacaagaagtttcgtaataatatataaatccctcaaaagtgttattgtttcgagcccaaatgcttcaaaatgtatagtttgttggtgtttttcttttcaggtgtactgttgttaggcttgaaaggtttaaaagtgcgaacattccttgctattaattcaggtgaatttgagttggacccaagtataatctttctgctagtaacaatttgattggatacaaaatcggcatcctcttttctttg

SEQ ID NO: 12803 - DNA, 459 bp, Saccharomyces cerevisiae
aatgaatcgtagatactgaaaaaccccgcaagttcacttcaactgtgcatcgtgcaccatctcaatttctttcatttatacatcgttttgccttcttttatgtaactatactcctctaagtttcaatcttggccatgtaacctctgatctatagaattttttaaatgactagaattaatgcccatcttttttttggacctaaattcttcatgaaaatatattacgagggcttattcagaagcttcgctcatataacgaaaaaaaagggtttggatcgaacgtaattgagattgattagttaatactcaaaataaaacagctcctaccaccagtgtaaagtagaacgttaatagagcaatgtcttcagacaaatctattgagaaaaatacagatacgatcgcctctgaagttcacgaaggtgataatcattcgaataatttgggttcaatggaggaagag

SEQ ID NO: 12804 - DNA, 408 bp, Saccharomyces cerevisiae
aagagtaaatagcgtgtatcttctcaaataagaaaatatatattcatctgcaacattaatgtgatagcatttccacttcgacattcgccactagctataacgtttactggcaattattatgaactatgtcagctattcatcacttgttgttttgtctcgctgcatctgtcgcccagctggtcgagcaccgtctgttcattttctaggttatgagccaaacctgtcaaatactcaagttcttggctacctaattgagaggctacgctcggatacagcccattaagtgtattctctttcggttggccatgaatcattgtgagattgcattgaggggcaatctgtacaactgcactgttaaaatgtaaaaccttgccattctttttgaaaaaatttgcttcggcaacgttt

SEQ ID NO: 12805 - DNA, 457 bp, Saccharomyces cerevisiae
tagtgaggcgattagatgtcgttttcatgtacaataatgatattattttttttttttcaatttttagtattttacatggcattcttacacttttataaagtattatttatattactagtagcagtaagtgatcgcccttttttttagcactcggtccaatgctgctaacgacgaatcaaaagataagcgttctcttgcttcaagttattcaaatttctatagttaccttctaatctcattaagaggccaccgaatgagtagtaaacggcaattagatccttgcttacttcctcaaacttgtaagcggtaccatacatgacgtaatcataatcatctgcaagggatctgtcaccagcctgtggaggtctccagcttcttgtcgcagaagagtcgttagctggggtgtcttcgaggtttaaagaggatgcaatagtcactgtcaaagaatcttgtgcgg

SEQ ID NO: 12806 - DNA, 434 bp, Saccharomyces cerevisiae
taatgattgtgttagttatggactggatttttgtgttatgtaagattttatctaatcttgtgcatctgtatttggtaggtaataaatgctaggggaatgcaaacagtgatattgcctttgagtattgaaaagaagaaaatatttctttttcgaacggaaaattatagaaaatgaaggtcatatgcacaattacaaagaaaatatttcatgaaagagctggacggaaccgtccaattttagcctcgtttttaaccactgttgtatttctttccataatcttgcgttttccatgtacccattatgggtgaagttgaggatgtattagaaagttgtcttttttggggcagtacattagagtaaggcctccttggaatgaatggatttacaatgagtctggacttctgcaacggtatggttgcagtgttgggaggatt

SEQ ID NO: 12807 - DNA, 430 bp, Saccharomyces cerevisiae
gcatgagcacacgctctagaggattgtaccattgtcactactagatatacatataaacaaataagaagcatcgacacataacaacaaccccaacatcataatttcataagtatttggttggttagtccatatggcgtctaatcctcgaaatgagaaggtacccgcctggtgtctatgacaaccttccgggtaataaatgttcatttgaacccattcatccaattgatatccgggcaatcacttccggaagcggaaatttacaaatatccggtgggtcctacaaggggactaaagaaaaaaaatacgtgaaaaacagcgatgcgatattttttgtatcgtcttgttcgagtgtttcttaccacgatgaccgggattttggccggtgaaaaaaaaaaaatgcgctcccgtacgtcagtggctgttgctgaaa

SEQ ID NO: 12808 - DNA, 430 bp, Saccharomyces cerevisiae
atcgaataatgattacgctaataacactacataagaaacatagataaattataattcactaatacaaaatccctcaatttaattaatcaatttcttattcaacaactagagtaggcactagcagtttgtgcgaccctcggcgccggagaggtacaagggacctggcggttgggccttcctgccagcttctcccccccttctcggcattcactcagcgttcattggctcaatcacgcgccaagcggattcccagaaaaatacaaaaaaaagttgccataatacaatggcggatattacaatatatatagcttgcgctttaaaaagaagtgttagcacgcattgggtgtttgtactgtattcctccacttaagataacgaatacacatatagatatacaatatattatacgtggacatctacggaaaggaag

SEQ ID NO: 12809 - DNA, 494 bp, Saccharomyces cerevisiae
tgaaagtatgtacatttggaagagcatatgttaaatattttatttatagatttttcgttgtgaaatattatttttttttttttgaaaaaaatgtcggactttattcctcctaattattaataaaatacgaatatatatctaaatataattaatgcttatttacatgaaaaatcatcaatcgtaaacagttgattaaaaaacaaaaactttatcggttccattacctttgtgaaacccattactccaccccaactcctttgcataattcaaaaccatttcattcattttaggtggtccgcaaatcaataaacgatggtcctccgcttgtttaggtaggtatcttttcatttcctctagagttacgtacccaacatcaccgttccatttaccgtttggcttatgaattacataatgaactttaaaatgcgggtactccttagccatgtggtctagttgcgatttcatgagaatgtcatcctctgtttcgtttgcgt

SEQ ID NO: 12810 - DNA, 461 bp, Saccharomyces cerevisiae
caataagaacgctctttgtttatctatttattactagcattatgcgtaagcttggcgtgatgtgatatatacttgttatatgaagtatatcaatatgctttaatttatgcttattatttgctctcatgtcagtaacccggaccagatttgccattgaaaaaattttcatagaatagcccgatgctgatcatcagtacaaaagacagagatttcatctcgacctgtaccaggagctaagcaaagagggcggaaagagcgtaatacaccgttaacatcgcgcattagaggtagacatgagtgacttacaagaccaagaacctagcattattatcaacggtaatttggaaccagttggtgaaccagatatcgttgaagaaacggaagttgtagctcaagaaacacaagaaacacaagatgctgataagccaaagaagaaagtcgccttcactggcttggaagaa

SEQ ID NO: 12811 - DNA, 453 bp, Saccharomyces cerevisiae
aaaaacaccaaagaatggagagtagtatatactcttaacaaacactagcatttcagtttatctatatacatatatatggatgtaaaatgtactttatggaagaacaagccaccacatgttgaaaactagataggcaagcaagatttttcatttgtagagctcttacgcaagatttttaaacttccgcttttttaatccatgagattcctttggacaccctttccggcacgcaaaacaaaaaaattaagggaactcattattttacgatgctacttagataactaaagttcattatatttcaacaaatataagataatcaagaataaaatgtcgtcagaaagggtcttaagttatgcaccagcttttaaatcatttctggatacatcttttttccaagaattatcgagattgaaactcgatgttctgaaattagattcaacatgccaaccactt

SEQ ID NO: 12812 - DNA, 463 bp, Saccharomyces cerevisiae
ttggtgtgaaatctctctgtgatatgtatatttgtttgatagatagcagttgtatgtatttatactattcttagtaatgaccttattacccgtcttgtagaattgaaaggcgaaaaacaatttgaggacccatataatggaagaaaacggacgtgaaagttaaatatacgtaccagaagacaaatcacagtaataaactaacaaaactatataataataatggacccacataatccaattggtatgttgttgatatttttagtgtttgtggaggcaattgagctcggtgccccttttggctttgcctcttttgcattttagttcttttacccctatattattaatactaaccatctcgatatagtccttgatcagggtactggtttcgtcaaaattggtcgtgctggcgagaatttcccagattacacgtttccttctattgttggtagacccatcttgaggg

SEQ ID NO: 12813 - DNA, 419 bp, Saccharomyces cerevisiae
ggagacatttaatagaccccatttttttaattcgatagatctttcttcataagataattctgttcaatgacttatgaagcttacggcttattgttattattatcatgattctttgccatttttccggtaccttcacattttgaaggaattcagttcccccgcctgtaacaacttagatacacgtagataaaaattaatatagccaaaatatttggtatgatagggtatagtataatataattaatacaatataatataatatagtacagtacagtataatattgtataatatcatatggcaccgtaatatcatatatatatccgtacagtttaatgaattccgtgcgcattatgctgtgcaatatgcctgtcagtttgaaaatcgaagataccacatcgtacaaaagcaagaggggtgc

SEQ ID NO: 12814 - DNA, 460 bp, Saccharomyces cerevisiae
aatatatatactacttcaacatgtcatgtattcgaaagtgccttagacgcattacaactaaagaaaagaagaaaaaaaaatcaaatcgagaataaatatgcccatgtatatacgtcacttgcgaattgtctatttctctcgttcccctttttctttcagtccgctgatgttatcaatgtgatattatcgcctttcaacaggatcttccccaagggcgtgcccttctccacatcttctttaccatcggcactattcacaggaatttccacggcttcatcgatgacaacattcatgaactcatcaaatccaactattttacccttgattcttatgccgatttgctcgaataaccatatcgttactggtgtttgctgttgtaagaagttaaatatgcaatttattggtggcaccatggccttggttttaactttgttcgacattccaagcctcttgtttttcg

SEQ ID NO: 12815 - DNA, 465 bp, Saccharomyces cerevisiae
ctgctgctactgcattgatatactagaggatataatatataacgaacattttttacctactgtataacgacgtatactctatacatcttgtgtattctttacaaataatcgtcaatgttggggtaccttacgtcagcgttctcttcacaccattctgaccaactttttaggtacttgttaccgcacctttgcagaacttctatattgccaacaacaactagttgccttctgggtcttgtcatggcgacgttcagtcttcgttcttccttaaggaaaccaacttcaaatttttcattgctacgaactaaactcaatatgataacatctttttcacggccctggaacccatctacagttgatatttcaatatcagttaattttaattcatcatggatcaattttttcagatgagaaacttgtgcattgtatggagaaataacacctatagagttctccgggacgttg

SEQ ID NO: 12816 - DNA, 400 bp, Saccharomyces cerevisiae
tataaaaacttgcattgtgagaaaacgcgaactttagaatacgtaatgggaggatcatataccccatggtactgaaatgtatgctttatatatatatatatatatatttatatatttatgcatgaaaaatgaggagttcggaaacagaagttttaaaagttacagatttattgtataaaagatacacgccactggttgaatgtaaatgttaaaatgaattggcatggtctaaaaatccctcgtaaatcttgcttaattcataatggtaaccatggataccctgggattccaaaaatatgggtaggcgaactcttgttcgttccgcgataccttttaacctcacaatatcagtcccattcaatcctgctatgttcttgctggctgaagacgttttagggac

SEQ ID NO: 12817 - DNA, 478 bp, Saccharomyces cerevisiae
tgcagtcgcattatcgtcgggcaccgcctggggtttcttgacgctcaaacagtgtttgatttttttttggaaaagtatatactgtgcatatgtatttttcgtttattatatgtaatatatcgaataaaccattctacggggaaaatagaacaaatatttacagcatttgcatgattttatatggcttgcccaacaaattatttgcttgcaaacttaatataatactctgcgtccaatttgaaaacgacccatatgcctcttctaattacttcgaaatactgcatttcgccttggaaaaaaatgtagtcgctatctgcggcaactaatttcagattctgcgataaatatacccatagccaccagaacctcagcaaaaagtcaacgagaatcgccgaatgatacatttttttctttaatgtgacggcacttttggatctggatcttaaagaggttaacgagtccaatgaccaatccatcc

SEQ ID NO: 12818 - DNA, 428 bp, Saccharomyces cerevisiae
aaaggcagttttcaatgctttcactttgtaaactttgtttagtagtagaatataatatattcagttttgttttatagtcacataacactttgtctttcaaagaataatctccttcgcaataccagcgaaatattttggcaaaaaattaacaattaggttcatagtcccctaattcaattaatcgaaaaaaaaaaaataaaatataagggaagattgtgctgatgaaatagacaatgaaacaataatgaagaataaagaagaagaagatataaaacatgccaccaccatcaagaagtagaataaacaaaacaagaacattaggaatagtgggtacagctatagcagtgttggtcacgtcctactatatatatcaaaaggtgacaagtgcaaaggaagataatggggcacgacctccagagggtgattca

SEQ ID NO: 12819 - DNA, 400 bp, Saccharomyces cerevisiae
tgactttgcttttgatttcactttattaattaaaaaatatacataagttcaatgtaattgaaagtacaacacatcaaaatataaacctagatatatagaaccagaagaatgttacaaaagagaaaattcaattggagctacgaattccttaatatcttctttgtggtctttgagttgggtttctttcttgaatgtaggtacctggaacaatgtgttctggcaagttcaagtattctctcaagtattcaacaccttcttcagtcaaggtgtagtagtagtattgccatgagaattgagtcttgacgtaacccttagaagtcaaggattgtaaagccttaatgacatacaagttcttggtgtcaatttcttcgtgcttggcttggttgaaatccttcttggc

SEQ ID NO: 12820 - DNA, 408 bp, Saccharomyces cerevisiae
gtcagacgtttggcatatactgagattatataatacctttgataagaatgtaagaggacccttgaaaatagttattgtaatgttatgtaatgtaaataatagtatacaggtgattcttatttatcccatgaaataagtatgagaaaagaaaggaaagaggcaattagcccggttctgttctaactaaaaagcaattttctttgtatttcttcttctgttctttagcagaatcttttgcttttccaattgttcttcctcttcctcgtcactgtcgatttccatatcctcctcttcttcttcagattcctcttgttcggatactgattcagctctttcttgttctttagccaactttctggcaatttcaacttctctgattctcaataattctgggttagattcgaccaa

SEQ ID NO: 12821 - DNA, 486 bp, Saccharomyces cerevisiae
aacggatgcattttatataattttagctatacgtgtacatatttgtaataaagttaaaagaggagactgtttagctttgtatttattttttacttaatttcatccatttaggtactctatttaaagtctttttgatacttgtagcgttatcagaagggccctgtggattggatttatttatcgtattaactgatggggttgtcctcgtttcgtgtgtgattttttgtgcgtcttccaaaagatgagcctttattaatgggccattagaatttgaatttgtttcaaaaagcagcattgttttagagccaaattccaggtcatccagtagcttcttatcgtctttagccaagggtttgaaaggatgagattggtttaacgtaaaaggcatgttctcatcgatcaggaactgcgacacgacgttataaactgtacgcatgtcttcattgggtttgaatgctatttgaatatggcttctatcggggaact

SEQ ID NO: 12822 - DNA, 427 bp, Saccharomyces cerevisiae
ctgatactttaccatacgggagttgaatatcggtactcctttattatatttatgatcctctccagaactccatctacctcccgccttttaatgaccatttttacgaccttttcgcatgtttttctattcttttacagtttccttggtaccgctagttacattatgttatcttgaaaaggctactatacactttttttgcactactgaagcagctttcaaaagctctttatagacttcagatagtattactttttccttaaaattctatctatttgtaaacgaccaagagtgtcattatgtatactatatatcaaaaagttccatatgttgtctgaagttccttttatcttccgcctttctatctttctgttacaattattcaacagctttatttttctaattttggaattagttgcaatgcactggc

SEQ ID NO: 12823 - DNA, 486 bp, Saccharomyces cerevisiae
gattaaacgtaataaaaataaatgctattttgctgtactatacataaaagaatcatatttacttagtatactcgctaagattttcacgtgctcatcaatgtgaacaaattattaaatacaagcgtttactcgaacgggatttggcctaattcataataaacctgtcttgtgtcaacgcattgctttcttattattctttttttgtcagataaaactggtattaaagcgcttagaacatcgtcctgatagctcaaacaatagtttagaggtactacagtcgtaatcatttctagaagctgtaaggctattaacctgacactgacactattatatttgtgcggaagcgaaagagatagtaataatggaactattgtgcttacgtgttcagtaattaaagtgtgatgtttatccgtagtgtccttcagagtttctaaagcggatacccttacttcaggatcaggcatatccaaagcctgcaataaaagc

SEQ ID NO: 12824 - DNA, 496 bp, Saccharomyces cerevisiae
ttggaagatacttagtcatatggatttaaagttacgcaaatcaaggtcatagaaggtgcagtaccttttaaaacaaagagtataagtggattcagacgaagtgtctctttaattctatcgtctgatagcgtacaagtaagggtgctatgagctagcacgcacagcaaaaatataaacacttttgtatttttttttattttatagtgttttgtgttgagtattcatctattcgacctctatagagatttaagaagggaattcattgtcacaataaggacgcatagttgttcattttagacatcatttacagcacttccgtaaactaccccatattgcgattgaatactaccgaaaaggctcaagaatttacgtggtgcccaatcaattatatagaatgaggaacaatggtaagtaatgaataatcatggtcagtaataaaaaagcaatctcgtccatgtttctttttgaaactcagagcttgactctgttgcattgg

SEQ ID NO: 12825 - DNA, 498 bp, Saccharomyces cerevisiae
aaatttcagccaataagcattatattcgtgaaattttagtaagagcgcgcgttttaattggtgaagcctcgcgacgtattcacagatgtcctagaaaaagttaccatatctgaagactggttgatatttagcttaaatagcatattaatactgtaccagttgaaccattttttaatctgttactgccaggaacgttgattcgttttcccggtaacattgttgtctttgggtactgagcatatttcatttttccacttacatataactaaatttctgtgctcttcctccaataaatatgactgtggttgaaataaaaagccaggaccaatttacgcaactaaccactacaaacgctgctaataaactcattgtcttatattttaaagctcaatgggctgatccttgcaaaactatgagccaggtgctagaagctgttagtgaaaaagttaggcaagaggatgtccggtttttatcaatagatgcagacgaacatccaga

SEQ ID NO: 12826 - DNA, 412 bp, Saccharomyces cerevisiae
aatttctgaatacatacagcgtatagctatataaaggtgtatgtatgtgtgtatgtatgtgcgagtgtgtgtggatatatatatatatatatatttacaggagagagggtaggaagcccacgggaatcatgcagttgcttgctccacggagcttgcatgaattagctgtttcaagtattttctcacggtggggagttcgtctaatttagggactttattatctggggactttctcaggtctttgatggcgacacaagcctcttgaacggcatgaggttcgaagtcggaagtgaataagatgaacgactcgcccacgtctgtgatcggttcttgtgatatttcggatatgaggtcattggagtccttgaaccgctgtagttttaagtttgccaagaacttgatcccgtcgatg

SEQ ID NO: 12827 - DNA, 401 bp, Saccharomyces cerevisiae
cgggttcatcaagcttttttccttcttgagactctgttgtatctctttatatattctattttattttatatgcatcgaactttttacgtaagataaatacttactacattttggataattgttttaacaggttaatttctataatctattttttatctgctcttatagcattcaaatatttgcagcggtaaaaaattatggttaagacccgcgcgactgtaaaaatagcgcgtaagatttccctgaagagcgatgagttttaacatttaaaagatatgtctgagatcaatcgcttttttaccagctacctaactttataaccttaaccgataattagaattttttacagtgattatctaagagtgttaatgaagtttttattgatggatgcttgcttaacg

SEQ ID NO: 12828 - DNA, 497 bp, Saccharomyces cerevisiae
atagttgtgtattgttcctgcattttctatcaacttgagaatatatgttcttcatatttaataggggaaaggaatgacataccgtatccaaaatagcccttttgctcatgttaaatcttatgtaatgacagagctgaagtgacgtttctattaaagcacatgtcacgatttaaaaaatcctatttcaaaatgtagcattgttttcttcgagaaattgacaaaataatctttgtaagagtaattttttcttagccattggcatatgcaccatgcaatttccacctatttaattacacttgcagtcaatcaactcgcttggggatggtattcctcttggagtgttaaactatatttttagtgaaagaagtgataagcaagtgtgccagaaaatacaaggatataacacaactttgaaaaagaaaaattgccgattcatctattaatgtatcttgtaaaattgtttacaaagagtcaatccgcattacaggcaagattga

SEQ ID NO: 12829 - DNA, 462 bp, Saccharomyces cerevisiae
aatggaatattgaaactggagtgacttctgatgaagtttccaattatttatatgtatacattatttatttgtctatcattaaaatttctgtcaagtaatggctttttatgtttatttcatggattacgaaatttgctggctttttagagtgaccgatgagttgcatgtacatatgtgcgaaataaaacaatacggtagtaaaacatgaatacttcgagaagtaaattcaagattgcaggcgtagcacaagaatgtccttccgcctgctagtgtgttgagcaaagcacgccatcactaatggaacccttacaaaatctcgcatggagcagcaaaccttaaatccattttctatcattcgttcctgaggacccggatatcgttttagagacaaaaatagatactacaagaggaatagggatatctgcacatggggcctcgagcatggctcattttcgattttcc

SEQ ID NO: 12830 - DNA, 416 bp, Saccharomyces cerevisiae
cacgctttaataatatttgtggttcctctacttcgaaacaaaaaaatatgcacgagttgttgacgatccagaaaaaccaacatataaatcatatccaaacccttgtagcattaatatccgtatcacttatgtattcagaatgcatgtattttatatatgcccagtatatcttcgattgaagctcttcggcattagtgcattgtatttttcaagcaatgaatgccaaaactaataaaactatcaagacgacaataagaagtcctatacaacaatcgtcgtatttttctttatttttttcgtagacccattccaattgcctacgacctctagccagcttatttacaacaccgtccataccctcgtccatattatccaacaattgtccctggttctctaattcatcccccattgtttga

SEQ ID NO: 12831 - DNA, 447 bp, Saccharomyces cerevisiae
ggacactataaataacaaacaatcgcgcggaacgtcaagcgtatatactatataaaaagaaaacaaaaaaaatcaataacccattaaagatacataatcaataaaaaacgatattaaaaagcacgtaaagtacttaatatttttttaataatagacattttcgcccttactttttaaataaaaaacataaaaaaatatcaaatgtacatcaaaatcataatactagaacaaaatgtgaagatcactggacggtggtgggaatgattacaaaaaacctcctccgttttctattctaacagcatcctagcttactgaaaaaacctttcgatgatttgttactatttctatcttgcgctgcgtttttagcgttttgttcgtcgttcgccgttggttgcgcattatatggatacttgttagtttgaccattggcacctgtattggcaaact

SEQ ID NO: 12832 - DNA, 486 bp, Saccharomyces cerevisiae
aacaaaaaaggaaaacaaaaaaaagaaaagggggtaaaaatgtgttatgtaagatgtacgtacgtaatggatattatatgaatgtatgattttatattattgcaatatcgtattatactcagagtccaacgtttgatcattatccatatcatgaataaacctgtttggaatagtgataaaatcaggaattctacgatcgttggctaaatcaatagatcttctatatcttaacaacaaattactgctttttgagccaaatttcttggtgactttcctataaaataacccacaggcattacacaaagttcttgtgccatatggtccctttctccattctggagtctcggtctccccgcaatggaaacaaaactcgatgattttttttgcattaggattcttttcatcgctattagcggcgggagttgtcgttgaaactgcagcagcaccaggattggaattattgatgaaatggctggaagtggtcag

SEQ ID NO: 12833 - DNA, 401 bp, Saccharomyces cerevisiae
taattggataatatgttactactgtactgatgtaaattatagaattatgcaatattttcctcttaataaaaaaccttagcttaaacattattaaggaacactacaaagaattttgcagatttttaaaagttgtcagttgctacgatattgtatgaataagttggcgatattttttatatttagtttactttccagtcaattctttccgccctttgcatctataaatttaaatagaaggataaaaaagtggttatgaataggtaaataatactagagtaggacgatagaagtctgtatgagttacggaagcttgtaaaaaacctcagagatgctcacaaattgtggtattctatacaatgactgccatcttttgatatttatcgaaaatgttaccgtcccac

SEQ ID NO: 12834 - DNA, 499 bp, Saccharomyces cerevisiae
cttgctcaacgcgaccttatacacagagtttaatgtgaagagaacattcatatacaattatataaacattgttgtattctcgtacatcgttacacaaaatacgaagcggggaaatagtgatattcgcttcgctggtggcaaatgggaaaaatacaaaattttacacatctttcttccaaatacttccataaaacatctaaatatagtggtttctaattatctctgatcataaggaagtggaagtacatcagaaatgtctcaagaacagtacacagaaaacttgaaggttatcgttgccgaaaaactggctggtataccaaactttaacgaagatatcaagtatgttgcggagtatattgtcttattgatcgttaacggtggtactgttgaatctgtcgtagacgagctggctagtttgtttgatagtgtttcgagagatacgcttgcaaatgttgttcaaacagcctttttcgcattagaagctctgcaacagggagaa

SEQ ID NO: 12835 - DNA, 446 bp, Saccharomyces cerevisiae
ctccgcaccttataaaaacaactctttatgtccctggaaaaaaaaaagaatacatatctaatactattcatatccttcattgttcttgtctgatgattcaaaagtactcatactattttttaatatttaatcttttaccttaacgtattattgtaattcttcacgaatttgatttttccccagctaaaaagttgatgaaagaagttcaaattatggggttattgacacatggcagctctgagccgagaggacgtatcagcaacctcaaccaaatatgtttagtaacagactaccacctccaaaacattctcaaggacgagtttcgacggctttgagctcagatcgcgttgagccggcaatattgactgaccaaatcgctaaaaacgttaagctcgatgattttattccaaagagacagtctaatttcgaactatcggttcctttgc

SEQ ID NO: 12836 - DNA, 485 bp, Saccharomyces cerevisiae
ctggcaatataaacacaagtgtagcataattattagtacatatagtgctttttttgtaatgaaacgaaaataccatgttattttaatgcgttaccccgtcggcgcgtattggcgcattaacatctttatagaaaatcaaattatttacttatttattctaaaacgctaaacatctatttatttacatttgaggttgaaacttcccttcatccgattgacaggcatatttagcggtaattattagggtttttggagagaccttgtattcttcagaaataatgtcgtccttcaacaatgagaccaataataacagcaacactaatacacatccagacgattccttccctttgtataccgtattcaaggacgagtctgtacccatcgaggaaaaaatggcactgcttacacggttcaaaggacatgtaaaaaaggaactagttaacgaatcgtcgatccaagcttatttcgctgcgttactgttcatc

SEQ ID NO: 12837 - DNA, 469 bp, Saccharomyces cerevisiae
ataagaacccacgcttcaaataaaagcaaacatagaagcaaaatccgtcattcctttcctattcaattgcaccgttctctttatataactacttaattaaatagcgcctatacgaagcagcattgttctattatttttacaaattccttatcatgcatgcatcacatcagtgtttgaatctgttaacttttcactttattgctcttacccgactctgaagaaaaacaaaaaaacagcgacatgttggaaaggtcgggcagtaaagcagaatttcagaaatactagtacgattgtttgaggtcttgcgaaaccgtgcattcataatagcacctttttcagtcgctcatccggtcgtcctatctgtaaacgtcactgtcaaacacgttgcattgattagattttattattttatatataggtatatttagaaaactcacaactggagaagacgaagaacgaagaacgaagg

SEQ ID NO: 12838 - DNA, 495 bp, Saccharomyces cerevisiae
cttttcacttgataaattaaaactacgtatattctttctatataagtcttttcccattaaataacggtgtataatcacgatcatatatcatatatcatatctacgatcatcggcaagatcaaattcttgttctgctgtatggtgctcatcaccataatcggttatcacgttttcctcattttcctcaaagggattttctgtactacttttaggatgcaccttgatgaaaccttcttcagaattattttctacagactctttcactgtggttcccgagtttagagtatgttcaacattgctatcctctagttcaaaaacagtttcttccgcatcactgggaattggagccttgatgtcatctgccaagggtaatctaaaattatacttcccccatttgaaataaagaccagtgataactaaaatgcagaatacgtacaccattaaagcataattcattgttttgaaagttacaggcacttgcgttggtaggcaaac

SEQ ID NO: 12839 - DNA, 430 bp, Saccharomyces cerevisiae
atatttggtccggccaatttttaataatactattcttatttgatgaaactgcgtaacgttcaatttacttttcaatatgtatgttgttatgctttattttgaatatataatatatatatgtgtgtgttatgaaatgcatacgtttcatgtttgcctaaaatctctttcttgtgagcgtccttcgaattcttttcgagtatgaattgaacctatttcgcatgtttttcgtggagacagtctttctagtgctttttaaccttacctttggcatgtttttgatctttacactgggcacattcatacttatcttagccatgattgacaattcaactatcttgtttcttgcgaatttgtggtactctaaaggatttaatttttaacgttttgtttgtcccacttggtattccccaggcgaaaagatatgtgggaa

SEQ ID NO: 12840 - DNA, 500 bp, Saccharomyces cerevisiae
aattgctcgtacacactagaagccaaacataacagctttaaaggctttcatttttgaactttttaaaaaattgaatactccaactgaaggtgaactagttgtgtctctgaatatatttttatagatatacgaattgatgaagtaccgcaaattaagctaaaaagtaatgcttcttgcagcttttaattgttctttctgcaatctacaattacttttcttgattccttctccgttcccctgtgttgtctggaagtataatttgtccaggaagattttttgaatagccattgttttctttaaattaaatcggagtgtttaaatccattccaatctcttttttctcgcaagtcaacaaacaggtgttaactttcttttccccgctgttttcttacctatgaatagtctcaattcctttttagaagatctgcacattctctgatactatgaacaagttctaggatagcaatctaagttttatgattctcttatttcggattcga

SEQ ID NO: 12841 - DNA, 456 bp, Saccharomyces cerevisiae
accttctttttttatatttcgattttttttaatatatcctacaccatgcttctgaagaaaaatatataatcatactaatctataaatgtattatttattgttccggataattgcttgattatagacaaagatatcatttacttaacaggctttggatttcttggtccaaggacgatggttttgttaaggaggaaaatctttggacaaccttaccattggaatcaactaagaacttttcaaaattccatttgatacccttgaaacctagtaaacctgctttttggcttttcaaataattatagacagagtcagcattacttccgttaacatcaatcttcttcataattgggaatgtaacgccataattcaactggcaaaattccgtaatttgttcatcagagcccggttcctgcttcccgaactgattacatgggaaccccaaaataacaaacccct

SEQ ID NO: 12842 - DNA, 426 bp, Saccharomyces cerevisiae
ctaatgtccactattgatgctttctcaagagaccttcatatgtaatattctcattaaatacaaagattaaacggcttcatttatgcattcctttatttaggtaaattttttttgcccgatttttggtactactgctttccttttttaaatgtaattgatatttttaaaaaaacctcacatgtaggcgattaacccaggtccttcaacaacttgccgactatgccattaaattaatgattaaaggtgtgtaaagccacaacgaaagcaaagaatatacgtaagataaacatctttagagaacagccattttccatcatctttccgtttgttaccaacctacgcctagaagaaaatgactgatgagctgaaaagttatgaagcattgaaagcggaactaaaaaagtccctccaagatagaagagagca

SEQ ID NO: 12843 - DNA, 423 bp, Saccharomyces cerevisiae
tacaaaaaattaacatatacataaaagaatattatagatatgtattatttacagattttagaaaatgagaatattttgtaaacacccgaacggagaacagcgaagagatttacatctttcagccttgacgctgtttgtgttttttattcgacttgcaataaatgtatactcttccctttcttcttaccaagtagcaatcactgcagaactttttgacagatgttctgaccttgaaacctctgttaaaaaccaaaggtctgttagctgcaacaagagctggttgcggagctgcaacagataggaggctgggcactgtgcaggcccttgttatcgttatgggggacggtttcatgtgcaaaaacatccttggcatagttaggcggagagtctgtaaaaacattctttgaaatcctttcgcttgct

SEQ ID NO: 12844 - DNA, 409 bp, Saccharomyces cerevisiae
tttattatttagtacacgtatgtagcatcgatcttagaaaatgcatgtttgtatttattgttagtaccttgatcgccacctttctaggtaatgataggtcctcaacttttactacgcggtgcacgcctgtaaggtcgggcaaaacaaagtgtgggaacaataaataagagggtaggatgaaatattacctttactctactgctcaggttggccacaatttgctaaagagtttatcattaagtagctaccagcgaatctaaatacgacggataaagaatggctagtttagaagatcttattcctactgtcaacaagctgcaggatgttatgtacgactccgggatcgatacactcgatttgcccattttagctgttgttgggtcacaatcctccgggaaatcctcgatat

SEQ ID NO: 12845 - DNA, 401 bp, Saccharomyces cerevisiae
gaaaaatagatttgccgtctacttatttatttatttatttatttatacaatagctgtaccatgtaaataatacatatatgaaattattgaaaccaatgtatggatccatctccgcatactatacaatccatggaataatcatgtttttctaaaggaattggagaggccacctgttccataagacatagtccaactaggaggggcttttggccttcatgcagtatcttataccgttggaaaaaatcgtcataatacccagcaccgtgacccatccttgcaccagttttaatatcaaacgccactccaggcaccaatacgacatctagaatatctgattcctcaatatgcggttcaggctcttttagttgatatggaccttgaggcttcaaatcacgaaccat

SEQ ID NO: 12846 - DNA, 466 bp, Saccharomyces cerevisiae
tacaataaatagggagcagatattgatctctagtactggaagatcaactttttgctttggccttataggtcatataaattttaataattaatgtaacagacaaatcaaggtgtgattctgttctgataaaatttgttattttccagaatgttctagaagtgttctttcatctaatggcatcgcgtttgaatagggggtgcacggacttttttttttgaataaacccctgtgattcattgtatctaagctcatcaaaccccctagttactgactcacgcacacacatatatatacatatatatgcatatgtaagcatgaaaagtttgacttctattatctattccaggaaccctgaaacaagcgagtgaaaatctttcaaggttaaatatgttaagacaagctacaaaagcaccaatacaaaaatatttacagagaacgcaactattaaggcgaagtactccacgaa

SEQ ID NO: 12847 - DNA, 465 bp, Saccharomyces cerevisiae
aggtactagcccgtaatttttgtgtacatatatttttatcagtcctgtattttttatagtaatttcctttagaagtcacattttgttaatattgaatattttctattatgagagacatgcaatttagtttttcattgaaaagaaaacagggaaaaaacatggaaaaaccatacaagacaccaaaaacaccatagtaatgaagatcaacagcgcaatcaagaggcactggtacttctaggcttgaaaatttggttttgaatataatgccccctcagattcccaatgaaaatgatgatctctttacaaggtggcttaagtctcgggccatcatacaaagggcagtatcgacaagagagtgctttgactcagaagtatttctggcgtctggtggctggaatataacgaatgagataataacgttaaagaaatattatcaactcaagtggccaaactccagttgcaatt

SEQ ID NO: 12848 - DNA, 491 bp, Saccharomyces cerevisiae
atgtgatcatcatggtccaacgtaagaagggcggttttcaggatcacataaatgcataattagaaacatttcatattttacctagactactttttatttataatttttcgcaaactcttttttgtaagcttttacagtacactttttttacgtaataacgtatttcaagctttattttttgtatacgtttcagaaaagggggtgggggggaaggacattgtatatatagatcctatgagtgacaactaggtaaccgaagaaacactattagatatatagtttgagggatagcataagtagaacttagaaatgagtttagtaccatatgaagaaggttcgctgattttagatgatcctaattctaaatcagtggtggttgttaatccaacctcaggaactttatcatttttccaacaggacaacagtaataatgactctgaactaaatgaagaccagactgcatctttatcagcactggactttccttcagg

SEQ ID NO: 12849 - DNA, 416 bp, Saccharomyces cerevisiae
tgaacagtgaagattaaacctatgtgttatttgcatatcatatataaattgtagttttttgtataaaagttgggaaaaagttatagtcgcgtatattttaaattactctaagcaactaaatggtcacggtttagagcatgaacttctgaatccttttccaaattgcatttagcaccgtactcgctttcaatatagctcaaacgttctttcagaccgtccaaaatttggtcgctatcaggtaagtccactgtaaagccctttatcaagctatattcgtgtgttattttaccccctatgtccaccacatattttttgacatcttcaataatgctattctggtccgtagccatattatccgtcttggggaaagttacgatgtatgatgataaggaagatgcctgtgccatggagaatat

SEQ ID NO: 12850 - DNA, 435 bp, Saccharomyces cerevisiae
acgacgaagcacgtgacacgttcccttcaaacatcacaattatttaagcgagactaatatatatgtttagcgaaaaaaaaggccaaaaaaactagtaaatatacaaagcagagtatttttggctcttgtccacattggataagagaatatttatttttcacacagaaaaaaaagttatatacgtatctctaagaaagtcaaagacaaattacgtagaatgtgattcattcccatttcgcccgtacactctctgtctctgtctctgtcccaaacttcccttcctatacgtattcataatctgcttaaacgtcaacagtagtttcggaacatcttcatacgtagggaatacgacttttttcttttcacctgcagcttgagccaaactaaaactgggatccggataaactattaataaaggatcgcaaagtccatacg

SEQ ID NO: 12851 - DNA, 488 bp, Saccharomyces cerevisiae
acgatcaccaaagcattagcaacctacataaataaatacacacacacatacggtagattatacgtaaccacataactggcaatagtttcacaagccataaagctagccacggtattaccctcaaacgaccccgtcttgggcgataatcccgcggtgaaaaattattcgttgaatcatctccaaataaatggatcagtcattgccacggtgatgaatatgaacagcgcagtgcatttcaggcagcgcataatatacgctatctctatcactacagataatatactaagatgttgaatttcgcatcaagagcgtcatgtgtgacaagacgtcaagcaagcttgtattttgttaaaaatcaaggccctagattaatagcttccactattccctcgtgtcattggcctttgagagcgcaaggagtacagcccaactatcctttatctttgagattttattctactgataagtcgaaaagtgttacgaagccc

SEQ ID NO: 12852 - DNA, 460 bp, Saccharomyces cerevisiae
tgtatataacttaatctaatctgcacatttatattatttagatccatacgtcgatgaggatatgcgcaggaaagacataaaggaatattgttatttcaaagattttctccactccttaaacccgttcgataatatatgttctccatcaatcaaacctgaatattcctcatcactttcttcaatttcggataatcttaggtgattattttcgaaaaccaacttaaatgctcttatttgagaatgaggatcctcatctcttggtatcattttcaaaagccactcagtaaggagaccataccatttaatggcttctaaacatgcacttccaacttgtggattattgttctttaataaaacaggtacttcctccgttgaaaactcttccacagtttttaatacataatggtcgtctttaaaaccatatatgatccttgggatcccaactaagaagcattgcagc

SEQ ID NO: 12853 - DNA, 473 bp, Saccharomyces cerevisiae
ttcagcagctaccgccattatcaatatgtacgtatatagactatactttatagattattctagatgccaaacgaattattagaatattaaagcctttgattataggccatatcccaggtaaatagtatactaggaatgagaaaaaaaaatgtgaataaatggtaacctattcttagtgggtaagataaactattgtgaagtaaaaatgaagaccgccaacgtaacaataaaaaattaataataaaaaaaaactttgcccaagcgagagcaacgatttccgccagaaactccaactggcttggagatgtgaatgtctaaactttgtgcaacggttttcagatgaatgcaaaaagaagagaaattaatgtgaggggtaaagatggaactatatgatcaccaacatttcttttacttgatgtagaagtggcggatgcagtactggtcgtcaggttaccgctaaaggaagcagtttg

SEQ ID NO: 12854 - DNA, 411 bp, Saccharomyces cerevisiae
agtatttaagcaaaagaatgcacattaaagtaatatatagagaaagataaaaaaataaacgcacacataaactaatggaagtaagaggttatccgcgaaccacaaggagaaaatcgaatgaatcggagaggtgacaacaaaaaatttgaaatacacaaaaggttgtctatatacaggatatatcgattatacttgtttctttttggcttattttttgggcttaacgtcagcaccacctttagctaaccactcagtaatagaaccaggatagataccagtgttttcgtacccataagatcgagccaactcttcggcagttttggctcttactcctttcgcacaaagaaaaatcaattctttatcgtgaggtggtttagcaaattggaaaactttgtgaaactccttttcggg

SEQ ID NO: 12855 - DNA, 470 bp, Saccharomyces cerevisiae
tgaagcacacaactatttctataagcatatcatacatactacaatcttatgtatttcttttcttttagctatgcataccaatggcataatatataaatacgttcaccttaaaagttttttttttaaagtaaataaaaaaagacctgcaacgatacaataatcaatccaatgtcgtttaatattactatttatcctacgtgatttttaaaaatattcgtccatgcttcagcttctagtctagtttcgtaaatccaagtgataattccaaaactttatcttggaggccatccattttatgagatactgggatggttcttaaaatcaacggacttaatgtttgtaggttttcaactccaatttgtttgttgccaagggtcgaattttgatctagaacacctcttaaaatcacgcatagcccatttaatagagtagctagttctgttttacgcaattttggtattggtgctcgc

SEQ ID NO: 12856 - DNA, 414 bp, Saccharomyces cerevisiae
ttctttctggtggcatttttccctttccttatctaacttggagcggtttcttttcgttagtatgtattaagaccttttttaaataaacttttttaaacaaaacatatacacaatcatgtacgctaataaaattatttcttttacattctttctcattgtattctatgattattttccagatttaccgtcgcaaaaaaattactctggggtgtagaagaaaacagctaaataccgtaaagagtgtaaaatcgcaaaatacattcaattatataaataactaaggcacaattcaaccagtattagacttgtgagagatagaccatttagcattgaattgaatgggtgtgcattttgatgataatgctaacacaacgtgggaagccacagaccctggcgtttcaagtgattgcgatg

SEQ ID NO: 12857 - DNA, 466 bp, Saccharomyces cerevisiae
tacaatatcgcttccctaggacgttaaaaaaaaagtgatataaaattatttatatatgaatcgattttagaaatatttattgtacattttcacctactaactaattgaataacgattagatttcgatttatgcagtccctcacgccagttcctcattatttttcgtttacgtattgtgcgttttacacttgaattaaaataacattacattaaactgaatgaaggtcaactccattcacatgcatcagttgaaaggtatataagtactacttcaatatattatctatcagctctgggaaaatgctttaagaaggaaaaaaggtaagtaaactattttttaacgcttcatgattattgaatggtccttttggctcatatcgttttcatgaatctatgactattttcactgatcatcgattaatcttttcaaggcagttctagcatcatcctgtttgttgctgtacgg

SEQ ID NO: 12858 - DNA, 400 bp, Saccharomyces cerevisiae
aaagaccccataatatctacgaagggatagactttgattgattaattagaggtgctgaaatacttcgtcgacgagtttgtgataacgcttctgttgcttagccatatctaagtgtatatgatatttaacgcaaagcaattttcttagtaatatgctatcgtttccaagtcggtattcagcaagagattcgaatttttcgctatcattactaatatctctctctgttataacgtcagctagttgtttcttttcctttgcagacttagcaagcacgtaagcacctttgatacccatcatatcgacattctctttaggtttaattattgctacaccgttgttaaccaaggaaatcaatgataatagtctttcatttttcgcttgactaccagatatccttaac

SEQ ID NO: 12859 - DNA, 491 bp, Saccharomyces cerevisiae
ctttttttttctttttttctcattttactacctcgtattatataatacctatgcatagaccaaaagtaagtcaagaactgtgttcttttaaaagtgttaacagattccagcaattttacttgaagccttgaccagtttcgtaggcgtctgctcattctggtcgatatccagaggctcgagcacatataacgaagggcccctattgtgtatatggcggcctttacgaatcttccgatattgggtagctccgtttttcttccctttttttttttttttttcttaaatttcttcttctttttttgctcttcgttttatttcactcacctgttgtcgaaaaaaacatcaggcgtataccatcaaaaaactcaaccaattgagctagtttcactttctgtacgcatgagtttccaatgtctcacagggcatgtctcacacaccaccgccttccaccttacataacgaactgcggaaaaacagcatgccacatggta

SEQ ID NO: 12860 - DNA, 480 bp, Saccharomyces cerevisiae
accatgtaattgatagaggtagaatgttgcttcgtagaaagtgactatacgattcctaaaaggggcttccttccactcatgcgaaatcgagatacatcagacgaaaacagaacgaatatttagcgcatatatactatgtatatctattgcaatcctaaaagaagggatagtgtaacatagccaaggcgacagagtgtgttatatacaaaagagctagagtatgactgtgtttctgggcatctatagggccgtctatgcctatgagccgcagacaccagaagaactggccatccaagaagacgatctgttgtacctcttacagaagtcagacattgacgattggtggacagtaaagaaaagagtcattggttccgatagcgaagaaccggtgggtctagtgccctccacttacattgaagaagctcctgttttgaagaaggtaagagccatttatgattatgaacaggtgcaaaatgctga

SEQ ID NO: 12861 - DNA, 489 bp, Saccharomyces cerevisiae
tgaacgtggagttttacttttgtagaaaattctttattttaagcctttttaaaccaaacatgcaaagagaagaaaaactttttggtaaatccaaataatttttgagcgaaattgaaaggagtacataagtgatagaacaaaatttcgttgttttcatatgtctataaggaaactccgtcactttctggctctattcattttttctttagtaaagcataaaaataatgagacggagagtaaactttacaatatatattcataaaaattcattaaaataaaactgttcgatcctattcgatatacacacacacatatatatatatatgtatatagatatgggtgtgtttgtgtgtatccgtgctaaactcgcaaatgcaactttatgtcaaaccaacttgctcattcctacatattaatccattagaggagataagtctatattttttgttcactgatatacatgacctgcgtgcccctcaaaaagacatc

SEQ ID NO: 12862 - DNA, 410 bp, Saccharomyces cerevisiae
atttaaagcaatagtaatcgtggacgatacttagaattgaatatgattctttgtaatgattgtatatatctattgcatgtataaatactctactcctcgtatatagaaagttaagtaaatttttgaaagaaaagagttcatatatttacggagttttgaagtttttcacaagcggaataagtgataccattcataaaatatcatatctatctatctatctatttttgtgagatatatggtacgaaaataaatgcctttccttttaagcctttctgtaagcttttatgtatacaacgtttctttatctttatttcggaccttgtttcatgtacttttccttataaatccaatctgaacctaatagatttgcaccttttttatcggctatcctaaaccatgcagcagctctg

SEQ ID NO: 12863 - DNA, 421 bp, Saccharomyces cerevisiae
taggcagggcctattaagtgctccctatctttttccttattcatttcatatatttagatatttacatttattttgttatttgtttttttatttactataaacgaacttttcacaggttctgaacataaacaagcctaaatagtatgttttctagttcaaatatgtcttagaggaatactactgctatactcttattgctgccgttgtaaatcatgaaacagatacagttacgttacgcgtatgacagggttcttaactaaaattatgaatttcaatacaggattagttaaattcttgtagaattagaaaattaatgcgtttatttcgtcaagacttttccttccaggacgttcaaattcaactcacatatattcttttatcaaaatccttatatcaccgcgcggtgtaattgtgaggctga

SEQ ID NO: 12864 - DNA, 459 bp, Saccharomyces cerevisiae
aactcgaaataaaacgataaatatattcaatgtttttaaattagtactattattatatgttattattaatggaatgaatcaatacgtattttatacagaaataagatttgagaaagaagggtaagaaaaaaaagaagaataagtaaatgacgaagttctttaactgagttaaagttgtgtaatgcaaatttgaagaaaggaaaagatgctataaggcaaaacaaaaaggacgtcgacactcagtcatggcatgccttggcagcattagcccactttctcgtttccgtccagcctgcatttatgacttgtaaagcatcttccagatttagaggctctctcaatggcttatcatctaccaccagtttcttgtaaactcgagcataatattcctgaggtatagcttggaaaatctcccttcgagtaactccgtcattattggcgctttcactttgctcagtg

SEQ ID NO: 12865 - DNA, 483 bp, Saccharomyces cerevisiae
acgagtacttcactttcaaatatcacgatattttggaacaattcggtattttttacttaatctagtacactaaggaatgctttgttatccggcattcgtatcttattcctcgcttctattgttctacttttatatcccgtttggctgattacggatcacgttcaaattggtaaatcccattaattaaaaaagaattgtaaccttatttaaaaaaaaaaatagtacataacaataaaaaaaaaaaagataataattttgaatttattgctagacattcttacgtttattgtgttcatgttaacaaaaacacatgcccgcggttattatcgctttttaattgctttcttaaaaagagtcggttggtcagatagagcagatagtaaattatagtgctatttaggtctgttaatttaaatgaaagaaacataaatgaccgtaaaaaactaaaggcaaaagcattaatttattttatcccgagcgcac

SEQ ID NO: 12866 - DNA, 474 bp, Saccharomyces cerevisiae
gtgatcattattttctttttgatgttccccctacgtatgtatacacccatatattatatagatacccgccgcataccaacataaaaaaggtaacaaatatttgagatatagagcatcgctacattatgggcaagatgcgtctttgtgagacgattttaaacagaagttgttcatctctcagtgatcaatacctatcaacatgtcaaattcatcagtggaaaaatttaaaatttcgaatacctgatccttcttgttcggatacaaatgaatcaacagtttcctgaagatattataaaatagcgacaacttcttgaaacattcatcgcatatttcatcagctatcattggtgacgttaatttaaatagtaaattaccttgaacatctgttaacgcctgaggtagataatagttcaacttatcatgcacattttttctgaccatgtctaattccatcaatgaattatccctcagggc

SEQ ID NO: 12867 - DNA, 441 bp, Saccharomyces cerevisiae
aagtagataaatcaccacgaatcatttgttcggtcatgtaacatgcacatctatagcaacgacgtgtctcctatcttttgcttttaccttgttttccgccggtatattcctttgccatatttactagtatttatttattattatttattcttctatttttcttttatttatttgttacttcctaatatcgtcattattatgcctttttcatatttgatttactccaatatattctgtttgagctttgtttcccagctccgaagattttgaactaaatactctttcgtcactcgcggatttttaattatagtcagttccttttcatgacagtacacatctctacagtcaaatcttcttgaaaatttcatagatttactgactgaatccatctctgctttaaaaatattctgtagctgaattaaatggctttcgatgatacca

SEQ ID NO: 12868 - DNA, 459 bp, Saccharomyces cerevisiae
aaagggacgtgtcgtaacatgaatacgtaaacaattaaatataacctactaatgagccttcattgctacttctctggttctaattagtggcggagttctgtgtcgtgcgatacgaattttgcacttttgtcacatgcaatcgaggcaaaaagaaaaaataaataataacaacgaatataaatacaaatcgaaagaattcagattgaattcaatattgcagggctttgaacactgagtttggaactatcagccgtcaaatacgcataaaataacatcaaatactccaataatgaatcagttaggagctttagccgtaagttctaaattgtaaacacatttgcatcattgaaaaactatactaacgcgttaaccttttttctatatttctatagcaagtttcacgtttcactcaaaacttctccatggaaaatattaagagcgagttccaatccttgcaat

SEQ ID NO: 12869 - DNA, 438 bp, Saccharomyces cerevisiae
tgatcctactttgcatactaataaaaaaaacacagtttgagaaaaatattaaatacttaacctcagggtctttatctttgtataatcttttcttctagtattagtagaattggcaaatcctaccaaaaaaatacaaacccatgaatcgtcatagataaggaaatgtaatagaatgatatatgtaaatgtaactctctataaaatagtgccgataacagtaatatgcattaccccttatggactacatatatatactattagacagaattgctagcattctcattgttgtcattaatattgccgtcatttaaaatggcattcatggttttatttaatggtattcgtgcaactattacagagccatcgtagccatcactatttacaggttctagtctttctggctcttcaaaatctaaatctgccaatacaacacatgtt

SEQ ID NO: 12870 - DNA, 422 bp, Saccharomyces cerevisiae
tatagctacttatgtatatagcgcttgatcattctgtttacctccacattatagtgccgttcaattcccctcacccgccttagtctttttcgggcaaaaaaaattgccggaagagagacgtcgttgaaagaatttggtggataaactcgtgaaagcttaaagtaaggcctttcacctaaactcgagtataagcaaaaaatcaatcaaaacaagtaataatgtctgaagtaattgaaggtaacgtcaaaattgacagaatttccccaggtgatggtgccaccttcccaaagacaggtgacttggttaccattcattacaccggtaccttggagaacggccaaaaattcgattcctccgttgacaggggctctccattccaatgtaacatcggtgtcggccaagtcatcaagggttgggatgtt

SEQ ID NO: 12871 - DNA, 495 bp, Saccharomyces cerevisiae
ggagacagcaaactgaaacgccttaaaaacaaaaaaagagaaataaatagagatatatgtaatactatattggcaacgaatattaataagtaatatcatcgccttttttcttagtgctgtttacaaatcggctttattatttctattttgaatttaatatacagtgagacatatttgaaattgatatatatatatatatatatatatgtagacagagaaagattagagagagaaaactatgctaacatgatgccactacgtttgtgggaacttatttttcgttagaaggtcttttagcttttggattgacaccctttttcaaaagattgtttttcacagacttttcaatgtacttatcgtcttcttcgtcctcgaaggttgcgaagtcagagtgaatgataccttcttccaaagcttcctttctagcagcagtttccttttcttttgcacttgcttggttatcatcaaacgaagatggaccgatcttttggaatt

SEQ ID NO: 12872 - DNA, 500 bp, Saccharomyces cerevisiae
tagaattcaagtcaaaaaaaaaaaaaaagacggaagtccaaaaaaatctcgttttcgatgtttagaaagaatatagatttatgaactatattatactatactacgtacttcctctgtaaaccacttcatgcgttttttcaagtgcctctgttaaagaaccttgagtgagaaacgaagtctttgacactcaaactttgctttttttgttcttctttttgttgttgtatttgaggggtggatactatcctcttcataacaggtggtgatattttcagatcttgcctcacaaattttgaccaattcggatcttgcatccttgccaagttgttttcaaattgacccaaaagtaccttgtcccacttgaatatgaaaagatcgcgattactgtctggcctgctgccctcgtcagtgtcgtctgtttctaagttgtaggcactccatagctttttccataatgccaggtcccatggaatgccctttaaagcgaggacaaaagacca

SEQ ID NO: 12873 - DNA, 447 bp, Saccharomyces cerevisiae
aattgttacaaaaaggaaagaagaaaaaattaagaataaatatataaataaagaggtcgtgaatgattaggtcgtgaaatgcagtgtagttggaaaggcgtagttttcctagcacaaggcgtttcggagttggaataaagaagctatcaccaacgaagaagcttttttgtccaagacatctcttaaaagggttgtgaaaacataaaacgcttaatgccttcatatatacatatataagtttatggtttcgatgtttacaataacttctatcctttgctggtccatgcacttcaccttggtaagttatgcaacgcacttttgtctacgcctgcattcgatataaagggtaagctgccgagataacttttgtatcttccgtgtctgcagataaaaaaataatgcattcttcaaaaactttgtacaatatcgggagagtttaacaagcaa

SEQ ID NO: 12874 - DNA, 473 bp, Saccharomyces cerevisiae
actgtactacactaatgcttctccacatgaaataattaagaaaataaggcatttcatagttctgtctgtaaatatacaatatgtaaaaagaatcgcaattagatcttaagttaaacttatattcattcttatatttctttaatatacccgttttattcgcttactcgaatttggattatggtaatgatattcacgccagaggaataagctgaaattgacgaataacttttcaaataattttattacttctattatacaactttataaatatctaagctgccatttacttaataagacgggttaattgtttacgcttcatcttcctgaccatcttcatcacatgatttgacatcccacttcattttgacatcccatctactagatttagcgctccagctgacgtacttaacaaactccaaaacactttcatctctcaagaccaaattgaaagtattccaagcaggtggatcatt

SEQ ID NO: 12875 - DNA, 422 bp, Saccharomyces cerevisiae
tgattacgtccgtagaaataaaatgatattacattcaccatttcatattatctttaaccggaatctcgaacatttattattaacactgttttattttattacgaatatttatcaatagtactttctgtaaaatggaattcattaaaaaggtaaggagggggaaatagagctgcagtgattttcaaaacgactgccttaaggtatgttcttatatacaaagtttcgttcgatcatcattcaatagtatcatttggatcagtacaagtaaacagtttgtacaatcttttttctactgcctcagtcatcaagtatttaccttcgttgtctgattgcagtcttcccttttcaatatcttcaagtaatgattgaaaactggggtataggctcacgacattattcgccttcatttcaggcattctccc

SEQ ID NO: 12876 - DNA, 464 bp, Saccharomyces cerevisiae
ttgaatcatgcacgttatccagcatgttcacgaagtgagtaataaaaaattattcgccgaagtaacatgtacacgtctatgtttgtggacaagttacgctatttgcatttagagatttcttctccaatgtaaattattttttcttcggggggtatacattatttatttaagtagacattatatttcttcataagggtaggagagagcgaatacaaatgcccagtaaattccccataagtagttcttaaaatataataccataaaagtggccataaataggaagggccatggattattgggtagaatttttataaatgccatatgcaaaataaaattagagaatgaaataccgaatatttcccaaggataatactttttttctttccatatgactttctcgacgttttcttcaaatgactgagtcattgcttccctagaaaagtatttcttgactcttagcgggc

SEQ ID NO: 12877 - DNA, 472 bp, Saccharomyces cerevisiae
gaaggcatataaaatagatcgttaatatatttctaacatcttcttgtaaatgtaaatattttaaaagggttgatcttattacggagagaaccaatcatatcgaaggatttctcaatagtaagtatcccgcgcgtggtcctcggggaaatagaacgagaaacttcaagtacttgatagcaagaaagtgagtgcttggcttccccattttgattataaagaaaggcattattttctagggcaagaaaagacattgttgaaattgttccagaaactttcatttaaagtctttcgtgaaaggagtggacgtcaaaaagaaataatgatttttaaacgtgcagtatctacattgattcctccaaaagttgtgtcttccaagaatataggttcggcaccaaatgccaagcgcattgctaatgttgttcacttttataagtctttgcctcaaggaccagcaccagccatcaaggctaac

SEQ ID NO: 12878 - DNA, 451 bp, Saccharomyces cerevisiae
aaatactcctaattcaatttcttttaacaaatatcttgtatctacaaaactaaaagcagtgtatatacgtcaatgtgcggtcctcagcagaaggttattttatcttgatcaaatagaaaaatcattagaactttttactgcctgccctattttggttaatttgcacacatttcagtgcatatttttcgccaatccgtaagtatttggaggcacgtcccggactaaagaggatattctagatacagagcttcaagtgctatatacggaggaagatataaagatagtgccagcttgaagtatcacggtatgcatttctatcttattcaccatcaaaaaatacgtgtacccccttgctgtggcatgctagaatgcaaaaaatgatacataatttcagaccacttaatctcatggtttatatacaaatatgaaacgttttgcaggtaactgatgg

SEQ ID NO: 12879 - DNA, 434 bp, Saccharomyces cerevisiae
tctgtgtgaagtgtcaaatagttaaaaatatgtaacgcaaagttgtagatagaaataacaaagcaagaaggaaaagtaaagaaagtgaacgatatacgtaatgcagggggaataccagagtatttaaagtgtacttgatttaatgttaaccagtttgaatttttcttttctggggtaatcgaattcaagaccttttgggcacaatttgacgcggtttcaacctgtttagcctaggatttgggaaaatttcatcggtgtgcaaaggcggaattggtccaaagatagtttgtggatttatatcttgctgtcttatcaattgctcttgcaaatacggggatttagcccatgccgctaaagttacgctagcctcatcttcagaatcagtatttatctctggtaaagaatcattgacagaggctatctttggggtcaca

SEQ ID NO: 12880 - DNA, 476 bp, Saccharomyces cerevisiae
agtactcacgttctcgtgttaatcccgcggtcttcttgttttactaacttttctttctctcatagcattctcttgacagtgttttatatacatcatatgtacatttatcgagccaatcgagggcagcagtttaacatcaagccggatttgctcacgctactttgaccccttttcgtttcgacggagagaagaaaccggtgttttcctatccttgcctattctttcctccttacggggtcctagcctgtttctcttgatatgataataggtggaaacgtagaaaaaaaaatcgacatataaaagtggggcagatacttcgtgtgacaatggccaattcaagccctttgggcagatgttgcccttcttctttcttaaaaagtcttagtacgattgaccaagtcagaaaaaaaaaaaaaaaggaactaaaaaaagttttaattaattatgagagctttggcatatttcaagaagggtga

SEQ ID NO: 12881 - DNA, 477 bp, Saccharomyces cerevisiae
ccaattcaaaacttccaacagtttggtgatgaaaataataaatgttttacgttaaccttattgattaacctcacctcccttattctttgtatagtataagtgcatactaacatactgtgtacgtacataaagatatgcagaacgttcacaaacatgtagaaaccagacacgaaaaaaaaaaaaaaaaaaaacataaatagattaaagatatttatcaccacaagtatacgatacggcgctgataatttacaattctatccttcgggaaagacaacaataatttaggctgataattaaaatcgaaggaaaagcaagcgctaatgcgcgaaaaaacacttaaattaaaacccgaatcttctcttagtatacatatatgcagaacatgctagcatacacataaaaagcacaatgcctataaaccatgtcaacgaatccctgtattgtccgggcacgataacattcataccccacagaccc

SEQ ID NO: 12882 - DNA, 418 bp, Saccharomyces cerevisiae
actccttttacttcggttgtgaaagaaagttgacattatcgatttgggtgacacggtgattgaaaaagcaacgaccagtattatacctcttttttttattattcagtttatatttttgcaagtgatcttaagcatttctacacaaacttatgccaacgtgaccatttattattttatatagcaaaaaaaaatgaggggccttgcagaacaattgttgcgagtttctaataacaagcacgtagaatattggccatttaatttttctcttcaatttatagaatggttgtgttagtgacaaaaagaatattcttccccgccaggactcgaacctggaatctcctggttcgtagccagacgccgtgaccattgggccacgaggaacaagaatataaagatctctgagggcaaggtatgccta

SEQ ID NO: 12883 - DNA, 488 bp, Saccharomyces cerevisiae
tggttaagatagaagtaaccgtgagttctatatataaataaacataccatatatacatgcatcattataagggttgaaaaaacatcgcgaatctcgctactttccttctatgctctttcgtttctcaaacccgccagtataagcaacttttattaccattggtgactacacgttgctccttttttaagtgtaatttactgttataaattgagtccaaatctgtcgtgtcttgtcctggtttgagaacttcgggaatgttcattggcttagcgcatttcatagttttctttccaatacctagttggccatggtcgttattaccccatgcaatgacctcgttttcttgttcagtttcagtgaacacacaatgagagccgcaactccagttggtcaatttcttgtcatccgacttgatttttatgggatcacattgcgagttcttgaaagtgttgttgcccaattcaccaaaaagtccattaccaaacgcg

SEQ ID NO: 12884 - DNA, 404 bp, Saccharomyces cerevisiae
caaattgcctaatgagcaaaaaacctaataaaatgatcatacttagtgttcattcaagatctttcgctagtattaaaattcgagataattaaacacactctttagtcccaggaaacactactattaagcttgttggtcgtacaggatatagaggtcatttcgattatttcattcttccactaatgtttgattgacgattcagatcactgtttttgtttggctgataattgtaacaagaaaaaaaaactaccgcttcttttcagtatttctgttgaggatgatattttcattgattctcttatcagcttcagtgccgatatcctatcaggctctagtagggctgaaaattaggtggaggcgattttgttactcttttgttcaagtctgagcttatgacgtcctgc

SEQ ID NO: 12885 - DNA, 422 bp, Saccharomyces cerevisiae
gtagtaagttcaagttcagaagacccaactagttcaagcgctgtgactacttcagttgacccaactacttcagttgacccaaatacttcagctgatccaactacctcgaccgttcaaactacttctgttgatccaactacttcagttgacccaactagttctatagtcagttctacttcagttgatccaactacttcagttgacccaactacttcagctgacccaactacctcgaccgttcaaactacttcagctgatccaactacttccgtagtcagttcaagttcagctgatctaagtagctctgttatcagttcaagttcagcagacccaactagttcaaatgctgtgactacttcaattaacccaactactccagctgattcaactacttcggccgttcaaactagcccagctgatcc

SEQ ID NO: 12886 - DNA, 494 bp, Saccharomyces cerevisiae
tgaattttacttcacgctactgatattttaaaacattttattgttactagtgacctggtaaaaatatttacaagtataaaaggaccaatttactgaatgaagtaaataaggatcattgatatgttacgataaataatgcaaagtaaaggagaagaaacgaaggggtccaaaccttagtaggttagctttctataaactttgacaggctttatatccttacaaaatgcacttttttcatacttttttgttagagtatgtcttggccctaaagtgaatttagagttttttagatttcaaggctacgatagtagccttataacaatttcccatgtaccaaacataattatactgttcggaactgttctcatcaaatgcggggtcaacccactatacattgaaaagagtccctcttctttaattataactttgaaactttgtactaaacctgtatactttcgtttaccattttccttgggcgtttgtctcaatctcgt

SEQ ID NO: 12887 - DNA, 400 bp, Saccharomyces cerevisiae
tcataccacatactcatatataaagactttatttattattattttcaacccgaaagaactaattattcttcagctacttcatgcaacttctattatcttccttttccgttacccgtatttttaagttgcaattattaaaaaaacaattaagaaaataaaacagcgccataaggcatggacgatagaaatacgaagacgaagaaaatcatcatcagtcgggatcaaataagagataattttgaaaatcgaaagttttcattatgacagaaagtgtaggtggaaataaactagtagattttttggtaaatgttcaatccattttgaatgctgcctctgtgaaatgtcatgtagtagatgaaagttttccagccaagttctttgagaaaaatccggataagat

SEQ ID NO: 12888 - DNA, 403 bp, Saccharomyces cerevisiae
ttttggattattccttccactcaaaccaattgtgcacatgcattccctatatatgtatatatatgtaacaatacatattttataaaataacgaacgatagtttatattactacttcaacaatggtttatttcttattggagtgttccctacattatgttttacttctttcaattattcatagctacttcgttgctgaagttagccaggttgtccggtttagcggcgaccggatccgtcgccaccactggattagcatttgtgttctttacttcagtgtccagcttaacagccgttttatccccagcgacattttgtggtactttgttcacatgagaataaatgtatggaggtttaaaatccttaatgttacaatttcctaggaagtttgggttcggtaccctc

SEQ ID NO: 12889 - DNA, 500 bp, Saccharomyces cerevisiae
gtctatgaattacaaatacactaaacacattctacttatttgtgttttgtaatttctggaaaaatactcattaggcaaattcacgcagcatatttacaaaatgtcacaaatttttttccttttttacttgcagtaggtatgtaatgccatactagcgtacatagagctcttcatataaaccgctatttattactaattttaataattcagtaattcattaaatacattcattactttctgggtaaatatctattcgtttctcatttttctttttttgacatatcccggtaccggaataagtccgatactattcaaaagcttctggaaaaaaaaaataaaaaaaagaaatgattagtaatcatttaatttcatgacatattaaaaaggtattctaagcagaagtctttcatcacatttgatctaagcatatacactgtaagtgaaggtatcgatgtcacaatacaaaactggtttacttttaatacatccggcggtgacta

SEQ ID NO: 12890 - DNA, 412 bp, Saccharomyces cerevisiae
cgatctttatatttgtcaccttttccgtatcggcggctaaaaggcgatgcggtgcacaggcgcggggtccctgggaaaaagaaatgttcaaattaacatttctttttcttgttttgtggctcttctagaaggatttttaatcagcatagcctgcgttaaaattttttaccggatcttatatatctaagacatctactctgtttaaatacttaacgaacatcatagagaatcaactaataatatagattagaaaagagaatttttttcgactgcgatgctagataacatgcaatttcattctccagcaccggaacatcctcaattgaatgggggtattaacaaaattcccgcttcccacaaaataggttacaaattaaaccagcaagtgcagagattggctgtggtcaggaat

SEQ ID NO: 12891 - DNA, 419 bp, Saccharomyces cerevisiae
tggtagaagaaagttagataccctcattctaaaacgttgtccgaacaccatcagttagttttttcttggtttcattttttcatttttttctaagatgtatatatatccgtgcacatatatgctacattatattatacaaggtcggatggcgagttattattaaattattattgttaatcacttcattagtttttctcccccatagcttctttgtgtgtgctctccagataattaacatgattggtcaaatactcacacattgcatcccattctggggtattaactttatcggtaaaatacttgaatttaataacttggcttttcggagtggtacagaaggaccccctcatatcattgaataaaaacaattcaaaatccattccatagcgatgcggcttcctgaagccccgtacttgttc

SEQ ID NO: 12892 - DNA, 428 bp, Saccharomyces cerevisiae
taggcaggacaatttcagtgtttgtaaaaatatatttatatttatatatttaaatatactaaataaaaataatactatcatcgttgtgatgcaaaaaaaaaaaaaaatgaacagaaaataatagtgatgtgaatggtttcgtgccaaggaacaaggccatgcatagtaaaccttctcactatgccaagtgaggataaattgggtgaagagatatcaacgagggtgattaatgagtattcaaaactaaaatctgcctgcagaccaataattaggccttcaggtatcagagagtggacaatattggcaggtgttgcagctattaacagagatggcggtgcgaataagatagagatactttccatagctactggtgtgaaggctttgccagattcagaactacaaagaagtgaggggaagattctgcatga

SEQ ID NO: 12893 - DNA, 473 bp, Saccharomyces cerevisiae
tcgtctaagatgtgagcaccatataaaaactttaaataatgtcagtatttatagcgtgatagttcattacccgccgactgtgcgcattcgtggcttctgctcactccggataataatactaccaaggggttctgtaaggcttgcgggttacaaagcacgggtccattgaagatcttacacaagaaggagtggtaggaagaccagcagattatttccaatcggtcgttgccattgtcttatttccttttctttctggcgcattgcattttaacacctttttttccagaatagccaaccaccgacgtctgattcacacattactgggcaagatcttgacatagcattacattacaacacggcaacactaatcacgcaacgctagaactcgcgcaggatgaatattcaaagcaataattctccgaatctcagtaataacatagtgtcaaaacaggtttactacgcccatcctccac

SEQ ID NO: 12894 - DNA, 412 bp, Saccharomyces cerevisiae
acatataaacataaagatacatagcaaataaagaaagcaagaagagtaaagcttgtacacggttggtaggtataacgcaaaggacgctttcggtatttttttttctattcttgttcttgttggaaacgttgcaaccatgtcccgatacatagataaccagcattcctcatgcagcgatcaaatggatagtcagtcgcaggccacttcctaccgatgttccgataaatgtatcatgttaaacgagtatagaattctttggcgagaaagaaaattttcgaattttgctggaagggcaataaggaaaaacttggatgagagaaccaaggaaaaaaaaataaaaaaaaaagaaaaataactgcgaagagaggcaaatatacgtaaactctccagtttcttttcttgtatttttcgc

SEQ ID NO: 12895 - DNA, 400 bp, Saccharomyces cerevisiae
atgaaatactgacagcttatgatgctgataaggaaaatattgccgcaaactttgtaataagccaaaagcactaatctcttttccgttagctttcataaaattagtgtatttaagtaaaccccggcccaaaatatgctctcaaatttgcttcatccttctgctttcttatcctttctacttcttcaaagcctcccgattttttcaggtttgaattacccacaaaattttccagttcatcatcaaattcattactagctttaagttttctttccatctcccacatcttctcagccttgtcaatagcttcgaccctactatcgtggtcagggtttaaagattggacggccaccataacttgctcccttacctgattaaatgtgcccggtctcataataggcaa

SEQ ID NO: 12896 - DNA, 482 bp, Saccharomyces cerevisiae
ataacttatggcatgggagggtacatatgagcgccttttttttctcgctttgggcagctcatatcatgttccctcactagctaataatataatgaattttttagaaggagcacgattatataaaaaaaataccacttatgttgctacccttatatacgaatttataatacttaatgacgcttcaatgacgcctgatgtcaaatgcttttggctcccagtgaaattgccacacttccttcttctttccgaactttatagtatcatcgaaaaatacaagttggcaaaggtctattacaatcgcggaacgtacgatgttcatacggtttcagcgaatagtcttgtaatatccggaagcatgcctaccggcattattataggtagttcatcgcccttggactatgtaggggtacaagtaaataggcaacttgaaatggatctccctattgaatgaaacatttaagggtgcccaacccttaagttga

SEQ ID NO: 12897 - DNA, 422 bp, Saccharomyces cerevisiae
atctagccgcccaatgtcgcgggttgacccgcgacattgggcgggcaatactctcatcttattggctattcaacttagacaacggccagttgcgcgcacaaatttggtcatgaccgctccaccggcatgcgtgtcgtcatcccgcatcattcgggacattttggccttttccgcagtgcgtagttgacgtggggagaaagctagtgggctgtcgcatatggttggttttaggtggcgaaagtttcgccgcgatagcaatcatgtcctcgaccttaatctcaatggaatgggtcatgctcggtaagtgagtctcgctgtatataagtatatatgtaatcgcctagttcgatagatacaaggaggtcttgagtatgtagataaacgaaaagaagataacaaaaggaaaatctcagcctctcccc

SEQ ID NO: 12898 - DNA, 449 bp, Saccharomyces cerevisiae
acacactagtgcatcaatatttgcacacatatattcgcatatatatatagtaaaatctaaagtaatgtaaatattccagggagaatcagcagaaacgagacgaagtacttcttaacaaaaagccagataacggtgcaaaaacacattatattctccatcttgaaaacacaatctcctacgtacacatatgcgtatttatttttatatgaatgaaacgcctatggatatatatatgggaatatagacattcacaatttcaggacaattgtgatatggcaatatccaaggcctgcggtgctgggcttcgctttttttcaccaacaaaatgagatggacaagtttatcatagcaaagaaacaataagcagattacataaagtcgtcatcaccgaattcaaaatcgtcggggccatctaggtcgaaatcttgatctttcttaaatgcgccacc

SEQ ID NO: 12899 - DNA, 452 bp, Saccharomyces cerevisiae
tactacttaaaagcgcaacagattttatataatgtactatatgaaaaagatatgaatattattatgtaactcataatactgaatcttaaatttcaatgaaactttcgctggagctacaagtattcttgcccaatggccgctacccgcctcttcttcgttgttgaagttttaaaatttagcgagaaaagaaaacaaaaccgaaaacagacaaccgcaatcatttcttcaacacccaacatccagcacctaaacaccatcaatacacgttttaaacaaaacaaacccatagcccaaaaggtagtaaacacaaaccgttgtatacgcaaccgccctacataagacactatttgcgtacagattatctcaatatgtctagtccagatgattttgaaactgcaccagcagaatatgttgatgcattggatccgagtatggtcgttgttgacagtggt

SEQ ID NO: 12900 - DNA, 430 bp, Saccharomyces cerevisiae
atttagactttgtttggaatacattgaaagagaaagagtggttaatcgggtgtagaaagaacaatccaaagtcacctttattggcgatatgtgtcattgttaatccattggccacatttttccgatgattttctctcggtgtgcaatatagtaataagttttcaccttttccggtgaataatgaaaaaaaaaaaacgaatacaaaaaaaaaagtaatttctttcaagtttatatatataacaatataatattaagtaattttaatcgaaaattttttcctctaaagaacccaaaaataagcaactattgaatgaatatctaaaatgatcggaagaaacggtgtgcgcggcggagggaagcgaaaaattgggaaacggaagcaatcacttctgtattaacaattgtttaaagctggggtgactgaacctac

SEQ ID NO: 12901 - DNA, 447 bp, Saccharomyces cerevisiae
tcaagggtcttccatacttctctcaatgccgcgtctacaattcatatttttttctctgttggccaatgccgcttgtttttttacgcttgaggcgcattgcattgctggcacgtttttgtgcagcatgaacgatataaactataattttagataatcaaggatccacctttttttttcatgctagaaaagtctcgcgggcccatctgagatatattagaacatatacgcatcctataagaagagcacattattcttgaattagttcttccttttcctcgaccttccagcttgtaaaatgagccaggcttgaggagcatagatacgcaaaaatggaagataagcggaaaagacgagccgctacacttagtacagcattgatattatttgtggcatgctgcgtttatacactatatatattcaagtttgataaccctcggttgtctccac

SEQ ID NO: 12902 - DNA, 486 bp, Saccharomyces cerevisiae
tcaagccgaggagtaaaaaggtcaagaaaagtatatgcacaaatttgtacatataagagcttatttatttatatatttaaaatttctgaggccatttaatgtgtatatatttaacgaatacctaaatctatatatttcttttttttttttctctctctctctctctttctctttctctcttggcgtctatcctgtttgcccttgcgcatgctaccgattgcacgtgtagtattctacttgaggttgagctgattactaattgctattatcattgttggcgcgaccttaaacctggaccaataacacaggccgaaccactagcttcgcaaaaaaaaaagtagggatgtgccgaaaaatttccgcgaccgtagcagacacccctgatgaagaagctataacttgtatataagagcgttgcatccccaaaatatacaagctagctacagcgattgcttttcacttgctgctacaggaacgaaaccccaa

SEQ ID NO: 12903 - DNA, 483 bp, Saccharomyces cerevisiae
ttcgggtgttttctcctatcctctgctgctctctttttctttccattcgtctttgtaatttataagctgttaattttcattcaagtttcccttatctgttttactttcgatttaagttttacataatttaaaaaaacaagaataaaataataatatagtaggcagcataagatgagtgaaacagaattgagaaaaagacaggcccaattcactagggagttacatggtgatgatattggtaaaaagacaggtttgagtgcattgatgtcgaagaacaactctgcccaaaaggaagccgttcagaagtacttgagaaattgggatggtagaaccgataaagatgccgaagaacgtcgtcttgaggattataatgaagccacacattcctactataacgtcgttacagatttctatgaatatggttggggttcctctttccatttcagcagattttataaaggtgagagtttcgctgcctcgata

SEQ ID NO: 12904 - DNA, 406 bp, Saccharomyces cerevisiae
aaggcggagaaataattttataaaccaatttaatttcattcttcattttttcgtctccatatgacaaaaaaattgaaaatatgtgtgtgtatgtatatataataatagtaataataacaatatgaaatatgaaatatccaaaataagagcggaaaacagaaattatcataaaaaagaaaaaaataaagtctctaaagggtatcaagcgcttatttcttcttcattctaccaaacaatcccttcttcttcttcttttgcttttcctcagtctgtacgtgttgttgtggctgatacactgcttgttcaccatacatttgactggaagcaccacccacttgctgtggcataccgttcgcatcgtaagtcacagcagcaccaaacacagggaaatcaggtcttacgcgga

SEQ ID NO: 12905 - DNA, 473 bp, Saccharomyces cerevisiae
ctggagtagtatgtcgatgttcgatgtttatgagatatgtatttataaaattaaatgtctgtcgggtagtttatgtagggatgagaaaagtagtataggttcatgaagaagtacaactttttttcatttatgcaagggcgtaaaaattatggatggttactactaatgatcaaagtaacattaatgcaataatcaaccaagaagaagcagaggggcatgaacatgttatgaatacaaaaattcacgtaaaatttgatcgtcacttaaattttccttgacaatcatataaacacctattaataggtttggaaaacgcttggtgaagtaatcgtaaaatccatcgggtaccggccccattagttctgctatatcttcaggtaaatccataaaatgatgatatttattcctaagtgctcttaatagatccattaactttgatgaatggtattttctgtacctttcaaggttgtcca

SEQ ID NO: 12906 - DNA, 423 bp, Saccharomyces cerevisiae
tagacggtgtcatcctgacattgctttcatattctttttcaccatcacaaatgaacattttaagaaatattactatatactggtatatattcaacattttacaacggactacccgtgaaatatttcctcagggtacttgaattcaacgtgcaagttttcagcaaactttatgtcagaatcactgaagtcctttttcctcccagcagcgtcaccgcaataatatatccaattcaacttgatgggagaaatttgttctgaaaccctgtatgcactttccaggtcccttttaaaaaactctaccattcctgtcattggttttcgaactttttcgaatatgttaggatcattgttataactttcacctaagcttgcgaatgtgatcttactatgatttgctgcaaaagttttcggccttttaggtgc

SEQ ID NO: 12907 - DNA, 419 bp, Saccharomyces cerevisiae
catatgttcaccgagttttgtcatgtcgtcatactatacggcagcggcttgttgctgccgtttaatgaaacagtttttttcacgacaagattcttctattgattattcacatatgtattttaatgaaaaatgagtactttataacacaaccctaatgacaaatgaaaaagttgattgccatgaactcttaaagcgatttatgagaacaattaattgattatatatatatatctttgcaattatgtcgtttgttgcaagatgcttctgaaagtaagtaactctataagatagataatgctacaagacgccaaacgcaagtgagtaagaaataagagctggcaggtcttcgccggaacactatcatcaaaatcactacaatttagcggcttagcacaatacgcgttttcaacttcctacgc

SEQ ID NO: 12908 - DNA, 436 bp, Saccharomyces cerevisiae
acacttttattttcttttggcttgttaacctaaacttgtacatatgcccatatatccttaaatatatatatatagccaacccgaagacgctaaataaacgcatttttttttttttttacagaattattactttcgtacttgggtttatgcttcttataacaacaactatgagctataccatgttaacttggccttcatacaggggggaaatcatatgatgatacgtattctccttaagatacgtttattcacacttttccttagattcttcattttcagcgctctcatcagaatcactgtcacttctttcgtccttttggataccttgccatatcaatctgtacaagattctaagaattaaaaacagccaatacaggttaactaattgtaacgcagcaattagtacaaatacaattggcaacgaaatccaacattt

SEQ ID NO: 12909 - DNA, 422 bp, Saccharomyces cerevisiae
cacaagagtgtcgcattatatttactggactaggagtattttatttttacaggactaggattgaaatactgctttttagtgaattgtggctcaaataatgtaacgatgagctcatcagctaatatgtggcttagcggtaaaaatgacgaattgtgtgtaaactttactttaatatttactgcttttttgctactttggtttctatttttttctatagaaaagcaataacgtctgtattatatataaatataaggagaaattgatacaagttccacacaagaaaaattttttaagctcgaaacaaaagtaagcttttgctccaaaagtcgattagcagaacagtctttaataaacgagagaattggcacgatcacttaattggccatttttttaggagcataccaaaattcaggccaggaaaa

SEQ ID NO: 12910 - DNA, 430 bp, Saccharomyces cerevisiae
tcctagctttgatatactctaattactgaaattgaattccttttcaaggctccataactatatggagcatactatgtacttatcataataaagaataaacaaacaagcaaacaaaaaaaaaaaaaactatggatcatagttttcaccaacaagcattagaatacaaataaaatttatatagtgaatatccttcaaataaatttcttctttcccttataaatcaaatagatggaacgcacgctccaaaactagtcaactagaaaaaaatacccgccgacggacaattttgaagagagatgattaatgaagacaaagtgaggctggacaacaagaacgacatacaccgcgtaaaggcccacaagactgcatggaatcacacgtcaaatatcttgacgaattgatattggcaataaaagacctgaactcgggg

SEQ ID NO: 12911 - DNA, 408 bp, Saccharomyces cerevisiae
tatagctacttggcaggcccgtttacgtaggcttgattcagatatacgtagtacatatgtccctttgatttattaattaggcgtttgctctataaaaggggttttgagtttgcgttggtgctgaacaaaaacacttgtcattacaatggcacaattttgaatgcattgttttcttatttatatatttttccaagtaaaatcttaggattcaactggtacatttattcttttagattcaaaaaccctgctacattagtaacggcaaactcctccctctgatagttgtgttgcaatactcagctgtcagcattggatagttaagatgtattgttaagtcaccgcctgaaacagcaacttaagctcccttctgtgcttaggaaggtacgtgcgcctcctaacccatctatt

SEQ ID NO: 12912 - DNA, 417 bp, Saccharomyces cerevisiae
tgacgatgacttcagtctattagtatgatgtttactaattaagcaaaatcagctcttgctgaataacactactattaaaaatcataaaaacatctttattgccaatagtgaagaacgacaaggccttttaaaaggcataaaaaacaatgataccattctgcaatgaaaaaaaaagaaaactttgttctttgtgtataaagaaaatattttagttctcctaaataaataaatactaaattatacgaaactctttcagtcttttctcctgcttgctgcttgaacagtactcatgatattctattaatcttctgtgggcggggtaactaagccttcactgtactcgggattttgaataaaagtcaactatccaatctggaaggcattttaacatacgccattaggagccgcatagcaagt

SEQ ID NO: 12913 - DNA, 476 bp, Saccharomyces cerevisiae
aaactgtggtataatgcgttgcctaacaatactctcaagagataatcaagatgagagaaaaagaatcatactggatgtccttaatcgataacaaaaagtttttaatgaagaatgactaatgatgaaattgttatacaaatacaaacaaactacacgcttgcacatctcagaagtgaaaaaaaaaaaaagaaaattgaaaagtaaattaaaagtcatttattttttattgcttaaataaaacaaaatgatatgtcatattctcgattggatgtcaacccaattttattctttggtttgccagcatgatcatcttcacttgcaaattatatagtaaataaccaattaaaataataatagtaatagaaacagaaagtagaacactgttattggattctttcagttggaattattcatatataaggcttaagccaaagatggcaagttagaaacgtcaatgttacggttcttttgaacgg

SEQ ID NO: 12914 - DNA, 466 bp, Saccharomyces cerevisiae
agtgacctggctctatagtgttgtccctctcgcgaggaccattgttgcttgcatatggcttgaaacatatgtcatcacatctgagcgattttacctcttagaattagtttagatatatatgagttgatgaataaatagttataaaaacttgctttggcttcgatatatgaccgttatttttgactaagttttaacgaaggaatctaacctcgttcttgtaattaccaaaatcttcaacaacgcgctgttggaggtatctctatggatgtggcttgaaatatggatgtcttgcctacttctacttctgggaaaggcatttttactcgatcgcgttaatatatgcatcaagaaaataaaaaataaaacgcgaagagctaaaaaaaaaaaagaaaacctactataaataaccgattagaatcgagtttttgtattgaaatggcggtaataagcgttaaacctcgacgaa

SEQ ID NO: 12915 - DNA, 451 bp, Saccharomyces cerevisiae
atgtaatcaactccccttcaaatatatatatttaataatatatattcaacgcattttttaagctagcaggattcagattactggtctacttcatattaaggaaatacaagatccattcggatgctagaaaaaaatcaaccaactattccaatgttggtaagctggtttgataaagtaaacacaagatactacagtatacgatcactcagacatcctaggaaggtctctaaagaagagcggtcaccgagagtactaacgatgggttcgtaagcgtactcctaccgtggaaactgcgaatgttaaggaaccagtctttcatcaccgtgatcataaattatatatattatctgtctcctcaaattacccacatttgataatctcatgagaaaaaataaaggctcagatctgcatgtgttgtataacactggcaagaaaagttcccgtttgcaaa

SEQ ID NO: 12916 - DNA, 449 bp, Saccharomyces cerevisiae
tattcatgataacaaggtgaaaaatagcatcctaatgaaggatagataagtagattttttcttttaaaaactatagtacaaggacatgcaaagtcatatatctaaactaattttggtacacgaccaacaaaaaagggtaacaaagtacacatattcgcgtcaataatatgaacaagtttgtttatttgcttttcaaatttttttctttctccagcaaacaaaagtcttaatgcattaaataagaaccttcgttttttctgcttcttgaattaccgtcgatgccattcgattcgaacttgtaagaaattttgatatttagatctctgttattcttctcgtttggagagcaaaccaattcaccttcaatggtgtcaccagtttcagcatctagatcatcagggaaataaaatattgtttgcttccagtgagtgtatggagcatgaggacca

SEQ ID NO: 12917 - DNA, 462 bp, Saccharomyces cerevisiae
aaagacaaaaatgaatagaggaaagccgagaggtttgtttcaaaaattgacgccttcctcatttttttcataattagctggtaaaagttactatttgtaacgactgctaaataacaaataattattcgtgtaaaaataaatagctaataccaccaggtgttcatattccatgactgcatatttgggaaacgagacggtttgaacatccttagttgatgtaaaactataataaaagctctatgggaagtaaactatctgcgggtcgggtaaggaatgatgcttgctcgacgtgtagcgatgaaaaaagtgaaaacttatttgaactctagaaaactgctaagatcctgaactgataccgaagttaatgaccttgaccggtcttctgctgtatggattttaaagcaagtgggacaaagtttaagaaaactggcaagaaggtagtgcctgctaaagcgtttgaag

SEQ ID NO: 12918 - DNA, 440 bp, Saccharomyces cerevisiae
catcactacccatttgtctttcctagcacacatgtttcataacattcttaataagattttgattttttatattattagccagccttgttcatttataaattgtatagcgcaggaaaaaggcatctgcctatctatggtatcaacaacattagtcgtcattagttagttagttataaagacatcattcactcatattcactacgttgtcttcttctcaacaactacctctaactgtttttttacgcgtcatttaattgtagcgaatttctatttttggacattctcgtaccggtgcattaaaggctaaaagctaaaaagggaacaggagcctaagaatagagaataaggaaatttatttaaggaaaggctaagcaatgaaatgtttcgttattttattgtattttcaagaggatggaagaagaacctgagcacaaacggat

SEQ ID NO: 12919 - DNA, 410 bp, Saccharomyces cerevisiae
ggtaagttttagaaatgtgcattaaagcagtaatgataagacgaaaataagaaaagaaatccataagctgttttactcgactcaacgttataattagtattattgattcatatcctgtatatacaagtaacattatactcttttctgtacttcatctttacctttttatcttacatggcacatgttgtttgaaaacaagatcataggtggataaagcaagccgaatctaaaaaaaaaaaaatgtctctattggaaaactgaatgcataacgatattcccttttcatgcagataacactgactagtttcaatttgaaacgcatcttcgtgttatttcaccgaaacgcactcggctcagcatgttaaaaagcacatcaatttagggctctgcgcgtccttctgcgtattctt

SEQ ID NO: 12920 - DNA, 461 bp, Saccharomyces cerevisiae
tcgtcataaaatgctcccatctcaaaagtagggcaaaattcatgatcgaccgcgcaaaataaatagatttgcaaataagttttgtatgtacatttattaatatatataatatatcaaaagaaaaaaatcaaaaaaaaaaaaaaaaaaaaattgcactcttattcagtcatcaattacaaaacctagagatagcgatggtgcatattcaataaaaaactccttatactgtcgagaaagcttattattggtacttctcgaagatactaaaaaaggttaatttttggagacggaggcaatagcgactagtcatactggtcgacattaatttcaatttttggctgtgcccacctcaatttttgtttattataccatgggtaagctggcaaaacacatattaaagtaatcacacaactaatgccatacgcagtcagtaaaactttcagggactgttgtgcaaatcc

SEQ ID NO: 12921 - DNA, 463 bp, Saccharomyces cerevisiae
tgcatacataatggataaatagcacaactttttgttgtattatatcattttcttcaggtgtaccgcggcatcaataaatgaagcgatgttcggaagaaaaaattggcaacgaaaacagtattatgaaagttacatatgaggatcgttctataagcaaaagaaacaaaaggatgatatgattagtaaagagtatgaatttggtaagactagtatactgaatagaaagaagtatacattagttatcgatgaagacaagaatggcaattttataagatttaccgttttacctgtatctaaccgaaagttcaaaaaagtcaagcaaaatgggagggtagagattaacatgggcatacaatatcaccaaattgtacttattttactactgaatattttgttctatgtaatttgcctaagatcaagatttctcgaacatattaatagaacttttgaagtgacaatcgcg

SEQ ID NO: 12922 - DNA, 481 bp, Saccharomyces cerevisiae
ctatctaactgagggagcttcgaagtttaaactgtttcgtatagggataccgacatgtatgtttataatataatgatgtttactatgagaaaaaggctgccggaatatcaacggttgctgtggtgagaaaatcgggtaacacctataggggttccatcacttcagatgccttgaactttgaaatctatacgaatataggaagactgagttggtagacctggtaagatagaagaggaagaaggcttctttattaccgcaactaagaataaacttatagcttcatgcgaatctcaaaaaatagtcataagcggcaaagaacgaggctatatttcctcgttacatttattatttattcgataataccctgccgtgcggtactcgtgccttggctggatgatgacccatttgaagcaacgcttctagaaatgggggatgaaccatggagtaaggacatcctttcaagcacacctccgttacatcc

SEQ ID NO: 12923 - DNA, 420 bp, Saccharomyces cerevisiae
tttctcactttccaccttcgcatccattcatttataacattcaaacatttttttttttagtctcattctaataactcctgagtatagtaatattaatatgtatgtattgatgggtatgtaactgtaaaattatattcggtctatgtctattgtagtttcacacgttggaatgctcgtttgaatgcacttgtcaatggctaaccttaacatcaattcgtcatcgtcggagcctcctttcattgttatcttgatcagtaccacataaagcgtaaaattcactttgcttattactatatcatcgtaatttaggatgtatctggatttaaactcacttaatctctcgatttggtccttgatcatgttcttaatggttgttggattttcagtgaaacctgcagaattcaaaaacccagttttccg

SEQ ID NO: 12924 - DNA, 496 bp, Saccharomyces cerevisiae
atctctacttacggataccgaggctcggggcgcgatgttattgtcattaacaatctcctatccctccctatgtttatatagttttcaatggaggagcatgaaaaccccttaaatagtgtttatttgatcgcgcaatggtgatgattggatcttcatatcacaagtgggatactaggacaaccgttgttggatttctattatcataatatatacgggtaacgatttttgatgcgtcgcgtttgtaaacaaaactaaacaaaacaaacaaatatactcatttgatggcttcatctgcatataagaaatagaagagccagaatactaagcataaccataatatatattacagtctatttcagttgtagctgaaaaatcaatatggaactagagcccactctttttggtataatagaggcattggctcctcaattattgtcgcagagtcatttgcagacatttgtatctgatgtagtcaatttactgcgatcatccacca

SEQ ID NO: 12925 - DNA, 497 bp, Saccharomyces cerevisiae
tcgtttataatcttatttacaagtcagtgcataaaatgatataatatcacctcacgcatgcctattttatacatgtactttatatacctcccttttttttaacgcatttctattataaaacacttctgctttcctatcctcaagatcagtactcgatcatctatcaggaaaggagccaagttagaaatattttcgtttactttagattttgaatgatgcagatacacgcttccctgggaaagttttcttctggcttctgatactgaacaatttactagtttacaaattaactttattaagtcaatctctctatcagcatactgcaaaattctggcttttttacatagatcaactaacttcgcagcagataaagttccgtcataacgtccaaaaataatattagaaagcgcttctgaatccgatccggagccaactccatataacatatctgtgacttctttagccaataaagtttggccataacgtagactgggtga

SEQ ID NO: 12926 - DNA, 474 bp, Saccharomyces cerevisiae
tccacatgatgagtaatgtgaaataaaataaaggttttaatatacaggttaaaaaataagtaatacaattgtataatcataatggcgttaaagcagaataaagtaaccgaacaccttatcttttgtgtcttctgcttctcatggcgtgctcccactcatttagttcgaaccgcaaactttcgctcaaagcttcatcatcgtatccatccaattggtaccacagattatagccagacaatctagtaccaatttgcagaattttttccatttctttaacaacttcttccattggagaaacgctatttcggatgatttggttaaatcttttgtgaatccccgataacttcattgtcattggggtgtagagaggggtagggcaatcggcttcaaaaagaggattaaagctgacttccttctccacatcagagcctggcttggcatcctccttgtttagtttttggtcggctttcagtt

SEQ ID NO: 12927 - DNA, 443 bp, Saccharomyces cerevisiae
gcatgacctttacaatttgatattttatttatttcactgttataacataattacaagtaattaatgtcatataataataataataataataataataataataataataataataataataataataataataataataataataataataataataataataataataataataatagtaataataacgtctatataagaagtatctacaccattgcttacgcttttattttttcctttcgacgtgaaaagcgataatagcttattaaggtggcaaaattgtccccggccccaataagctgagagtggaataggtgaagcattttatatttttagtttcaattagtagtaagcaaccataagacaccaatcaacacagttctataattatgaccgacagatattctttttcgttgaccactttttctcccagcggtaaattg

SEQ ID NO: 12928 - DNA, 493 bp, Saccharomyces cerevisiae
attgattaagtgagaataaacttttcgaaaaatttttatttatgataattttactaattcttacttatttcttttatattcgataaaaaaaattcaaaataaaaaaagattaatcctttgataggaactaaaggtactaggtattttgggcggcgaagcatcattccgttcttaaacatctatatatatataattatattgcaaatgtataagcatttaaaaacataaacatgcacctatgaagaagaatttaagacgttttatttttatgttccacgcgttttggtgaagtgatgaaagaagtcctgataaagggatgtcggattaataattgatacagtgtttataagatagctaatcagaaaaaaaacgaaagaaaatggtataagtctcagaataatgataataaaacacgcttgaagtagaataaaaatataagtagagaagataaaataaaaaaataaagatagaaagattttcaatgaggggcaaa

SEQ ID NO: 12929 - DNA, 477 bp, Saccharomyces cerevisiae
tatctatgctatatgcccggatgctttgttgaccaatagttacattgaaatttctctattatctcctctcttctaccgcttttaatacaagctctaggaacagtgtcatgaaataatgttttgtattcttttatattagggaacttgtgattcttctgtttttgttttttatttttcctgtctgtacattcatgtaataataatttagatttaaagttcaatctttttacttaaaaaacaaacgaagatcatggtgctaatattcggatttgagttgatcaattttttaaatgaagtattaatttacagtttatatattcactatagacctcgtaactcatctcttaaatcagttaaagtaaccactttacttccgtttagaatccattgatcgtatgcactatcaaagctagataaaacgttgatgaccattaggtaacattttctctttcgaataacatcaagatcagcttgcat

SEQ ID NO: 12930 - DNA, 499 bp, Saccharomyces cerevisiae
aactgatggcgcgagaaacaaaattgtacatgaatgctaaaaaaagaaatgacaaaaaaagagaaaaaaaaaaatgaaactacatagttaattaataatagaagtatttgtcaatagtatgataatgaaatcgatattatggaagatattaaccgcgcgccgtattagtgtacactatattaaactacattttgcttcttactgaatttataaattatgattatattattattactattatgactactgtatatattttttagaattagcatcgggaaccgatgagcgttagctgaaatggacgacgataggaacgataattaccactagtaaaataataacaactaagaataaacacattctcatttttagatctttccaccacatttgctttctgaccctgttggcgcctctcttgaatccttgtgcggagatagccaagttatcagctttgtcctcaatggatgttagcctttcaccacgttcagcaaccttgttg

SEQ ID NO: 12931 - DNA, 465 bp, Saccharomyces cerevisiae
tttttagaatttaactcactcgtggtgctatatactttcgtagttagttctgaaatttttagggtggtaatttaaagcatattcaatcataataaaaaaaaaaaaagagaattattaggaaaaataaaaacaaaataatatataatatatgatgtagaaaaaaatcttgaaatttttatcgattcgaataaaatggaatttaaaaaagtgggaaagaaacaatgagaattcataggatataatgaaaggtaaatgctttaaaaaaaaattaagaggggaaaataaaagtagaaaagcaaataaaaacaaaacatggaataaaagtaacttcaaaaaaatttatcaagaaaatggtaggcttgaagaatataataatagttttttagttgatttgagatgtgatatgacaaataaaaaataatgaaataacgataaaaataaggaagggaaaaactgacaatcgaa

SEQ ID NO: 12932 - DNA, 453 bp, Saccharomyces cerevisiae
actaaaactatttcatttagaatttcaaatatatccaaatatatgtatatatatgtagaatactaagtcatgctacctctgaacgtttaagagacctagcaactcagaggtgatgaattaaaagaaaaaccgggtaaagttcttcgagagaccgcgctgaaaaaatttttttagaagagtcacccatacagcctactggtgttctctgtgtgtgctaccactggctgtcatcgttgttgtatgtccttcagatttatggaattacttagatggtatgaataagtggttaaacacattatctaagacattcacttttcggcttttgaactgtcattataggcgatcattaccactttgtcaaaacttttctctgaagaagtcgttaactcataatcaagtcaggttctttaaaatgagcgatcttgataatttgcctccagttgacccaaagac

SEQ ID NO: 12933 - DNA, 430 bp, Saccharomyces cerevisiae
caaccctgaaaaggcttcagcgctgcatacatagacatatacacatcacacgtacatacacgaaaagatagctttcatgctcacaaagctacgttccccacagaatatttcccaggacaacagggaaagttggacaaacaccaaacttctcataatacaatagccgaaaacagtcttgcttttgataaagagagctttctgcggccggaagaaaatgtgcctattccgcggggccgttccgcgcagaaactaccgcacgacgtcggaaatataacggggttttgcgcggatttactgacgtgtgacatcttttcgcagttaatttttttttcaatttggaaccgtataagaacagaggtattagatagtagaagctattgtgtctattgtctttgattagtttttttttctattgttatcgtggcaggca

SEQ ID NO: 12934 - DNA, 457 bp, Saccharomyces cerevisiae
gtagaggacgcaatttaagtatttgatgtatatcgtttgttttatttctgttggtatcggttgggctcggtattattgttacacccgcgttgtcaagtaaatttataagggtccaagataaaatgaaagcattgaaatatttccatcattctgataagcagaaccacgtaaggcagactaaaaatcatgacatcgattaacagttttcccaggaatattgactggccttccaacataggcattaaaaaaatagagggaactaatccaacggtgaatgccatcaagggcttgttatataatggtggatcaatttatgcatttctatattttgttattgctatgtttgttgaaccaacgctacaaaagcagtaccagcagagaaatgatttttccttgtttgttttgttgcgtttgagaagaatcatagcgcaattgcaaaaacgactggtgatgaccc

SEQ ID NO: 12935 - DNA, 499 bp, Saccharomyces cerevisiae
aaattatgatttgatgttcctgaattaggataaagtatttttccttgcacgagagtacgtatgtaaacgtaatattgataaagaatcaaaaaaagttttatatctatctatatatgtacctaataacatatggaaaggattatttaaattcaaaaaataaaacaataaagtttataaactaaccaaattattgttagagttggtaatattagcacttcagttaactcaatacgattgatcttgaaactatcggtaactgaatggtttgtttcaggatcacttacgaatgatccagtggaatagtacctttccattagagcatccttctcactccaaattttatacagccattctgaaaattcattctcgtcctctaatggaatatctttaacatcaaatgctctgatgtgaatatcgactaacttcgggtattttccttctaaaaatatgctcttcagcccatatataagctcaccatattcctcctgttttacaccgg

SEQ ID NO: 12936 - DNA, 444 bp, Saccharomyces cerevisiae
gatagaacagaaaaagggaagccaaatcccgattaattttgtattttttataggcaataatttgatagagttctatcttattctaagttacccctcatgacttcccaagtgtgttttgaggttatctctgtgaatattttttctttttttttgctacttccccaggaagttaaatcttcgtagcatatttgtcagctttactaccgtcttcatgctcatgaaaccttcttcttcaacccccttcatttctccaattttcgaaaactggagctacccataaatattcggagttttgtaggtatttttattttggagaaaacctgtacaaactctccccagggagcatagattggggatcgtaacgcataaagctgtctagaatgcatttttccatgctacgtcgattttttgcccggaagaggctgacgtagcgctggaaggtac

SEQ ID NO: 12937 - DNA, 474 bp, Saccharomyces cerevisiae
caagatgcctagatagatagagtacgatatataaccatatgtatgtgactaattatttattccttaataacaccaatgattacaactttctaaagctggcggagaattcgcgctgtacgagaaaagagcgaaaacagaggaatattcaaactaagaaccaaactgcgataaagaggattgaaaggaaaaacgaaagaaaaggtaaactgacaaatatatacattaaccgatgggtaatttcagatttcctataaaaaccaagctaccaccagggtttatcaatgctcgcatacttagggataacttcaaaagacaacaatttaaagagaatgaaatccttgttaaatctttgaaattcatcgctagaaatatgaaccttccaacaaaactgaggttggaggctcagttaaaactaaatgcattgccaaactacatgagatctacgcagatcaaaaataggtgcgtggactctgg

SEQ ID NO: 12938 - DNA, 466 bp, Saccharomyces cerevisiae
tggaatgcaaacaaagatgaaactactgttatagaaaatatgtaattttatgtactcactattaatgatcaaagtaattgctctttttatgtatagtttctttaatcggaggaaattttgatataggttcaaaggcggtcagtgattgaatgatcaaggtaatagtcgggctacaatgatggccatccctatggccgtttcaaatgtttgagaaaatgatgtatagtaaatcctagattttagcagttcgaatcaaaaacccatgtaaaaagggtaaatatttcctaattataatatttttgtttaattacacatgtagaacaataaaagtatagaattttagatagtatctattggacagatggacctgggttcattcttctcttaccgttaaccaaggtaacgttaacgaatcttctggtgtacaataatctcttgtaagcacgaccctttggtttctttggct

SEQ ID NO: 12939 - DNA, 451 bp, Saccharomyces cerevisiae
tattgcgcatacttcttatgggagatccaaattcccagtacattagtttgactctccttccttaatgttttcctctgtacgattatttatgtttaaacgatttattttactatgtatgtatttcctttcattttctttcggagtcatatatattgctgggcggctaaatgtttccgacttgtaaaagaaaacataacaaacatcttgtagttgtgaaacagtttcattaaataatcttttagaagagtaaggacatgagtagaggcaaactggaagatatggaacaaaaggaaacatcggaagttgactggataatcgtacgtgaaattgtcacatccttaacctattttctctttactaacttttagtaagaggtgtaatctcctcgaatattatctatgacagtgttttgctttaattcaatccaggaatcctacgttgtggaagaggg

SEQ ID NO: 12940 - DNA, 435 bp, Saccharomyces cerevisiae
tctaacttggaaaccgaacactaacgaaaataatatgtatatatacatatatatatcaaacaaaatacagtcttgaatgaatagagatacactatgtaatgaatggtaacgtaaaaattgtaattttggattaaaagagaggtagtagcaagagtgggtatcaaatagcgattaataaatgaatatccttattgtcatcacttcgaacgacgtaagttaaattggaaaatttttcactttttggtcacctaagaaataagcaggaaaaagaagagaacattgagaggatggtaaagcaagaggcatttagggcgaacgaactaggtaacagataacaacctcagatagagtgttacgggatgggtattgaagacattagcgccatgaagaacgggtttatagtggtgccgttcaaattaccggatcacaaggcac

SEQ ID NO: 12941 - DNA, 430 bp, Saccharomyces cerevisiae
aaacagtaaatagacctaatatgatttatgtaattttagaaactaaatatgaatgctaatttttttcttattttgacttttgcttgcgagaagtaccaagttggaacaacaaacacagtccaaagagggaaatacaaaggcacagtacgcaattactttattattctttagcaagacgaagatagtatgaatatacgtgtaaggcatatgcaaagccatgattttataccatagacatgacatgcgggttacatgaggtggtaaaatgttttaagatagcgtccagggcaagtacatgaaatgtcgtttagagatgatgcaagagtagggttatgatgtgaaagaatagggcaattaattaacagagcggatgttgtaggatgatatagtgacacataatatataaatgatcggttgagcgcgatattat

SEQ ID NO: 12942 - DNA, 465 bp, Saccharomyces cerevisiae
gccgttatgtcggcaagaacactgtatatatccagaacgtaaagtatatacaactatctatcatctctttgtacactagtataaaatagaattaaatccaacgaagccctaaaaggcttttgtaaccctgccaagatgacgggaaaataaagggaaagaccttatgtttttgcccaaaaaccctagcgccggcgctaatattaatggccggaatgaaaaggtcccggaactttgtgtatggcgttgcgctcttcctgtgagtggggggaaacagattagataattgaattcaataacaacagtcaatgggggacggagggtcttatgttccctttgggtcatcggggacgcaagtaagaagatacgcaatcagcaagcgctgttattactctaacgaagaaatcttttcagcaaaacggtccaaaagaacgaatgtttacgtcgcagcgacagcttcgacaaaat

SEQ ID NO: 12943 - DNA, 419 bp, Saccharomyces cerevisiae
cttcaggatttcagttattttcgtactcattttcgtaattttttttatgacatgtatcttttcttatactttatagggaataccttgtaaatatcctatgaaaataacttaaatgaaatttatattggttattaatgcggtgacgtgttcttgcttggtaaacattttggtgttcaatgaaactcttggcttgcaacctttaatatatactagtttcacggaatatgaacgcaataagtaaggccacagaagttcgaaccttacctttcattttatacagtttcgaaaagggaacaccatttagactagaaaccaaatatcctctttaacgttctgctaatgctatatattttttgattccaacgctaataaagattttttttcttgagtacttttcatgttttgttgtagagagccca

SEQ ID NO: 12944 - DNA, 488 bp, Saccharomyces cerevisiae
cacaaatgaattttatcgagataggtaaagtcatatttcaagaagaaagaaatgaacagcttttatttatataataacatataatataaaacggaagaaacgggtaaacgtcagttcgattattcttttgcggatacaaccttgaaaccttgctccaataatgcagtgacgtcttcatttttgtatggtagattgtttagtacgaatgcaatatcatcccattgcttttgggtctcgcactttctcagtcttccaactaatttctcgtttaattgcttttggtgccgttccttatcgataaaagttaacagaaatttgatgattttcttgaaactctccttacccaataaatcatctgacgataaattactaaagatatcgatgaatccattataaatggcgttgtccttggatgctaactcggtgaaaaataatctgcacatatcacttattccctggtctggattgtctaggcatttggccatttc

SEQ ID NO: 12945 - DNA, 455 bp, Saccharomyces cerevisiae
acgagtggctaaatatttgttcgatacgagtcacttcatgcacactttgatttgcactcttattgctgggctgtagttttcttttccgttttcgcttataaatctaacatgttctattaggggaaagaaaggcgcaaattgtagagtttgttaggtcttttaagtacttgatttcaccaaccgaaagtgaaagaaataaaaaaagataaagctattattattaccatgaccctgtcattggtttaaaacgtttgtccgtctgcttttgatgtttttaaaaaaaatttaaataaatattctaaataagtgaattacaggctggtagatagttcgtatacgtataagtttttcatttaattaatttcgtctctatacctggacgcattgtagttgagttttctagagatttggaggtgtcttaaagcatccgaactgggaggtctcgcaaatcagag

SEQ ID NO: 12946 - DNA, 490 bp, Saccharomyces cerevisiae
tcacagcaataatgtcttacgaagttctctcttccgtaacggatcctctaattccctgcatgaaggcacgctctaatatatatgtatacattctttagttcaaacctttcaagaaacacaaaatgcacctattttccgcattgcaattattactaatttcctaaagcaaatatttactattctcccattataacgttctctctttgttaccctgacattcagaaaatatcaccgggtaacagaacgcgttaatattatcttttgggaaatttcattaaatgtaataaataataatcgtaacagtagctgcgaaatgaacaaatgcgtaatatcggttagtcacatgtataagaattcaacatataactatctatgggtggagaaattattactttgcaagcaggtcaatgcgggaaccacgttggtaagtttctctggtctcaattggcgaaagaacacgctataggcaccgatgggctatctcagcttc

SEQ ID NO: 12947 - DNA, 474 bp, Saccharomyces cerevisiae
caatgacacatggagatcatttttgtttttgttgtaattattcttcattagtaacactttctattttgtttcgctctatatttttgcttattttctttcttctaggttcatttctttaatggtgcgtcacttgacttggcttctctctgatttttatcccatttctctagattcgactagacatgttatgtacatgtagatatatatctataattgtgttattttctattttttctattttttttatttaaaagagcctttatcaaaagttatttttcttgttctgtgttgttcttagtttgattttgattctgtgtattggcctaaacaaattagtatatagtagtatataaatcaaatattcactttaaaagattttaaaattaaaaaagcatttaagcagagatacgtttttgggcagcaattctacctctttgtctagaagtcaatctgacaaccttcttttcagcagcc

SEQ ID NO: 12948 - DNA, 450 bp, Saccharomyces cerevisiae
gcataaattttaattcacaatgtaccaataatttttactatattatcagagtttttaaattttttttttttttttttggtagcaattttttacatatttgtatagtcacttttctcattgcgcttgagttgcttcaagtgcatgtcaacaaacatttgaactactaaacttagactattatggttagccctttgctaattatcaggatgtcttttattacgattgtgctttgttttcgtacaatatgatgaatggaaagcgcgatgagatgaggtcgaaaaaaaaaaaaaaaaaaaaaaaaatagaaacatccacttatccatagatccttcattttatttgttgtcaggtttggtattgattttattagtcaacaaaaaagaataggcaagaccccgcaaggatccttcttctcgtttctgtatattaccaaaatcctgccttagcagc

SEQ ID NO: 12949 - DNA, 448 bp, Saccharomyces cerevisiae
caagaattctagtaaaaattaaagtccttattttttttacttaattttatttaattgtccattgtgtcagttattttttttttctttggtaataatcatgcagatattacaggtaatgttcgcaaactgcgtgtttactgtatgctgaaatgtttttttttttttaattcaaacttcaaagtccatgtcaagtttacgcacagtctggtaagtatgtttatttctgtttaaaagtggaattatatcattgagtaaaattctttcccacgtttggaagcctgaatgatcctgatttaaaaaggcgcagagatttaattcccttgatattaggtttgataaatgaagaactaaatggactctattagaatcgcaaagtttaatcaaatatttcacgaataatttaacatctttttcatgcggccctccatcacctaaagtttcggcaacc

SEQ ID NO: 12950 - DNA, 416 bp, Saccharomyces cerevisiae
gatgcataaatacgataaaaagacattaatacgtatatataatccaaaaaaaattggcgatacgcttcaacgttgtgtcaaactcttgggtcactttaaagaaaacccagcatacattaatacagagcaatgctggttatgtaacttcgccgcccgccgccattcgaggaaaaatattcgtgtttcgagaatgcgggcaaaacgaaaatatcaataaaacacatacgggaaattcattgtgcacaacgacctctaacaatttctgccaaaaagaaagttcaagagcgtcccattcatcatgaaggaagagctcagcaaagtgagcagtatgcaaaatttcgagatgatccagcgtgaacgattgccaacattgtatgaagtgttaatacagaggacatcgcagccagttgatctct

SEQ ID NO: 12951 - DNA, 469 bp, Saccharomyces cerevisiae
tgacggaggaagtgaagaaaataattctgtgtaatatatatattctagttatttttttaacatatttgaaatttcccattgtttacacgaaatttctaataattttatttcattaattttgttatccagcaggtaattcatgtcacttgttccacctctttgcagttgtgttacaagcattgatatttttcgaagtattacatcttgcgtggaagagaaaggcttgtcagtggcatcataatttttcaagaatattatcattcgattaatcttctcgagtaattttcttatggtattattattatatttttgaatattgatttctttatccttcatgtcaattaattgaaactcatcaaaacctgggtctacggtattattaggtgtgggaatttggtatctgtcatttacatccttaatttgcactttatcttgtagaaaatcaaggataatttccgcgcctatctgt

SEQ ID NO: 12952 - DNA, 500 bp, Saccharomyces cerevisiae
tgggccgtatgataggcattgcattgcaatcaagtcaacccatttgaagaaaaataaatatcgagtgcatatgtgaatagctgctcgctcagatatatataaataaatattcgttctggaatgtaaataaagtatcgtcaataccttggatggtttatcagcgaaatcggtgctgtagatgttgccctgtcatattactacagatgtcttggaagcaatcaccatacctgcattatccttacccggaaaaagaaaactttcgtgaataatgattaatatttaagtggcgactttttcatccttgctattgaaaaaaaaaaaaatgaataattgttattaagcgttagcagatgccaaattgtcgaaatgatttcaaatacagagaattagccgcaaatattaagtagtacctgaatcacgagacatacaactcggaaaaatgaactttggaagccaaacacctacaattgtggttctaaaagagggaacagacgcatctc

SEQ ID NO: 12953 - DNA, 426 bp, Saccharomyces cerevisiae
aagtcctattcttttccctctcaggttttttcacgccttgaaaacaaatgactatccgtttaatataatgatttctgaaagattatgaagtaaaaaaaagcaaaatgcttagatatataatatatacatacaataaaaattccgtatctactccaaacttctatggctttgtcctcaatgtgttctgatgtttatttaatagcctgaagtttttattaagtatgtatacttttcgatatttattcttttaataatgctacaggagaccataagtgataactcaaaatgtccctcagtggacttgtaaaccaaaaaaaaaaaaaaagaaaaagaattaaatatattatgtgtaaaaagaaaacaccaccgtgtgttatgtatattttgtttatgtctatctatcatctatcctgctggcagtcaatg

SEQ ID NO: 12954 - DNA, 500 bp, Saccharomyces cerevisiae
tttatcttttccgaagaagttgattgaactccagaagctgtcttgaagtagtcgcattaaaaaagatggcacccgagtctaggccaagccatagtcatgttatgataggattttataagacaaatattataaagaagtttaataataatacaaaaagatacaaaaaaacttgaagatattctgaataaaaaaaaaaagaataaacatttggagcaaaagaagagtaggttaggtaaaggaggcattaattaaaacagcagttctgtattcaaagcatcttgcaattcttctatagagacgcttatatccatattatttttttgttcctgtgctacattatgatttgatattcgttcttcattcatgcccttattctttctccccctcttactttgaaaagattctgatattgtgcttaacgatgaattaaacttatccataaaagatgcatgcttaagatttgtgttgttctcttttaccgtatgtgtatctgatcgtgc

SEQ ID NO: 12955 - DNA, 404 bp, Saccharomyces cerevisiae
atagaagcttcaacataaataggatactaaaaatgcacattagctcgcactgaatgacgaagttatgatggattctcgttcgctagatgttccatatttttttcttcattcgttagtgcacaaacaataaggaaaaaaatgaaatgtatatattctagaacatactaatatcatacgtatcgtattgtaaacaaaattcacattccaaaaatttttcagattcttactttatattatttgcatcaagctttattaacaatgacacgttattttatatgtacaggatactataatgtcatactatttaggatcaccttctaactctgctaaaaacccttccaggtggtaggccatatttttctctgacggcggcgactttggcatcccattcgcttctccagata

SEQ ID NO: 12956 - DNA, 425 bp, Saccharomyces cerevisiae
tggggaaggagtagacgaaaagaaaaaaaggttttctatttgttccattttctcaattattaatggtcctcaaagaaataaaagaaaaggaagaagaagtaattgtaatatcaaacggttttttatagtatattcttcttattctatatttatatatcaatgttttataataagatgtttattcatagcatatctggtggatcgtctctattaagcgccagcgaggtgtttgcctctgcatttttcagcaaagcaagctccctttccagcttgaatctatgttcacgctcatccgacaattctttttcatactttctttgtgtactcgtaagcacttttttaaactcacttgtcattattgaaagtgaacgtgatccagaaccgcttgtggggcttcctacagaggaaggtgaacttggatccca

SEQ ID NO: 12957 - DNA, 407 bp, Saccharomyces cerevisiae
atttttgtgtatcttaagtccaagcttacttgtggctgatacgcacaatcttttatgtacgaaaagatcaggaaacgtagcattgatggttttttatgtacgtctgcagcattgtatgtaattattacccaaactaattttaagtgaaattgtagaacaccgcggcggaagtatttttgagtaaaaaaaaaaaagtaagattcgaaaatgaaattatacagtacagaaaacgtaaatatacaataaaggttgaataaacatactagatatcctcctttctttttgcatgtacatagtactggtgtaaactcgatataccgatggtcagattttttggtttaaacaagaaaaagaacgaagaaaaggaaaatacagacttgcctgcagacaatgaacaaaacgcagca

SEQ ID NO: 12958 - DNA, 489 bp, Saccharomyces cerevisiae
tagataagctatgaaagtcaatccttttaatcgagaatgtaaatatgtggaatacacaattttaaccaaagtactatatatgcgttacaagtaatttaaatttaagttcaccgaagtaaaactaactgcaagattgttacaaagaacaatgcactatttaaatcacacaatggctattgaaaactgtaactgtcagaaatgctgcatgtatctatatgcatcactaagttgcgacttttaagaaacttccacagttctcaactcttctttgtgcttttcacacattttcacaattttccgaaatctccaaattgaaaaaaaaataaaaataaaaaaaggcaggagaagactaagtattcattattcgctgtttcataaataaaaggataaaaaggttaaggatactgattaaaatgtttgtcagggttaaattgaataaaccagtaaaatggtataggttctatagtacgttggattcacattccctaa

SEQ ID NO: 12959 - DNA, 414 bp, Saccharomyces cerevisiae
gagagactgtaagatttgaggttttagattaaaaaaatagaaatgcgcggaaggtaaaattgagccttttttattttaaaactatgtaaatcatccaaaatagtagacgtttctagaacgtccccttaccaaaaatcacatcatacgaggagttttaaggaacaataactgggagtcgcttttacaaattggtatatattaaggtactcttgatataaaccaaaggactttgccgtttagagatttttatttatgaaatcttgtatatagattttggaaatatcccttaaaacttccttttttttttttttttacctgtaacagacgtaaccaaaggatataatataatgagcactccatttggcttagatttaggtaacaataactcagtactagcagttgccagaaataggg

SEQ ID NO: 12960 - DNA, 477 bp, Saccharomyces cerevisiae
cttgataattttatttagcacttatactgagcgatgtaccaaaccgattctaaattcacaattcataatggaacttaatcgtttatacagtataaacaagtagaagtattttgacagagattaataaatttgtgccacacgaaggggctttctcacagctaataatattgtacaaactaaaggatagaatatgctgtggtgcaagttgggtgcacattaacgtattgtcgtgcattccctatcatttttaagggaaggaaattaattctaatggctagttacttactctcaggactccataattaacatgtagcaactgaaaaaagaaattttgctgtgaatgacttgtgctcaagataagcttctttttctgaaggtttgtttcttattgcgagcacttttttctgtatataatgtaacagtgaagagcagcatctatatgttaaagtgcttcatgtatggttaagcaggctttgc

SEQ ID NO: 12961 - DNA, 427 bp, Saccharomyces cerevisiae
cccaactgaaataaaaatgaatagaaacaataaccctactataaagcatctgtatttcggccgtattacaagacttctatatgtagtaaataagttctggggaaatgcataacgatatatgtgttattctataatgcagtagttactgtcatggtttgcgaattgattaacatgcatggaggtaagccctccaaccaaatatccaagtcctcgacatattgtaaacttgcatcgtgatcttcatgtgttccaagagctggaactggcaaggttgaaaaaattaaatccgaactctttgacatttgtgtcatcacatcattcagaaccaaatgttgagcagtgctgggaagatcattgaaacctaaattttgcatcgctgtgactaaactatcttttgaacaacaaggtgataattcgggaagaaccg

SEQ ID NO: 12962 - DNA, 434 bp, Saccharomyces cerevisiae
catatacataagtagaagataattcgttgcgcatatgctacaagaacccttggtgaaacgaaatttgatacaagtaaatacatgcaggaaacatacattacctctgaaacaaagccgagacggggcccagcagtctttttttagaaatcgcgtggcttggtaacgcgataatgacgcgacacagccattagtgtgaaatttgattttcttggccaaactaggtataatatttgttacaaattattgattttaatatatatctcgggttcattttttacgtcggtactccaaaggatcaaaacacttacattttgaggcctaccggaccttgcagtactgcttgtttaaatacgcagtatacatttcttcttcttcttctctcttctttccttcctcgaagagtcactaaattaatactgggaagccaaaccaaa

SEQ ID NO: 12963 - DNA, 483 bp, Saccharomyces cerevisiae
ccggacgagtagaaagctatacatagtaaatagaatatttatagatgaatccgagtagacagccttggtgtttgcttatacattctttgcaattatgcacgccctcattaccgttgctcatatttttgggcattaattgtattttgaaaagtgctcgttcaggcccgtgtaaaaaaaggtgatgaagcaaacattataataaacacttctgagaagccacgtgtagaggggtaagctatatcgtaaacaccgttggatgtggaccacggtgcactgataaaataaagatatagtagtagaatctgttactaatcttaacacttttgatggtagaaccggacatgcagaagaaggcaagtggtggcagtggcggttccgagatggatactttaaatgctaccagcaacagtagtaaacaaggagtttcaaataataaaaggaatccggtcagtaaaaagaaaccagggaataaggtctctgatg

SEQ ID NO: 12964 - DNA, 408 bp, Saccharomyces cerevisiae
ctttgataaaataacatttttcgttctaatatagtcaagtaggaaaattctactcgactttattttgttcttttgatcttatttcttttactttaattatatataggatattttcttaggataattgtaataaaatgcattaatagttttatatgtccatttctggtgcattactggacataatttcagttcctttcaccaaagaatttatagccttggaatatttccataatttgtcccaccgggtaatgtgcgtaatgcaataacatatagcatctatatctggtaagcgtagaagaattaacaaacctaagaataaaatacaaatatgtttacaaccaaaaaatcaacttaaatagatgaagagctcgcatatcaattttaacagacctcgctgaaagactctga

SEQ ID NO: 12965 - DNA, 491 bp, Saccharomyces cerevisiae
tagagcacatgcgcctccctcccgccagccccccaattcctattatgtgtaatcaaacaatttctattaaaaccgaaaacctaaaaattgtaacgtcttttctctttcctactataccctcctcatacctgcctttttaacaattagtattataatttttttttttcacaaaaagacaataccgactatctaataaataattttaatacgtatgtaatttcgttaagaacaagaatttttaagtaaaaaatcttacttttaagaaaaactgtcgcccttaatattagtcccaattttgtaacgaaaaataaaatacaaatcggggtggaaaaagggaaattttacaacattattattccaaaaactagttttcaaaaagtaaatcgtgggggtatgaacaacaattgttgtagtcgcaactacggtaattggtcctaaaaaattattctccgggaaaaaaagaagaaacaaagagatcccgaaacataagt

SEQ ID NO: 12966 - DNA, 461 bp, Saccharomyces cerevisiae
cttattgaaattatttgtcatttttttatatatcctttttgcagtcttcaatccatgtatatatttatctgttatgtagttttaatcaaaacgcgtattaaaatcttctttcttttatgaatactaaatatatttaacagtgtgtaacagcaacattgttccaaaatgaacaccgtatatttttcttataactttttacataagtcattatttatgacttggatatttaaggttttccgctaaagttcattaatatgtcttgataaaattaaattttaatttggtaaaatgcgaaacaaggactataaataaacactgtgagtcccattttattcatcattatttttgtgttttttgaatgcttgaaagttctctctgcttattaaaagaaatgcttcattcttattttattactattgcctacttgtttaccctttttttggcaagatcagcacaaatga

SEQ ID NO: 12967 - DNA, 500 bp, Saccharomyces cerevisiae
ataaattgctcaagtgtgtcgaaaacattcctgttatagagcataagtgacagacaagaagaaataatgaaaggagggaaagggataaaaaaaaataaagttacatatacacgttatacatgtataggtcaactaatatttaggaatggtttgatcaatatcgtctatgtatttgaagtatcctcctctcacgtctcgtacattagaaaacccaaatttatccttcaataatcttgtagctagctgagagtcgttaccgtagcggcaaagaatcactatattactgtctttttctacactgggaagtttttcttgcagtttcttaagatcaccgttcatatctcttagatttttgattggaatattaactgcttcagggaaatgagatatctcgtaatgatgggatggcctaacatcaagaaatatatgttttgctagaaattcatcatccttgtagatacgctgaaatgcgtccacactgattctctcatcaggctcgc

SEQ ID NO: 12968 - DNA, 407 bp, Saccharomyces cerevisiae
ataaatgcatggtttgattacctgctcgtaatactacattctcccaaataaatagtttacatataaacgcgcggctaaacttcacttcgttacttgaaatgccaataataacacataacatagagtacaaaatcggaatagaaacgccgactgaagaaacactttcaatggccgaaataccattcttccgtttatcgtattcaacggtatcctcttgaaataagttccttttctaaactatgccagaaataacgcacgacttccacatccttaaatcttttatttttgtcaagttcgaccttttctacattccattgctgcacgtgttgtggtacagaatcaccggcaaagtggaaatagtagcctttgcagcgttgaaataattcctgtggcgaattccactgata

SEQ ID NO: 12969 - DNA, 489 bp, Saccharomyces cerevisiae
gaaagtaacttgcactttaaaaatcgtacataatggacttcatttgcatttatttatttgttgaagagtaatttagttatcaacttaaaaattcgtactacaagtcaatgcaaggctggtctgtaatatctttcccgtaccatattgtccatgttttaaaatatttattatatagatatgagcccttttgttcgtattcttccatagctctcatagcactggaaatatcgtaaaagaatatagatacgcataattttcttgatacaataggcgtaatttctagaacctctccaaaattctgaaaatctttttctaattcttgaatatcaatgttttctaaagtttgccctttattcagatttgatttgttaggcattgctgttgtcgagctttttttcactatcaaacatcttgatatgaacttttcctcttctattattctgttgacagattgctctttcattatgttttcatatgtgctctcgagga

SEQ ID NO: 12970 - DNA, 471 bp, Saccharomyces cerevisiae
atttccatttatagacaaacttagatattaaaagcaatgtacaaatacatacacaaaatatcactgtaaaaaaattgcgaagaaacttgaaattgaatatgattctgcccacttttttcttgctgtcatttatagtcagaaatgaaaaattgtccgagaaattaaatataatatatggaaaaaaaggggacattgagtttaaagaatttgattaaaatgtcctctcaatatcctctgtaagagttatctaaatctcactttacttattcatctcgctgggaattatgcaggcggtagagagaaggccctcgttactctttgacgaatatcaaaattctgttactaagcctaatgagacgaagaataaagaagccagggtcttgtcagagaatgacggtgatgtctccccatctgttttgaaacagaaggaaatatcagtcgatgatatggatatgatttctttgcccacgg

SEQ ID NO: 12971 - DNA, 415 bp, Saccharomyces cerevisiae
tataaagtgggaaaaagtatgtgctatgatatgatgtatgtattcacgaatgtattatgtagaaaaatgctaaaaaattggataaaagaaaaccatgtttaaaatgcataccaccatgtgtattataagtacttcgtaaaattcgaatcctgtagccagccaaccttctcgaaagcttggaatagtcttgatgctttattaacgtcgatcctacaggctttttgggcgtcggtccttctaaacggcaaccctttctttagtctataaactttttccaaaaataaccttctcttagaatccagatacaaatcacaaggtaaccttagagtttgagcgagaactagttcagcagggtgtagctcgttcctcagcgggtctgtggacaggtccattggagaccccttccactcgatct

SEQ ID NO: 12972 - DNA, 491 bp, Saccharomyces cerevisiae
atgtagccttttcaggtacgcgtgtcttgcttgtccgcggttttctcagtggacgtgcctattctgggttcctcttgtttgatgagactctgatatctacaatccaaaaaaatcggttgtaggaagatggcgtgcttctaattaaagtaacgtggggactcttatttagatacttcctaactacgagcacgtacgtctagaattcatgttatataacataatgatttttccttattttcttagtttttatcagccttgccttggcttccttctcaacatctagttgaattgataacatgacaaaaagaagttaggcagtggtagtcttcaaaaaaatatacaaaatagcaagcctgtaaaagaatttaattatgaccattattcagacggttactgaattgggtgttaccgaggacaccattaaggttcagatggctccttccggcggcaaacacctattggcagatcccggtaatcatccagcggagcat

SEQ ID NO: 12973 - DNA, 480 bp, Saccharomyces cerevisiae
tttttgcttggcttcttactggacctgttgtacctgtaatagaaatatatattttatatcttttgcatacatatacatacatcagctatttggttttttaacttacccgataactatctataagcgtgtcaccatgatatttgcctgaacctcgtccacagttgattgtgtttatttttacttttattcatagctatttgatttcagtttcagctaaacgttcagcaagatcatctacttgtacttctagcagttccttttcaagcctttccgtttcaatttcttcgagtttttcatcctcgtcctcgtcttcctcgtcctcgccttcctcatcttcactatcgacctcttcaaaatcgtcaacctctaaatcatcaaatttgctttggagcaaatctaaagcatcagaatcttcatctaatctgttaccatttatttctagcttttccaattcaggtaaatttcccttttccatagccg

SEQ ID NO: 12974 - DNA, 410 bp, Saccharomyces cerevisiae
tgttttctccttctttacatgtttaatatattccaagttacctaagaggtgtacgatatttttttcttttatatatatgattttctctattcattttttagttttttttgatacataagcgaatcgcacattgcgcaacttcaatttgttgattcgccaaagtattcttaccataaaacaaccattcgttgctttaccctttcgtaatcatttaccgtgataaccataatcagaaacttattatttcagcctagtagaccggccaagcaggccttgtaatgtttctcttgattgcttgaatcttttaagcagccaaatctttccaaaaaaatgcaattatcagaacaaaactatttaaggtgacttctccgtatttacaccaccagaagcgttctggctccccttttctc

SEQ ID NO: 12975 - DNA, 403 bp, Saccharomyces cerevisiae
ctgcccataattgtccaacggctccaacatatatcaatctatatataaacatatatataatttttaacatgtcgtttgaaatgacatgtctatttttaaaaggatagcatataaattaatgaaaaaaaaaaaaagaaaacgattactgcagatcttctaattctgttaatcagctttctcttgtgaaccattggcaggtgggtaacataaaagcacaatacaatagcttccattattagttttgtttgttttggcaatacatgttaaatctttttctttcaagttaaatataaagattatatataaaagtacttctttggaatacatttgattatacttttctttatcgttttatttttatttcatcgttatagtcgcttcttttcccctagaggctttgtca

SEQ ID NO: 12976 - DNA, 473 bp, Saccharomyces cerevisiae
gctgcttaaatagaagatgaaaaataatgataatataattctctgttaattttaatcttttatctatgtaattttatctccccgtcatatcacataactctaaaataagttttttattaatattattatattatatcggataatcctacgttcaaagtattgaacatagttttataatgaacaaaggtataagaaatgctcataaactgaaaaaatcccgtagataagataataagaaatgctactgtctatatcaatatgtcaatcgttactcattccctctctagtacggaacgtgtgcgttcttcataccgagctattagaatttagtgaataaaggcatctatcgatttatgccatgaactgaaccaacgcctgcagctactttttctgctcccccaagtcctccgttgagatttgaagaagactttgccgattgtactataccaacctcaggtgtcatgtagccgcta

SEQ ID NO: 12977 - DNA, 478 bp, Saccharomyces cerevisiae
gtgactctttctacgttatcctcctccgcagaatttcgtaataagtgatgtgtggctcttttgctaccctttttttttcatttctttcttttttttctattttattttttctttttcatttttcggtacttctatgtacctgaaatgaataataatgtaatggcaagccatctcatcgctgtcggctaagtaaatctatagtttaatatattcattttccctcattcaaagaagataaatcactctgccaccatcgtaatggacttactgggcgatatagtggagaaagatacatctgactctgttgaaagtaatgacaatggcactcttagtaccaacaactgtggaacgggatttcccgagttgtacaaacccaagaaaatatcatcttggaaggaaagactaagagaaaaaagagcccaaaagaaaaaaactagtggcaaggatgctgaaaagcaacaaacgagtacagacgccc

SEQ ID NO: 12978 - DNA, 417 bp, Saccharomyces cerevisiae
gaggtgaaagtaaaaaaacattacctatctgtcttactagcgccttccgtgtataaatattacgtactactacataaatactcattaggaggattacataatttccattgtatcgtatactaggtcgcatctttgcatattataaagcttgccaaatagggatatactgccagcactgttacatttgtcatattgacatcattatttttactattcacaaggtaagcacgtttttttttagttttcttcatctaaccagtctaggaactcaggagccaaataagtgatgattaatctggcacccgccctcaagaaaccttgatgagattcaaaggcaattgtcttcaaatcaacaacacctttttcagctgcagcatgtaacattgcgtattcgcccgacacgtgatatgcgcagat

SEQ ID NO: 12979 - DNA, 469 bp, Saccharomyces cerevisiae
cattaccgatgtaacaatatatgaaagcctatatatacatagatgtataggtatatagccgcattcaaagtctagcaaaataaatattctttaaaaattcaaggacaccggatcatggtggccataatacgggcaagtgaacctagagaaggtgtcctacgtcactatccaagttaatttgcttaagagagttcgagtgcagcacctacagctttatcattgaagacgaagcaaaaagatcttgagattctatatcatgggcacaggtagtattcattaggtagtagtaacgtattaaacaaggccatactatatttataactcatgttcaaatacaaccgctcactctgtagcagcgctttgatagcaaagtctcagattcgtttttatagattgaagcgggcgccattgaattatgcctcccatatacctgaagttcttaataagaccatcatagggccagacgaac

SEQ ID NO: 12980 - DNA, 491 bp, Saccharomyces cerevisiae
aatgcaaggtgaggtaaaagttttttctttgtggtttctttgtaaaatataatatgccataaaaagaggaaagaaaagcataataaatagatatatgtatagagtatatatttatatatatgctagtatatacggatatatgtatctgtagatgttacacgtaaagtacaattgatacatgtaataagcaaattaattcattaagtttataaatatccggtgaagtcttctgtataaaaagagaaacatgagttcgtccaaacatataaccgaaggggggggtaataaaaagagcctgctttttatgttactgagaaatctatatcgtcacatccaacacgctccccacatccaacacgtttcctgatgaaaggtcctccaaaagtgggataatatctagtaactcattatcatgagtatcagagaaccaagaagatatcggaacagcatgttgcggatgaaagatgtaagaggccggcgaattatctaag

SEQ ID NO: 12981 - DNA, 473 bp, Saccharomyces cerevisiae
gctcagtaaatgaaatgtaaggaatgtacttagtgttttttgctacatagcttttatgatactctttataatgttatattcaataaatttgattcaacgtagaaggacccgcgaaagcagaagaggttacccgaccttgacaggcgcgtcaaaagtaaatgtaaacaatgaagtcttcaaaataacttacgtagggactttgctatagatgaaagaagtaacgagggaagagcaagtgtaaagggaaggaacgcaagagccatgtcacaaaaggataacctactcgacaatccggttgaatttttaaaagaggtcagagaaagttttgatattcagcaagatgttgatgccatgaaaagaatccgacacgatcttgatgttataaaagaggaaagcgaagcaagaattagtaaagagcattcaaaggtttctgagtcgaacaagaaattgaatgcggaaagaataaatgttgc

SEQ ID NO: 12982 - DNA, 437 bp, Saccharomyces cerevisiae
ttttctataaaggttataaacgctaggcttctttaaactgcattgggttttttctcaatttcgagaaaaataatataacgcgttagaaatggtgatgtaaataaatgaatgttagaaaaatacatacgttaaacaaataagttagacattagcacaggacagcacttcactcatggattatatgaaattggggcttaagtcccgtaaaactggtattgatgttaagcaagatatacccaaagatgaatacagcatggaaaatattgatgattttttcaaagatgatgaaactagtcttatcagtatgagaaggaaaagcagaagaaaatcatcgcttttcttaccatcaacgttaaatggcgatactaagaacgtattaccgccatttctacagtcatataaatctcaagatgatgaagttgtccaaagcccatctg

SEQ ID NO: 12983 - DNA, 420 bp, Saccharomyces cerevisiae
tcaaggacataaatctaagcgagggaaatgaaaatgaatgaattgatgcgcttactacttacttacatacggtttttattcaagtatattatcattaacattagttggttagaccaatgacaccacaggctggtcttggaccggcattaccagtcttcaaagattcttcagtgtcacccttacctaagtcatcttggccggcgtggataacgacgcttctgcctacaacggaggtaggaccgataagcttgatcaaagagtccttgaaggagcccttggccacaccattttcgtccgtctttacgttacccatgtcaccgacatgtctgacttcgtcagttggagcaccatgtgtcttcttgaaaggattgaagtgaggaccagcagagacacaaccattggtggcatctccaaactcat

SEQ ID NO: 12984 - DNA, 428 bp, Saccharomyces cerevisiae
tatttcccttgttaattttgcatgaattctatatattacataacgtttatgtatatatttcccatcctcattggatggaaaaaactaaacagcacatattcacacggattttggatacacgaagcatctatcacgtattcttaaaattgcacgtcccaaagagcagccggtcctttcatattatacttttctcttgtgatataaaatgtatctttaggatgagtgaaaatttgcttagaaacaatttgggcacccaagaatataatctctgaatatccacttttcttccactcaggaaagtaatctggatatttagccagtttgattactgtaggacactgtacgtattctatagttggaacaaatgcggtgctatttgtcataaacttgcttttcttttttgttgcagctggtaatacggatttcgc

SEQ ID NO: 12985 - DNA, 496 bp, Saccharomyces cerevisiae
ccctaggcgaataggtatatacaagagtagcttattatcaacttatatattctgttttttcaaaagtagcgatgaattccaatcgcgtatttattcgttgtatttattttttggggtagggttgtggggggggatccgcgtaagtatatttataacaattcaataataatattgtagatttgaagagaatcacacatgtaacagaaaagctgtaatgatattaagtcagaggaggatgctgagttcaaagcaactaatagagaacttgataagatacaaatttcataaaacaccatatactcggagctcaatatggcctttcaaaagaaattcggcggtaataatactattattcattggaatgaaaggcgaactacgagtgcttttaactaaacgttcaagaacattgagaagcttctcaggtgatgtttcatttcctggaggtaaagctgattattttcaagaaacctttgaaagcgtagccagaagagaagct

SEQ ID NO: 12986 - DNA, 401 bp, Saccharomyces cerevisiae
accgaagtttaaatgcattagaaaagagtattttgtgttatgttttatgttttattttttttttttttgtttattccttaaaagaagattactgctttttcattccctagtttctaaattgagtgcctaaataagattaaataaatatgtatgtggaaactagggagggtatgtttttatttacaggaatagttgtagtaattcaaaagcctaaagatttccagaaccgtaatctaaagccctcaaaactgtttaattttggtctaacatcgagataaataagtggttgttgctgcgagtttgcatcgttcagatcggtggaatagaaatcgattacgtagtcgacggttttaccgcatctatctatctgccaatcatgtctatcaaaaggtttggccagg

SEQ ID NO: 12987 - DNA, 493 bp, Saccharomyces cerevisiae
ttcaaggttctttagcagaccgattttatgatctcaatgacaatgatgatttaattatttcgaccacttatttatacatttttttatctatttattatacctcctttacataattcttcaaattcaattgatacaggatctctattcttaaaaatattaattattgcgtcctatttatgatgcaagttcacagtacgtgcaggatcaaaaattatatcagtatctattgctctaaaaatatggcagcagccttcattctcaatatgcgatcatgccttctaatcaaattttaagatgtttttattactctttttattcttagaaaattcatcttatattcaaggacttcttaattttccttccatctatgaccacagtttacacacttataaaaggtagtcatcggctcatcagctgacctaatttgtagttggaaaaagtaagcactctcaccaccacaagtatcataattgggacattgggttttggtttg

SEQ ID NO: 12988 - DNA, 403 bp, Saccharomyces cerevisiae
ccaccagaaagtggcatacatcagtcgcgttatgccagaaaaggagaattgaaaggaaaacggtttgataaatgtcctaattaaactatcatgtataaaattatgtatcatccttacgcattttaacgctatatgaccaatatgacaggaatagatacactgtctataattatgtaaatggggtatgggttcatagtctaagggtgagtacaaactggatctttaacaagagtaacagttaattagagcaaaactatagtacatatagcttgaaaaaaacaagcggcttgccattggaagaacattgcataaaaacggggccactgctaataataaagtggtaattaaaaagaaagcttttgttcaaggttaagaaggtataaggaaatgccgaacgaagata

SEQ ID NO: 12989 - DNA, 429 bp, Saccharomyces cerevisiae
attcagaaataaacacaaacatatacatatataagagtaaaaataaaaaaataaaaaaattttacagggttaaaaataaagaaaaccatcactccttttctatttcatattccatgacaaacttgatgcatcagcaatctttctaccgccgaagagccaaaacgttaataatatcaatgccatggcagcacaaatacagcctccaatcaggtaaactatacctaaaaatggatttctaccgccaaggtgagaaccgtgagtcaagtagattcccttcttaccattaaactccaatactggccaatgcagaccgatatccaactggtattcacccgctggcaaagtatcgtttttattgattctgatcagttttgtaattttatcaaaagcacctggcctcatccagttttggaactcttcccaatcctg

SEQ ID NO: 12990 - DNA, 497 bp, Saccharomyces cerevisiae
ttactgtaggaataaagtagtatagggaacattacataatagaggaaaacttgtgaggaaaacttgtgacattctaaacgtatttaagagttattgaaaaattaatggtgtacgacaatatttctctttgaatatttatatgcttcttagcggtattatgactaaatagtaacaggaaaaaacacaagtaaatgcaaatgggtttacatcagtaatcctgccggtccatttagcatatatgtggtcgagctgccccatgcggtgtggcgtttctcctttcttgattcatattcatgtaatagcatgcacatgcaagtaagtatctgactatcccacggcacattttcaatgatattagagcccatttcagtataattggtagatgttaaactagagccatcatcaaacgaatcagtttcttgtaagtacaaggtagctactctcaaagttctttttttcggtatgacactaactttatcatctgtgtatctggccca

SEQ ID NO: 12991 - DNA, 500 bp, Saccharomyces cerevisiae
gtacatgacctccatttcagcttcactttcaacacagaaacagtgcgtattatctgcattcaataaatagcaaaaggagcattgtctcattcttttcgaattctgggattctgccttacggcgctctttcatttgattgatcgagaattattattatatttatatgagtacttgaaattcctcatatatttatttttagagtatttaagtagcttgatgaaaacattagataaaattactaattacgacctcttcgattttgcagatgagtttttgaaatttgttcctgtgtttagacctaatcccacggtaacttgtctttttggcaatccgttaactaatttactggttaacggtactggagcagcgtgtttttttgaattttgttccttggcattgataaaggtttcaaaaattctgcttgatctgttgctcttagcgctattaatcgattcagaaaacgaattgtgctttgaaattgatggagattggctatgcgt

SEQ ID NO: 12992 - DNA, 418 bp, Saccharomyces cerevisiae
acttttagaatttagtcttgttcatacctctacactattttcattcgtaaatgcctatgtacaattttagcatatgcatacatatattctagtcgaaatataaccaaacaaaatctggttgatattattattctccttcttcctcctcctcttcgtcatcacttaattcgatagcgggaatttcaaactcctcctgttcttcatcttcactgtcctccattggcttctcttcttccttagtttggcttacagctttttttacaatcaattcttcgccattatccacggttgtttcttcaacgaatttcactttcttatgtgaagatgtagactctctttcaatgacttcttctactgaccttttcttgaatatggcagtatcatcgacgacctttgggacttcgtgtttgggttcagg

SEQ ID NO: 12993 - DNA, 408 bp, Saccharomyces cerevisiae
acttagtcatacgtcattggtattctcttgaaaaagaagcacaacagcaccatgtgttacgtaaaatatttactttatagtttgtacgtcataatttcttccatattacaagttcgtgcatatatagaaagaattctgttgttgtaattgtcataactattgagctttacctgaaaattcaacgaaaaaaactcaaaaaccacatgcttctcttgagtcatgcggttcctttcccttatgagtgaaaatcttccttttttagctatgtgcgccatccgataaatgtaggagcaatgaagcggaaagtcaattttttcatacagtatacattaatatctagtgtgtattgactgtgatcgggaagatcttcagggttgaattacaacatggacacgcagattgcaataa

SEQ ID NO: 12994 - DNA, 428 bp, Saccharomyces cerevisiae
tcagtttgattgcaatattactacctctaatcaaacaattaaataagtcactacattataagattatctacaaaatcaacttttccttgcaatcattaaaaacgatataggttacggttatgtagaatatccattgtataatataaaagaaaatgaaacagtaattatattatattatattacatgcaagcattgaggagtatggcaatcatttttcttcttttttacttcacctcgtctcttaaaacatctgctttcgaatttgcgagtaatagaactttcgaattgtgacagaaccattgagaacatggtgaatctgtcaatattacaacccaaaagccggttggtggtaaaccgtagtacggagcattacaaaggattccatcgtataaattatgcataagcatcaccttgatccatttgccttg

SEQ ID NO: 12995 - DNA, 452 bp, Saccharomyces cerevisiae
gagcacgacctactaataacgagaactattgaaataaaaaagagtagttttttatttttcaattttttaatatgataattattttatgacttatataaccacaccaactaatcgtacttttatatgtttaaatagaatggctgtttcagtcgtacactattaataacattatgttacttcgcaattaaatgtttttcaaagctaaaacttcaaaacaagatataaacaatgtacaaaaatgattacgaaaatatagatgatgtaagcaaggtacggttataaacagttaacatataagtttacttcacttttttgctgactcctttacttgtcttccctgcactttgattttacttcagaaaaaataagatatatgtttctgataaaacttttaggttagcggagaagatgttgccacgaatatcatgtaattgaaaggcaacgaaaggtct

SEQ ID NO: 12996 - DNA, 477 bp, Saccharomyces cerevisiae
ggcaacaatcaaaaggggaaaatgtcaacgctttatagaaaccttgtaatgcttaatattaactatatataatttatattattttcgttttaggaaagaacaaaacttatagataatatcaaatttaagcagaagtagccttagcagaaccggtttggaaaccgttcttaaatcttctggagacatgcttcaaatatctcattctaccggtaccagtagtgtgtcttctctttgccttggcagcccagttgtgagatctagtcttagcggatgggtaaccacaagaggaacaggtcttcttttgaacatggaaagaacgacgaccacatctgttacacaaggtgtgagatttgttgtgacgcttaccgaatgaaggagtaccctctgtttaaaatgaaaacataaaagttaattatcgttagtaaaactttgaactaaataaactctactgctggattcagaacaacttcattggcg

SEQ ID NO: 12997 - DNA, 400 bp, Saccharomyces cerevisiae
ttatcaagcccttattagctacaatgctgggagcaatagatatataaataacccttatgcacagcggaagacttcaaaatatctttgtcttttatatcattatgtggtatgtattatataacgagaataatatatcaaatacaaaaagtaacgaggttaccacattgaattttcttcaaatatcagtggttaattcaacacctccgacagcccatatttctctttcatcttcaaatctgtcactaaacattgtttccgcgtctcctccggcagcaatcctttctctttcgacatttgctaaccttttaccaaccctcttggtatagtccccaacagaccgtaattgaattgtagtacctgtgacagtttcgatgctgttaccgcgatctgaaattttagc

SEQ ID NO: 12998 - DNA, 462 bp, Saccharomyces cerevisiae
aaaaattctaaatgcgttatgtaagaaaatatatacgaagatgtatactagatagatttccactgttatctttcacaaaataattgttgttttaattgtgtctcactaagagattagtttatggaccatatcataacgtaatcctaaagcgtcattaataagggaaaattgcaattcttcgccacgaatttcttcgggaataaatagatcacaatgtattatgacctctttattcatttgttttggttgacaccttttaatcatcagcagttcatcgcctttgtgtccaattaaaaaccatagttctttttgtatcttagggaatttatcacaatatacttcaaacccattattatgcttactagaaaggtgcttgctataaaatgttaacacctcgttattttcctgttcttcaaatttcatgccttctaaaaccggtaatctttggcagacactgacgaa

SEQ ID NO: 12999 - DNA, 488 bp, Saccharomyces cerevisiae
tatcagagagttttacataacattgtatattaaaaagatataacaagaaaagagtggatgtagcaactgtctagttatagacctctttttaataatttaatgtttaaatcttgaatatcgaaagctgtatatataaagaatatttattgtatgtacaaaagatcttcaaccgcgcagcaatcaagctatatttacgcatcttgcttttccgaatgtttctttaagtagttttcaatgaatttttcctcgtctttgttgtctgttttgatgtcgactgtttttggctttgcgcttttaaaaggatttggaacaaccaataaacctagcagtcctaatgtcccaatggctagttggtgtggagggatagctttccccatgaaatgataagcagcacccattgtcgtagttataaattattatttgaagtcacctggccttattcaatgctaacgagttatgtgctctatggggggacttgctcctaaaaa

SEQ ID NO: 13000 - DNA, 497 bp, Saccharomyces cerevisiae
acagtcagtcttttcttttgatagatgcgaagttattaaataaatagtagcctaatacataaaagaaccactatatcatggattcgatacctgggccgtcttaaatttttatcgcattgaatatgcaaactttatgtattgttttactaatcgccagtaatggccgaccaattctatgatagatcttccctaagtttataatgatggtaagaaaacgcgcatatttcaaaactgaagaaaaaacaaacaaaagccatatggataatgaggggaaaatgtgatttctttacttgagcaattctttcaaactatcagtaacgctcctggcaatgagtagaatcgatgatttacagcaggacattgaatctttactcagtgaaagtatgtgattttgaggctgtaacaattttctttcttttaaaaaaatgattaagttgaacactaacatagtagaatcttcacagtcaattcattagaagaaagtcgtgagaagctca

SEQ ID NO: 13001 - DNA, 414 bp, Saccharomyces cerevisiae
cctagataaagcccttacatacttttaaatagtcagaatgagtcattgtaaatagatattgccacggcgctgccttttatcacttttacctcttcgtaaatatctattattcctgctcaatttctcatatgcggcttcggaaaaactcgggtttttccacgcctcagcagtaactccatctacctttggggatttgaaccatctcattccagttttggataactgcgattagattaaaatattaaaagattatcgattagataagatagaaaccaacaaaatttgttgtaatagctgtgtccttgtatccttaaaagaaaacagggttgaaggcatatgtattcacatctttctaacttgttaacgtctatgctaggaccgaagtcagaaagcgataaacatgcaagcccaagg

SEQ ID NO: 13002 - DNA, 438 bp, Saccharomyces cerevisiae
cgcttcttccaacgcagatttactaacacttaagctcgaagataaatcgtcatctgaactaccgcactccatttctttattaataccatccttatccaatttgtcattaggcttattctcactatccgatgttttcttgtgaatgttcaaaattttggaagtttgcaaatgttgtaacgcctcatttgttacttctgtctcaacttcttcagaatcctgtctttccgtggtcagtgggcttgcggatacatttaatagattatcattttgtaaagtaggggtatatttatgtattaaatcagacatcccttcattcacttgatcatttgaatacttctcaagatctctttttttctccaattgtagttgtaaaagctctaagtgttcagcaaataatttatatgttctctttttaagaaaaaattcaggcgtttcaaa

SEQ ID NO: 13003 - DNA, 424 bp, Saccharomyces cerevisiae
taatcatatcccttctcacattttttacacaggaagtaagcaagttatgttatatttccgacactataattaattcttagcagttaaaggtgctttgtctatattacatttacatacagcttgagtgatcctgaccggatatagggtcctattttcttacgtgaacggcttttcttcttgttcccgatggccttcatgtgaaaaagcactcctcgggaggcggaaaaatatcaaaagtacggggcgaagtttataatgaagatttatcgatataaattttggttatttcaggagaacaagaaagctctttacactaaaattatcagagaagaagctgatatattagccctaaggagtacaccaaaacacaatgaatattgtcaaattacaagtatgtatgcctttctcgaattcccacactgct

SEQ ID NO: 13004 - DNA, 480 bp, Saccharomyces cerevisiae
ttctcatcactccatctcatcctatatatttaacagctttctttttttcaaaaaactttttctattattagattagattttttttagtgtgtatattaataacgtaaaatttctttatcaacgacttgtagtattcttttacttttattttttttacatatgcaacgttatattcttttttaaatatccccatatactaatgatagaacttttaaacttttaggccattgacgaatttcatgacttcaaaacagtagttcagcaattggcccatgacattatttagaaacaaccatgatagcaaattctcatttgattttaagctaatatcgccgattattgcattcctgaatcttgtgctgcaatcaattaatttcaagcacgaaaatttgctttgtagggaaataaaggaacaaaaatctttaatcatttcatttaaggacttgcattcgatagacacagagggatcattgctaacgc

SEQ ID NO: 13005 - DNA, 405 bp, Saccharomyces cerevisiae
tagtttaagaacttttgcatggtatctaaaagaggtttttcgtttgggagctctagcattaattactatagctagagctttctgtgttgcacatataaacatcataataataaatcaagttttttttctttgggaaatgttcgaattaaaattgtacttataacatatcgtatcattagtatatatataaaagtgtcagtggcgattatatcattagaggaggaaagaataaactatacatcgatttgccgtcatttctgtatttatggcatattgactctgaactcatgccatctaatggtggaacaaacggattgggttctctacgtaaaccaaatcgaatgaatcggcagctgaaaatacaaccttgtccatgacagaaccagatggagcggcaatgtattt

SEQ ID NO: 13006 - DNA, 449 bp, Saccharomyces cerevisiae
cttagtgtatatactttggcacacttgtataatgtataataaaatcaggataaatccagtgtgacccggactgaattactgaaactttgaagtgttaaggaaattgtactgccatttaacgcatttacctatcacttagtagcatgcataagccatgggctaatcataacagattgtgatgataggcatcctgtactccttttttttacaagaaaatgagcaaccaggcactatatgagaaactcgaacaaaccaggacgattctgtccgtgaagctggcggaattgataaatatgactacgatagccgatagaaatgatgatgacgagggttcattcgcacaagaaaattctgagctcgctgtggccacgaccagtgtgatgatggtgaataaccagaccatgcaattgattaaaaatgttcaagacttgttgatcctgaccagatcg

SEQ ID NO: 13007 - DNA, 426 bp, Saccharomyces cerevisiae
ttgtctcctttacccatttatgtatatgtatatgtatattgagattaatatattaatatattaatagattataatagcagaactataagaatatgatgtttgttcagatcaagtgctaaatgacttgttgtatcagcttttaaatttttacatcaagacaaatcaattattcgtattatttcgtctgtagttgaaacagagttcaataagccaagagttttgaagcagctacaggcaagaggtaccgaaacacagaaaaaagtaacaagaaaactctctcgctctatatatatgtgtgtgaatatacgctatttatacacatatatagatgagcggcgtgcatgtatcgtagtaactaagattaatagttcttaaaagagataaataaatcatttaattaaaaaactgatttttaagcggaggcac

SEQ ID NO: 13008 - DNA, 419 bp, Saccharomyces cerevisiae
taaagttttttttttttttttcagcatgccaaaatgctacatacatttgttaattatgtactataaccgatactggtattaatgatgcgatgagctgatgagacagtagataaataaaagacgcttctacctacacaagcacatacaatataatatgcatatgcaactcaggaaaagaaaaagggttgactattcagggagaaatcagacgtccgatcctccttcaaccacaacggcagcggtaccatccattattgtccctaagaagcgtaaagtagtcgcacaaaacatggttagtccagctattcgagccacaaccacaacactgggcacctcaaatataataatacctaagcctctgcagcgccctaaattccacaatagcgccagcctatcttcacctgatgatgatcccgaaa

SEQ ID NO: 13009 - DNA, 423 bp, Saccharomyces cerevisiae
cggataaaattatctgatgactgtcgaaaggaaacggaaaacttttttcaacgataacatgtgtatgtaatatataacaaaaccatccggtcttttacaatataataatagtgataatagtaacaatagatccactaagaaaaaacgaatatacgaaagttgaatacttaaattctttcaaagattttacacttacctttttcttctgtgttgaggttttggtgatggagatggagtaggaacgtttttcaagtcaacgttaacatactcattaacctttgcggcaacaccgccgtgggcacgctttaccactctactggttttggtgcctttacgtttataaacgttaatgtaaaatgaaataaatagtaccaaatatgaagaaataatggcacaacctgcaaaggtggcagttgttgaacc

SEQ ID NO: 13010 - DNA, 416 bp, Saccharomyces cerevisiae
gtataaagttcatttgttcttttatgtatcttctagttattggtcatgtttaaaatggtaaaaataaagaaaataatttctatattttagtgtataatataatcgtcatagatttcgaagtaatgaaagaaaggttatcattaggtactataaactatgctttctgtttgctgcgaaaatacatatgtacagttgaaatatttattatttttgtcttcctttatttcctttattgtggtattagtttaaaccctcttttttggccgctttcaagactgtcgtcttttctagttccttttcagcttctgcaaggagttcattaaattcagtctccttggccatagtgatcgaatctttgaatagtttttcagctttagccaaaacaccttcatgaaggcttaaaacccccattccat

SEQ ID NO: 13011 - DNA, 498 bp, Saccharomyces cerevisiae
atacggttgccttgtttgtctcatcttttttctttctttcacgttcaagaactttcacacaacgaataacgtttatatatttatatacacatacatgttttaagatacgcatatcattatgatgtacacctcacgttagtgcaatatgcgctattcgtatattaaatttttgcgttcatttaatggctctttttcctattctagtgaaaaaaaaaacagaaaatcgaagagctggaaaatttaagaacaggcaaataggaagctggaagctttaaaatgcccaagatttcggtgaagcgcaagtgttaactagaaaaaggccgccactactctataagcaaaaccttatgtccatagcgcgattagtatactctcttttcagaagagtacgatcggttctcttacttttcattaccatatcgctattgttttactatacgttccagaatgaaatcgatatcttgaattcgtacgctttaaacgactcactaccgtcca

SEQ ID NO: 13012 - DNA, 428 bp, Saccharomyces cerevisiae
actgctttctatatttacatgtgggaaatgtggttttattctgtatttgagctagtgaagtgctgctagtataaatttaagtaatctttcatatattgccagtggggttctagcactttagtgagagtatttggataactgatacaacaatgtagtccgttaccaggagtagagattacgcttagtgagaaaattgaagatattccttgcggctcgttgaatgtagcatccactatataaaacggtaaactggtgttgcatgcatctttaaatgtttgaaatcctaagtttgttacttcaaatgtggaagaaggtccgttattcaagctaattttatcttctatgtattgttgagaagaaataacctccaataactttacttcgtttactttatctattattttatcctcggaactgcttcttatggc

SEQ ID NO: 13013 - DNA, 448 bp, Saccharomyces cerevisiae
atattccgtccttcaaatgaaaatacaagatgagacgaaaataaaaggaagtgtgtatatactgtctttaccctcactattacttgatagtccgtacatgtttcaacggtcatcatggaaaaagggtaaagcactcaactttttccatacactaaaaacgggtgccctttttactgtgttattcgtaccattatttattcacttatttatttattttctttgtacagtcacagtaacactctagttttgcaaagctctcagcctttcacgcatttcatttaccatcctatctgcttcctcatcaactttttcatccggaatttcttgctcttcttcattggctgctaattctacggttggcacttggtcaacattcttgaatttctcgtttgtgtattgttcaactatcttattaacttcttcatcaacagcttcgtccatctcttcc

SEQ ID NO: 13014 - DNA, 406 bp, Saccharomyces cerevisiae
ttggtcttacgttcttatgtgtttattcgatataattctataacatttttatgactttgtgcctttatgcataacatgtattgtacatattaatcgacaaaaatgacattcaataccctacactagtaattaataatgctgcaattccatcatcgcattctcacctaaaagaaatgtggacagtgttcattataagctgggttcctattcgtatttccggcaataatgcgtgctaagtgagtttgtaaaatcgttaaaatgagaatcaatgtacaaggttagtatcacgtcaattctttcaaagctttatattattaggtatacctcctttgaaagtagcaccagtcaagataatggatctttatccatagttattgcaattactttcaaagcaatgcggttgtta

SEQ ID NO: 13015 - DNA, 413 bp, Saccharomyces cerevisiae
tccgaacaatagtaatcagttcctactgtagtccctgtataataattatcatcttcattttcgaaaaggaatttttttaacatatagaagtgtcaaagtataaaacactaacaaaaatctaagagattattgcgactgcgtgtttttctctttgctgaatcagggctagaatcccgtaaactacatagcacattgtctttgccatattttaaaaattttgtggcgccgtcaaaataaaaaaaaaatactgaaggatgcgaggttcgaactcgcgcggacaaccgtccaacagatcttaagtctgccgccttagaccactcggccaaccctccgtcgataatacaacaacaaggaaatacaggatacgaacaccatccagtttaacttgattaatctttacgcatgcatattgc

SEQ ID NO: 13016 - DNA, 434 bp, Saccharomyces cerevisiae
atgacggtttaatgcaagtaatgtaatataatacaagagtataaaaataaggttctacacaaacatctataaatgtatagattatactagtttggttggcttcttagcgtttctctcatctacgtaagatgaacgccatgtgtacacttttcacattttaaatacatctcgcgtggaggagggataatagaaactatttagagaaaaaaacgaggcagattaaacgaagttactccaggattggtcaagcaatactcaaacaagatcaacgtcacgtcatagtcaacttcaatgtctgagatattacaagatgtacaaaggaaactggtttttccaatagattttcccagccaacggaaaacagaaaaatttcaacagctatcgctcatgatcggagctttggtagcgtgtatattgggatttgcacaacagtc

SEQ ID NO: 13017 - DNA, 423 bp, Saccharomyces cerevisiae
tttatttatttatttattttggagggcaaacttatttattgatctggcaaaaatgatctttcccttttttcttatttttctctctatctctctcattgattcttggtcaatagtactcgtttactgtcaacttacaccttatctattatgctatataattttatgcaagacattgaagtacaatatacgtcgagctgcaatatgcaaaaatatcagagggaaaccagctcattaggaaatatgacatgtgggctatctgtttgttggtggtagctgggtttttttttttttttttttgattttgtcgtgcgggtgtgcaggctgggatttcaaacaaataacaacgagtaattgacaagaaaaacttattggcttattttctttttgttcttcaaaattgtttgccttaccctctccctcagt

SEQ ID NO: 13018 - DNA, 476 bp, Saccharomyces cerevisiae
aggtatacggtgcaaggaaaataataaaaactagaatttatgggaacataataatccacatgcaactttatttgaaccgaaaatttgaaacgggaaagaaatatataaatgtataaagtataaatacgtcaaaatatgctttaatgaacgatatacacgttaatatacaagtcttatttgtgttttgttcacttatttaccttgattctgctggttttttgttgcgctttggaataattttaatgccctaccctgtagcgcatccgtagctttttttattccgtttacatcaattgacatgtcattttcgttagccttaaaattctttatagcttgtctcagagctttgatgtcctctacgatattagaatactctttttcgctagaaatcagtttttcatatcttttaaataaattctcagtatcacttatcataatgtcagccttagagataagctctaacctttgcctgatca

SEQ ID NO: 13019 - DNA, 477 bp, Saccharomyces cerevisiae
acttaatacaacttttcattcctttgtatagagtcttcatgaatgaaagtcttattcatttttttttttttttagcatagttttatattccttttttattccaagacttatattctcattatattctatttagtttcgcatggaatttcaagtacacatataactacagccttacttgaaaattgcctgtctgggtcttatactttgcacccttgtacagctttgtatttttgccaattgttaatccagatacaatatcgatggcttctacatagattccactggccgattgtcctatgtaagaatattctaaggagactgtttgtaaatcaactttttttgtaaaatttggcccagtattttcatactcaatacagccacgtagtacaggtaccgttccagtggcagttgatttatcaaaaatccattgtccttgacccatgataatgctattttcaaaacggccatgagtattgc

SEQ ID NO: 13020 - DNA, 491 bp, Saccharomyces cerevisiae
tagaaatatttacatgtatcgctggtatatcatataaatacatacagcagcactaagtggtagaaaagcgctatcaaaaatcactcggaacgaacactgaagaaaaagcgaaaaatcaaaaatatgaccaacgcttggaaaatttcagtagcaattagacgaacctcgcagtcctgtagtaaaacggattaagggacttcatatactgttgatactcggtgtattgcaattacctactaggagttttctgaatagggacttaagaagtcaaatatacagacaaaaatagggggttgtagaaggaatatttgattcgaactatgaaatgcagggtatggtcagaggctcgtgtttatacgaatatcaataaacaaagaaccgaggaatattgggattatgaaaatactgtaattgattggtccacaaatacaaaggactatgaaattgaaaataaagttgggcgaggaaaatactccgaggttttccaaggt

SEQ ID NO: 13021 - DNA, 434 bp, Saccharomyces cerevisiae
ttcaattggtttggatttttcttgttgcttcaacggattatcttaaaaaaatctatcatatttcaaaatataaattcttatttttacaaagaagatatagattatgcataatattattttgttacattttttttcttttactttttattttcttttctttgtacttcctcaaataagcatctttagcaggttaacaatagcaaatatcatgtccagcccaaatcacataatactttccacttcactttcactatctgtttcgggagacctatcatccacggtattgacagttggtctttggaaatcagttgcatgtgcccaaggaatggatctcgaaatgttctcaaacacggaggaccttcttctgaaagtcccacggtaagcgggcataggttcggcaaaactgtgaggattattgtcatgtgaaggcgtga

SEQ ID NO: 13022 - DNA, 464 bp, Saccharomyces cerevisiae
aaataattccccactgaagaaaaaagattgcatctatgaatgacactaaaatatgtttctctttttgtatttgcttttgattaaataatggtcaatttgcgccccccaccttatatagtttagagaaagacgtgtaaatattttttaaaaaattgatactgctctaatgagcctaaatctcctttcttcgcttgtatatatgcgtattctgtatgtttgtccaggcagatttttcggctttttttaccagcttttattattaaaatgtgataaccttaattgaaggttgcgatacaaaataatcctttattacgcataaccaaggaaaagagaaaatcagtgcacatatgggtttacctgaagttaactttcttcgaaaaaactgcatacttgtggagttaaaattattctatcaaacagtatacccaccgaaggaactatattggaataaccgaataactgca

SEQ ID NO: 13023 - DNA, 496 bp, Saccharomyces cerevisiae
tggatcataacgatctattgtcgccgccgcgtcacaaatgcgccccgaacttgtcgcgaagttaatctgaaacatatatgttacctactgaaacagcgcatgttggaaaagacaaaggtgaagacgaagttgtatatttaagatagaccctttatacatccttttgaaaaaattattaatgtggcaaccgtcttttatttgacaaagtatcttttttctttgtgaaaccaattttaggttttcttgttatagtaagttcttaagaaaaagacaagaaaaccccttgcgatgtttaagacttcatataacttgtacgatttgaactatccgaaaaatgattcattaacgccaataagagactacaaaaatgactattttcataaaaatgatgacaaattaccagaaattgttagaaaacctacgagaaagttatcgaaacatgaaaacaaactcaacgataaaaaattcacgaataaacgaccagcaagtctggact

SEQ ID NO: 13024 - DNA, 496 bp, Saccharomyces cerevisiae
taaataattagaacaccgtattagtgtacatatagtataagtatctagacggcattcatgcacatcataacttaaatatttaaaatagcattaagataaaaaaataaagagaggtatagttgctaaatgtcctggggttgcgtgtaaataaacaattgtttgctttgagtaaagcaagcatgtggatggtagatgaggccttatttactcccattagctgggtaacgcagaaagttttaatatgaaagggtgacggcgcttggcgtttttcttggattgtagaagtcatgctaggcccttggagtaagataagagagaacaaataaaagctttggcaaatatcaactcagacgtcttttttaaagaggatatagagctttggtgttggcctatttcccatcgctgttaaatttccgcttttttgttttttttttccctaaatttgaggaacagctgtttatattgatttccttctttcctggtgcatattggttga

SEQ ID NO: 13025 - DNA, 436 bp, Saccharomyces cerevisiae
acattccattgcgtttcattgtgtgagcagctggccagtctgcacacgcagcaagatatatagagtggggaaaaattcttccccggtgccaaagaaaaaagcaaataaaaatgaaaaaaaaaaatgtgtgccagtacgacagcataccgcaacgagtttttacatacatgattaaactagtaagtaatattataagtatttattgaacttattgcgccacgacttctgcccctgcaaaaccttcagctttattaggtgggtttgatggaagatagtagagcaagtggaaagcataacatcgctaacgtcttccacaccctccataaagccgctgcatgaatgataaacgggctcaattcgtatcagtgtaaccaaatccatcaattaacgcccaatcgagctcgttaactccattttgggaaagaatcaagatgcc

SEQ ID NO: 13026 - DNA, 407 bp, Saccharomyces cerevisiae
tttttgaaaatagaagccttgtttatgagaaaacttatacataatattacatacaaactagagcattactatataattaacttacttgtcacagctgattgctttttctaggggaatctacattttcaatgtaaaattcaggaaccctattctgaatttgtgaatcattcgtttccggtatcgatgacgtggtgttagtgattgtcaaattgtctaattttggaatggaattcaagggaaaattgctactactcacatcatcgtatctcgtatgttgctcattagttacctggggggtcacgctctccgtggtgttttcattactcttggctttttctttagacagtttggcaactttactcacatatttgcatttgtcgtcatagttgggcaaacttgataaggct

SEQ ID NO: 13027 - DNA, 481 bp, Saccharomyces cerevisiae
cacgcttaataaaggagaataaatcgttttctactttcttctgctgctataataagcacctatgggatctatatagtatttttataacgatagactttataaaagaaaatacctaagtgaaaatttggtgaattttgagataattgttgggattccatttttaataaggcaataatattaggtatgtagaatatactagaagttctcctcgaggatttaggaatccataaaagggaatctgcaattctacacaattctataaatattattatcatcgttttatatgttaatattcattgatcctattacattatcaatccttgcgtttcagcttccactaatttagatgactatttctcatcatttgcgtcatcttctaacaccgtatatgataatatactagtaacgtaaatactagttagtagatgatagttgatttttattccaacactaagaaataatttcgccatttcttgaatgt

SEQ ID NO: 13028 - DNA, 437 bp, Saccharomyces cerevisiae
gtccgctagttcatcgcctcaagatagataacgatctcttcctccacctcctatttctgcacactcttgtgatgtaaatacatatgtagacatatgtaagcttttgtataaatagtttaagaaagcatcataccaattttgaatagaagaaaaaatagctaagagcatagccgctcggaataagttgacgtagcgaaaaatcccaatatcgtaaaggaaaaataccttcatgagaacagaacattgaaaagaagaaaaaaaaaactgagcactgcaccattaagtcctcaaagatgagccactttttcgccgatcatgatgctcctctgagcatgctttctgttaaaacagaatactttcctcaattgactgataaggaacaaaaatatgcgcatttcatgtcaaaggcctcccatgcgggttcaagggttgtaatg

SEQ ID NO: 13029 - DNA, 497 bp, Saccharomyces cerevisiae
gcctgatttaaatatccgaaaactataaaaaaaactcccatattagtgcattactttaaattctacttctttgtcttgtctcttcccttgtgatgtgtcagaatttttttttttttttcatttttgcacaatttaagctttaaagttgtttgttgatcaaaacttacaactcgcagtgcagttacatagtcataatatgtagaaaaaatatagagaaggtatacgtcgttcgttgaagacagatggacaagctaactccatctcaatggaaggtaataaataagtcatatgaaccagcgtctacgataaaagtcattgcgggcccaggctcaggaaaaacgctaacgctactatataaagtactacatttaattactgtggagaatattaagcctgaagaaatacttatattttcgttaacaaacaaagcagttgatagtataatagaaaatttactgtccattttcgaaaactcgcatacaaataaggaaattgtc

SEQ ID NO: 13030 - DNA, 499 bp, Saccharomyces cerevisiae
aaataagccaaaaagaaacaagtataatcgatatatcctgtatatagacaaccttttgtgtatttcaaattttttgttgtcacctctccgattcattcgattttctccttgtggttcgcggataacctcttacttccattagtttatgtgtgcgtttatttttttatctttctctatatattactttaatgtgcattcttttgcttaaatactctacctacgattatgaaattcaaattgtttaaactctttacccaatctcttcttccttttcctttccatgaccttttcacgttgcttggccttcatgtgatcaaatttccacttttgcaccactttacgtttctcagactttttcaaatggtatctcgtattattgtttttattcatatcattttcgtattccttgagaatttcacgctcgagatctttgtttttcattgattgcaatctcgatttcatacttttcagtctttgttccatttcttcacgttctccc

SEQ ID NO: 13031 - DNA, 470 bp, Saccharomyces cerevisiae
aataataccttcgaagaaaatgtttagataaaggttccttgtatataattacgtaatctctgctctctcgaatgttggctgcttgatgtatgtgaacgtttggaaagaaacttgggtttatattcactgctaaaatgacatcctattagaagttcgtctttctccggttcggttagtctactcacctagaaacatcttgcgaaaatcgtcgttggacatctgctcttgtttgtcaggaatttttttctttacttgaagatttggtcctttttccatcatgtttatacaactaggtttgacgtgtttcatgctgtgattctgttgattgttataatatcttttcatgtcattaatagtacctgaacgtatcacctttccctgaaattgagatccatttagtatcattagcatttttgctgcaaacttactatctctaaatataataatggcgccattgaagtcgctaacga

SEQ ID NO: 13032 - DNA, 476 bp, Saccharomyces cerevisiae
cgattgagctccgcacattatttattaatagcaaacaccaaggaaagggaaaaaggaaggggcgtggtggacgatgatatatgtatacatatacatatctatattttgaaaaaatcttctatataacggttgtatagaaataattacttatttatgaattagtacaaaatatacaaagcatgctgctgttcggaacgtgacgaaaacagtagcttaaactgtatattttttgtgatactgtgcggctgaaacagggaacaatatcattagaactgcacaaatgcttctctagggatgccattcatgctactctgaaaaccctttatggcaacttcatagttccagttactttgctcggccaacataaacgtgtattctgcattcaatttcgtttccaaatgtagtttattcagcagctcgagttgtacgggatttagccgcgactggacatctggaggtagttgcaaagtgggagc

SEQ ID NO: 13033 - DNA, 487 bp, Saccharomyces cerevisiae
tgaaacagcaattcattacaagctcgaagaagtgaggaagtttagggcatgccacatttcaaaagagcagcagtatatgaagagcaaaaaagaactggtaaatggggtcaacttgttgaagaaaccaaagatagaatccccgaatattcgaacaaaactatagcaaagataagccacttggacaatggttgtttgtggcctgagataaaggtctctttttctcatcatttgagcatacttcaatcgatgtgtcttcattttattatttctatacttttctccaaatatatcttcgtttttcttttcgctttccttcttccttctgcctttcctctatttattttgcactccactcttttccgtaaaccttgcctatctattattggatttttgaaaactaaagtataaaggtatgtcataaataattaaataacaaaaaaaataggatcatgatacaaaaaagtgccttccccttagcacagctgat

SEQ ID NO: 13034 - DNA, 483 bp, Saccharomyces cerevisiae
ttgtaaaccaagaattactttagcctaaactggatacatacgtataagcatacggtaaggaagtgggatctgtagcggtaatgcaataatgtgttggctctcacaaatatgaaaactgcgaacatctatataataaggtaacggtataacagaaaaatctgaataatttctctttcccgggtaatgagcccttaaggaggactcaaaacgaaaaggaaaaaaatacgagtggaaagaaaaaatgaaccctttccagtaattgataataatacaatcattcattattagaaatatattagttctcaattcaaggcagaatagtgctgtcattgtgatcaaatttttgtgtgagtctgctttgctttctgtttttttttgttgactcgctgttcaatctcctacttttccttttgttgttaaaataaggtattatatatttatacaaccctataaaaagcaattagccaatttccaatcctacga

SEQ ID NO: 13035 - DNA, 500 bp, Saccharomyces cerevisiae
taaaagaaaatatggaaaaccctttcatgggtgtttgcacggaattaggatcacataatgaatacacacaggaggaaaacggctcgatacatgatttggccataacggcaaaagcgtatactcacataatcgtatgcaaacatatcacacaaatctatcatacgtatgtatacatttatataatatatgcatatggcggataatatattattgttcactgattttgtcactttatacgtagtcttcctcgcattatttagagacgagggagaaaaatgggccaaacatatttgatcattgtacgtgatgaatccatgtcctgtaggcttctcaagagaacaaaaacaaaacacagacaaaataattgaaaaatggacggtatgtttgctatgccaggcgcagctgcaggtgcggcctccccacaacaaccaaaatcaagattccaagctttcaaggaatctccactatacacaattgcactaaacggtgccttcttcgtt

SEQ ID NO: 13036 - DNA, 499 bp, Saccharomyces cerevisiae
cgacccctcaaacaagaattgtacgacattacgttcaagaaaattttaacgagtatcgtaatatttacaagatctttttatgtactacaggaagcagaaacaaaatgagtatcaataccagtgtaaatctgttaatgagaatcatcacattatcccagttttttccatgcaagggaaaaatatactatacgacatttctatactttaattatcaattaaggtcatctttctgtacgaaaactaaccacgattgtcactaacgacgtgtcccttacccgacgcagctgctgatagcgtaccgcacaggcacagccagctcttctgtgattggcagagaggggtccttcctgcggaagacgccgcaaaggcacatatgactaaccttttttttttcgcaattaattttctaatagtttttcattttttttttacaattttggcagttacgtctcgagctatttattataagagtcagaattggcgcagggagtgttaagta

SEQ ID NO: 13037 - DNA, 411 bp, Saccharomyces cerevisiae
ctgacgtgaacttgcaccatgtacatcaattctataaatctactcatataatgaatgtgtaaatatgaaaaaaaaaatgcaaaagcgcaccaccaaaagagaaaaaagctgaaaaaaaaaaggaaaaagatacttgatgtgatgtgtgagtgaaaaaattattaattcctactggataaaatcaccccaaggaaacagttcaagagctaaactaaagaaaagcatattgcataaaatgttaagagaagtcatctattgtggaatttgctcctacccaccagagtactgcgagttttcaggaaaattaaagcgttgtaaagtttggttatctgaaaaccacgcagacctttatgcaaagctatacggtactgacgataatacgcaagaggtggaagccgtgaccaacaaact

SEQ ID NO: 13038 - DNA, 491 bp, Saccharomyces cerevisiae
gattgagtagccccatgacatggatgagtttcttcacaaagtaaataatattcgaacgtggatagtaaagcataatgttatctatttatatataaatatacctatgtttttatatgtctgtttactgatctaaagtctttgagcaatcttgataacatcacccaaaacaccagcggcagtaacggcagcaccggcaccggcaccttgaatgacaacaggattggtgtaacgcttagtcttgatggaaataacgttatctgatcccttcaatgatgcgaatgggtgtgagtaatcgtacttttcaattcctacagacacagatttggtggcaacatcgactttaccaatgaatctcaataccttattttcagtggcagcttccttcttcaattgagtcaaatctttatcgtaatcagataatttttccaagaattcatcagcagacttgacagattccaatggttttggaatcaaagactggacagggaagg

SEQ ID NO: 13039 - DNA, 422 bp, Saccharomyces cerevisiae
tgggaaggactgatgatgaattcccgtgtacatttcacttacagcttgcgttatctctcacaatgtatttttttctgtataataaagaatcatataattagcgcttaaaaggaaagagttgttcgataaaatggggagcctaacccctcgatgacctttcttttgaattagtcgagttccatttcatatacaatattacataacttgacaacatttgaggattactaatgacaaaaatctttatacgctctatttacggcccttcttcttgttcttaggctttttattaacagtgggcttccctttctttgatatgtcaagggcctgttctgattttttgttcatagcaccaccttgagtttgttttgcaccttgttgttttttctttggcctataagtagacctgtctcttaatggcagcc

SEQ ID NO: 13040 - DNA, 490 bp, Saccharomyces cerevisiae
aaattttgtgccctactaaggtcgcatggtttcatgcatattctgtctacatataacccccgttaataatgcttttataaatataatcaattacatataccttcccaagttatttattactaaccttcgtgcacgcaagaaaaaatgtattaacgtacatacattttctaaatagacctttcctgacgcctgcattttgcaatagccgaagataagaatatgattttttttttacgatttaaatattctgttgttgtgcagtctaaaaacacacgtgtatgtttttttccgcacgcatgagcagaattagacggttttataaacgttcgctctgtgtatttcacgtaccttcccggatacaaatttcgtcatggtttatattggaagtttttccgaaattgcgggttttgaaggtttatccgagacgacgtgaggggtaggcaggagaaggaaggctgtttacgtacgcaaggatggggtacgacaatga

SEQ ID NO: 13041 - DNA, 433 bp, Saccharomyces cerevisiae
tgaattaatcatcctcttcatgtactacttatgtccaatttgagtgtaaaatcacaggtacaaggcttatccatattcgtatatatcttcataatgtttcataattgcttcagaaaattattcaaaacgtcttgtgatattcattaggtgaaatcgtagtttgcctgatacttgaaagaatctcacctggagaatgggtgttttcactaagattcgttaatttccactaatgattaattgttaactgtttaacgcgacgcgtaataaagtttcctgaatacgccaacatatgggaacatatagattaaattaataagaaagcttgggaaaaataattgagaagggcaagaagtgacgtaaatatactagacgtactattatggtttcagttatagacaagcttgtttttgactttggtgggaaaactctggtc

SEQ ID NO: 13042 - DNA, 498 bp, Saccharomyces cerevisiae
tagtagtttttgttcatgcctggcgtcaaaaaaaatttgtacatataactttttattctacttttatatgctggtctaaatattactcaattcttgccagctggtataaaattataattcgctctcatgatcaccacatctgactatggttacaaaattacctgtgcctacagcttcacacgacattctttgtatattaagaatataaaaaataaatatgccatctcctagaatcgaaccagggtttcatcggccacaacgatgtgtactaaccactatactaagatggcgaacttatataaaataaaaccttttcaaggttatatatactcaatagatactgaataattttggagcttcattatctttgtgcaattgtctccatgtacaaaccaccgataagatttagtgtagagtatgttgggtgtaaaaaaagaaaggcagtttattgactactggtgtaactagacgataaaggtttgagaggttttcatggca

SEQ ID NO: 13043 - DNA, 414 bp, Saccharomyces cerevisiae
ttttgaatttaaataatcctttccatatgttattaggtacatatatagatagatataaaactttttttgattctttatcaatattacgtttacatacgtactctcgtgcaaggaaaaatactttatcctaattcaggaacatcaaatcataatttaattgtttgtgcatcgatggcttcccaatcagcagcggtcaagacttcatagcgcttgtaattcttgagccaaaaaatagtgtcatttccatccaaaccctttggtaatttttgctctctataaaccttcttcaaaattttatgattatctgtcattttaatttcatcaacaaatttaacaaataggggcatagcataagacggtagatttaaccggctcaaggaatcatttaataatttggtctttgcagtgatgtca

SEQ ID NO: 13044 - DNA, 443 bp, Saccharomyces cerevisiae
tgatgtcttcctttgtctgctatctagcacctctcgtcttttagtgctttttagcgtatgattctttttaagaatctggtctttcttccttctattttgattgggtatatttctattcgtgtttcattactggtctgggttaattgggttttggtttggtccagttgttttcaagtagcctttattttttcattgtggtattttatcttatcgatttatacttttttttattcaaagaaaattaaacagataatctcttatgagcctagctactttgttttttcttacagggccattgacttatgccctgaacgagtcttactttactttttttgtattttcaataatgtcgtgtttcccatgttgtaatacgcccaaagattatgtggtagagctttttttttttttggttagtgtatttaccaaactgggatgattttcaa

SEQ ID NO: 13045 - DNA, 444 bp, Saccharomyces cerevisiae
aataaccattacctccctactaaaaatgactcgatggtcttttaagccatacgcatgagcgaaaatggttcctcctgttcaaactaaatcggttattcgagcgtaccgttgaaaatttaataaaacgttttgggggatttatagaaagttaaatacgaaatatgcgtatagtaatgtttatacatgaaactcaaaaatgcgactgtgttccttaaaataataaaagttgagtacgaataacgatgactgagaaaggtagtgtatattgtatataaaattggaccatctttgtagtaaagacaaaaaaaccaataaatgcagataaacttagcagaactaactctaaatttaactttccttggatgatttttcattgagtttttgagtaagttctaggatttgttgcttcaagtcatcattctcaaccaataaatgtgctctgtg

SEQ ID NO: 13046 - DNA, 472 bp, Saccharomyces cerevisiae
taaatccctccctccatataagcatttactagactttaaaagttgcaatgtatatctggaggtataacattgtacattacttgaaagaaaagcgtcttttaacgtaaaataaataatactgttcttttttattgttactggcttcttaatcaacaattatatacttcgacgcaaaaagccgggtaaaacattctatctgccattgtcaaaaaatatgaaagaattttttacatataactacattgcattagtatcaccaaatcaataatgaaataatagctaaaaactatatattgaaggaaatatagtttatcatatatatcctctagtgaagctactatagatagaaattatttagcatttcaggatagttcgtttctcccttttttcccctttgttttctctcatagtcttgtaacctcagcttttgttcattatgagtgaaagtggtcaagaacaaaacagaggcaca

SEQ ID NO: 13047 - DNA, 472 bp, Saccharomyces cerevisiae
aggaaagaaaatgtaacttttggcatccaagatgcacaatacatttgattttttttatatgtcttttatatatatatatattaatatgataactttgcattattattgtggggatggaacttcacaagcggccgaaatttccaagatgaaaatatctaaaaaacgagatttaataaaggagattgaaacggaagaaggtagaaagcactgcaatatatcaccaatatgagtgtccagaaaatgatgtgggtgcctcgaaaaatggttggaggtagaataccctttttcacatgttcaaaagttttttcaggtttctcgagaaggtcttttcatgagagtccacttgctcgttctacatatgaagaagaaaaagttttggtggatgaaatcaaacaaaaacttactccagacgatattggaagatgtaataaattgcgtaacataggtatatctgctcatattgactccggaa

SEQ ID NO: 13048 - DNA, 423 bp, Saccharomyces cerevisiae
gcgcttgataccctttagagactttatttttttcttttttatgataatttctgttttccgctcttattttggatatttcatatttcatattgttattattactattattatatatacatacacacacatattttcaatttttttgtcatatggagacgaaaaaatgaagaatgaaattaaattggtttataaaattatttctccgccttttatttgctatttctctgtagagcttcgtcttcgagggtatcaattttacgcctgatctgctccatattttcgcgaattttaacctcttgttcatcgaattttttatccagctcatttaaagcctttagccaaacttttccttgttcttggatgctggttatttgtgaatccagccctttcgtggtttcgtacacctcgatcaccctgttgttc

SEQ ID NO: 13049 - DNA, 424 bp, Saccharomyces cerevisiae
taatagcgctttttcactgaggttctacacataagattacgtttttaaataccagccttaatttagtatattaaatatttcattctagcatttgatggggtacttcaaattatcttctttaaattgtccaaagcccttccaaaaagtaaaatcaaaggagaaacttcgagaacgcctaggcgcgcagcaaactccatatataacaatgtattttttctttaactacataaaaccaatttatcctattttactctttccatggagtgtatgcttttttgtagttacttagattcagaaattcaatgtcttccctcattttcttcaccgtagagtagaccatgggacgtcgttttactttagtttttgaattttttcagcgatgcccgaaaactgaaaattttatctcatctcattcacctgcctg

SEQ ID NO: 13050 - DNA, 466 bp, Saccharomyces cerevisiae
gtacagaaggaagaatgtcgccatgttgatgaaagaactttcattttccctaattcttatatagcgtaagtatctgtaaaatagttgtgaaagttggacaaatctttatataaaaaaatgcatatagcttgaaactatttcaggttgggtacattttgatagaatctgattcgcaaaatattttcatgtcaactggatccataatttgacctggatttaaagaaattaagttttgctttttcaatgttttggccaatttcttcaattttttactgtcgtaaacatttccatttggtaatagtattggattttcaaataattgagactgaatgtgatgagcaaatggtaatgcctgtgttattggtttgaaagtctcactgcaaacgggacaatttttcctttttagtgaatgtagcgtaaagagttgtaaatcttcaacttctttctctgctgttgtggcagtttc

SEQ ID NO: 13051 - DNA, 420 bp, Saccharomyces cerevisiae
tccgactctaaatatttttcttgtttgcattaaccataattttatctatttttatttctcatgaatatataatctctccgtttataacgaaatgcaagaaaaaaaaatctcacccatttttttaaacctttgacgtggaaaggtatctgggaaaggtatctggctaatgaataatgccatagcatataccagtatagtctatttactcgttacaacgtatgaaagcgtcagcgctgcaagaatgactaattcatagaaaataatcatcatgatatatatcataatgcacggaacctgcttcgctaattttttcacttaaatcacattttttcaacgaaatctcttgcgcagttggttggaattcttatccgaatgactcagtctacatcaaaaaactgtggccgaatggtggtaattgat

SEQ ID NO: 13052 - DNA, 465 bp, Saccharomyces cerevisiae
aagttgaattaattaagagagtattttaaaattgtatagtacataggttgttagttatctaatgccattgaaggagcagatattgagcttttgcatataattagtggtgcctcatggattgaagaatatacgtattttggcaagtttattggtttttagtttatgtatcggcaaaagcacgggcgcctctttttttcctcgcttactgagcgctgttttgtatataaatacatttgcagtggggtgcaccctcgagaatatatgagatcattaaagctccacttgttgtaaattgtttggcgattttatatgtttagacacaccgatgaactaaaattcgctttgaaaagtttgctatgaatactttttttctttccttgctaagtggcgccgctgctggtacctctacggatttggtttttttccctatagacacaattaaaaccaggcttcaagctaagggtg

SEQ ID NO: 13053 - DNA, 468 bp, Saccharomyces cerevisiae
attatcgtcctccatatgtctcgttcctatatatagaatttttttttagagttatgaagttgaggatgggttccttattcagctatgtttacgaaatgtttgtagttatataatcacaatggaaagcttcgaggaaccacttcttaagtactcacttagtaggtggagtatttcttgaaactggactatacgccattaaactaaaaaaaaatcgaggctgaaactccttggaataattctgggtagattaagatagcaaagaaaacaatactctatttttatagacatacgtacttttgtaccgaaaattgcatattgatgaacctgccttcttcctttaaaaggaatcaaactgtaaatccgaggctttcagcagctctagtgacttgtttttgtagaattttctgtgattctaatgaagtatttgtcattaataaaaagtgcgatagcctttctgagtcatgctcc

SEQ ID NO: 13054 - DNA, 422 bp, Saccharomyces cerevisiae
tccgtttaatgacacatataaaattgttatatataattttacgtatatatttacaagtagaaagaacgctaacgatttaagatgacaaccaagtcttcggaataaattttttccaccacaacacaaaatcataaaaatacaattgattaatacgcctctcatagactatccagtttgtcaagttctcccacatccatttaatagaccacctcgcatactccgaattaattctttccactttttcgtcgtagaccgtcttggcgcagtattgcgtcatgatcaggaaagtcctctctggcccgagtggattctgtagacattcatcaagatgtctggttaggtcgttagtcttcaatatcaaaagcactacacgagggattctagacaaaatgctcatcaagtcgctcagtaacgttccttcc

SEQ ID NO: 13055 - DNA, 414 bp, Saccharomyces cerevisiae
tgaatgattgcaatgaaaagtttaagttaagcaaaaggaggtaaaaatggcatgcactttaatttttatacaatcgtttttttgtcataagacttatttatgtatctgttgtttttctttttctatcctctatttttgtctatttgtctttgttttactctttttcattattatttctttatataatttttgtacgatatgatacacataacaatgagcaatgaacatatttctaatcctaaccattagatatacttttcaactgaggaataatggcgccttgattaaactaagctatggaatttgcattattcaagttttagggtgtgcttaatctgcgttgacaatggttcacgaagacgacatcggcaactttgctgtactacaaattgctctgaatgtgaggctgatcca

SEQ ID NO: 13056 - DNA, 478 bp, Saccharomyces cerevisiae
tttaccctatcagcttatcgtatttttctttcataatttacattttatttgaatatataaatcatattactactttaatagcataaaactcttcaaaacatctcatcccgaaaaagattactaaacttaaaaattacatgttgccttggtttcataattttggtaatcattcaaaatggaaaatgttagcacatcttgttgctgttgtcaatgtatctgttatgctatacaaaattaaattgtagggacgtaatcttaataaaaagttgaaaaagggtctgaatgttctgaaccattgtaaagtatcccgcttgaaccttgttttccatctctatgcctaaaagtaaatccaacaagcttggaatcaacggcagagtcatcgaccattgcagataatttgttctgtcttttgaagacatctgcatatttagccatatcttcttcatttgtgaagtcatcgaaataacctgcatccgtt

SEQ ID NO: 13057 - DNA, 412 bp, Saccharomyces cerevisiae
gccaacaaacaactttcgtaacctgttttctactcagctttcttgttccaatgctccgttatacgattggttaagtgtacaacaatatatagcctcaagtatttctgaagtttttaatatgtaataatagatttcaacttccacctacttttattcgtgattactgagccattgtaaaaatgcctccaacgctcaatgattccgttgtcgtcttctatcatgcctctactggattaaaaaatcgtaaataaactacttattaagccatatatcctgtgaactttttttcatatacatccaaggttctttgaaatatgcagaaaatgtacgtgatagttaagcttttaggcatcgaacatttccggacaattgcacccacatccagatgggcactcatcaccaatctcccacc

SEQ ID NO: 13058 - DNA, 495 bp, Saccharomyces cerevisiae
tgtagaaaaaaaaaaagaaaaaagaagtgaaatttttcaaatatttcacacacgaaacatgactcctggtgagaaatgaccctttcaggttgctttgaccataaaggtttgactctatctcttgggtttctcatgttcgctttttactctgtataatttttaaattcataatcatcttagaccgaaccatgagtcttcttcatcttgttttatatataatgcagaacttgcttcccttagtttgcgttcagtaatctttccttcttctagtgtaacctttacgaaagatactaccccatagcaaagcataacagcttaaaccgaatcctccttaacatgccttacactctatccgacgctcatcataagttgatcacctctcatttggtggacaccgaccctgaagtggactccattatcaaggatgaaattgaaagacaaaagcactccatcgatttgattgcttctgaaaatttcacctcaacctccgttttc

SEQ ID NO: 13059 - DNA, 488 bp, Saccharomyces cerevisiae
atgcgtatgtgcgtataactgtgtgtaacataagataaaaatgtgcatttgtgtgtgtgtcagtgattttttttcgcatttacatatataaaaaggcatttctgctggtggaaactgatgaatgttttgtgtgggcaatattactatttagttttgcatacttaaatttgtgtatacgattagaaatttcaatatttcgggtgtaacacaaacgattatttttttcttgatttagagtcgccatatgaatattattaacctgctttttctgtgttctctcttatatgaggttcaatggtaagtgtgtttttaactcgtgttcttcttcattaatcatctttaatacacttccaaggttgacctgtaaatcttcaaagattagtttatcctggcacgtccgatggatactccgtatagaaatatctaaggatctaataaatttgtattggtccattattggtgtggacggtttcttcggtgactccagc

SEQ ID NO: 13060 - DNA, 484 bp, Saccharomyces cerevisiae
agcggctatggacatttttaaacatatatttatatatatatacatatatgcgtatattgcataaatcacaaagaagaacaacgccctagatatagtgacccaaaatattatgtttaagttactggttggggttcatgtacatttttcactatcttttaattccaaatgtggattgtgcttctgcagattttgttgcctagtattctgtgatggaaaaaattgccccgatgagatataaaatgagctagccccctaaccaaagaaagcaggattggttagtacatagagaaaccaaagctgttatgttgttctataagcctgtgatgaggatggcggtgagaccgctaaaaagcataagattccagtcctcatacaccagtattactaaattgacgaacctaacagaatttaggaatttgatcaagcaaaatgataaactagtcatcgatttttatgctacttggtgtggcccctgtaagatgat

SEQ ID NO: 13061 - DNA, 439 bp, Saccharomyces cerevisiae
gatgaataatgcaaaactcaagaatatttatttgggtatctaagactagctttaaaaggttccaaaactggggtaaggtgtaatctttgtgtataacttggtttatgaaaggggtacatgacatggctaaaattcttcagacgaacatctttaatctaaagtttacatctaacaagtccaatctgaaaaatgtacagcgtataattttacatacctccaaaagaagaattaaatcaaagtgtgcagataatactatatacagcaaaataaatgctaactttacatatgattgctttcattttaaatcattctttccaattatgcctaatttctgtcccatcttaaccttatcaccaaccctaacatcgaacttaaattcagtgggagcttcaaaacaaagtacaacagtgctacccaattcaaagccacccatttcttc

SEQ ID NO: 13062 - DNA, 419 bp, Saccharomyces cerevisiae
acaaaagcgtgaacacttccacatgaaattcgttttttgtccttttttttctcttctttttctctcctgtttcttctaccaactttacctaataattaatgtgtaatcgaatttttttacataatcactacctaataactaatttatcatcacttttttttttcattttgaggccacactttcccccatggactattgcatcattgcgccatgcttcttacttgcgtaagccatagaacggaaatatcatgttccccttgccgcatgcatattgaaaacatcacgggaacgagaagaatggcattttcgaaataaaaagaaatcatatttcaaatgttggggagagaaagcaaaggggaatcaataatcattaagggaagtcgatgaaagtttccttttccgaactctacctcgcctta

SEQ ID NO: 13063 - DNA, 498 bp, Saccharomyces cerevisiae
acaaaattgtctacatacataactgcctaatacacattctacacaatatttttttctttttcaattcgcgtacatatttatgtaagataaaataataatatcctcttaatccatgcttagaactgctgccgttgattttcaaattcatcctcgtcaaatggtggcagttccattacatgaattttgtaccccagtgaatattcctggtcttgtaaggattcgaacgtcaaatcagacagctctttatcgtggaacccaacaatggcattatacacaattgtgctaactttaaagtatttcgccttgctatcaccttcggagtcagagacgtttccactttgtgcaaaagtagttggcaaatttctattaaactcctctaattcatcttccggtaattcaaacctcagtagagttgcttcttcatgatcttcataaacccctacatagaattcccttgtattattgatagatgttcgaggtccgccatttgtgtatgtg

SEQ ID NO: 13064 - DNA, 481 bp, Saccharomyces cerevisiae
aggatacgaaaatgcaccttaattcccaatattattacatatgctcatcgggaaaaccttttaagcaataatagattttaagtatgtaatgatacaaataataatatatttatatacgcatatatttacatgtgcatatatgaaaaataacctaattcacgttacccacctttttttttagccttttctttatttatatatgtatccacaacataatgaatgaattgtgagctacacaacatttctcgttgattataaattagtagattaattttttgaatgcaaactttttagtcgtcgtagttttcatcttcttccacttgccttactacattttctcttggaagtgtgttctcctgtggggatttttcttgagatgtttgctcttcctcacgcattttggcctcctctttcactgtttccattgtttccaaagtaggtttgattacagttatcgttgtagcagcggtttcatcttgtt

SEQ ID NO: 13065 - DNA, 417 bp, Saccharomyces cerevisiae
gtcttctactaggccttttttccttgaatattgcaaataagcttttgctagtactttttttactccgttcattttatggtttatttttcaattagttcgtttttccacaatacaaaaaaacacagtcctttgtactatcccttttatttcattattttttcttttttaagataccactagatattatcatatatagcatattatataacataaaaagtcaagaaaaaaaatgtttttatcactttctataactgcatatctttttttgcatttcgaatgattgcttacacatcgccatgctgggattcctcctctggtggtgagacaaatggacctgctaattccaatgcaggttcgtcaatgttgtggtgagcgtatgacaaaacaccaatcccaccggcgtccagtaagaaacat

SEQ ID NO: 13066 - DNA, 412 bp, Saccharomyces cerevisiae
aaataaaccaaccgacttattcatatgtatcaaagatacctatgggaactgctaaaagcaactattttgatcccgtagaacacgatttatttcattaaatttttttttttttttttttttttcactttcttgcgatgagatgcacatagtaaaagaaaagtataccagtgtagtgcgtaaattaatacctatataataattcattttcggtgactcaacattccctgcctatattttaagcacctgcaagaaatatagattatatacgaaggatggattctactgatctgttcgatgttttcgaggaaacacctgttgagcttcctacagatagtaatggagaaaaaaatgctgatacaaacgtaggagatactccagatcatacccaggataagaagcatggccttgaaga

SEQ ID NO: 13067 - DNA, 483 bp, Saccharomyces cerevisiae
gtttctaattaaaataccgccggttttccacatttttatattaccaaaacctgagagattttttcacatcgataaatctctactcgtttactatcgaacaatgctctaggtacgatgatattgttaaaaacttcagatacattttgtagcttgatatggttcaaagtccgaaaagatagccaaactattgcttgacatcgaaggtatgttatttgattaatttcacttttgtcaagctcttttattcttgtgtgtcgtaaattaaaaaattttgtgaatttactatcatcttcctttatgtacaacgatttaaaagttctcttatcgacttttagttcctttagtatattttcctcgatgttccaccacttgattttacttacacgtttcattgtcagagatttaaaatttttgggaaagacaatgctattcaggtcgatgtaagctactctacttaatacaagcttttgcaagttgtcccat

SEQ ID NO: 13068 - DNA, 479 bp, Saccharomyces cerevisiae
tatgtttcacgtcctgacccatattcaagcttcctttctgccggtttcaagcaatttatttttcttacttctccttactctctcaatttggttgtataatatttactttttagattgaaaaatattcaatccacttttctgctttgtgccacaaagtagtctatttagttttttatctattatatgcttttaaagagtttggaaatcgagacctgcatatgcaatagtaatattcaagggtcctttgattctgactctaagcgagcatttgcctcctgaacttctcttaatgacgttccaggaacaacactccagtctatcattttctctccgcgggtattgtatagccaatcgtttatcattttgaaatggttggtaccaaaaaatcctctacttgcacttaatggagacggatgcactgacttcatcaccatgatattagggtacttactaccgcttccaacggaagtagatcccaa

SEQ ID NO: 13069 - DNA, 419 bp, Saccharomyces cerevisiae
catttacattcaaccagtggcgtgtatcttttatacaataaatctgtaacttttaaaacttctgtttccgaactcctcatttttcatgcataaatatataaatatatatatatatatatataaagcatacatttcagtaccatggggtatatgatcctcccattacgtattctaaagttcgcgttttctcacaatgcaagtttttatattactccggagagttggcgcttactgatacagccttgtatgaactcaagtccaatatcacagtgacatccttggtaatcttcgccaagttggctaggttaggtctcagctcattcaaattaggcacgtcgctcattacgattttagtattagccagaattgatattattacttttaagaacgaattcattatctcccacgttttcagcttc

SEQ ID NO: 13070 - DNA, 402 bp, Saccharomyces cerevisiae
acttgatagttgtgataaacatttcttatgtacatttgttgaaggagttcgtatatatacagccagttgagtaataattatattttactattgcatttcataattattacccggaccttacgagttcttcgaataataaccatatatttcagaaaggtaggcataccgaaggaagagacaatgaaaaaactgaaatgaacaagcttctgtatacgatccaaggatcagaaacggttgttatttattgtttggacttcttgttgttaggctttatttaccgtgcataatactatctgatactttgagaaacccctccccccacagaaaggttcaaaatttacaattgctgcactaggtctacactttcctctagatttgtaacttgaagaccccattccaatc

SEQ ID NO: 13071 - DNA, 482 bp, Saccharomyces cerevisiae
gccaatcgtcatgtcaattatgtgctactttcttctttctttcaatcatctttgaagaattttctacttcaagccaatcctataaatggataaaactgtctttattgattatttgacaagattattttactccatcttcaacttttatcatattttattttattttcctgacgtttcaatattttcgttcgttaaattatcaccatttcttgtcgaatttttattttctatcataaagtgcaattctagactcattttttaatttaatggatccatttaatccatttcgtcaagcaagtatgttttcataacaatattttgctcagtgcattttgatcaagaaacgtatagttgatgattagaaacgagcttttttatgcccatcgtcatctatatatatatttgtatcactttaatagttattttaatatttgataacaacctttctaatagtattgttatggaaggtttagtgctggagg

SEQ ID NO: 13072 - DNA, 425 bp, Saccharomyces cerevisiae
aaaaaaagaaaagtgtagaaaactagagaaaagttttcttgtataattcaacaacccttctattaaataagcataagcaatttataatatatatatacatgtacgtgtattagtttcgaatagttattatttttttttcactatgctagaatgtataatcacaagctctacttgaagtacagctgtcataaagcttacaaataatcttaatgttattgtgcgcaagaatgtaagaggcagacattaactgatatcaccatgagacatgcctaattgaacaatggcataaacgttcagtaaagataagaaaagccacacaattatagcaataacagtgataatccaattgtttgccatataaacgattttgacatcttttccattttctatctccatgccactagaaccatcttgctcgattacgc

SEQ ID NO: 13073 - DNA, 462 bp, Saccharomyces cerevisiae
catgtatactaggagattgaatatgaaataaaatactatatatatatatttagatataaacccatctaaactatcgaattgaagaaaaaaaagctagtaggaatgtatatattgtgtatgcgtaaattgtaaaaaaaaccaaattcataatgtctcttattttctcgatctgttcttctttttagaagatttgcctctgtttctttgacgttttttagtagatttatttctagggttcttattgatagctccatctgatacttcacggggggtatttgaattttccggtcttttattgccatcatcttccaataatggcgaattttcattgcaaccagcgttctcatcgttgttattaacattgttatcggtgttgttatcgtcggtttcaagactgtcgtggtaaacattattttctctgtcaaagttagaagagattctttcatacgtcccaacagacca

SEQ ID NO: 13074 - DNA, 425 bp, Saccharomyces cerevisiae
aaacgatagcgaactcattcatatccgagaaatcgtcctgtaagctgagaaagatgaactgctactcacttcttaacctatattcacagttgtgttgtacaaaacttttcttttgattatataatattgtgattctgtaaataacaactagtttcaacgcactgcttcaacgtgcaccctcctgactaaacacggcaatatgcaagaaaccgcaacaattaagtgcactagaatagaagaaattattgtacttatagtttatttatgtatttaataattaaatctaagcttcaactggttcagcttgagcttcagtttcttcagctggtctgtagtccttgacagatggagcaagaattggttcttcttcttttggttcaatgatggtgacagcatctggcaaagcctttggaccagttctgctc

SEQ ID NO: 13075 - DNA, 400 bp, Saccharomyces cerevisiae
atcagatagaatatgcctgtaaaaactatgtaatatatcacaagtaacaacatttcatcaccattactaccattatgtagaaatttatgagcaaagacaaataagtaaagaaaaagacattgatataatataagagtatgctttcttcattttaatgtttggttgtgaattgaaagaataccattcgggcacgcaatagttatgaacttaaccgagctcaaataatttaaagataaaagataaaagataaaagataaaagacaaaagaaaattcatagcccatgttgaagtatcccagcgggaaatgttgctatccaacagaaagtaccaagccagtttcaaaaaggtacagaattaagtgatgctatccgtcccacaactaattttctccagcggagga

SEQ ID NO: 13076 - DNA, 439 bp, Saccharomyces cerevisiae
aaaatttttgctgctggaagcttcaaggttgttaatttattgacttgcatagaatatctacatttcttctaaaaatacatgcatagctaattcaaacttcgagcttcatacaattttcgaggagattatactgagtatatacgtaaatatatgcattatatgttataaaattagaaagatatagaaatttcattgaagagtatagagactggggttaaggtactcagtaacagtgtcatcaatatgctaattttgcgtattacttagctctattgcgcaaatgcaattttttcttaccctgataatgctttatttcccgttccgaaaatttttcactgaaaaaaaagtgcttaagctcatctcatctcatctcatcccatcactattgaaatattttgctaaaacattataacagagagagttgaaaggctcgagaacc

SEQ ID NO: 13077 - DNA, 429 bp, Saccharomyces cerevisiae
aaggatgaataaactagaagaaactgatgtatccatacaactgtgtaaatattaacaacgtcaaataatactactttgaattgttttttactgtttcccaggagaattacgccaacctcccccctttctttttttcccttgttttattgtacttttccacatatttttttaacatcaaatagtaattgatacatacataattagtgagcattttccttatttttacgtctcttcttggcggattgccaccagccgcatcttacaatgtatgccacgataccgccaggcaataaatgaatatggagtgtcacttcggctccgtaagccggcgctgcatccgccaccacagttttttttagcgtcgctgtcgccgctttgccacagaaaaagaaaaaaaaaaaagaaacggcgccgtgtagggttttgtat

SEQ ID NO: 13078 - DNA, 462 bp, Saccharomyces cerevisiae
ctttgatctcgatgtatatcaattttactagttttctgataaaagaaaaaaagtataatgtcagatttttgttaagtagaaatagaaagatatacgctgccgtgggagaaggacacctctccggatttgtaactaaaaatcataaaatatcacgtctttccttcatattttcaaaaaaaaaaaaagttttctttaccatttttgacacaataatcacgataattgttaggtcaggcattccctttccacttttatgttcatttggacgcaataagatatacatattatttaatgtgctctaatgacagttctactgtgtttatatcattagagtcacttgttacgaatactacatatttccgcgcagtggctaaaagcaaatttcaacattataaatctctaatagtaaactgacaatattgcggaattagaaaaaatgtaccacgcgaagttaagtgtctt

SEQ ID NO: 13079 - DNA, 490 bp, Saccharomyces cerevisiae
ggagtgattttgtgccatccatttgaatcttcaaaatatatgtacgtatatgttatgtatgtatataaattgttgtacgtgcaattgaccgaacgtgtatatttgtatatagatatgtgacaaactaaagagcttacacttcgttccttcccttctgttcacctttttttattatgcctgactattctaaaatttatgtttatgtggcgtaaaatatctttcttctgaaaacacatgcagcagttactcccatcataaaaggaattaataaatgaatagtataaacaattatttacttaaatatatttaaatttctgcttggaaaaccggccatgtcggcggcacataaaagttctatttacctttaaattcttttcgacatgtatggaccgtctagttcatatcctagtttaccatagtaatttcttacaccaacaccagaaataacagaaattttctctgaaccatgctcttccttggcgattctttc

SEQ ID NO: 13080 - DNA, 439 bp, Saccharomyces cerevisiae
atgcaacaaaggtcaaatgacataaaatgaaaactgataatattactaaggtttataaaaaaaaattgctgtatatgtgtacatagatatcgaaatgcaatttaactaggaattatcctttcttgatggagataatagtgtgtttccaacaattcccggtggttttttactcagatattgctccttgtaccactgatcgaatttcttattagaagaatcatgtaactgacagactttggtgatattgtcacattcttcgtaccaagggcataataagtcccttgttggttgtagcgctggtaacttaaattcaggcatctgaaacctagtcactgtttcttgtggaaaatccttaccatatttgttgtagaggggaatacgccgtaggagttcttcaacattattgttcatttttttatgcgataagctcccattgcta

SEQ ID NO: 13081 - DNA, 403 bp, Saccharomyces cerevisiae
tgactaggtttagataccaacactacatattcatatcaaagacttattcatcctttcatatttctttccttcattttccctttgtatgtataatattattaaagccgacgattattgcacgaaagaaaaaaaatatagataaagtgaacagtaccgaccatatcaatattgatttatcatgttaaaaagttaagtatatgtatagtttatcaaaatgaatgtacacattttctattcttcacaaatctgaggcaatggggtctgtctcaaatcaccatcaggcatgtttaccgtagaataaaaataatatgcttccaatcggatttgaaccgatgatctccacattactagtgtggcgccttaccaacttggccatagaagctcagaacttgagaaaaccgga

SEQ ID NO: 13082 - DNA, 432 bp, Saccharomyces cerevisiae
cccacaaaatgaaactcaaacgtagttttctcttctcaaacttaatgatctattgtttttccgagttgccatatttgtatagtttattctatttatacggttatcctaatatctgttatataattctttatgtaatacttttgtaaagttataatgaatctaatcctgaaaatgacttgtaaaataataagaattttttattcgatttaaagtaaatattaatacgacacatggaggaaagaaaaactagacgatataggaagaaatacaaataaaatcagaattgaaagagtaactagaggattttggagtaataaataatgatgcaaattttttatttgtttcggccaggaagcgtttcaagtaggcttgcgtgcatgcaggggattgatctttggtcttccaacttctcttcgtgtcgatctttgttgc

SEQ ID NO: 13083 - DNA, 465 bp, Saccharomyces cerevisiae
cctgcaatatgagtagagtttacgtatctaatatattggtataaaaagaacgcatctttttttttttgggctgttctgggctccaggaagtcataaattgtgggtacgctttagatgtgtttgcaatatttgcaactgctctcccaaaaaaaattagcattgcaagatattgaataactgggtcgtcccgaagcaacagtggggaaatagtttacgagttttgttcaagttaaaagcattttttgttgtgaagagaataaacttgatttcgaaggagatcaaattcgaaataatctgcgaatttattatgatcgactaggcaacgaagacgcagttttctattaaatctgtgcgtttgagtaacttaactgactataatatcgcaatcttaacatcattaaacaatgtaaaagaggtcatacgctataagaagttgatttgatcccccgtggattttgaaaaatg

SEQ ID NO: 13084 - DNA, 500 bp, Saccharomyces cerevisiae
gtgatgtgctgagaagataagaggaattatggatagatttttttttttttattcttactttatgtcgcctctatattcaattatataaagatgcctgtatattagagttgggatattttaaccaataagtttaataattggatgtgctcgttcgttccgttgtttaatctggaatccgtagtaaacagcaaccaagatatttgatttttgaagttcgtatcaaagttatcgttggtgatgtaatattcatgtagttggttaactactgacgcagcagaccaaccgcttttcataaacgtattgacgtatttcttaatctcatcaaaatcaccacttttgactttttcaacaatttctattagaatgtcatgaggtaccacaccagctaattcttccacttgggtagaagttatgtttttaccatcacccaagtattgcgcccccttggaagcggattgtaataatgtaatgcctcttctcaagtcacctgccgaaatgtc

SEQ ID NO: 13085 - DNA, 452 bp, Saccharomyces cerevisiae
atatcttaattcacctgtttactatcatgaataatagttatatatgtatttttttttgtttatttttgattttcttttaccgttatcacattctgtttatttttcacttttttttcgctctttctgtatgtatagaactaaatgcaaaagaatatttgtgccaagataaggccaagaaatttttggggcaacagtaggcagtgaaagcgctcttaacgtactttggcaaaggatgatcccagctccacttgatgcttccttattgagagaacatgcattccaaggaactaatgatctaagcacagttttgagtccaagtacgtttaccgatgaaggtggatataaacctgtattgaaatacggactcggttatttcaattatggactggttatagacgatgaagtgtatgattattcagtgtgtgatatcataaggggtcacgtttacgatc

SEQ ID NO: 13086 - DNA, 461 bp, Saccharomyces cerevisiae
tgttaaccactagaaacgagctagatcatgtgagagagatagtatatgtctttgtaactgtattttatatttatatgtatatggtgaattttacttaaattccttggtagattacatacacgactctgttgcttgttcattccctaaaaatcagggaatctaggtaaaacacatatgaacaaaggtctccttttttttttttctttcatttctttcatttttttcatttttcatttatggaaatgttaagctttcataagttctgcatcaaaagactaaccacagagcacatgcgacaattgaaataccaatgacagcggtaataatacctgcacctgcctttgaacccttagtgatatttaatggtgccaaatttgtgggttgcgcttgagtacctgctgccccatcaccaacagatgaaccaccattctctgccgtgtatggtgcgggtttatctaagg

SEQ ID NO: 13087 - DNA, 482 bp, Saccharomyces cerevisiae
gtctttacgatatacaaaagttctgctcctatcataaaaatttttaattttacaggtttttctcattctccttctaaccttctaaattctgtttttgtcagaagtttcccaagttttctttttcattaataacgttaaaacactttgtaccagtttgcttaatatgaatttttttaaaatagatagcttttgttatctttgtttctatgttgtaatatcccagtttgtcatatttttaatactcctcgtgtaacaacaaattaaaaaaaaataaatacttaaattaatcaagttaaataaactaatcgaatcaaacaaacaatttattataaaattatgttttttcatgaataggaatgtgtaagttgttcagttcttaagaggtatcttattttttaacatctttgagatcttcctcctcaaatatttccttcttgtaatatttccactattagagtttctattatgtgcggctatcgctc

SEQ ID NO: 13088 - DNA, 498 bp, Saccharomyces cerevisiae
taggcagccatcactgtagtattattagtaactgaatagcaaaatagtaatagtctccgtagctacaataggtgtatattgatgtcagagatacgggttaaacatgcgcaactggtagtagttcttcaaagggtgtttatgcttatcatagtacttggacattagccgccgaaactggctccactcgaaatctaaatggcattccctttttaatattaacaacaccaatcttagtgtccgagaggtccaaatctaatgtagggccgtgggaggatacttcttatttctctttgcttattttgctttgatgttgtatgtgttttacctgtaaattctctaatatggtcatttttgctcttaatgactcttttatttttacccggattgcaatttttcacatatcgtctttttattcactacgtactttaatcgtcttcgcgatgatatgtactgctaacgaaagaatgccatacaaaaaaaaagctaccacatcgctcg

SEQ ID NO: 13089 - DNA, 494 bp, Saccharomyces cerevisiae
agacatgcctttacgaatgagattccatagacattgaaagtaacgaaaaaatgaaataaaaaatgctttcaatataaatacagctgattacatataaacatatattaatattataaattcatttgctttcacgaactaccggctgggcgtcaatataatagggaacgcatagttgctcttttatctttctcacaactaggggtttttttatgtgagctgtacggaataggccagttttacaacaggattcgtagatcagaatccgttcaagctattcacctgttacagcagtagagttgctcttgtcttgacccgtgaatattaaatactgtagaaccagaacggatacttgaatatattcaacgatgggaaaataaaaagacatataagaaaaatgtgctagtacggtaaggaggatactgaaaagaaaaggaaaatatagtttaaaatagtaaagataacccactttcgttatgggtttagtgagggttggt

SEQ ID NO: 13090 - DNA, 422 bp, Saccharomyces cerevisiae
gcttaatgtatcaaataatcaagtactatttaatctatgtaacatatgagaaatgtaaaaaaaaaacttctatttcgtcaagtttttgaagggcggttcagcatctcttgatgactggatatgaaactacacgttcagtcatatgaatttgaacccataatgcacaaatgaataaaaatgctaacaaattctaattaatggcatggtactaacacccaacaatttaccgccctttaggtgtacagcttcaaataacaaagctttacaaattcaccttcaacatttacgttcagtagtatgaaattaccatcatgacgtgctcctatcaaagtgagattattgcacttcgtattattaggaaattaccaaaaaatgcaaaatttttcaattctgtgtcaaagaaatcgcggtaggcatgacta

SEQ ID NO: 13091 - DNA, 524 bp, Saccharomyces cerevisiae
tattaaatatgcgttaaatggagagccgtatgatatgaaagtatcacgtacggttcggagagggctcttttatatgaatgttattacattcagataggtttgctactctactcttagtaatgcctgctttaattggaggttttggtaaccaaaaaagatatgaaagtaataataataataatcaagtaatagaaaataaagaatataatttaaaattaaattatgataagttgggaccttatttagctggattaattgaaggtgatggaactattctagttcaaaattcatcttcaataaaaaaatctaaatatagaccgttaattgttgtagtatttaaattagaagatttagaattagctaattatttatgtaatttaactaaatgtggaaaagtgtataaaaaaattaatcgtaattatgtattatgacttattcatgatttaaaaggtgtatatacattattaaatattattaatggatatatgagaacacctaaatatgaagcatttgttagaggtgct

SEQ ID NO: 13092 - DNA, 493 bp, Saccharomyces cerevisiae
acacgccgaagaagacttagtttgtatttaggtaaaaaattatttcttcataactctgttcacccagcattttttatggaatatcgaccttgtaatgtcattaaccccttaaaggaccacttaaagaaaatgaagtgcatcatgaaatattcatgacgagatgcggaacatatacactcataaataccagaagaatgtgctgaataattttttgttggtaattggctgtcatttaaagtatcgttgaaacaagaggtattggaagatagctaattttagtattatttatgacgttctttcctggataaatgtagatgtatatacgtaataaaatgttaattagtaagttatatgctttccatataatgttctatcttagtctgcataacttgtttgcttgtttttgtttctaacgcttctccatactgggctaagagattttttattttttttgcagcagtcggccctgatatcagcttttctcctagtgcgc

SEQ ID NO: 13093 - DNA, 463 bp, Saccharomyces cerevisiae
gtacaggaaaaacaaaaaagagttaggaactctttcaaaaaattatattatatgggtgtgatgttgcagcatattactctgatatgtagaaaattgaatgcattgttatagcgtacttatgtgtaacccttccacataacggaatgcaaggtatcatttggcatcatatatgggaggtgctattataaaaacatgtagttaatagctaaaacagttttcgccttctctctttgagatgttaccacataactacatgaacttctatgtgcagatatgccgcataaaatgtaagaatcttgctttttttatgaacctatgcccacaagaaatgggctaaaatctgtctgtgccttttcaattacccataaaccaccacctagtgtcaacgtctagcacccctactcaaacatctctgtaaatgagctgctagtctgtttgcggacacatccctgccacaattctc

SEQ ID NO: 13094 - DNA, 425 bp, Saccharomyces cerevisiae
gtctggaaaagctatgaacacaataaactaggggagaaaatttttttttaatcatattagaaacctgtatatatgggggataacaacgccaataacatattccatctttccatttagttaccaacacgaatacgtatgctatcaatatcgtaacttagttttttatcatttatatatatacatggatgagcctacgaaaaaactaaagcacattcatgtatcaccataatattattttagaaagaactttttttgttaaatttatttaatgcaaaggttatataaagaacgatcaacgaaaattgtacgcgaattgcctttttttcagtccagtaggcttaaacctgggaaattgtaggtatgcccatttgtcttcttgccctccttctgctgaatccggtattagagccaaatccaccattttg

SEQ ID NO: 13095 - DNA, 401 bp, Saccharomyces cerevisiae
aactgagttcacgtttgaatgatatataccttatgatgcagagcaataaattcagtatttaattttttataagttttatagataagaattttccaatgaataaaggtatttacaatcatttcctagacattctcgtggtcttttctttgcacaatcaatggtcatagttttttttgtttagtagtttaaggacagaagaataacaaagatgttcacgttttgaatgttaccagacattctcagattcatcctttaacctagcgacgcgcacaggctcccaatcctcttcagaaagaccttgtaaacgataatattcttctttaatatcaaattccctttgattcttccttattttcaagatatcctcttcattaatttcctgaactttacgatcgccttgc

SEQ ID NO: 13096 - DNA, 416 bp, Saccharomyces cerevisiae
acgaaatatttgtttcagtgatttaaacttacccaatgattttcgtagcttgaaagagagaaaaactcatacagaatacggatatgtgatggttgcttaacgtaaagagctccagcaggatttttgagttgcataatgtcaattagcgtgttgattatcccgcgcttgaaattattatgtagtacactatagatgtatgtacacacatatacatggaataaaaagttaaatgtgatactgagaacattatttgaaaacaagagacattggccacgaggagtgtagcggcaattacaataatgttaaaatttaaaggtgcaactgtgtcgtcttcgaataagcaggctttatgtgagaaataacggtgtatgacttcaggaagagtagcaagagcgatcttgatattcagaagctgc

SEQ ID NO: 13097 - DNA, 427 bp, Saccharomyces cerevisiae
cgataatccattgtttcagagtttacgattacgatgcatataactaaatatttgatatataatcatgcactattagcatccgggttacgtaacttctccgccaacgagcctcagaaaaccttggagagccacaacaaattatgaaaaactggaaaaaaaaaaaaataaagaaggaaggaaagctcaattgggaggcactttctttacttgagatttgcgtttttgtaaagcagttcttaaatcggcatctctcatcgcatagatctttaaggaagatataggtcattcactcgcgttttcttctatctttctttttgttctttccagaagacgtttcgattatttccgaattgatcttgaaggggaagcaataattaaatctttgaaaattgatttgatataaaaactgacatcctcagtcacggaa

SEQ ID NO: 13098 - DNA, 454 bp, Saccharomyces cerevisiae
tagttacaatatttttaacagaatatataaaatacatatacagaaatgataaactataaacgcaaaagattagcgatacgaaaaaaggatttctcgctattatatcaatttataaagagatcctttggaaatataaattatgttcatttcattttttcaacttctagaaggatgactaactattgtttccatttgctagcatggtaaattaatacatttttgaatttgctgctagggtacaataccatgcaatgtttataatataaatcaaagtgacagagattcctaaaagctaaaacaaatccattgataatataatagtaggttggtcaattcaccgcagattcaatgtaagtattgatactccataaatgttaacttcaggttgatattcgttacaaaaatcttagtttgcttttcattactatctgaacggaatgctcaacatttttct

SEQ ID NO: 13099 - DNA, 410 bp, Saccharomyces cerevisiae
aagggaaattgagaagagaaaaaaaaaatgtgaacaatcaatgtatattcagagttctgtaaataaataaagaaaataaagtttacatattactaaggatttttgtcgcctatttttactatttttcaggtgaaatgaaacgttttatatcacattttgctatgataacaaagttattatgatttttatgtagcctatattattgacgcgttgttatagcattctatgaatttgcctgtcattttccacttcagaaaggtcatctaattgctcccaccagttgaataagtaattctcgcaaataatcttaaaccaaggcgtaaacttgtaacttgggtcagcaaacatagttttcaaatcatttggtgaaacccatttgaagtctctaacttcattgacgtttgggttga

SEQ ID NO: 13100 - DNA, 459 bp, Saccharomyces cerevisiae
aaagaacgagggggaaacagaaggtagaagcagggccttttaaccgttttcctatgtatatatgcaacatttctccgaaaatactataacttcaattgttcactttctccatttctatataaaaagcatacatagagttacaaattttatatattacttgactggtcttgcatgccgtccgtatcgctgctgtgattgtcattatcttctttaatggacaattgtttaaacgtttgtgtggtttcctcggcagagtttctcgtaggcggtaaagaaaatgaattttctgttcccatcaaattgtctgtatcctcatcttcgccatttttgccgccgccattgtttcgtaccccgtccttgtttgaacttgactgtgaatgattcggtgtggataccgttgaggaccccttggatttgggtaaagatgtttttgatgtggaaggttggctggttccttct

SEQ ID NO: 13101 - DNA, 493 bp, Saccharomyces cerevisiae
tcactctttaagtatgtagtgcaatgtttttggtttatatgtatattaatttcataacaacaagttcatggtttgcccgtattggagcatgttttcagatgaactgaaatgcctaaggatatttctatttcttttcaagaccatttactcaataattgctctaaagaaacgcaaatgcaaggagaaaaaagagggcgtttgagacgcgaccagtaacagttataaacggtaaccatttggcatcttttcataatatcactgtcagctattatcctcttccatgggttccacgcgatgcagaatatttcttaaggaagttttcatcttcgcgcaagcaagggacaaaacttgattgtatttttacataagcaagcatatttgatgctgaagaagtattattataaaaactaaacattggaaaatacacatatagcataccttaatatatacggataaaaaaaaggttgaaaaaatggctggaattttgtcaaag

SEQ ID NO: 13102 - DNA, 417 bp, Saccharomyces cerevisiae
tgatttttcgtggggtattatgaaagcaatcatgattgagcaaaattaaaactttccatttgtacatatatatatatatatatatatatatctgtgtgtgtataataagcaattggccatcatttggctaaaaagttcaagatttcaggtagtatataagagaataacttccctcttttgctaaagaaggatatgttctatttcagcctttttgcatcataagagcataagcgacagaaaacacttcgagatgagcttgagaactccatttcaattaacttgataaatacatgtagattcatatcatcactgttcttttcagatactagtttcaaaacttccttgacagaaccatttcatgttcaataatgaaaattactttcacatgttttagtggaaaaatactgaacaatgaaa

SEQ ID NO: 13103 - DNA, 468 bp, Saccharomyces cerevisiae
tttctgctaacgacagatgcgcagaatcaacctttctgatctctccgtggtcttacttttcaaaatggcattgtgaattaagtatttcatcatagttgataaagcttatgtccgcaatgttatttgtctgcgtgacactggctgtctataagaatgtaccagtatgtaatattatatcaagaaaatatcaggtgttgattaaaataatctaaaaacaatgtctatttcacttgttaaatatgacttttcaaaaataaccattttatttatttcttgctttttaaaaggtgagagtgggtatttgttttatctgacgccaaggaaaataaaagttaaaaaatgacatgatgattttatagttcaaaacaagaaatgaactttcgtgtttgtgatcagattcaaatggagtataatactgaaagaaggtcgagaaagacaagcaagcaaattcacaacttcattgagcgc

SEQ ID NO: 13104 - DNA, 473 bp, Saccharomyces cerevisiae
tcgcctttctaaacttccttggccaagcctttcagcggtgcttttttgttctcacgtccactgccaatttccacatttttttcccctcttgttatatataaacttttctacttggaaaaaatggttagaggagtgaagacacagggaggaggcttacgcagatattttacgttttctgctttttcttttctaatatagttaaataaaaggtgccaacattcccgtcatattttgcttcgcatgttttgttttctttaacctgttgtaatattcatcatcggattcaaataaacacatacaaacaaacaataaatcggaagacacttttcattttcgcatatttgctttactctatttttctgattttccgctgttgcactcacgatgagaaaagaattaaaataccttatctgcttcaacatactcctcctgttatctataatatactacactttcgatttgctaacgttgtg

SEQ ID NO: 13105 - DNA, 470 bp, Saccharomyces cerevisiae
agggtttgagttttcagtacatagttatatcgacaattacattatattatagagtgataatattattttctttttgaattttaacagtctttttgataggacaccaaatattgcttaacgcactgcatgttcctggtagagaaagaagaagaaaagtcttactgtcactacctgcagaaaagattgtatgaaacgaaatggagtaagaactcaaaatataaacaaaagaataaggatatatatatgaatgcttattttttatattttatacaatattaataacaataattataattttgttttggtttaacttaattaaatgttagatgggtacaagaaaattctgacagaggcaccgaaagtcttggctggcaagttgtttctaaaggtagctctaacgacaccagagttaccgtgagttctggtgactttgccccacataactctaatcttggaacctctgacttcct

SEQ ID NO: 13106 - DNA, 494 bp, Saccharomyces cerevisiae
tataaacttatgtatattccttcagtctctttaatagagaccaagtaagtaagtggacgagaatagaggcgatattatgcatttatatttgaaattcaacagaacataattatgcttaagcaaattaacatgttgtattaatacatagcgttttacacatctatttcatatattatgttatgttaatttttgaattaatttttcttgttctttcgttggatcaatggcgcagttgcttctttgtcaccactctcactctcactgtcatcagagacttttgattgtttgtcctttactctttgttcttgaatttttttattttgaattttgttttcaatcaaatcatcaaacgcgataattgacctaaccaaattgcttatatatataaccattaattcatcattagttttcacagttaaagccttttgtaagttatttgaaatattaattctgtcatgattctccacatctatttcgtcatcatcaggtgttcc

SEQ ID NO: 13107 - DNA, 440 bp, Saccharomyces cerevisiae
aaagtcaaaacaaggtcactttacaaaaatggtacgcgtacaaagataaaatcacctctgaacataataatatacatctatatacatatatatatatatatatatcacacatcaatcaacgcgcatggacatttgaatcaatggggcaggaaaggcgatgcagtggccaaatttctttgttcatttgtggcgttgggtcaatgagtcaaaaaatgaaaaaagtcgacagacgtttttcaaaaagcttcaagaaaagaagagaaaaagtaaaagcgtattggtaaaaagagtaagaacaaaaaggagcacaggcaaccaatataaagatgtccagttcacaacaaatagccaaaaatgcccgtaaagcagggaatattttgaaaaccatctcaaacgagggcagatcagatattttatacaaaattcacgatgccctgaag

SEQ ID NO: 13108 - DNA, 436 bp, Saccharomyces cerevisiae
tgatgatttctttcctttttatattgacgactttttttttttcgtgtgtttttgttctcttataaccgagctgcttacttattattatttcaccttctctttttatttatacttataattatttattctttacatactgttacaagaaactcttttctacattaattgcataaagtgtcaatcagcacatcctctacatcgctatcaacaacaaatttgacaaacctgcctatatcttcaggaacgactgctgcatcgctaccaccactacttgtgaagtccctggagttcaatatgcactgaaatttacctagccgtcttacacatgaccataatccatccatgctatcgcaatatatgattttgtgttcgtttttcgtcttgcgaaaggcatccccaatggcttgtttcattgatccatcagtgtggctcgtag

SEQ ID NO: 13109 - DNA, 445 bp, Saccharomyces cerevisiae
ctataaatagataaactacgtaaacgcaagcggcggaaattgaaaaaggaaattataaggaagtgactagcgttttgatttcatgaatcgagaaaaggtactgctaggttaagcccgattaggtaaagagccaggaaagcgactaggaaagcgactacgaaaaaagaaaaaactgcgaaactgtgaaagtgcgtgtcagccatctgtctttggaatcgattatctatttgctttgatcccctttatgaagaacgcagcattgtgtgaggctcttcctctgctcgccacgtgctcccacgaaatcccacccacaccacacacggtctgtttcgtcttcccccccgcattattactatccccgagcaaactcacacttttgaattcgcgtcgcgtcgcgtcgcgctgcgtcattatcattgacccacgcttgctgcgtctcttctct

SEQ ID NO: 13110 - DNA, 487 bp, Saccharomyces cerevisiae
atgtcatagtaagtgtaaacaaaacccttaacggctaccgcgcggtgacgaatcaatgcgattttgttttcgaacagtgctatttcaaggataacgaaaaatctacctagattggcacatcagtgccttattttccgtctttgcctcttgatatatgttctttttttattgttcttttgttattgtagttgttgcatgtacgtaagttatatatagattaaatattgataatataatagaaaataaatgatagggaaacgttgaataaacgacttcccctcttctttttattcaatatttatctttttaacgggagtaagaccaaacgttcttcaacaaaccatcgttttgagccaaacggttcaaagagtcatcggattcacctctggatctaacgtaaccggacaaagcgtaagtgatgtattcacctggaatggcgcggccttcttcatcaaccttggcaacgttgatttgaacagaagcgtgg

SEQ ID NO: 13111 - DNA, 487 bp, Saccharomyces cerevisiae
atacacatatcaaagaaagcagtcagcagcttttttattcatacaaacatttttattaccaaataggttatagcgtggttctctcgtccagttatttgcattacaaaataaatcgttctttatagttataataatatacaaacaaagcaaatacacataaaggaaaatgcaggtgtaatcacaaatccacaatgagttcctccacactccagtcctcaaaggaaccatctggtaaatatcttctaataaccaaaggaattttcttttcagccaactccttcatggcaatacgcaatggatcagtttcaccttctaaatctacaaaaactggcgcattcatggaaatttgtagggctcttgtacctaaaattcttgccctttcatatttggtcatgtatggagtagttgctctttggtcttttgggatggccttttccttaagtgtctttcttcttatttgctcatgctgttgaaaatcttctgggcc

SEQ ID NO: 13112 - DNA, 409 bp, Saccharomyces cerevisiae
tgtctgcctcttacattcttgcgcacaataacattaagattatttgtaagctttatgacagctgtacttcaagtagagcttgtgattatacattctagcatagtgaaaaaaaaataataactattcgaaactaatacacgtacatgtatatatatattataaattgcttatgcttatttaatagaagggttgttgaattatacaagaaaacttttctctagttttctacacttttctttttttttacctattatatggatggtagccattattacgtctattgtatccaccgcgaccaccacggccgtttcttctatggtttccaccactacggtgattgtaatcgcggtcacgatcgttacgatcacgatcaccgcgatcacggttgtagccataaccgctattgtgg

SEQ ID NO: 13113 - DNA, 485 bp, Saccharomyces cerevisiae
tgaatcatgtattgtgcattaaaataagtgacgtgagagatataattttttatattactttttcattgaatacaattaaactaacgagccttatagaccgcattatataatgaaccgtagccacttcttgaccactatcttcaagtttgataatgataaatgacaggtaatcatatttcagtcacctttttcccttcaatgaaatgtgatatcgctgcaaaaatggtgaatgaagaggacaaattaagtctaactgggtcgagccgctttaactaattcatatccattctaagataattgaactgctgaaaactaaagcctgctttgatacttgtcatattgtatttatctacaaacttacattaacaacagtgtactgaattataagagagcaattgccaaaaaagtcatttagttaaaacttctccatttcaagtttccaaggataggtgaagtgctatcccagagactccaaaaacatgcga

SEQ ID NO: 13114 - DNA, 421 bp, Saccharomyces cerevisiae
ggttagcccttcctttcattttttcattttcttttttcttttttgtttgcttcgtactttagattataatacttataatactaatcataatgatacatacatgcatataaagctttttttctcttattattttcggttcgttcacttgttttttttcctctattacgcccacttgagaactaccaagcattatcataccctcctgatccagtattacccatttgagatgcattggagtaaggatcttgctcagcgcccgtcatcattacgtcttcgttacttcccagcatatttgaagcggtgttgttatcacccgatgcaaaattaactttgtcttgatccatctgtgtcagagctaacaatattgaggcaacctttttctgtaatgtatcgatacctctgacgacaacttgatcaacgg

SEQ ID NO: 13115 - DNA, 485 bp, Saccharomyces cerevisiae
cattaagatggtgacaaatattacaaatttgatactatttgtatctattttgtttttatccgggatttttcgtatttcttcctcattcatacccttccctttatttgttcccactgagtataatgataaactacgttaacattacatgtataatatttagcactcgtacgttactagtctttgacacaagtttatatatccccccctttatgttatcgtttattggctacagcctcagtaatcaaaatagtccactatttctatatcattaacttctgcgtcgccaagatgttaatcatgaaacgatctagttcttcaacagtttgccagcgaccattcgagctaatcttgaacaaaagtaatactatttaagggtgggcgcgggttgttataccgttttgagacgatctactataacgttatatttaattatataagtgatgaatttaatgtcccgtccacaacacgaaatcgcacctcatttc

SEQ ID NO: 13116 - DNA, 496 bp, Saccharomyces cerevisiae
tgagtacatacccattatgttgtatatgtatattagttgacgcatttatgcacatatgtagataatataaaatattcaggtcaaagaaaagttaaaagtttacgagagaaaattcgaagttgataactgagcaatgtgcacaccacaatatgtcgtggttgatttaaaattttatgattcgcctttttatttatatgctatgttattgtgtatgcaattagtataagaggtaaagaagctaaaaaagtgcccaaaaagaatgcttggcgaatggtgtcgtagttataagtaacactatttatttttctactcttcactttcttcctctgtagtgacctcggtaatttctaaaacctcgtctcccattagcagacttcttggacgacttactgatggaccttgtacctgatttgctgcttgtggtatttttgggtaattggctttgtctgatttgattgataatttgttcattttctttggcttcgtttaaattggc

SEQ ID NO: 13117 - DNA, 459 bp, Saccharomyces cerevisiae
ccattgcaatagatatgattatagagcttatagctacatctttttagataaaagcgaagatgtttctgcgatttttccattatagctctccatgatactaaatatcaaggtctacatgtaagtatttgtatatatgggttggaatgtatatacgtatatacgtacgtacgtacgtatatgcacataattgttacgggatgtatatataaattagtagcattatagaagatatccctaacatcaatccccactccttctcaatgtgtgcagacttctgtgccagacactgaatatatatcagtaattggtcaaaatcactttgaacgttcacacggcaccctcacgcctttgagctttcacatggacccatctaaagatgaagatccgtattttataggaaacattataaataaggaaagagagatacacctatttttttcattttgtgggtgattgtca

SEQ ID NO: 13118 - DNA, 465 bp, Saccharomyces cerevisiae
ttttcataaattgactacaaacttacgttttctgtatcaatactcgatttatcatcttcctacattgtgaaattattacgaataggcaacgaggcagcaaatacaaatgatgtgaggcgcctgagctttcttaaaagctggaagcatgaaaaattgttatatacacaaaggaacttcttcgtcgtatgcaaaaataagaaaaaccgcaaaacaatttctcatcggcgtcatttgttaaatatgccttaaaacttaaaaatacacttcgaaaaaatcctatttaacataaattaatttgtataaatacgcaatttgtaaaatttctccaataaaacatcaatttatatatccgataattgtccgttcattatctacacttcagttgacggtataattatgtgaagagcctaattgttttcttaaatcgtcctgtgaaccactatgtggcaaaattccaccaacact

SEQ ID NO: 13119 - DNA, 466 bp, Saccharomyces cerevisiae
gaaactgactaaataaatgacttaattttaactatatatcgccaaacatgtaaattaaaaaaagaagcgagaagtatatacatgtgtgtatgaataaataattcgtttactattgatacgtattgcaagatatgattatgtactgtccactaatacgattattttggaagtttataaaagaagtgcggaaatcacatctgctgtttatttagccattcctcacactaatagttaaagtactttcatagcagctctgcgcatggtcggacatgcgaaaaattctgatatcaagaaaaagcgaaatatttccggccttgtaggggccaaaacattaacgtatatcaagatttcctgtggtagcaacattataagaaaaaaaggtagccttcattgaaacattctctctatcagcttaccaagttaaactccgtattccacaagcaagtgccaaaatgtcttcttccca

SEQ ID NO: 13120 - DNA, 449 bp, Saccharomyces cerevisiae
ctgtaaatatgaggactgtctgtgctgtttgtatataatagtaacctgcatatatagcattataagctgtgtagacaattttagaagtacatttatatggtacccgcacctgggtcacgtgcattcccctcacccgtttttttaggtggtgtcttttttgtttttttttttaggtggcgcggcaactataaagtacagcaagtgaggttgaggcaatactgggagtttacactatgggagacagctcctaacaccaagcagaaaaacgactttttcgcaaagtatgtaaggcgctgggtgagcccagcggacgaggatgggcttaataagaacgtacagtttagcacagctagaacaggatacagctaagggcaactctgcttttcgggagaagttaaagaggggtagacaatgatggtaatcttataaaccggctacaatgaaggttg

SEQ ID NO: 13121 - DNA, 460 bp, Saccharomyces cerevisiae
taataatccggcgtgaggggagtatatataagtttctggcgatatgtaaataccataataattaatcctaggatctacctttatacgcatttatcctataaaaacccaatctttcagatccacagtatttttatatgtgtgatttccttgattgtctcaatttaaagagtaatacatacaacttagaccaaagaattattcaatagatgacgccgaaagaatctggaaagcctatttcgtgtgcaatgaagaagttgaaaggcaagagatctaagattttggttttatctagagatgcgggcaccaacgaattgaagccaacgaaaggaagagcacatcgagcttgcatagcttgcagaaagaggaaagtacgatgtagtggtaatataccatgtagactttgccagactaatagttacgaatgcaaatatgatcgccccccacggaactcatcggtatt

SEQ ID NO: 13122 - DNA, 439 bp, Saccharomyces cerevisiae
ttcttacgaaacggtatgctccttcctcattggggtgcggctgctgcaggaacctgcctaaataggaaaatacattcctgatttggaaactgtaggcacacgacgcgtccctttggagaagatcgatccttctttgggtctttcaatttgattggaaaaaaaatatttaaaaaaatagaagaaaaatatagaatatatagaatatatagaatcaactactgcagtagataaataaagaagactattcatattcagtatcacaattgaaagattattacaatttgtatacattggttcccaatgaagagcttttttctttatctttatgtggcattcatgtttagttgcataacggctctgccattacctgtggataacaaaagggcttcttcagactccttagacctaaagaaaaaatacgcaccagaccctcctatta

SEQ ID NO: 13123 - DNA, 446 bp, Saccharomyces cerevisiae
gggcgaatatgattactaagttaaataaatcagatacagtatttaaagttctttcaaaaaaagataatgtcatatattttactatctacgcagtgaaagagttccttctaatgacacactattcacttcgggtaacggatattgtgtactgaaaaatataaaaaattttatcccggaaatgcgatgagatgaaaatgcatgaagtagcgtatatattgattgcatgaggttggacttgaaagggcatatatactcggttttatcattgattcaagtgttcccataaataataaaacagttaaatcgaaatgctaagaagacaagcccgtgaaaggagagaatatctatacagaaaagcgcaagaattacaagattctcaactgcaacaaaaacgtcaaataattaaacaagcgctagctcaggggaagccattgccaaaggaacta

SEQ ID NO: 13124 - DNA, 479 bp, Saccharomyces cerevisiae
tgatataagctatgtaaaatcatgcatcattttcgaaaccataagttcttttttggtgcggccttctgcaattactgattaagtagcaattttccttcaaacatccgtgcactgtggatgtttgggttgtgtattttgctttcataacatacagatattttgtttaaggaagtgaaataaacaatatcataaaacaggtacttcatagaccataaagcataacccagattatcctcttagatagcaatgctaatgtaaacagagatccgtttgcgtgactttatactaatatgatatgtctacttcgctttgtgttcgagcagcctggcagtcccctctagccgcttttttccctttccgaaggtttccgcctaagccccctggctctaggccgagaaaatgttaatgctccttctacgagaaaatgcttgtcgccacaccaggacaggtgctcgacgacgcttccgctaatctttctc

SEQ ID NO: 13125 - DNA, 486 bp, Saccharomyces cerevisiae
ccagttgactagtgtttgtgcgcaaaccgagagatgagtatttaacaaaaaaaagaaaggaaatgatatgattatgattttatgtttataaagcttttatccaatgcgttgttttttcttgcatatttatactttttgcgctcatggagggagttaatcaatacgcatgacgtctagttaattcacaggtagtactgtatatttatatgtttacacaataattatgtattaagtagtgattagtaaaaaaaactaagaggttgaaagtcatcaacccttatattaatttcaacgaatttcgctgatgacgtcagggtagttctcttgcttaggtcaatgtaaaaatgccagggtaatacaaaaccaagctctgaaccgcccaacttatctgtaatgatgcatgtataccttacaatgattttttttctcctattatggaattaatattggaatccatgtttgtgaacagccttctccgcaatttag

SEQ ID NO: 13126 - DNA, 441 bp, Saccharomyces cerevisiae
gttgatgtttacgttgcatgattgcttgatatcactttccatgactatattgcccaaaatatacggtgtcacctcctactttttcctctctacaagactctaccattctaatgatcataaccaagaaaagaaaagatcagaaatgtctagttctttgcatattccttttaccataacagtatatgcatatctacatgtatagtgcggcactacttaatattacgtaacagagtaatatctttacttcttttgttctgcctgtttataacatcgattggccagttgtctcagcacttgcttcataacaagtgaaaaattagaggcgttgaataattatgtaccttgactttgaagtcggttatcataagtgcttcgagaagagatataaagacaagataaagtgttatgtcaactatggtgaaaaaggaagggaagacaggc

SEQ ID NO: 13127 - DNA, 452 bp, Saccharomyces cerevisiae
ttccattagagcactagagcataactaatactataaattagacaaagcagaaaaagggaaaaaggttcatgctatgataatgtaaagaatatgcgtagagatatctatatatccatttatacgtttatatacttgcgtgtttactttgtatggcataataacatgtatgtttgcattagggatttgttttagtgtatccaagagcgattagtatagaaggaatgtatgtatgtgtatacgatatttatataaagggaagttggctaattttttgcacactttcgtcctctttccattttcaatgaatgcgtagaagcacagactgggagtggagagagttcgcagttttgatctctttctcaatctttgttctcctctgccgccttgtgataagcgtctatagttgctaaagaggtgtattctatagtgtccacttggggacaatttctccg

SEQ ID NO: 13128 - DNA, 423 bp, Saccharomyces cerevisiae
gtcaagttcagagtaattttcggttgatttgattatatataaacaataaaattatagataattgtgacatactaggcgagttgtcgccttggtaacatcttgctaccgccatcttctgttagtttacgccttatgaccaacattccttatattctcgttcaaacttttgtctcgatattttgcaggtacctgtagaacttaatgtgttctattcaaaataagtataaaatttctggccagtaaaggcaaacaaaacataaagatattaatacgaaaaatttcttgaagaaaacaaaaaatacttcttataataaagaaacagcgaagccatggctattgacaagataatcaggaaggtgagataccctggatagaagactaagagagagcaggaagttgaagaacgcaatctcagctatcgct

SEQ ID NO: 13129 - DNA, 482 bp, Saccharomyces cerevisiae
atcacgtgaaccacagtaacctaattgctcaaattttgagagttaaaggaaagaataaaatatataaatgatacgtttatacccgctaaaaaaaaaaaatataaaacaaaaaaaggatctcataagacgatttgttgggatatgtccacatctttcggctatatactacatttagctgtttcccgtttctttgtattattcccttcttatgtataacttttactagtaataattataataaatattcgttttgaaacatggtaatttcaaatgttcaatgtattttcgggccgattgctgaccagcgacactttaagccgaactgtatttagtagactcccttttctcatcagcgaagaagaagtagcaaaagctgtttagcaagcaagacagcaatacgaagaccaagcatgattaggtacactgttgctggccattccagaaggtgtgtagtaggagcttcgaaaagagtgggtgcaatt

SEQ ID NO: 13130 - DNA, 439 bp, Saccharomyces cerevisiae
ttggaaggtatttctaggttctactttagttttttataacgcatccagtacaaagaaatgatattggtatttggaaaagtcattgaatattcttgaatagattataagtgagcttcctttctgtatcaggatatgtggcttaactttaaactcgtataataaaagtactcgtatttttgtgggatgtttgcctccgtaaatttataaatggcaacaggaacactattataatgtaatgttacaatattacttttactgtataagtttaatgctttataaaactagatggcagcttctaagttgtggcttgtgtcggaggttcaagctgtcctccaagttcagcgcagcgattatttgcaaattatctacgtaaggactatataaacgtttcgatgccctctcttcacatcttttgtgtcgaacctcgaacatcgagcat

SEQ ID NO: 13131 - DNA, 490 bp, Saccharomyces cerevisiae
ataagatggcttatgcacaatagataaagatatacctacatataatgaattataaaaacaaaaaaataataataagaaaaaagtttctttgttatacaatctataaaaacttcttatagaaatttaaacacgtttatttagctgcttttcgttactcattattctatcaataaagaaagaaggaaatataaaaggaaaccatgaaaaaaatggcgctaattttttatttttaaaaactattcatggattcttttcgaaaccctcatcacgaaccatttgagcattaactttagctgattctggatccaagtaaaatttcctcacaaaagagtaattgtctctatccaactctataactagcggaatgccgttgggaatatcgacatctttgatgtcttcatctgagataccttccaatactttcagcagagatcttacagagctgccatgcccaactataacacacgattcttgactgattttgttggcg

SEQ ID NO: 13132 - DNA, 405 bp, Saccharomyces cerevisiae
ccatatataagaaacacactttcagtgtgttttaattattcttctttgaatgctgctttattgctgtagggcaatttgctccaactcatcgattatatcccatactatgtcttcagctatctgttctttgtacaatgtatccagtgtgttaacttttgaattcccgtcaacacagtaagctgatcggatttgatcgaggtactccaatttatcttcttcactaattatcctcgctgttccaccgttaaaacagctgattgttggatagtaacccagtttgttattatttacgtatttgtttctgagtatcaatcccttctttttcttttgttgctgctttttctttttggcactggttgtgtttttatcattggactcatcacgagcttcaccatgttgccaata

SEQ ID NO: 13133 - DNA, 496 bp, Saccharomyces cerevisiae
gtactgttagtttttattttgggacacccttgacatatagtttagaactttacctactttacccttgtaaagtttctttccttacttagcgaaactgtactgaataagttgtgtaagacagaatctttgattttttccaggaataatcatcactgcctactgctacaacagactagtttactctcccttttttccgtttttattccgacaaggggcatgaacattcaatactaaattcttttgtgctttttttgggaagccttttctaataagtaccagaagacacatttttatgtgacactactttaagcctcgaatgtttttttgtgccctattatttctaagcaaaatattaaacaatctaggccgtaattaaaacgcctatcttggtacagtgttacagcggcttatacagtttatgttaaacttaaaattacataaagtttcgagaacttccccttaagaagggtccgggcgcaggcaactgagcctactc

SEQ ID NO: 13134 - DNA, 443 bp, Saccharomyces cerevisiae
atgaggaggtaaactttcatgtatatatatatatatacatatatatatgtatacttaagatgtatcatacttttattcaatcttagagtctaaaatatactatgatcgcggaaatgctgtgctcaaaagttatgaggtggcatcctatgcaattttgttgattattacaaagctgttgaattcatgtgaatgtcatataaagggtatagatgtatacgtcaattaaatatattgagataaccattggaacgcctctaaataaccatttctcataacaacggaacacatgaaaacttcaactggtctttgaccttcaattctttgagagccagtggtattcaataatcctaaagcagaacgtagctccgcttcagaaacggcgtttggagcatcgatcttgttaccaagaattacaaaaggaacgtccttcaattcggcaatgt

SEQ ID NO: 13135 - DNA, 426 bp, Saccharomyces cerevisiae
gattaagccaattggtgcggcaattgataataacgaaaatgtcttttaatgatctgggtataatgaggaattttccgaacgtttttactttatatatatatatacatgtaacatatattctatacgctatagagaaaggaaatttttcaattaaaaaaaaaatagagaaagagtttcacttcttgattatcgctaacactaatggttgaagtactgctactttaattttatagataggcaaaaaaaaattattcggggcgagctgggaattgaacccagggcctctcgcatgctttgtcttcctgtttaatcaggaagtcgcccaaagcgagaatcataccactagaccacacgcccgtactaattgatgtcttccttttcggatagatgtatatatatacaaattggtcagattgcttttggctc

SEQ ID NO: 13136 - DNA, 487 bp, Saccharomyces cerevisiae
ataggtaagtttcaatgaggcgagttcagaatgaacagtgatgatctcctttctccataactatactatacgtcccttttatttactgtagtttttaagaacaaattctctgatgaaccagtcgtgaaaccgtatatcgttttctgccaattccggatgaaatgatgtcgcaagaatattgtttttttgcttagcggcaacaattagttcttgaccaccattatccttcccatctaatttgtacaggacctgcacatgttcaggatccagcacctcttctattactggggctcttataaaagtagcaggaaaatcattgcagtgaggaataaagtttgaaaagtcgcaaatccgggtagaagactgagcttgtctcccaaatgcatttctttttactttaacctttagtaaattcagcgtcttgaccagttttgcttcgttagataattgttgtgaaatataaatcaaacctgcacaagtaccccag

SEQ ID NO: 13137 - DNA, 431 bp, Saccharomyces cerevisiae
gaagtccttgaatataagatgaattttctaagaataaaaagagtaataaaaacatcttaaaatttgattagaaggcatgatcgcatattgagaatgaaggctgctgccatatttttagagcaatagatactgatataatttttgatcctgcacgtactgtgaacttgcatcataaataggacgcaataattaatatttttaagaatagagatcctgtatcaattgaatttgaagaattatgtaaaggaggtataataaatagataaaaaaatgtataaataagtggtcgaaataattaaatcatcattgtcattgagatcataaaatcggtctgctaaagaaccttgaattatttaacccactctcttggtttggtggtaacttctagtaatttagcttctctggaaccaggagcagggtggtggttgtat

SEQ ID NO: 13138 - DNA, 405 bp, Saccharomyces cerevisiae
aatttcacatactattcagataaatttgaatacttcttgtacataggtatctaatgattatgcaacatacactttcactattattcaaaaataaaagagcagttactttattccactttaaaaagacggttactttgtatgtacatgattttatataaaaagaaagaaaatgcaccagtatatatatatatacaattaaaaaagtccaacaagacaaaactgattcgctgattaagcaaaatcgattacaataccggggccatgtgtgcttgataatgtggttttactcagtatatttggtttcttagatttttgattatcaacagcagttttaaatgccgctctagcggatataatgttttgtaaaatttctcgatcagtgaagtagcatttgccgactccaat

SEQ ID NO: 13139 - DNA, 486 bp, Saccharomyces cerevisiae
aaccataatgcaaaatcagtataaaggcgtgtaaatattagatgaagtagcaattatcatgataatatcgatcgctgtttttttttttttttctgtctcaatttggtgagcgtgcggctgatggtccatcacggtcggggaacaaactaaaattttcaatagcataatatctctatattgcatagctttttacttaataggaacttaaaaatttcattgatgctattatatttaactcataagtcaatctctttttccattttgattagcttattgcgacatggactatgaattataataactttgaaaattcgaagggtgatggacattctaggcttcccaaacctacatactccggaacgctatcagatggctatgatgaatcgaaaattaaaaggcaaaaaacagactctgcttttaatgcagcttactcacctcatatgtatccgaactctccgtattatgaaggttcatggaataccggtt

SEQ ID NO: 13140 - DNA, 486 bp, Saccharomyces cerevisiae
tgcgaataaaggttaccagagataaaaaaaaagtttgaagacttacataggatataaaaacactacacacttgcttggttaagttaaatttatttatttgtttggataggaacggaaagaataaaggcataaaaaacattgtgagagtaccgcggtctagttgagagggtagcgagcattatattcttggatagcttttttgtactcttgtatgtatttgtccttaatgctttgatccaaggattgccatttatctccgataattttcattagatccaattgagacttgtcaggatgttgtgcaaaaacttgcgaacgaacttcattggcatacttaatgaagggtcctgctggtttctttggaggaagtttttcgtcaaactccttcttcgccttttggtattcagaatacaacttttttctttcagaaatgtatttttcctttatatcagcctctaaattttgccacttttcaccggcaatctt

SEQ ID NO: 13141 - DNA, 452 bp, Saccharomyces cerevisiae
aatattctatccactcatcaacctcattaataatttttaaatagctctaattataaaatagtctttcattataggtacataaaagaaaagaaagtcaaggggaaaaaaaaaaaaaaaaggaaatttctaaatttatgttatttggtccgtttatgtagtacttctatcattttttgcatctctgtcgtaatctacgtcgaacaatacgtcattatttgcgttcgtatttgcatttacacttggcacttcttcaaaatcggatgctaaatcaatatccatattgtgatcgtgttcctggtagtcattacgtggctctctattaggcaatgcctcatcagacaaggaatttatgtcatctaaatcgaattctgatacattttccatgtcagttggtaattgatgcgagcacgctagtaaatatgatgtacttgtaggtctccagaagaatgcga

SEQ ID NO: 13142 - DNA, 401 bp, Saccharomyces cerevisiae
tgagaaaagaaaacggttaaagatgtatacttgcacctgaccactttttcttccttatatttattattctaacatgtacatacctgtatagtcgtatttccactagatcatcacttcccctctatattcatgtctgacctggttatgcaggtcatgctctattcaaatagtattgaaaaagctgaatgagcaataattactgattttcttcttcatccataggattatatatattcttagataatagcctatttagctcatgcttaacaaattcgactttcgagggatttactaaaagatgggtgtcatccaactcctctagtactatatcactcatcttggcgtcaatttgtaatatgagcgccttgatggatggatcacattgaaccagtgcacccttt

SEQ ID NO: 13143 - DNA, 464 bp, Saccharomyces cerevisiae
ggcggtaaataatctctagtaatatcttgatatattgcatgtaaccttacatcatccattattctttttggttcataaaatttcagtaatatttaatacctttaataagccaatgtatgaatttcacttcacaaaaataaatttgctagtaataaaaaaaaaaaattggtttttttatgtatttcttaaatattagaaagagatagactcaattcttacatatgtatatgtggagaacttgaaaaaaaaaattaataacaaagtaaatgagaaaaaatgataaagggaaagaaaaggacaagatgttaaaaatccagtagcctttttttttttgcttttcattttttatagtttttattcctgtcataaaatttgtttagtttttaattttctttttttttcatatttttttattttttttattttttttaataagatcactcacctaagaggtccatactgga

SEQ ID NO: 13144 - DNA, 466 bp, Saccharomyces cerevisiae
tagggctgtaaaaacctctcacatgtttttctctgctgtttttccttccctattcttcatattttgatattatttcatgtatatattatgtttgtatttagacttttttttttatacgttatactatgctaagaaaactctttaccaagaagtaaagaacccagatcgcgataatagaaagcaccagcagcatgaccgtgtggagtgctcttctagtagcagaatccttgttgaacatccattcttcgtacaagtacgtaatacacttgaagctgaacttgcccattaactcgcgacgattcaactctccaatttctgcaacgatgttgaagttccaatcaaaaatgccttctgcgacgctaatgatctgcaacttttgtgcttcggtcaattccgtcctggtggccagctcatagttcttcttgtattcccatttcaagcgtgtttcttcagtgggacccagatc

SEQ ID NO: 13145 - DNA, 491 bp, Saccharomyces cerevisiae
aaagtcgtaaaactaaaaagtctctgcccccactttccagaaacagatatctatattttataacaaagacgtacggcatcatttaaagtatctaaaatttctttgaagagatcacataaaaaattttcaccttctttttctctttttggctgtccaagtaaacaaaacataaactgcttcaaccaaagataaaacttgagaaaatccaaaatgaacaataaggacatttcttggtgacagattcgttaagtttcattatttttttcacttattttatagaaaaaaatcggatgttgaatgggcataaatataaatgtatatataagtaatattgtcttgtttccctggagaagtaaatgaaaaatgaaatagcatacaaaacagacataaaatttaaaacagaaatgaaatgagcatttaaaattaattaaaaggtgaaacgacgaattgaaaattattgatgagggtgaagggaaacagggaatgtgcta

SEQ ID NO: 13146 - DNA, 490 bp, Saccharomyces cerevisiae
tgagttaacctaagttagacgaaaaaatgatgtgacagaaaagccacagactctcaaactccaatgctatttttctacggcgttcataacccgtaataattcaataacaaaattgataacgtaacaaccgaagaaatataattaatataaaaagaaaacctcatatatgaacgaaatctatatgtaaaaaaccataaataaaaatatatcaaatgtgttctaagaataaaaaaccgtaaccgtaacccttaaccataaccatttaaacgcctcaattctgtattactcaatgagactgtcatattccgtacttatcaaatttgctcgtttaaacgatgaaacgatacgctatcccaaaggcgtaccgcctctttcttacaaatacttttcaaaatgtttatcttgtaaccaacctaccttttcaaatgctgcaaatagccttgatgctttattaacgtctattctacaagccttttgagcatccgttctc

SEQ ID NO: 13147 - DNA, 450 bp, Saccharomyces cerevisiae
gctgaactattatttggaagccttttttaatagaccattgtataaaaatttcttttttttgtatagatatactaaagcaacgctcataaatgtaacatagcttcttttcaactgagaatttatattcatgctaactaagcgtaaatcacttttgatcttcacagctctttagcggcacgaaagcaagaaaaaaagataacactgtatgtctggaaaagaatactataaaaatacctgtttacataaaccaataaggaagaacgtgagagcaggaccgtaaaagaattaatgtgtaaagaattaatgtgtaatggttatactacttaaaaacaccgttttccttcaaatatcctttttcgttggagtactgtcagttggagtagtggaactttcatcactttcttcgtctgattcactatcacttctgtcatccttgagaatacctctcca

SEQ ID NO: 13148 - DNA, 424 bp, Saccharomyces cerevisiae
aaaacgatagggtggcacatcatattaggattaagaaaggctaacaactttttgcatgttggtggatatatatgtatatataaatagatacttggaaaaatccagattcaaacaatgtttttgaaataatgcttctcatgtttagaggcaagataattctgagtatgttttgggtattttattgtcagtaatttgtaaacgctgcaattctaatgagaccgagctttgttgctgtatgtcattgaaccaagggtggttcaaagcttcatctatattgtacctttcatcaggatttaggaccaaaagattggatattaaatgtagtactgagtcatcgattttatcccagtacggagagtaaaacgcatacttagcttgtaagatctgttccttcaatgaaggtggccccaattgatcactgaat

SEQ ID NO: 13149 - DNA, 476 bp, Saccharomyces cerevisiae
cagaaaacgcctcaaaccgactttgcttggaagagttttctctgaattagcaacggaacttcgaaatggttttagacaagcatgcatggtatgtagaaacagttaaagagcgccgctaccatttgcacagatgtacatataaataaatgacttattttttatattctatcaataataagacaatttgtggttgcctttagaaatttcgtggctttttttcatatattctaacttcaataaagtttttttgatgcgaaatttgatcgctcatattaaggacgcctgaaaaagacatgcgtctacattttgtgtcattcccataagaatagtaagaacaggcatttttataaatcgatacaaaaaaagagctactatacgtacataaagtcagtaaataatcaaatgttcccaatgaaagatcactcagctcttgaacaacatactctcagcagagatgagttaagacgtcgcaaggg

SEQ ID NO: 13150 - DNA, 414 bp, Saccharomyces cerevisiae
aaacaaccaacacgaagcacacagtttaaaagagtagctaatgctttcgaggtaaaacgcgaagttcgtagagagcgaatatgtttggacacttaaggaacatactatgtttatgcactataaaaggacatgtacttctatacgagctaacgaggcgtatttgtataacccggttaacgtaataaatgataaattatcgaacaaaaagaaagaaaaacgttgaatgcaaccaccgcaaatttagcgatttcgctggattccgtatctcttaaaaaatggcattagtaaatataccttaaacgtgtctattcttttagcaattttttggtaagtattcctcacggactataaatactatcggtcagaatcactacattcaaattaatcttgttttaccgagtctctgacgtttca

SEQ ID NO: 13151 - DNA, 483 bp, Saccharomyces cerevisiae
tttggaatgtagagacgtgtataatatataatacttttccgagaaatatttcattttcattttcgtaaagttgttaactacgctaaatattagtacttttcttaaatttatatggggagccctttttttctatgaaaagcaatgcgtaaaccaaataagcagaattttgtaatagatgagcaacaatactgagaaggtgataactataaatttatgtgggtagtacgataccagaatacattggaagatggctctattagctttatatcatgttgtcttcaggccttcaaaacttatagtataggtagatcaagtaaaaacccactgataattaaaaatgataaaagtatttccagacagcatatcacattcaaatgggaaatcaataatagttcggatctgaaacacagtagcctgtgtttagttaacaagggtaaattgacatcattaaataaaaaattcatgaaagttggcgaaacattt

SEQ ID NO: 13152 - DNA, 454 bp, Saccharomyces cerevisiae
tgttaaccgtactttgtagcaccatttctttttcttctaatttatataattaatgaatatatatatttgggataaatagcctttaatgaaatattaacagaacttttttgcttgggcagcaacagatttatatctttgtggaaaggagtaaactgggctttcactttagatcattattcacataaacttcttttagaatatgtttgaatgtaaatccacaaaatggaatcggtcattctacatcatgaatattaatttaccttctttccttttatatgctgtcattcatcatcctattacattatcaatcgttgcatttcagcttccattaatttcgacgactgtgtcccaatcctatgtcatcttcttacaccgcgtgtaataatatagtagtaacatgactactagtcactatatggtagtttatttttatcacaacagattgaagtgtgca

SEQ ID NO: 13153 - DNA, 420 bp, Saccharomyces cerevisiae
ggaatacctactcctgtcactttctgtacatatgcatttacatagcatcgttctttctatcagtttatctaatttgtgacgcatctttcttctttctacactgcggaaaatcctatttgaaaaaaaatagacgaaaaatatcaggacccacccccttatgaaggagagaaggggaagaggagctgcaaaacaaaaaggtgaggcttcttctgtccagatttttgtgagtgagagagtgtgtgggaagagaaggaattaaaccaaacaaaaattggaaccaacaactgttgcgtttgcgtgtgtgcataatatcaaaaaagctacaaatataattgtaaaatataataagcatgactcgtcccccattggttcgtggaatcttttcgttaggtctttctgtagccgttttgaaaggtgttg

SEQ ID NO: 13154 - DNA, 453 bp, Saccharomyces cerevisiae
gctgattgaagaaacccaaaaaaaattattatattcttaaactattgccaagcaagtcttgttccttcccattaattttttctttttccgatttcattttgccaaatcatctccattttcacattatgatgatcctctaaaaattcatacatttcgaatttgagagctggagagctggaagtaacgaggaacattaaataggaacaacaaaattagattagttatttttttttctactcattaatttttttatgatatatttgaataccaaccttaacttagttacatagatttaacaaacattaaacatgttaattctttgaaatgaataccacctaataaaactatacattttcaaaataacaaattgttatgaaactaatagctaattatcttctagtgacaataaccactttactagaaattattaaaaaaataccgcgttgaaagacg

SEQ ID NO: 13155 - DNA, 411 bp, Saccharomyces cerevisiae
ttttctggtcatataataatctacattcgttgttaaatagagtttgcaatttaatattcacattaaggatattctctaatatcaagctacaaaaaaggaaaacccctgctttttataaatggaaatcagtggtggaaaaagaattgccttgctaagagtattgttgtccaattattcaaacttcgttttgaaaaacttatgatccatagcctcctttgctgttaatctttcttgatggtcataccttaataaattgtcgattaaatcaaccacttcaggaacagctaatttggtctcggaggttataaagtgtgtccacgatttttttgtaaagtctctcataatgttgtcgtattcagatggtaagtgcaacccgtacttacccaaatagcctaacagttccttggttcc

SEQ ID NO: 13156 - DNA, 404 bp, Saccharomyces cerevisiae
taatgatatccgaaccatagctgatggaactccgcttttcactgtatatataatattacataatattactggataagccttagaagccttagaagccttagaagccttggaattcatgcatactacagcgttaactctttcttttagcaagttttagtagcggacgtgtgggtttctttgttctataattaacactcccggttaacccggatcgctattattcaaggacgcacaatggtgggctaattttttcttccgatggaaaactgacgccagcactttccagcgctgggaactctccactaactggcaaaaaaattgattaaggtcatgatcaaaggaatttttgaaatgttgtaaagtagagttaagaattaatcaagccgtgatacgtatgtttttga

SEQ ID NO: 13157 - DNA, 484 bp, Saccharomyces cerevisiae
tgaactttttgtataacatcattggtatacaagctttataaataaatgttaaatagttaatgaaataaaaaatcacatttgacgaattcggaagacaagtagcccaagaaaaaaaacaacaaaagcatgctagaggatgatgtttaaaacgaccctcagcctgttattacaatagagagcaaaccaaagaataatagataaagtacacagatatggtagttaagaagcgtaagttggcaactgaggccggtggcagtgatgaaaggcctaaatacttgccgggaaaacatcctaaaaaccaagagaaaactccgcatgtggattataacgccccattaaaccctaaatctgaactttttctagatgactggcatatacctaaatttaatcgatttattagtttcactttggatgttcttatcgacaaatacaaagatattttcaaagatttcatcaaactaccaagtaggaagtttcatccaca

SEQ ID NO: 13158 - DNA, 490 bp, Saccharomyces cerevisiae
ctttaaataggaagccctttaacaagctgttcttggttacattatattttcttaatgaaagattaaagacaatacctaattcgaccattaatcaaaatagcatgtaaatttcttacatcttcttgttgtgaaaaaaaaaggccttcgtgcaatcacaggtaataataataacatatacatacatatacgtaaatacgtcttataactcctgctacctcatacgctattttctattatggctaacatctatgcaactcaatttagtctctttttacctttttcacaatgaatgtataaaggtccttttcatcgtaatctaaccttcttttttgtgcatttaaaccgtcataatcgattagagcaagtttgtcgacaaaccgatcttttctatttagctttagtgaatcgcacagttttattcttcctaacctgcagtttttgaaaaattcgcctttaagaacagttatctctcctgccattgatgttacca

SEQ ID NO: 13159 - DNA, 429 bp, Saccharomyces cerevisiae
aaaaggaggaccaagagatgtgggttgtattttaaataacaattcctctattaagacgcctgtattttagaccccatcttgattcaatactttcacgtgtaaatacctagtatataaatattaaacaaaaattttttttcttctcctattctcttaaaatgataactatacgaagatcctactggtatatttattcgtcaatgcttatttacgaccggtacctccattcttactttcgctcttcctcctctcaaaggaaaagtaattctaacattgtaattcttatttaaacggatggaagaaagcttttgagaatttacttgaaaagtcagggtgtcttaggcgattgatcacggacatagccatattacgaaaacttcattctgaatattgccaacgagacaatcgtgggcttggtaatcgttgaaa

SEQ ID NO: 13160 - DNA, 457 bp, Saccharomyces cerevisiae
aaaaggggtatactagctccatgtaaggagttttggcctagctttccttgttactattctattattatattttattggctgcaaaaacgtgacttatgtacatttataaatgcccatatcccttactactctccctggggacaaggcgtaataactgttaataaatgcatatactctgttctatttaaattctcggggttcgctggaatattgaatcacaattagggagattcgcatgtaatttacgccgagaatgatactgatttgtgttgaatatgacaaggtttagcggaaacacgctcttgaaatttttaaagatattttcatgatttatatacagactgatctgtatacatttttatattgtcatacataggctttaataactactcagttttttttgatggcggcagaagcagcgctttcattgctctacacaaatccgcaattcaagtga

SEQ ID NO: 13161 - DNA, 406 bp, Saccharomyces cerevisiae
ggcgttggacatccatgacaaacttcaatttaatttcttttcacagttttatagttttatatatacgaaatgtaactaatcatgacattttttaaaagttttcaatgaaaaaatgaaagagtaatgaacaaacatattttttttataaaatgcataaaaacatatagatatatatatatttacgtggaaaaatgttaaaactattgataagaaaaaacgctcaaaacaagtagtaagcaggctttttttttttttgctgcttgttttagagaacctgtatatcaattagtagtctcagttggtttttcaaacaaacagtaatcaatgtaacgaacaccgtacacttgattccattgttttggtaaaactatttgcatgattcggttgattggctccggtacgtaaa

SEQ ID NO: 13162 - DNA, 481 bp, Saccharomyces cerevisiae
ccagtccttctgttttgtttttttctgtttttcttcctatcttgtatttgacttatatatagactgttttattcgaaataatcattttgcttcgtttatgtaatttttgtattcataagccagtattttctcttcttttttattttttttttggaatgtcgcgcccaggacaaaaacatataatttattagcctaggcagtaaatagtaggcgaaaaagattgaaaagtattatacatgtggaaatttattaattttatctatcatataaactcatgtcattattctggcgattctagtgtcacaccattttttaaattcaaatcagcgacttcgttttctgggcatccctcagatatttcagacgtactcgatgaacccaagcctgaattattcttgtagacttttttcaacaatcttaactttctcctacctgaatttgtcctctcaccatcatcattgtcatcttcgtcgttgcagtc

SEQ ID NO: 13163 - DNA, 448 bp, Saccharomyces cerevisiae
ataagataaagtttggtttgttgatccgttgaaggaggtatatattaatattagtagttacgtattaaatgttagaaaggaaaaggaatcctgtataatgcaaaatgaaatcgatacaaatttgatttgagaaaaatgagtctatatcaagaatatgatggtattgcgtccctgcatcaaatacggtataatgtacatgttgacttgtgttgagcaaatgaaaacatgggaggttgaaggcagaaaaaagtccaaaaggaaaaaagcttagaacttcaaagtcttaggcttttcccatgggtattcttggtttgtgaaatggccataagaagcggttggcaagtagattggtctagctaagtccaactccttgaccaatacaccaggtctcaagtcaaagttcttgctgataatgtcgataatttcttcgtcagacttggtcgcagta

SEQ ID NO: 13164 - DNA, 472 bp, Saccharomyces cerevisiae
atttataatctttcttcaatatgcgtgtaaatactagttttcgactttataggtagataaaaaataaaacttaagattgtaaaacaaaatcaaataaaacatggcttagacattgcaccatatgtcatctttctttgagttaaatatagatacatataaatctaaaagaagagcaaaaagttcgtacgtatataaatgcgcgtagcagagagaatttgatcttcttttttgttttccttcttttttttcttttctttgtttacatagcacctggaacacccaagacttgattcaaagcactttgaccgccactttgttggtattcaatggtaatgacttctagcaaagaaaacccaccagcaatgccaacaactataccagcagctttacctttcaaacccaaagattcaccgataacggtgatcaaacttaagacggatgcacccgtaacagctgcgattggaatgacttt

SEQ ID NO: 13165 - DNA, 402 bp, Saccharomyces cerevisiae
ttaatattttcaattttttacgatttataacctaattattaatttcacgaacttattatttgacgacatactacatccgggagccgtgactttgttaccatctcttacttgtgctctaaattctatcgttttgtttttgtaataaagaatgagactgcctgcggcttaattgtctttttattgtaggcaagaacaaaattcgactaatacgtaaaattaaatgtcaaaccaggagtctcacattatgttattaataaaaataataaaattttcagctcgttgacgataggaaaattcctggcaccatcaactaggtaatcccactgaagatgtgttttatatgaatatgtgctatatttactaataataaagagcaagttgccaaataaactaattgtgctc

SEQ ID NO: 13166 - DNA, 462 bp, Saccharomyces cerevisiae
gggagcacttctcctcaagaatagatatttcctttgtcctaattgcatacataggccactgcaaatcatataattatgtattaccttacatctaaatgtataaaaccaactgagcggatccaccatgggtctgtctcctgttaaagcatgtagcttcatgtttctcacataaactttcctcatcgtaatggaaaaaaaaaatagtcataaaaaaaaaactaaccatgaatgacatataagattaccacgagcgagagtaaaaaagagtatctctatatgggttcgggcgatactagaggagaaagctctctggtagctaaaccaatcgaaattatacttaataagctaccacatgccatactagcgcaacaacaatttcaaaaatatataacgagccccatctacagatatctttccaaacttctactgttcagagaggtggcttggcccgaaagtacaaaa

SEQ ID NO: 13167 - DNA, 453 bp, Saccharomyces cerevisiae
cctcttcatcatctgtggagacacaaatatcttcatcctcatcgccattacccaataaagcgatcggtaaaaatgaaaaaagcgttgaaaacggctttaaaaagctaaatttgcatgatatcagttaatcaagattagaactttgattaagtagaacaacgatagaaaatccgcttttctggctagttccctcgtttcatattaattcatttcacacaatttacttcatttcatcacgctcatattgtttgtaactttagtttttatttaattttacgtacatgacactgcatataattatttcacaggcatttaaaataagagcattgggcacagtcttcttttatatgttgtcatattcaaacactaaacatttatctgtatagtaattaatgttagctcttccttctgcatggcgcttgttatatacttcattcgtctattttggtgccg

SEQ ID NO: 13168 - DNA, 444 bp, Saccharomyces cerevisiae
cgtaggtaataattttcatcgtcattatcataaaatatcaacatacttatcactgtcattatattattaatactttgtatttaaatatcattaattcatctaataaacaggggattagtcaaaaattcctttttttttgttgaatctgtagaagtgagtattaataaactgcaagctatatgctatattaaaaggatttttcaagtacaaacgaactgaatggagactcaagctacttgcgggaaagaattacaaaattacattccattctagtaaaaaaaagttataaataaaaaaaaatcgtctgacgacaaatttgtatcttaatcaaaataaaaattttgggttactttctttaacgtttccaagttataaaattcttcatcttcgtcctcgtcgcttggttcaggtggaggcactatgatgtcctgacgaacgttcaaa

SEQ ID NO: 13169 - DNA, 400 bp, Saccharomyces cerevisiae
ctgaggtgagtagacgaaacattcggcaattgagtgtttgcggggcataagaattataaagctttcgttacgtatatacaaatgggatttggcgtataaaataaatagagaaacataagaggaagaaataaataatcacagatatatatataggacaatgggaggaaaaagctgaagtgatcaaccaatcttgtcggggttttttgcttgtgcattagtcaagcatcatttcgaaaaaagtgggaatatataaataataaaacatcatgtgcatttttttgtgcgtgtgtgtgtgtgttaggttttgtttagagggttttagaaaaaaaaggatgcaaactcaggaaaaaacggtgcctaccaccttttttcctttttccagaaaagggcatgttaattt

SEQ ID NO: 13170 - DNA, 410 bp, Saccharomyces cerevisiae
aacacccccataagtttgaaggatagatgtgtgtacatagcgtgcttggttgagacgttttagagtgtgttctttgctattcctaggtgcgcatatcatcgttttatttatttgtacaattttcttttcatatattcataatcctctccttgtgccttcgtattgagacggcgggaaagaaggatctaagaagaacataattcgacaaatttcttctaaaataataccatatatagtaacacataagaaaatagaataacttttataatacagtaacatactctatctattctgaaggctgttttcgtcacggggaatccttacacctatttacctaatccttctaaacttattgtttttcttgctactacccaacacagtattacttgagcgaggtggcagatgattat

SEQ ID NO: 13171 - DNA, 434 bp, Saccharomyces cerevisiae
tcattggaagacgttgttacgcactgggaagtcaatatgtacaaagtatataaaaatatatttaaacacctataaggacattgtaaacattaagtattaatagaaggagaatataattgccaactaagccttttgaggttaatattcaatggtgcaaaattagtagccgcggttattattattcgccgggtaaagagcccgcttttctagggggattttaggtgagcatgcctctagaaagccagaaggacccttaacgaagcgaaactgttcagaagaatgaataaaaagacacattgaaaaaaagaatattgtcgcactgtacataagggagaagctgtaatccctggcaaactgctaatatctaataaaaataatagaagatgtcatctgcaaagacatttactaagcatatctcgtttgatgatctggca

SEQ ID NO: 13172 - DNA, 488 bp, Saccharomyces cerevisiae
caatgagtaagcgacttgcatagtctgctatcatatatgtacgctaagaaacaactgggcaatggtataatatcatgtagcaagaggacattatatatgaattggtcaatatataaagccttctgtgcaccaaatcgttaggatgatttttcagtatgctgtatcattgtatcgtatattcattcgtatctcttttacctcactaaccgctgccaaaatttacatgtatacaaaataaaagtcttttttatgaccttatttggtgagtaatgctacttttgtaaagagtgatggaaactattattccaaagggttagaagaaggtgaggaatacgttcatatcaccgctacagatcgtgtctctcggttatgagtaatcaaaccctctgcaagcaacacagttactttttttcggttttttcttttcgtgtgaatttttatccagtgagtttccttgttcactttcgagaatggaaggctgatttcga

SEQ ID NO: 13173 - DNA, 482 bp, Saccharomyces cerevisiae
gcaaatcaataaatacttgtgtacttaagtatttaagtattttcttctgcatggataatgacatatacaaatgtatctatataatatttttttgatattcaataaaaagaaaactgacatttgaagaaggaaatagacaagtttttagtaagatattattagtgtatatatggatacatatatctgagaatgaaaatttgttgactgtattgaatgtattgggagatgaaggggtatttggtgattagaccaacgacttggagtaagagaataagtcggaaaatgcatcatttcccttcgacttgtcctttgtagcctgaggacgggctttttgctgttttttctccgcaaagggcaatgatgtttgcgcagcagcggtggtatctgtgtctgactttgggccatcccagtcaagcaaatcatctattttactattggaagttttaggtgctgttgtgtcgggactcgtttcgctttggaag

SEQ ID NO: 13174 - DNA, 422 bp, Saccharomyces cerevisiae
gacaagaaacaaggtgaatcactaagactaaagaaatgaatgagaaatggctaagctgcagccagtcatatgagctgctttcctttcattctattgtcgtccgaatctatgtcacgaagtacatatataactgtctttcatatataatatttaatcaccgtgcattccctattttactcttcctcatgcgtttgatcatctgacctttatgattttgaacaccccgcaatgttcactctaatttatgcaactgaactttattttcgctgctgtgtttgcatccttgacatattcaatccgtacactatacacacccaaacctcctttaaaaatttcctatgaatcagaaaatttggctgtttctcaacgcttcggccaacgggtgaaaaacagcggcagaaggacttccttcggagaacgct

SEQ ID NO: 13175 - DNA, 440 bp, Saccharomyces cerevisiae
tgaaaacttttttttccttattttttctttgatcccatcgaattactttctcttttgcccaggatcatctttctaatctatcattttattattttctctcatgagaaaacagaatttcgaaacagatataataaaaaaattgaaaaatttgaaaaaaaaaaatctagaaacatattttcctaaaatgaaaatcggaagctaacaaaatttttgaaaaacgaaataaagaagaaagattattattattagttactttttttattgtactccagtatggacctcttaggtgagtgatcttattaaaaaaaataaaaaaaataaaaaaatatgaaaaaaaaagaaaattaaaaactaaacaaattttatgacaggaataaaaactataaaaaatgaaaagcaaaaaaaaaaaggctactggatttttaacatcttgtcctttt

SEQ ID NO: 13176 - DNA, 451 bp, Saccharomyces cerevisiae
gcttaagtaatatcaactcagagcgtataggtaaatttgtaaatatatgtcccatattttgccttgaaatttatctttttatttacttaccctccccggctcatagtatctatcgaaagggaaaaacagaaaagatactagtagttgattatacataataaaaatttgaagtaataaccataaaggttcataaaacaattgcgccatacaaaacattcgtggctacaactcgatatccgtgcagatggtatatgaagcaacaccttttgatccgatcacggtcaagccaagcgataaaagacgcgttgcatatttttacgatgcagacgttgggaactatgcatatggagcaggtcacccgatgaagccgcatagaataagaatggcacattcccttattatgaattatggcttgtacaagaagatggaaatttacagagctaagccggca

SEQ ID NO: 13177 - DNA, 449 bp, Saccharomyces cerevisiae
aatgtgtatattagtttaaaaagttgtatgtaataaaagtaaaatttaatattttggatgaaaaaaaccatttttagactttttcttaactagaatgctggagtagaaatacgccatctcaagatacaaaaagcgttaccggcactgatttgtttcaaccagtatatagattattattgggtcttgatcaactttcctcagacatatcagtaacagttatcaagctaaatatttacgcgaaagaaaaacaaatattttaattgtgatacttgtgaattttattttattaaggatacaaagttaagagaaaacaaaatttatatacaatataagtaatattcatatatatgtgatgaatgcagtcttaacgagaagacatggccttggtgacaactctcttcaaaccaacttcagcctttctcaattcatcagcagatgggtcttcgatt

SEQ ID NO: 13178 - DNA, 426 bp, Saccharomyces cerevisiae
caatgggagatcaaaaatacaacatattgaatatagatttattaatactatttacatcatagtgtaatgcagtgtacttcctatagaacccgaatagacggtttcattgcgatatgcaaataaaacaaaatgcgatgcataattaaatgccaaaattccatttcattctttcatagacgaaaaaactacatgcaaccataggtgttactttaatataacctatgcttagaccaacaaaaaatccacgtactccacgttctttaaatattatgtgagcaatttcagatatcgattgaaatttatgatcatacatagtttttggtgacagtgcacttacttggagccttctcctaataatttcaaatggatatgctgccgtttgggaggccataccagctagaccaccagagatcaattcagcccacg

SEQ ID NO: 13179 - DNA, 483 bp, Saccharomyces cerevisiae
tgatcaattaatgtattgcagaataagtttatattttaagtaaacagcaataattttatgcatttcttctatctatttcagaagtaattgacgtgattttttatagttttgctttgaatctttgtgtttccacaccggagaaaaaaaagttcatgaagtgaaaaagcggttaaacatgaattttctactatctaaagataaaattacagatgcagttacttacatacattgaacagtttctgacggcaaatttagcttctattaatttttttctgtagctgatgaaaaattctgtccctatgatgcgccaatgggtcatcaacatccgtcggaaaaaattcatttctagggtattcaatatcatctccttcatcagaatcatcttcgttatcacttatctctatttcaccttcttggccatccaagtcaatgaaattcgaggaatttatggatttcaagacatcactttttcctccaagcctg

SEQ ID NO: 13180 - DNA, 424 bp, Saccharomyces cerevisiae
gtctaaactgtataatacttggatcatatatttacacatagtagattattaataaacaaacccattcaaagatatagtaaatattactggcggatatgaataatatctatcatacatatttgttactgtaacgttaggcgctcagggaaagagttcctctaaaacctcaagattcgaaacaacgtactttctttcactcaactgtaacgtgtcagtttgcttagtattggcttcccaagtgtttattgaattattatctattttatcaattgacagcttgtattcgtcccgcattggtttactaatcgagtttgaaagaaacccgtatttatcatttctatctaacagtataccagtccaaccggcagcttctgccccttcgagatcgttctttaattcatctccgatgtgaaagcaatgctgt

SEQ ID NO: 13181 - DNA, 500 bp, Saccharomyces cerevisiae
gtttttccttgttggaaagaagaataaaaagctagcacaacggtcatggttgtaagaagtttaacaacgatagtgcactcattgtatataaaattcatcaatatacaattaactatcaaaaagcatacgagaaagtgtcatataataatagtactcaatacctatacgtattataatttagatgtcatactctttattaaggcttctggatacaactcatgtccaaaataggtccctaaatgccacataccaccgtcaacaactaagacggtaccggtgacatacgatgcggcgggtgaaaaaatataaacagtagattcggctatatcccgtgtagatccaagcctttgtaatggtatctttgccaaggccttttccttatattttttgccggctaatctcttcaagccttccgtattatcgatagcacctggagcaatgcaattcgaacgtatacccagaggccccaactcaaccgctaaattctttgccaatgcgtc

SEQ ID NO: 13182 - DNA, 411 bp, Saccharomyces cerevisiae
caagcataagccatcttcttcattatgataaaaagagatatataacttttttaagtgatcggctggtaaatagacttataacgagtagaaaacattagatgatatattgtacacaataatacatttcaggctagcataactaagaccttttcatagatagtgaaaacaataccaccactcaagaccaatctcccaagtctaggcgtagcacctttccaaaacgtctttaacccttcttctttgaaaatggttgcaaaacaattcattgtagaggagtatttggtggaatccaaactttgcattcttgttttcacagtatcaaggggcatggtggaatagaccgtcacaataccactaaatgcacccactaagaaggttaacccggatgataaaggtttgtcttttggcgaa

SEQ ID NO: 13183 - DNA, 430 bp, Saccharomyces cerevisiae
ttcttttcgacgacctgattcatgttatatacgcgatagttacgtcgcctactcatcatatcattagtacataatattcaatatctccgcttcacctaattaaatttctttattatcaaaaagacgtaaagttaacgctgaaaaagcattctttacagaaaacgacctttttttaacctaatatatttagcactgtaaagatattccatgtatccatatgtaatacactttgtgttgcggatccaggaaaaacaaaacgaaaaaagagtctctttacttgcaaataaatctgtaaatcatttgctaccattacaacttatacattaaacctgcgtggaggaaatttattataaatgaaaaacgggacgggatcatttcttaacggagcgatttgctcaataagaaaagctcttcatcgccatcgttcttt

SEQ ID NO: 13184 - DNA, 406 bp, Saccharomyces cerevisiae
tcccaatgaccacactattataaatcatttgtgtaactatatacattttcaactaccgtatagcgtatagtaggcacgtggtagtccacccgtacacctccctcggaacggaaaaatacgaactatagcttatcggaatatataccaaaaattaattgacgtatttccgagattccaggcacaagtgccccaccttttcacagaaatcgcgcacagatgagtctgcaacggaaattgttttccttttttttctttttcttctctgggcatctgaatcgattgataatgaaaaaaaagtaggaaaagtaaattggattactcggtttttcgtgtggaagattggcttatataaaagaagacgtgctctaaacaaaggtgttttcgcttattttggtgccacagcaaa

SEQ ID NO: 13185 - DNA, 458 bp, Saccharomyces cerevisiae
tcggcagtctaaaggttaaacattatcagaaattatctattcctatttgtttagctgttatcctctgatggttgaattgtaattttactaagaaaaggagaggaaaaggacgtgcatatattcttttaatacatttaaaatatgattctaatcatttcttatataatagtgtatagtctaatcattcatcgtgtatagtaaccctttttgtttttttttatgcaaagtttttttgtttttggcaatctatgaggtttgaatattggataaaaggaactccgcacagtaatacggagcagtcagctaatttaaccagcactaatagggagtacattcaattggaaactttgattcgcttgtatgcgtgaaaagcaaattcccttctagagaagttactgaaaaacatgaatttattacgaatgaatgctttaacaagcaaggctaggtcaatagaacgg

SEQ ID NO: 13186 - DNA, 408 bp, Saccharomyces cerevisiae
aacaaactcacaggtcctcggaaagacaagaaagcgcacagtaccaataaatctgcccaaaataaaattttcttttatatacaattatgtaacttacaaacaaaatacctacgcatttcactgtcctaaacttcaaattgacatgtaagattgcttaacccctaactaattgagatttgattaaatttaccgtagacattaacgtataccaggcaaactcttcagtattgttatagtactcacccaaacgcatgaccctatgtaatttatcctttgcaaaagtaaacgtttctttgtaattgtgggatttatcctgagccataaataactttgaaccaatgtaggtgctcgaaacagccaatctcttagcataccatgcagaatcatggtggtccttttcgttggaaa

SEQ ID NO: 13187 - DNA, 453 bp, Saccharomyces cerevisiae
acaagagaaacttttgggtaaaatgcatgaataaagttttcttctattcccactatgtaagaggaatcatgtatcctcacagaaaaaaaaaactggagcacattgcaatagtggcattacattgcaatttgtgggaagagaagtatacacatcagatacgtaggtatttatcaaattctgaaaatcactcatcatttttgtagtattttttttctccccatttattcttcagtcacttataagggataattcttaaataaataagaaatactttcaccattatgcaaacgacgaatactttcagccagcacactactgatgtcaatgactgccagttttgggcacttcttgattttttcttcaaatggaacagtatttgtgcaaacaactctatccagtttagaattgttaatattttcaatagctctgcctgataaaacaccgtgcgtgaca

SEQ ID NO: 13188 - DNA, 456 bp, Saccharomyces cerevisiae
tgaggccttcagtttttagctcaaaaagagcaaataagtaccactagttaatagaacatatatatatacatgaatagcctcatcacatagcacagaaagtaagctttcaaaacactgatgatcggctcttattctggcgtactcattttcagcatctcaaaccgcgctgtttttttctcactttttgatacaataggtatgcaaaggagaatggcaggtgtgccaaggaaaaaaaatatgaggaactatagcctaaaatgaagcctcctctgatgtgggagggaccccaatttaggtcaataatgattttttaaatttatattcttgtcttaatgaaacttgagtcaagtcgaccagtttcctgacgattttgatatagaataatattgctcgtttggccggcaacagattacataagaagcagatggatgatataagcggaaggcaaactttacc

SEQ ID NO: 13189 - DNA, 481 bp, Saccharomyces cerevisiae
attatgtaaaatagtcattctttaagcaagatctaaaaaaaaaaagataactcaaaaaattcctcaaagcaaacaatacaatataacataacacttatttttaaagaaaaatttctaaattagattttgttctgtagtaatagaatatttcttcaaagtaaactttaatatactctcataagctccccccttctcccctgtgaagcattgcttcatggagggggttgacttcttgaataaaatggctttctgccttacgcgtttatagtgattaccgtgttgcgtggctctgatgatgggcatttctaattttaagatcaacaacagtaaacacacggtgcagtcaagaaatctcgaggcagaccacgtaaatacaagtcaattttagtatcgttaccgcatgaaggtagaggaattgattattgatggtttcaaatcatacgctacaagaacagtcattactgattgggaccctcaattc

SEQ ID NO: 13190 - DNA, 454 bp, Saccharomyces cerevisiae
aagatgctttcgggaatgtatctaggatttattgtatatggaatttaaatcgaaatagtagataaattaatgatgaaaaaaggacacgttaattggatgcgttaaattattatttttttttttatttaacttttgttcctaattatgtattagtatttactggtcgtcaaaaaataggaaaggtaaataaataagattcgggtatattatacattataaatgagaactaaccggttcatgccttagtttcaacaggaacttggtcttctaatagaactaataaatcagaagagtccacattttcaccatcagagacaaacacttctttaacttgtccatcggatggagaagatataatcatttccattttcatggcgcttaatacggctacaggttggcccttctttattagtgatcctttatgaactttaacttcaacaatgacacctgccat

SEQ ID NO: 13191 - DNA, 459 bp, Saccharomyces cerevisiae
aatagaaaaagatgagagtagccacggacagagcaaaggaaacaataggaggaagggacagaaaagcctgttctgactctattcgtagtagtatttgacagccggaatccaggaaaagaaaaagccaaacatacaaccatatccaatttgttgaaatggcatattcatatacgatgtacatatatacatatactgctggtgttaattttttttgtcctgtctcacgtaaaatcttttgttcgtccagttacttttaattatttatgattttcatgttttctttattaatcttctatgcattaaatatggctcggtcagaactaaagaaatacaatttaagatgtaacaaaaccgacgaataaaaagttagaataaacacaagaagcagaaagtagatactacagccacacataatgctaagagttatatggaagcatagttccagagtcactcgttcga

SEQ ID NO: 13192 - DNA, 463 bp, Saccharomyces cerevisiae
gtctaatctggcttgattcttaatctaaattctttctcacattttcctttttttcttctttggatttttggtgtttaatgagtgacacgatttgttttgataatattattatcctcctatttttttagaaattcttttcaacaagaatcaaagattcataaaaaaagaaaacgatgaaattttttgaacaacttttacgtataaagaagaaaaaaaaaaaattctaaatatccagtaaatagttttatattagtagtattctttcccactttttaaatgtcatcacatgatgtttcttataaaatgcaatttttttattacttaatcaccgccaaataggtctatcactctttgtgccggtggcagtactttgcttaaggttactggacaatgaaccacttgtcttacttttaaccaaccgagtctttacatttgtgtgttccttggattttgcagaggttcc

SEQ ID NO: 13193 - DNA, 400 bp, Saccharomyces cerevisiae
atggagaactgaaaaatattgctttaaatctttttctaaaagtttgtcatgtttccgcggagaatatattgacgtgcacattaattatttagataattcttcgatttttaatgaagagcggtcctgatccaagttgtgcttcatatggtataaagctgattccagtatactgcacgagaagtatatgtatgtattttgtaatttatataaaggcaaaaaaaagaaaaacacttgggcataatggaggagaagatcttatgacctgatagtcaaagagaaaaagaaaaaagcagaaggagcaaagaaaggcggcgaccaaatgacgaattagatccaatgaaaaacgattcaatgcgaataaaggttatcatggatcacctgatgggcctcttggcaatag

SEQ ID NO: 13194 - DNA, 400 bp, Saccharomyces cerevisiae
tccaagtgaatgatttaatgtgcatatatgtatatatttatatatatatcctattggttgaaaatgatgtaatagtgtaaattttttaattatattagataataaagaccaactcataatattgttacgtattaatgatatataactggggatgtataattataatgaaaacaaaaatggaatataaaccatactccgatgatagaaacattatatcgccttttcttttcgatgtagtatttctttttacaaaaaaatcatttttgaaggaaaatataacgttaatctacatggattcaaactctgtatcgatatatctaccattccttagcaacgtcttgcataacatgggcattatttccacttgcaagggttccaaaggaaacttttcaccatccac

SEQ ID NO: 13195 - DNA, 475 bp, Saccharomyces cerevisiae
tttgccaaaaatgctatagtcgcatctagaaatcattaccaaaacgtgacgattaacataatacattcaaaaataagataggatgcattacatttcattataccgtggattggaactgaagatgaaaattgcagtaaatagacaataatcaggccttatggttgtatgtcatatgtatactcaagatttgaactttatatcacctttattagcgcattagcgcacattttaggccccatttcgaggaatgtggatttttggcaaatcaatgtttctaggtgtctcttagctttctatataaggagtaaggtatgcttcttgatgacatcaaccgtttactatactttttttagatattttgttttctgcgataagtatgatggaaagtaaactggtaataacgtcaatacgtactctcttgtaattgtagtgaagcacagtaattaatatttaagcgttcccatgttcaaatgtg

SEQ ID NO: 13196 - DNA, 426 bp, Saccharomyces cerevisiae
taattttaagaaccattctctttcaaatttgtacaaatattgtcatcaagtaataaatagcttctttttttttttaacatacagttgtagaattaacttcgttggccgaagaattgcacaacaatagcgtttgttatattactaaatataggggctttcttgggaacgaaagtgaaacaaacgcttttaatacaatgaaggtcgagaaatcatctaaaggcttggaagttttagtgaggacacaggaggatgatctagaggggttctctttcctggagattatggaccgcgtagaccctttaccattagacttcgagaattacaaaaatttcaaagagggcatttactatatgtgtacacacgatggcacaaagatcggtttcgtgttgaaatttgcgataaatgaaatggagactgtttgctcgg

SEQ ID NO: 13197 - DNA, 469 bp, Saccharomyces cerevisiae
tgatacctgtcctcattcatctataaagtatattttgagcttgtcatcctccctttccattatcaaaacccagcttcacttatgtagatatatacactcaggataaactcctttttcctaatattttcattccacagtctccttcttgtttattttccatttttcaaaatcagcttgacgagtgtttcttttcaagttggatttatgtcttctgctacccaaatgaattttccaatatttttcgccaatagctacaacgttcttaccatctgcgttacgacagacgttgcaagtataatgtgtccaatcgtccaatttcttcatcgtagtttcgcctttagacaacagctcctctagggctttaggtgccctttcttgcttgatgggtcgattgctaataaagtcattggaaatagctatcgctctttgagatgcattcgtgtcccattgagaaaggtcagtggcatcc

SEQ ID NO: 13198 - DNA, 417 bp, Saccharomyces cerevisiae
aaaaggaatgaaaaaaaaaaaaaaaagttcaaaaatagtaacagatatctttcgaaaaagttaaaaactggtaaaaaattttgaatagagtatataaaaactaataaatatgtttagttatcatacaccatagaataactactagagatattatttcattttcgttttcattttttttatttttttcttttcaataaggtaacagaaagttatttatgcattcttgttctacatgtcttatgtatactaataagctactacaggtattttggtagtatggcttttaaatgagttattaattcttgatcagtccctgtaggattatcaaactgccacctaatcgcttcgttattaattttacccagccatggacctggcttcatttgaagtagttttgccatttgttttccgtccact

SEQ ID NO: 13199 - DNA, 404 bp, Saccharomyces cerevisiae
tgatttaaaaagcagttaaggagtatggcgcattcttaaagcgttctgtgtaattacggcaaaaaattccatcacaaaatagaaagtctttattttactttccattgttattttccaacagaagccggaaacgtaaaggccttttatattaagtgttttctcattataggatatataataagaatttgtaattgttacttttctttcagttttcattaactactttaaaccttagaaaatacattccaatcctacgaatagacgtataagtaaggattaatgctatcggaaagcaacttaaataactataaatggtggatggttagtgtcataatatcttaatgaatatcgcttttgacgatatagtactagcaatctgcggttccaatggaatgcgtaaacgc

SEQ ID NO: 13200 - DNA, 434 bp, Saccharomyces cerevisiae
caggctctttaacacaatatagactcttatagactatttactatttatacaagaataccacatcgatgtccaagtgaaacaataagctaatgatatcaaacgcgtgggtattttccctttccggaaatatagagccaccaaaaaaggatagtttcccgatatggaaattttctcgagccggtaagatgacgaaatttttcatctctggcatgatagaaacatagtatggaacgtgcaggagagtctgattcgagacacataatttgaaagaaccttctagcctgagccttgtacatgtattagcgttgccagttatttgcttctgctgctaataagatcaaaaccttaagtcctttatttcgatcgaacgtactgcgctactgaaaaccattgcatcttttgctatcattcattcctggtggtttctttggtgt

SEQ ID NO: 13201 - DNA, 482 bp, Saccharomyces cerevisiae
gtacttatgacgatttggaacacattcaaactagaaaaaactttgatgtaggatatccctatgcacatccatacggtatacatagtgaacgctcactgtgtataatggactaacagtagttataaacctgctttcgttactacagcacacaagactattgtactttgttaaagaactataagattaaagacatacataattccaactatttataccattaaatattcttcttaagctttttttcgcggctttctataatatatgaggatcaattagtgaaagcaatgctctctatgttggaaccacagtgtagatactgcactttcataaagcgctagatatagctggtcaatctagcggagtacatgggtcacagttaccattctcgtaacttgacttggtgcactacgggtcaagatgattgaaaacggctcccacaacttcaactgaggtctgtttcagatggaggtgcagtgttttcc

SEQ ID NO: 13202 - DNA, 468 bp, Saccharomyces cerevisiae
taaaataacgtatttcagaaagctgtatgcagacgaaggtgcatacttatgtacaagataatacaataggttttttcttcttcgcatcctacttacatttctcctgctgttattgtgcaaaaagtatgctttaaaaatatttgaacgttgatgaattatatttgtactaggcttatatatatatatatatagaaaatgttaaaatagaaatgaatcattcccattcaacagttgcaggaggtttggaagttatatcgtaagtgaccctagcaaccccatcgacttcattgacaattcttgaggcgactttcttcaagaaactgtgttcgaatgggaaccagtcagcagtcatgaaatcagtagtttcaatggccctcaaagcaataacttgatcataggttctttggtcacccataacaccaacggatttaacgggcaacaaacaggcaaaggcttgggaaatttggt

SEQ ID NO: 13203 - DNA, 466 bp, Saccharomyces cerevisiae
ttcatttctattttaacattttctatatatatatatatataagcctagtacaaatataattcatcaacgttcaaatatttttaaagcatactttttgcacaataacagcaggagaaatgtaagtaggatgcgaagaagaaaaaacctattgtattatcttgtacataagtatgcaccttcgtctgcatacagctttctgaaatacgttattttaaaaaatcaaaattgactcaaatgcattagagtgatcaactctacaacttttaccatttatgttggtaatttcaacacgcggaaaatttaagtagcccttttttaaaggaatcaaatggacttcaaactcctttcttttctcttttattgcgcaacgtttctggccatgaattaaccattcattactgctcaaaatttcaaaaatatatcctccgtcatctataacatcttgcccccattgtccactaagatt

SEQ ID NO: 13204 - DNA, 492 bp, Saccharomyces cerevisiae
cctctgtgaattctgcattgtatactatatactgcggcaacaaataactatccatacgtcctgagtaccacaagtcagcgtcatcgatcgagcggggtgtcggcgccgcaccgtaaaactacatgtataaaaaaagaaccctttttttggaactcttcaatggtaaatggatctcgacatgttgcctgctttaatttatgtaattcaggagtaagggtagtgttagttcaccatacttcgtattgatattatctcggttagctcctttgctttaagatactaataggtggtaattaaaaacaatagttttccttcagccttgtcccccctaagctgcacttacattttgcttccataacttttgccaagcatgacaaaggaacgtatgaccatcgactacgaaaatgacggtgattttgagtacgataagaataaatacaagacaataaccactcgaataaagagtatcgaacctagtgagggatggttgga

SEQ ID NO: 13205 - DNA, 464 bp, Saccharomyces cerevisiae
caagaatatcaaaatttcttgtaccattcattgtataaacatataaatatatacatttactactagtatatttccttttgtgaagtatttgtgctaaaattcattacccattttatttttttttcaaatatgcgttcttcctttaatattgtataataataacccagttgattatggctattgtctgttttaagtgatatatatatatatatatagatacatacattaaatttatttttctttgattaaattaatgttttttagtatagtgatacatatttcccgagttaaaagttaagtaaatagttttatgccattaaacggtgcaaaaacaggtgtaatctaaaatattaaactccataaaagaaaacgttaaaattacaaaataaatgaaatatgttccctgtgttggtatatgcaaagtaaataaaaattaaatctttatgcaacgtcaagacaatcaa

SEQ ID NO: 13206 - DNA, 420 bp, Saccharomyces cerevisiae
cgacttcatccgtcattttcatattttaatattgttttttcttttgtatactatatttatacatataattgtattcttttcctgtagtacattgcgtaaagtaaaaatcatctagaagaagtactccacaatgttcacatgagggacaaggttttattgtctctggaaaaacgattggatattagccagccttgaaagattttcaaagcccggaacagaaggaagagcgaaccaattattagtatcttgaccgtcagattgtccactattgggctcccatctatcgcaacaacgaaatccatacgtgttccaggcggtcagacacattgcaacaatgaccaaaatcaggtagaatattttcagtcttaaaagacacaacacagcgaagacaccccagattacgggtgtcacatacatcga

SEQ ID NO: 13207 - DNA, 447 bp, Saccharomyces cerevisiae
tgataaattttccgagtatttccaatttcattaaattatattttgcattatcattcgatatatgtgtatatattatatgaaaattagtaaaatcaatgtttgtttcagctgtatcggatcggtttaaagaagcactacaggttgctggaggcattaactgtaatgtagcgcgctcattggaaaattgggaaggatccccacttcatatcaacgactctctttgtaccatgcactttggataggttactaatagtcttgaaatcatcctcaggcagagtgaaaatcttaaaattggatacaattctttcaggattaaccgatttggccagaacaacgtagcctctttgaatactccaactgataataagctgtgctggctcaacgccgtgctttttagccatatcaataattgcttgctcttttagtaaaggagcattagcactccca

SEQ ID NO: 13208 - DNA, 490 bp, Saccharomyces cerevisiae
aggatatatttaaccacgactttcgcaagagagacggagggggtgggaaaaggctgaatgcaaccattgtcactaagaatttgagtgttcatgaacgagttatacacgctatttaagagtcagagaatgatgattcaagaaaattctggcatttttcctgtccaccactgtacgccattgtacacaaaagtatttttttatattttttttacaattttttataatttttttttatgtttagtgtatatttgctagaaagaaacaagatcttttttggtagtgtaaatgcttaaactttgtctctttttcctttttactttggaaaaatgccgacgcaagaacatagacatctgcgaaaaccaaaaataaagtaccaattgtacatacaaaaacagagaaaaagttcatgaacagaacgttactacggtatagcaagatctttgaatacatccattacttcggattgttcaccatacttcaacacaggcca

SEQ ID NO: 13209 - DNA, 455 bp, Saccharomyces cerevisiae
acaaaaattcttatataacttaggcgacacataatatgcgcttaaataacatatagtgagtatattatcaaaaagcattcatttttttttatttattagtccttcagaaagttagtttgtatgtactatatgatgtgaaagtgctgaaaaattacccaataaaagataggcaaccaagagagaagctatttcaccgtaaagaaaatccctttccttgtcaggacactatgtcatcaagcgaaaacacgttactggatggaaagtcagagaacacaatacgatttttaactttcaatgtcaatggtataagaaccttttttcattatcaaccattttctcaaatgaatcaatcccttagatctgttttcgacttttttcgagcagacataataacattccaagagctcaagacggaaaaattgtctatctctaagtgggggagagttgatggtttt

SEQ ID NO: 13210 - DNA, 458 bp, Saccharomyces cerevisiae
tgaatgtctgtatgtagcttcaaaattaaaaataaagggaatgtaaataggttccttccaggtttttcgttgatagaatttgtttagtattttcaaaaataaatactaagtttatatagtacttttatagctaagccaagacgtgataaatagtcgttagaatttttattgttaaaatgaagcatcagctatcatctcttgacttgttccatactactagaagattatcatatacgacataaaaagatgatataaagattgagaaaagtctagagatgtaatggaagtttctgtcccaattatggcaactattaatttatgttaacctttaaattttgcttgaaataaaatgatgaatgacaatatattaaaagaaaaacaaaatagaggaaaaagttataatattatcgtgtaaaaatatcgattccttaatgtggatttcaagtcctcgaggtgaa

SEQ ID NO: 13211 - DNA, 412 bp, Saccharomyces cerevisiae
taacatctatataacataataagcgcatatacttagttctctccatcctctccatttattttctctcaccattgtttctgttctcttcacatgcgttaggtatagcttataccccccactggttgcgctaaatacgccttccccaccgcatgtgaaaaaagctcgaccaagctcaacgcgctgttgcaaaatggaaaaaatataaaaggaatcaagccatagttgagaaaagacctttcacacttgggcttttctttggcaggtgtttgctctattcttctctttcagtttggtgcgctattcagatttattggtcgtcctactgtatacatctctttcattttctttgtttctgcagtgggtgttaaaatgggaatacacataccatatctcacgtcaaagacatcgcaat

SEQ ID NO: 13212 - DNA, 486 bp, Saccharomyces cerevisiae
cactttttctgagcattttattacgttactcaactactaatagagttgatttgttacttgctaaaatctttttatatttcttttagccccgacagaacttgttgcaaatgaatacaaaccgtgaacttcccgatatcattctaattgaacccagatatttacacatgtacttcttactcattttcaatgtcagcttaaatatcgtctaaaacaatattttactagatacgcagttcaatcttcgcgcatattttcacgaaagtccaaattgcgtacgtagttttatgtcaaagtgaccgccgttgtagcgtactttttcctataagacaagctcgtgatatcaggaatatatcaggaatgtaaacgaataccgcatatctttttgatttttttcctctgagttattctattcttgacattattacatcaccaattcaaaagaattgtcaatttatatatttaaatgaggaagctaaatccagcttt

SEQ ID NO: 13213 - DNA, 485 bp, Saccharomyces cerevisiae
tgaacttcttgtctattttccttggcattcagcttgtgaatataaaatgtataacaatatgagtttgtactttatgtattatttcctgttttttgactaactactttttccaatgtaatagctgtatcaccgtaccgaggtaaggacgtcagccgcgtagttctaaaaaaataaaggattgctttgaagggcttctgggccacttcaggacaaaaagaatgaacataaagaagagcgctaaatttaatactacagaggaacctgttactatctcagctttttcaagaaaatgaaacctccgttaaacatgtcacgttcaaataaaccacttactcaggaagctaatagttcggcgcatattgatagggcacatcagctagcacaggattttaacagtaaacaggatgataccgcactaacttcactgccccacaagaaccccgacatattcagatttgagaacaacatcacagctcatagctcgc

SEQ ID NO: 13214 - DNA, 490 bp, Saccharomyces cerevisiae
attcggtttttattattcatgacctagcatacacatacatatacctacatagtagcgcatttatccaaaacatacgatattgtggatgtacataccttctatatctccttaaagctattgtgtagcttgatttaaaatatgctaacgccaactctcacatggtagcaggcgggtatagttgttttcatgtattaacgcccggcgatggtgccttagatgagggcgacgaggagggcttcctgatattatggctctttctatcctgacttttgttatgatgtcgatgttgctggccacctaggtgcttatatatcaaaagaggatcgccgatttcattgatttctgggatggttaatgtcaaattaaagatctttgccagtgcaattttgaaaattttttgaatgtttatagatttggcagtagagcagaatataagaggagcattcatgacctgtgcatacttcatactcgttctcgagatttgttcctg

SEQ ID NO: 13215 - DNA, 460 bp, Saccharomyces cerevisiae
ctcttgtagtttacatggtgatactttatatctttgtattgtctagctattctaaatcatctgcatgtaataagaagttgatcaaaatgactcgctgcgtaaaacctctcttcgatcggaggtgccgcctaatttatcgcctagcactgcgctttttcaaagtttttcagagcaaaaaatgaaaagtaatgagcacaacaatagaagagtatcatgatatataaggtcataaaactaggtttcaggggctatcggcaatttgaggaaccttcaacctgcctcaagtaaaaatcgcttcgtaacattaatacaaattctttttgcaattatggaaggaagatcagattttgtggcgacttcacagtccggaagtgaaatgagccatagtgaaactaggaatagaactgggatgaatgctaggaaaaggaaattcgcctgtgtggaatgtcgtcagcagaag

SEQ ID NO: 13216 - DNA, 440 bp, Saccharomyces cerevisiae
tcaaaatttacggctttgaaaaagtaatttcgtgaccttcggtataaggttactactagattcaggtgctcatcagatgcaccacattctctataaaaaaaaatggtatctttcttatttgataatatttaaactcctttacataataaacatctcgtaagtagtggtagaaaccacctttgcttttacgagttcaagcttttttcttgccatgatctagaactctcaggcaatatatacagttaatctttttttactgggttgtagttctaatgtattgtttcgaaaaatagcaaccaggcacatattatgttcaccaagtggtgtatccagtacagatttcttattccataaatgaaactgaaaacggttaagtacacaaataaaatgatggtaactttaccatcccacgtgtctaaaggtacgctgtttggcatttt

SEQ ID NO: 13217 - DNA, 415 bp, Saccharomyces cerevisiae
gcaaagaggaggagaaaacaaagggaaacagtacgtatttttttattttacttttagtatattaaaaatgtgtaagatataaaacaaaaaaaagaaaagaaacgagaaaacataaaaaaaatgcgtattaatattataacagatcgatacacttggcaatggtttcgacaccggtttgcaagtcctcttcggagatgaccaaaggaggagccaatctgatgatgtggtcgtgggtgggcttagccaagaggccgtgatccttcatcaatagacacaagtcccaagcggtcttaccattggccttggatgggtcgattacgatggcggtaagcagtcccataccacgcacctcagagattataccgttagatttggcttggagagctttcaattgggcgatgaaagagctacccag

SEQ ID NO: 13218 - DNA, 408 bp, Saccharomyces cerevisiae
ctggatcatttgtctcgcatttttttttttcgtttgttttgataaataaaggacttaatgttagttttgataatgttaaatgaatatataaaaataaaccatgtaaagagtattttgttacgctgtttcgttatagcgttatgtcagtgttattatttcttatacgcggaaaagcctgatccattctgttctgaaaccgatcttcatattttaaatttcgcgaattaactaaaaaaagaaaacaaacaaaaactcgtttcaagtattgccaatgatacaaacaaaacgtttcaaagtatctcctcaactgacggactttgaaagagcccgaagatttaaacaatggactgggcaatcaaagcagctaggaagaaaactcaaaggaagccaggctctacccgttcaatc

SEQ ID NO: 13219 - DNA, 428 bp, Saccharomyces cerevisiae
ttgcacatataaaatatctatcactatgtatatctttctagagtaaatgtcttcctgtacttttaaatccgtacattttgaaaattgaaaatgtatctcagattcatttttcaattcgaaatgaacgaaaattacactaaaaaggtaacgtgtagagtgatattatgcacaacgattttttgaaaatttcatatacgttattctaatgtttagtagagagtttagcggaagatataaggtgatcaggcgtaaattaaccacatacaaaccatagaaacatcataccaaaatggaaaacgataagggccaattagtatgttcgagaaatctataagattttttatattttaacggatgaatggaaagtgcatggctgtttaaataaatgtaagaaagatatcataatgcaaacaaaacgtaggcatccg

SEQ ID NO: 13220 - DNA, 462 bp, Saccharomyces cerevisiae
cgttagcgaaataaagacatataaaaatttcaaacatacactattaaatattattactattaatatataaaacgcgagacgcgtaaaataaaaagaagaagggtaaatagaaaaaaatggaaatgaagaaaaacagagttattcaactaaatatctgttatgatttgaatcgcagaatataaaattaaaacagtaaagtaaaagaatatcataatgtggccataacgaaataaaaagaatgattagctcagaattaacgaatgatcaaatcatagaccttatatcggattataagaatttcaaaagaattatagaggcctctgtaccagaagatgatagaagaaggaaccaaaaccgccaaaatagaaataaagacctgacaaaattgtcgaatgtacaattttggcaactgacgactgatgtcaacgatgaattgatgaaaagattgacagattcgggtgc

SEQ ID NO: 13221 - DNA, 421 bp, Saccharomyces cerevisiae
aaaacgtgcttaccttgtgaatagtaaaaataatgatgtcaatatgacaaatgtaacagtgctggcagtatatccctatttggcaagctttataatatgcaaagatgcgacctagtatacgatacaatggaaattatgtaatcctcctaatgagtatttatgtagtagtacgtaatatttatacacggaaggcgctagtaagacagataggtaatgtttttttactttcacctctcattttttcttctcaaggcctaaaacggtcattagcggggccagttgttcaggtcctaactgtatgccagatttttccaattccaatttaaattccttcatagcgtgtctcagatctctgtccattaagatcttaatcatttgccatggtttcatcgtattttcttcattggcagaagtcccatct

SEQ ID NO: 13222 - DNA, 490 bp, Saccharomyces cerevisiae
ttattagtactatagcatagttttgtatagaattgttttaaacatttcacttctcgacttaataaaaagaaatgagagtgacagtgtctggaatttctttcttctagaataccaagggtacgcatttctctcctacggaattttctgtgcagatgtcccgatctacgtggcagatagtgaaaactccgtaggcaaaaggggcatcggaaaaacctcttcaaaaaaaaaggtttttaggctcgaacgagccggagcaataatgttcctttgaaaaatagcaatcgttatgcaaccattttatatgagtctgcccctcaagggactcgccaccggaccgctgcagttgtttgcattcatccacatataagctggttgtgtatgacaggagaaaaaatacttcattcgcagttgttaaccaacagcgacatgtctagcgggaatgtccaccatacgaaaccgatgatgtacaacgtaaccctgccttcctaca

SEQ ID NO: 13223 - DNA, 440 bp, Saccharomyces cerevisiae
gctcggtcacattatcgtctttcttaacacagccatttagatatgaaacaaataaggtttataatctttcaatataattacaacataccgcatacacacactttttatacatcaatcttccgttaagattcctttaattaaccaatttaattcatgccttgtaccaacgtttctttcatccaaaggcgtgaaagtcggcttttcatttaagaagtccggcaagtcgtcaatattgctcttcatatctactagttcatcatcgttaactagccctaaattagttaacgcatagtatgaacctgaaggttcaaccaaattcggaaatatagataacgaatcatatatgtcttcattcgttaatgatatcgttctgttttcatgtaactcctcattaactgcttcgccagcctttgtaatgctgctcattgatatgtcgccaa

SEQ ID NO: 13224 - DNA, 404 bp, Saccharomyces cerevisiae
gatgaagagtaatgtggttggatatgtatactttataatcttgactcagtctatatacgcaataatgatagatgttaaatcagacatttcacaacacaagaggatgtacagcttggagaaattgtaccaacttatatggttgtattattggtggtgtcagtaggggaagaaatagaacatatttttccactttttcattttttttttttagcgaggcatcggaaatgaaaatttttaaaaatcgatgagctcccacttcttcaacattgacgaaaggaaatatgcactaagttgttttaaatccaagatttgtctcgttttaagacttacagataaaacaatatattagaaagattaactataatggccagagcatcctctactaaagccagaaaacagaggca

SEQ ID NO: 13225 - DNA, 460 bp, Saccharomyces cerevisiae
atttcacattgatctcttacatacatgtacttataaaacaaaaacaaaaagtagaattcgatcgtcggggggtcattacatatttattttaaatgatgggcatggttatatatatttagacgtaataaacaattgaaaattggggccaaattggtaaatatctctatgtatttcaatcaaaaaagtataatcgtataacttaagggtaaaaaaagttgagcgatgtcatattatacttgtgctagcttttaaatttttcattatcttcagttttatcgtggtaaagtgccagccgaaactgccaaaaaagattatggcaagaaaatctcacgctgtcagggaaataaaaatctgatacagtttcacactctcagaaggattaactttaactattacctaacaccaatatctgaagagaatggatgaaattcttgccaaagcaggttcacaagccgttaca

SEQ ID NO: 13226 - DNA, 436 bp, Saccharomyces cerevisiae
tagataactcggttttgagcatattgggcaaaagctgttactaaattttcccattctttctatttttatctttgtttttattttccttattttcagcagcaaaaataatttaacgtatagttatgtaaaggaccctaaacatcttctttttagcatgtgctgtaatttggcgatatcttcagtagataaaaataagatgtgttaagtaatgcacttcgttatttggctactatagttggcaatcatcatttgtttaaatggaataatctatatagtactataaatacagtcatactagaaaaatattaacgaccaaataggcccaagaaaccacgcttctttttaggctctccttccgtctgctcattagaaattggtgtttgagagatgctctcggtttctgtgactgaatctttcacttgagaagctgagggct

SEQ ID NO: 13227 - DNA, 462 bp, Saccharomyces cerevisiae
tgtgcacactagggcattcatatacatatatatatagacgcggtaaagaaccactttactttcactattatcactttaccactaattagacagcaaaggctcgtatacgtgtcattaaaaacgaaggtaaggccatacctttttgaggcagttggaaagagtaaatactggcacagtggctaagacctatcactgccaaacaaaaggttagacatcttgggaatttcggacacattcgttacttaaaacgaggaccaaaattactcaatacctattttttatttaatattttaggcattgtttcacctgaatttgctgctattagaagcctgatctacgcaataaaagatttcatctggatttttgaagcttatacagtactcaacaatcagcttattaacagcaatataccgttaagcaattgagaaaaagtaacaatcagagcacttgtgtggcataacg

SEQ ID NO: 13228 - DNA, 448 bp, Saccharomyces cerevisiae
aagggaaccttttacaacaaatatttgaaaaattacctccattattataccttctctttatgtaattgttagttcgaaaattttttcttcattaatataatcaacttctaaaactttctaaaaacgttctctttttcgagattagtgcttcttcccaatccgtaagaaatgtttcctttcttgacaattggcaccagctggctactcgttgctcgaaaactactctcttttatttttaatttacgaacgattatctttcgaaggaacgaccaaacgagctaaatatgggcatcgccaacgttaaaaaaatggaccctaccgaagacgttattatgccaaggcgcagcgaagagtctttctccttgagaaaaaatatgcatgaaacaaaatagacaggaccagaccctcttcgggaaaaaaagtcaagatttaacacgtggctacaccg

SEQ ID NO: 13229 - DNA, 475 bp, Saccharomyces cerevisiae
aaataaaatcattgtttagtcctggataatcgaatggatttcaatatataacattctcttgcggctatttaatctaattgtgatatatacagtttatagcaaaagcgtatcattgcatcactgcatttctatatcttcatcttcatcttcatcctgttctccttctttgttttcgttttcaataaatccaccttgatcttttctgctattctggtgctttattaaatcttcataactccaaacagatacaccctcttggtctttagggtctgtgggttgtgccattgttctcaagaattgtttggtattggatatggccatgtcagtcgaaaggttcaaatcggcgtcagacaaaccttgagcaatccattttggtaactggcttctttttcttgaaaacctacggtctgctagtaccattacaccatagtcgtccttccctctcagtactctccccagacattgagctgcatgt

SEQ ID NO: 13230 - DNA, 446 bp, Saccharomyces cerevisiae
tttaaattacgctaatatccccttcataatatttacatatatatatcttttattatctatatcttaaatcacatatacctacaaaacttctagctagattcacacaagagtacttttgaaggctgcgcgtgcattttgaaaccaatgagacccgctaaattccgtctgaggtacaagatccctcggcttctttcttcccttatcatcaactttcggtttgctattattggcattcatcacacttagcacgtacgacattggcaaaattttgggttcgtccgcctcacgcttaaaccattctcttatcctatatcccattgtttctaaatcatctgccccaatttgctttctaaagttataatctcctaacttcagcatcaggagcaacgtgtaatatgcatcattgcctgcgttatgtaagaaggcatgtggcaagtgaaaaagcc

SEQ ID NO: 13231 - DNA, 478 bp, Saccharomyces cerevisiae
gaagaatagtttttctttcccatttcccgtaattctccctgctcctgtatcctcattctatccatattaacgtctgtatcattattataagttgaaatttgtctctccgtacccgagttatatacatacatatatgtaatctatctctcctttcacgtctaatctcttatgtttttactataatatatagcatgaaaatatactctcacacaatattcccaacgatagcgcagtagccgttatgtacgcagaaatttggtcagggctttctttttgttgaactttgcatacccggaaaaatggaaattaaggacacctacaaaagtacactgtagaaatcaaatcaaagaaaaggtttaatagacgataaatttccatacgtgccgacaggacaaaaaaaaaacccccctaccatttctaataacagcttcaccactagttatactgtcgactttctaccgatttgttggttcctttt

SEQ ID NO: 13232 - DNA, 411 bp, Saccharomyces cerevisiae
ctggcagactaactgatcaaattgatttaatgaatctatatatatatactgtgtgtgtgtgtctgtattcttaatggacaaatttacggcgataatgctaatactttagcgcgggtaatatcctaatagtaatttttcaacgatttgacagagtaaaaaatgaccagcgtaaaaataacatcaatacgtcaagggtatactagacccttttcagctctttccttgtccattcgaagacatatcaaagataagaaaggtgttggatatttactattgtaatttcaccttttatttctttttttttgacgggcaattgtttgttcgtaatagattttctatcaagtcaagaattttttattcttgcaaaggccggctcacgaataaagagttgcatttgccttgcaattcgta

SEQ ID NO: 13233 - DNA, 413 bp, Saccharomyces cerevisiae
gctagcagttgatgtgagtgagctcagccaaaaacatttaaatattcaaataacgtacaaataaaagactgataaatagtaataaaactaagcgggttagtaatactcaccaagaacaatagcaggaacgatagtcggttctctttcgtaatttttttaagtcacaacccggagggacgtgaagtttcaaaccttattcattccgggattaccctctcctgtgatgacgtttaggcaataaggactaaaaaaaaaaaaaagaaatgctatggcaaattttattgatagaagtggtaatgatgatggaagggcttttgagcaggtgaatagaaggtagctaacggaaaagagttattgcacccttaatataatgaatgatgaaattaatgagccaccgcccaatatatgtgagc

SEQ ID NO: 13234 - DNA, 414 bp, Saccharomyces cerevisiae
atagtgtcagcggtagtggaatcaaagataaataatgaattatctttgttttagtttcatgaaagctcatcaagtcttttttgactaatgtatgtttatattttgatattagataaagtatgcatttgttctgaaggctatgcatacgtaagtatatacttgggttgtattatgcagaataaagaaatgagagaaaacaagaatcgagagaaaacgacacacttgacaataaataggttccattaaaaatggatgtcggcacctaagagataggaaatcaccaaatagcaattcaagctcccgattaaagcccatacgaaaacagaggtataggtcaacaaacgactgttagtaaaatcaactattttactgtgcttggagttcaatggagtggtttcatcagcaatggcgtta

SEQ ID NO: 13235 - DNA, 456 bp, Saccharomyces cerevisiae
gaagtgtcgcagaggaatctttatggtttatatgctctttatataattttatgtatattatagtagaaaaagcaaagaaaaaaaagaaaattgatattattagcgaagctttttcacaaattaatccgtaacaaacaaattggcaaagacaattgaagggagtagtgcgaaatatgggccgtgatatatgcacattagacaatgtttacgctaacaatttgggcatgctaaccaaactagctcatgtgacagtaccaaacttatatcaagatgccttcttcagtgcattattcgctgaggatagcttagttgcaaaaaataaaaagccatcttcgaagaaggatgtacatttcacacagatggcttattacagtgaaataccagtgggtggtttggttgctaaattagttcctaaaaaacaaaacgaactatctctcaagggcattcaaatcgaat

SEQ ID NO: 13236 - DNA, 415 bp, Saccharomyces cerevisiae
aaagaaagaaaaagggcacaagtagcaaatttattttgcttgataaaaagtcataattttcacataatgcattaatacctctacaaaataagtggcatttgtatttgatgcgaacggaacaggtatcgacttacctttatcaacagtatcgttgatactattttattagcattatattatacaaatagatctcacgtacttatatatatatatatatatatatatacgtgtatatttttatcactttacataccattccaaggtaacgaaggcatgggccacatacgtttgtacaaggacatagcaacaacatcctgcgcagataatttaccatcaaatgtagccttgaaataaccatgcgtacccaaactttctttaatgaaacctgacctacctgatttggtgaacagtggga

SEQ ID NO: 13237 - DNA, 416 bp, Saccharomyces cerevisiae
ggtggttaaaaatagcagcaaataatttttaagaagcagctacatatatatatataaagtgctgtacagcttgaatgaatcacaagttagataacgtaggtaatatgcagatagtataaaaagtaatagtaataactggattggttttttttagtacatgacgaagattatagctcttgtatcctacaacccaaaagacctctaccattccagtttctcgaaggtgttagcgatgtctttaggatttgcccttctctcaagagaaggacgggaagtggcctgtcttcatttttcattacaaccatctgaatgttttgaagtttagagtggtttgccgcatgcacattaccaatagaaatcagcttatcatcaacctttatgtctgctttatctgaagggctaccgggtactacctc

SEQ ID NO: 13238 - DNA, 489 bp, Saccharomyces cerevisiae
ccctccaattaaacataacttgtactctatttttatattttaggttttttggcatctggggttcttataggatctttagcctttctcttcatactttcttgtttagccttatctagtaaatctttaacccttgtttcaatatgattcaaaaactcttccttcacctcaccggatttaatcaactcgtagttaaacggatcagagatttctgaaacttcattttccacatcgccactttcgtcaatcaccgaatcaatcatgcttgaatcaatttgtaatttagcacctttattactttttaagttgaaaaaattctcttccagtaacttgtaatcggtaaagatattggcaaaattttccggcgttacttcgatagggaatctatccttgaagaagtttttcggatatctgaaatctttgtctacaagctttttatactctaaaccacagtatatgagagatagtacaatgaacgtataaccgtcgcac

SEQ ID NO: 13239 - DNA, 434 bp, Saccharomyces cerevisiae
tttttcacgagcacctacaacacaaatatatacatatgccaatgagtcaaaaccacgtgtaattaataaagagattactacttgcttatgtagaaatatagtagctagcagaaaatgaatctgataacatcttcattgacacatttccaagtatagagaactttcttctgcttcctttcggaagaactgagtgaatattgactggcgtgcgtcatagcgagattttttcatctgatgatgtatggaaaaaaaaaaaaaacttttttttgaataatggatgcatcgagtgactttcattgttgcgcacgttgcttttccaaaaatggtattaatataggtcttttatctcttacttcacatttaactgcttgttaaataaccccagtgttttcttttttttggatgaataaggaaatcaacagctggtacacgca

SEQ ID NO: 13240 - DNA, 460 bp, Saccharomyces cerevisiae
aatcacacgtcagcgtcatgctattatattattcttacgtaaaaaaatacttacagagacgttaaagcttttgtatagatactttcacgagccttccctttcagtaaaatgaacaaattattttgccttgtccttctttgtttcaagcgtttatatgactcctctacagtattatttttcaacagacggtgtgcccgtacggcgttgtcaaaacctcgaacataaaacaacactgaaacaaacttattgcactcctgcatcgcatacagatctgatacttactacaaccataatgctgttttagaatcgcatcaggtgtttaccagaagtgtatggtacatggtgctttccttatgctcactatttcggatttacttctagtctatgtatagatttgttagagaccagttttaagctacaatggaacgttaagattaagaaatgcatgaagagtctccca

SEQ ID NO: 13241 - DNA, 409 bp, Saccharomyces cerevisiae
agacccttatagaattaccaatgtatgtttgtttactcgtcaaccatgtctcttttaaaagcacattgttcttgatattacatcaataagtaaactagtaaccctttacatatatccacgtcatgtatgccctttttgtagttcgaaataaaaacatttctatcattagtgccggttaataattagttggcgatatccttgcaataaaataaaaatacttgaattgatgattcgtttacagaggctcaagaacactcaggaaaacattattgctttaaattgacatagtgttcttatggtagaagctttcttaatcaccagcaaaaaatatttggtaagtaaaacgttagcgaggatatgctgcaaccatcattgctgaacaagttattggcaacctacttatgcggag

SEQ ID NO: 13242 - DNA, 478 bp, Saccharomyces cerevisiae
gactagtcaaccacaagccttttaaaaagaaaaattgaaaaaataataaaaaaatttgaaaaagaaaaaaaaaaatcataaaaccaatcttaagaaaaaccaaaaaaaaaccgctaattaaaatctaaaaaattgaaacaagaaactgtatgattagtaactaatatactggcgcggaagggaatgaatgccatttaaatgagatgattatgaaaatatagcgtagagtagatgcgcgaaaccgaggcagaaaagaaaaagagacaagttaaaaattgaatataatgatatatgggcactttcttctgtgctaggaaacggaggtagaaggggatagcaagcttgagcagtaattaaaaaaaaaaaaaagcatattgatagatagctcatttgtagttaactgacgacatttatgtacataattaaaatagaagaaaattttcaaaaaaaattctcctggcgattgttagggacaaga

SEQ ID NO: 13243 - DNA, 419 bp, Saccharomyces cerevisiae
tttaaatacgcacaactcatttaatttagggcttataagtagatagaaggattttaacggatcacaaaaagtagctgttaacaactaccttttttttgagttaagaacactaatgtggattaggaagaaacagctgctctgcacaattcttcaaaaaaacaaaacatgcttaatgtgtcattatttaacctggaaatataaaggtagtgttttatataagaaatatcattaagggaatcctctataactttttagttcgtttcaacgaggtgggaatgccaaattttctctatgagcgacatattcgctgtcattatagcccaattcctcttcgatttggtcactgtgcaaacctttaattttagttaattcagaactcgtgtaattgcatcttgccttgcctactgtttgcaagggaa

SEQ ID NO: 13244 - DNA, 419 bp, Saccharomyces cerevisiae
gaaagaaaaacacaatactaccaacatatatcctggagtaaactctcaaaaatttccacattcagttttacctatccgtacacttaatcaactgccttttggagatggaacaataaaaaaaatgcaagagaggaggccgtatttgtatataaattaatatatttaaatgtaaaatatatacagtacttgagtttttttatgaagtaacgtatttgcgcagcattctttttcctcttacacttcgttataacattaacactcatgctattgatactttttctttattattatctataaaattttttcgctttttgtttatgccatgccgttagcaacgaatttttttccatgctcatcacttttaaaactgtttaaagtatatagaaaatatatgtgaataagatcggggtgggactatc

SEQ ID NO: 13245 - DNA, 492 bp, Saccharomyces cerevisiae
aacaatttttcttcaccacattttccattgttccttccccccataactataaacgtatttatgtatatatatttgcgtgtaagtgtgtgtactatagggcaccgtaaagtaataatgcttaattagttactactatgaccatataagaggtcatactgtatgaagccacaaagcagatagatcaatcatgtttaacgaaaactgttaatcgaagattatttctttttttttttctctttcctttttacaaagaaaattttttttgcgctttttgccatcaccatcgcaagttctgggacaattgttctctttcgctccagttccaaggaaagaggtttctgttttacttaatagaaagtgtcatcttgtattttatatctcttctttcttgtgtaaaattctttagttttgattttgtatttttaggacagtgagctacgaagtaacatttttacttaataaccgtttgaagcatagagcaggccctggtac

SEQ ID NO: 13246 - DNA, 436 bp, Saccharomyces cerevisiae
ggtgggaaaacaaattcaataaaaaacctctagaatctaaagaacatgtcaaggaactatagagttaccttcactagtaatatcaacgctaccttactgataaaaaactactgcaattaaatattctatagatcaaaatatagaggtatatcgttggaaatatttttcaaacgtacagatattgaaggttcaccgcagttaatcaagacacatccttattcaacggactcattgggtccattgggtctatatcctcatctttagccttgtcagttactttcatatttttcaccttatcttttagcttgcctataagcttggtttcaaagttgtgacgatcttcaggtaccacagtttcgtgaataccttcctcttcattcatttcctccatcaaatgtctagccttgtcacttgaaatgctgctttgtggtgtcaa

SEQ ID NO: 13247 - DNA, 463 bp, Saccharomyces cerevisiae
cactacgcattggcttaatctctttaaactgtaaataatggtataactacgagccgttgccggctggtcacatatcgtatatccgtatacattctttcttcttttaattatacatattgtaatctttttcttttttgcattctcttaaaaattgattgatccatcggcgaaatggaagatggaatatcaagcagttctattgttctcggatataactaaggtaccttcaatttgtaggtgtacacgctagggaggttgcttcgtgctgtaccgcttctattaagtttttgaaattcacaatgagcatacctcacagtgcaaaacagagtagccctctctcaagtcggcgccggtcagtaactaatactactccactgttaacccctagacatagccgtgataactcgagcacccaaatatcaagcgccaagaacatcacctccagcagcccatcaaccataac

SEQ ID NO: 13248 - DNA, 499 bp, Saccharomyces cerevisiae
aaatatatagattatttttttagcatttcttagtattcgtttgtgtatttctactaggtaagtaccaaaatttgccggaaatagagtggaaaatggaacccgttccaagaaggggtaagatgcatgaatattaagttggttgcataaatatgctatataaagtccactacaaaaagtcatttatttttgcccgtaagaataaagaacgaatccgtccttatctctgacttcaatgggaacatttacacgcagtacgggcttcaataatagttcccagtcgtatctggttctaggtgtacataatgaaaaatgtctcagcattcttattttgacagctttgaattttgacaaatttctcaggaaacaccagaggttaatatttggaatatctttaaaattctctggatcttggaaatcattgaaaaaattttccaatgtcacattttgtaagaactcctccacatctaaatctctatattcgatggttcggttcttcaat

SEQ ID NO: 13249 - DNA, 497 bp, Saccharomyces cerevisiae
ataggaagcgagaatttttgacagcgaatgaaaaagaaaaaaattaaatgttaacattttctttatattaaatatgtacgataaatgaaatcattattatagaaatgatagattattggcttggtgtttttcccattttgattaatcatttccttagctgcccaaagaattgcacgcttacagtgaggagtagtgatacattacaattataaaataaaattatatagcagctaaaatttaaaacaaacagactttgttcctttgtatgtcctatggaagatactgacttgcagtttgtaaagtgtccaagtcgtaatccactttacttgccacgaattgatcattgaataatttaattttaataatctcttgagttaaatcgggatgtactctgggaatgaagtcatttaaaaatgagtactctcccctaatggaggaagatgactgacattgcattatcttgaacaaaattctaattatcggcccagcatcattat

SEQ ID NO: 13250 - DNA, 492 bp, Saccharomyces cerevisiae
gaatccttgtgggagtagtgtgaagctattaatttgcgacaattctcgaacagttaattatattattctcagtatttattttaaatttctgtatttttatctgattaataacattagtgtgcataatgaaggcaaaaaatttcggcagaaagtatatgattatgaaaaaacgtaaaatacatatacacataaaacgtacatacatatatagattcctaagaatacattattgatgggatatttatacaaagatgcaccttctaataatcgaaagagaaaggaaagacagaagcataaaataatttaggttttactgtgacgaacattagacagatcgttcaatagtttgtcatatttttttgtcactgtttcatcttcaacaaggggcctctgcaaaggcgccttttgttgtgattcttgtaaactgtcattactcgggcttctagagttcaattcatctccatataatgattccaatccaaccttttcaga

SEQ ID NO: 13251 - DNA, 429 bp, Saccharomyces cerevisiae
ttgttaatttttaactttcaaagagcaaaccctttttctttacagtattatagatttacatatatgtatttatcaatttattattgatcaaaattaatataccataaaatatttatcttaagccgttgttcttgaacgattttcggtgaagaaacctaagagaccattttttgtggaaaaaggtctcgttttctatagatctgcgaccaggaatctcctgattgcgtactacaaaaagtgttcgtccattttttctttactacattagataattatacataatccaattggagtagtgacatgagtattggtataaccttaatccaacaattttaaacacgtactaaagtgatctggactcattaaaactcaaatctcgtccagttttttcttcatttgtgatcaacatccagggagacacggagatta

SEQ ID NO: 13252 - DNA, 500 bp, Saccharomyces cerevisiae
aacagtttatgtaaaatgaaattaggactataaaagtatatagatatttcctatagaaacacctcatatatggcggtggattttttcatcttgaatgaattatgcttagaattatgattatgggccctctaggattcatctgattgcttgttgaacaatgtctgccttttcaatagcgccatttttgctctcttcgaaatcttcaaagtaaagctctctcgttattaatagataggatatcaaccctacgaaggcgaaaaatgacgcataaacaattcttctttgaaaactgacttctttttccaatctttccaaatgcaataaatgacggttagtaaatttgtcattctccagtttctgttcttctaatatacgtaaagattgatctttcaattgattggcaaagttattcagcagatctagattactcatcattgtttcgttgaatatcgtgacaagatgactgaactttgcttcgtgcgccatttcaagttgttcaa

SEQ ID NO: 13253 - DNA, 410 bp, Saccharomyces cerevisiae
tttaacgttcgagattaagaaggcaattacaataatattacatactgtagataatgaatataatgaaaaatataagagtttaaactatacattgttaaagccaaactaagatattatattcatttccttggcataacgtgtagtaactctttgaacctgtctgatatcaccgcatgcaattagtatcttttttagaaggttcctcttaaaatctttatcggcaaatgctgacccggtaccactgatggggagatcatcatataaccattgaaaaacatcgttcaaacggtccatataccccaattcactcagacggatgcaataaaccatcattagcttcgaaaactcttcaggctcctccaatctgatacttattaggattttattttccaggtgagacaaagttacga

SEQ ID NO: 13254 - DNA, 423 bp, Saccharomyces cerevisiae
acacatatataaaatataccggagatgtaaataaccgtggaagaatttgtattatcatcgtgttatacgatgcggagtccctttgcgcctactttttttagaagaatagtacataacctttataaaaatcttccaatttagatacataaaaagagcatgagaataacaagaacacgtagtctaggaaactaagcgctatgccagagcaagaactacttatagggcaagaaatgaatacacttcatgcaggttcatctactgatggcataaatgtcggaaacgcaggacgaactagagacacacaaactggcgtagaaggggaaacggaaatagggtctgacgaggaagatagcatagaggacgagggaagcagcagtggaggaaatagtacgacagaaagactagtaccacaccagctgaggg

SEQ ID NO: 13255 - DNA, 429 bp, Saccharomyces cerevisiae
cgtttacagtagatgaatgatgtattttattgtatatatcgcttagtgcaccaaaatcatactacgtaagtataaaatcactttacacgtagaagatgctttttcagattgttcttgaaaaagttgaaaaaaatataattcacactcagcaacaggtgaaagtgtataatgggtaaaaaaggaaggacagaaggtatattgctaatcaaaacgactttggtatacgcgtttggggctacaattgcattttaaatatatttaagatgtttaatagaaaaagaagaggaggtatgttttaaaaccaatgttttccagaagtttcgttctagagtgtgtatatcaagaccaattaggatggtatttccattttttgtcagttagtacggtgtgacagaaaagtgtacttttgtggcacagagaagtggagaa

SEQ ID NO: 13256 - DNA, 446 bp, Saccharomyces cerevisiae
aggcaaccagaaggaaggagatgaagaatggacataaaaagcaaaatgacttgctagatcttggcctgagttactctcatgattgggaccgaactccgataaataactctaaaacatgctagaatatttcaagtaaatatacataaatcacaaataagcaaataaacagataaatatctcacaagaaatcgggagccgatcttcgatgtgtgtgggcgtatatacaaatgtgcattcggcacgtaaaagactggtaaaggctaccgtccttcagtgagcattttttacattcattcaacgctatacagctcttactgtgcgacggaaacgcgacaaaatgtgaagagaaaactaggggttgctatgacacgaccacggaaggcctaaaaagttaagtgacagaaatcgtcattggtaaaaaaaaccccgaacatgccgataaagac

SEQ ID NO: 13257 - DNA, 419 bp, Saccharomyces cerevisiae
tatccttcgacagcttaatgaacacgcatgtaaatgttttgtaaacagtttgttttttcgtttttgtatctgttaattttctattatttatttttttagtttttttttgcggtagaattgggttatcactgaatctattttattttttgggttggtttctccctgttttcagtttgtttgaattggtgtttaacaaaatctggaattattcactataattatttcctctttttagtttgaccaaataaactcaactatcttgtgttatttctttgtattatagctttacacatatttaactatccataccttttactttttgtatatactgttaatttcataaaacacgttttagtaccagaaaatcgtgtcatagcaccgttttagcagtgatttttaaaattgtccaaggtgccaat

SEQ ID NO: 13258 - DNA, 423 bp, Saccharomyces cerevisiae
tgaagagtatcaagaatttaaaatgaaacatctcaaaagaaaaaagaatgcaaatgagtctatcgacgaatttgaagggaaataaacgcataatgtacagtaacgtataacaattaaagatttgtggaagttttcaaaaacttttcaacttttttctttgttttttttttgcaacttcttatattaatattgtcatagatatttcttatacaaaaacaagcgaacaaaaataatcgacgtatatacaatagatatataagactgtttttcttcaatagaacaggcgaaattattctaccggccgaaggtacatcttcccgctatgtaataaatagaggtatttaagttataacaattataattcccccattacggcagcaattaagttttgcacgtcattagaggcgattttaccattctcca

SEQ ID NO: 13259 - DNA, 491 bp, Saccharomyces cerevisiae
cgcaagtaacgaattttataaatgaatcatttctaaacgattttttaatagtatataagtagtattaatattattattatttttttttttttttttttttcactttcgaagttctgccggaagagctcatcgacggccaagaaacattttacataaaagttattgagttgaaaattgagtaaatattctctccaaaaatcaaattgtacgtttatatcaccaaactatgagcttgaggccttgcttcgtatcattgatagatgaatctgataaacctatattgatttacgtccctaatgaggcggagaatgagatgaatgatgtactcaaatataacgtgctttctaacatatcgttagattattttgaaagtgctttggttgaatggcattctttagattccaaacctcttctgaagtcaatttttcaattggaaggtgtctctgtatttgctatgttgattaagcagacgggcctgaagattgtcattg

SEQ ID NO: 13260 - DNA, 499 bp, Saccharomyces cerevisiae
atctagtgttagaagacgaagcatttttcttctttacttggcagatgcacataggttgaacattttaatcaactttatgatgatttgcgagagtaataagattctcccgaacagtaataatattaaggtatccaattcttccgaaacagcgtgatttgtaataaaaataaataaggacatatatgtatatagaaagttgcttaaactttttagaccacttggaaatattttttatttatatttttcttcaaatgtaaagttgggtacctaagcttaaattcacctgaaaatgaattatatgaaagattttacaccacatgtaaaaaaaaacgtacaaaaagccaaatatttccactcaatcataatgcatgaattataggtattttaagttatattgctgacgtaaaattcagaagagactacaagaaaaattctgaacatatttattcttaaatatgcttttgtgcttccatatgtgtcaaaggataatgtggctccc

SEQ ID NO: 13261 - DNA, 434 bp, Saccharomyces cerevisiae
ttgggttactaagaaattaaaaatagtttttctttaatactttacattttgtaatataatcacaaatattttttagaaataataaaaaccaaagaaaccattcctccccgttacagtttagattacctcccctttttctttcgtactttttatatttttatcgtttgatatttacaagaaattaaatctatcatatagcctttatttactaaagcctatgcttaaggttctcgtatacacaaaaggtaatgcaagtggatggaatggcccgtactaagtttgcagataggcccttataaagtccaacaaaaccatcattagcaatgattaattttatcaaaggaaagagcctaaatttttgctcattggccctgaaactttgtaagtttgatttcaataattgaaaagggtaaaccaaagtgacggagaccatt

SEQ ID NO: 13262 - DNA, 479 bp, Saccharomyces cerevisiae
tattaattaaaaaaaaaaaaaagccaataatttcgcgcaagctttgctctacataataaaaatacaattaggatagaaatgaatatttttttagcggcagttttaccataagtagcaaaaccctaacaatacaatgtgagactaaagtaaatccgggtaatacaaaatacaatttttttttattcttcacagcgttttttcgacggaggagggaaaaaaaaaaattgtatttaaggcatcaaatgcgcgacatcatatacctttgtccgctgttatcataccttgaacctctacatttcagcctagcgcgcgcaaaaagaaaaaaaaatcataagcaagagtggtacggtaaccacaaggcaatgcaaagaagggtgcgatatcaagtgatgttaccttcctttactttttgcctttttcttgaattgtcaatccgccctttttttcttttcagttttttctcctttcatccgtctcgt

SEQ ID NO: 13263 - DNA, 498 bp, Saccharomyces cerevisiae
tcacaacagtaactgcgacaagaatgaaagaaaaggaaaggaaaagaaaaacaatacggaaaggcaaaaaattaaaaaaatggcgccttatgagttcagtttgataacgatgaagtgcactatctgaaaaaggatgctcaggttatatatctcttcttgtacagacattgatgttttaaatactacaaatattcttagattcactttatacttcacacatttttttaagtagtagatttaataagtgcgcacaatgctacatctattcttctccacagtaatctcttcacatatgtcaaggtcatacattggcagatatgtttgaatacctgctgagaagatggtaatatgcaccttaatcaaataatatcatgtaaattgttatagtatctatctatacgcaattcttatgtaaaggatacaatatataggaatgtgataacttcgataaatataccaaacgaggtagattaaatgaaggtttcgtatggaactgga

SEQ ID NO: 13264 - DNA, 485 bp, Saccharomyces cerevisiae
gcccccacaacaaaaattatgacccaaaccagatccgagtttgtattaacaaacaaagtttaaaatatgtaaaactaattaatttatccttaggtatatatacgatgaatgcaattcaattcatcgcttctatttattttaggtttttcttctgctcatggttcgtgctcactgattaaccattggtgctagaaatgactcgagaacggatataaagtttctattggtgatctttcttgtcccttgacctctcatttcattttcgttttcagcgaaatcgtacggtgataataagttgttgctcacgtatttgacataaatatggctgtaaatatactgtaaaacctgagtgtaagactgctgtttaaagtcggacaatagaacaaaccatagccctgaagctgtacagtatgtgtggactctatactttcctgtagatatactccgtatgtcatttttaacagaccctttggagagcttttgtg

SEQ ID NO: 13265 - DNA, 466 bp, Saccharomyces cerevisiae
tttcacgaggtaaaaggaaggagacgcaattgaatattcaaatacatagtagaaaataaataaaaataaattacaagatagaaaaaagttcattgtatttaagtcgaactaattgttgtatgcatatatagaagattaactaacccggcattgaagaccttttttttttttcaccttgagagaaatactgaaaattttttttgctgggatgagatgagatgcctacctaaagtatttcgaaggtgaaagcgttttattatagagtactgaaataaagcacaatcaggaataacaaattaactgacaatggcacctttaaccaagaagacaaacggaaaacgttctgctaaagaagttagtcattcagaaaagaaattagccaaaaaacctagaatttctattgattcgtctgatgaagaatcagaactatccaaaaaggaagatgctgtatcctcttcatcagatg

SEQ ID NO: 13266 - DNA, 402 bp, Saccharomyces cerevisiae
cctacgatggatcgaacaaaagtgtaagcagacgtgaaatagcaaacctttgaatgcatttatatattttaatatacttataacaacggataaatgtttagatcccttttgaaaaaaaaaaaaaattaggatgaaccgaaaaaaatcatactcgtattcctctatcgtcttcactggcattattgtgtaaagaattattaccaaataaccacctgaaccaccccacagtatcattctttaaatctttaaaataacggcggctcagcatctttaaacaaagagcttcataggtggggttgttagtggtcatcaaatcatttacgcatctatcatattcgtctttatcactcttgggatctattgcagagcatattccagttttaccctgtccctgaagagagc

SEQ ID NO: 13267 - DNA, 442 bp, Saccharomyces cerevisiae
tagatgagaacagtcctttaagtaacattctatggttgtaataagtgatgatgcttccttgtcaaagagttagttgaaaagtttagggtcgtagcattaattatattgtatatagttcaaaaacgacattcaatgaaaaaatcaagtttattagccaatgaatatttcgtattttgcgttagtagcgctaccaagacttctgaaaagtgcatgcaagaaaaataaaaacaaggaaccgtttacttttatgatatcatcattgtcaggccaaataggataaaattgattggttgtattatgctttttaattgaaaaaaaaagtagaaacttttattattttatttaaattaatttctttacattacttgcatctaaaaccaaacgagctggtgacttcaagcactgcactagttgccatggctttgctaattcagacgacccc

SEQ ID NO: 13268 - DNA, 418 bp, Saccharomyces cerevisiae
tagatagattaagagagaaggctcggatctgcactgacttacttttttttgtttttttgatgtttaaaggatctgtgtcactgtatatactttgttttgctttagggttacgaaacacatttttaatatataatgtatgtaataatattaaaaacaactgtatggataatacttctggaccaatcggtgataccatcttccttatttatggtattattatcattattggaccccgccggtgcttttttttttaccttaaaagagtggttctcctccaagggacgcacgagtggtgtacccaggggttgtttccatggctaaagaaattggagattacaaacgtacattgtcatttaagaaggttcataatctgccaattacatttgatataacaagatgcttcccacattcaaacgtt

SEQ ID NO: 13269 - DNA, 438 bp, Saccharomyces cerevisiae
gagaagaaataaggatgcattttacattttaataattagtgacccctcgcgttcccttttatttggatttagaaaattttctataattatccaatgcttaacctatttctcatttcatattttattccataatctgtaaattagtgctgtacgcccatattgaattgaacttattattttttttaggtgatatatttgaaatagtatacataatttatgtttacatagttttaggtactttatatcattaaaagttttgtttaacctttaaaaaatttgtaccattagcagttataggtattcatatcgtgaactgcgcaacttaaaattattcgcgggacgaaaaagatatacaaaatttttgaaagtgagcaaaggatgagatggtgcaatcgttactatttgatattaataaaaaggcaatcatcacatcaaccc

SEQ ID NO: 13270 - DNA, 462 bp, Saccharomyces cerevisiae
atcaaggttgtggcattttttgataaaaaactgaagagaaaaaatataccatatcaacgcatttggctgtgaacttctgtaaagagatacggaccataacaataggcatgatgatggcatctataacttctattggaaggtaagtttatttttcccataaatatgtatatatggtctatactctcaaatgagcctacatattgttgcatattaacgaggttcccatctcaccgaccaacttagtttatcacctgctttaaatgggatgatgcttatgtctttgccatcgctgataacctgagggataacttgttcttttttgaataatattgccttatctgaagaagccacttcgctatctttaacctcataaaaggaaattccgaagtcggaaacaaagccctttaagttctccaaggcattttgctcttcaaaaacttgggcgatataagggatcgcaaa

SEQ ID NO: 13271 - DNA, 414 bp, Saccharomyces cerevisiae
aaagacaatacatctaaagagatgcctaacatctgcaagagatttcggcagaactactctataacttaaaaaacgaagcatacattccaaacaagttgatacttctagatcatagtttatcttcatagggcttcttttgttggtacaatgttataacaactatatttctgctatatagagtattaatgcattttttttttttatctccagcattaaacgtgcacgcttctataaggtggaaaaaaaatactagaaaaggaataagtgaaacaccacgttgatggtgaaaaaatataaaggggcgagctgggaattgaacccagggcctctcgcatgctttgtcttcctgtttaggcaggaagtcgcccaaagcgagaatcataccactagaccacacgcccgattattttatgg

SEQ ID NO: 13272 - DNA, 446 bp, Saccharomyces cerevisiae
tgacgaactgagtgactaataaataaatatatatgtataaataaaaaataaatatgaatattttaatagacggaagaaagaaaatatgtgtgaataaccaaataggaaataaacaaaagcacatttaattgttgccgttattattagagtaacctaatgtacgaactttggtattagatgcagaattattggaagacaagtttagttcagacacgttttgtcgcaattgagaagtaccattagaaggatacatccttggggtagtatatgctgaaggagtcattgaatcaccaccacctcctcctcccccgtccgacaccatgtctaagctagataatttttgtaaagagtagttggcgctgtttgacacatttgtgcccaacctctggtaaccaagacgggaggaggaagcatctacttccggttctttcgcccaaaaagatgtc

SEQ ID NO: 13273 - DNA, 459 bp, Saccharomyces cerevisiae
tgaagggatcatcgaagcattagacctacatctaccttactaagattgtaagtacatagcatgtgtactgatgtgttcagtagcattcttccatatattatactacataaggtatgtaaatttatgtatttatatatggaaaaaagaaattgaaagaaaagaaaaggaaagatacttagttatgaatcaatcagaatacgcatataacaaaaaaaaaaagtggaatgagaaaggaataaaggataatcttttcccctatatttttgtattggtttttttttggcaaatattttcttgttttctgtaattcatgtcatttattggtaactcatttgccaagaacattatcggaaaaaataagtttaccctccaattgctgctttagtcgtaaaggtatgaatttactgcttttcttgttcttgtctttgttttagaactaatgggtggcctgttactctg

SEQ ID NO: 13274 - DNA, 480 bp, Saccharomyces cerevisiae
aagcgaagatgaacaacgaagttttaaaagtgtgtatatatacatttatatcaacagagtcatcgatttcccttgtttgagatgtaaaaaaaaaaaaaaatagaaaatagtaagtccctgttatcaattttgcctaggaaaaaaacctgggtcaaaaataaatggtctctagcgggatcgaaccgctgatccccgcgttattagcacggtgccttaaccaactgggccaagagaccattctattgttgaagattgtttaatttagataaactttcataatgttgagaattgcttattgcgatatataaagttgaaccaaagatcaatttctttttatgtattgtagagaattacaatttgaaaaagagctaagggaaattgctatattctaaaagaagtgcacaagtacattaccttgaatttttatatttattcatgatatattaatattaatatatcgatggtgaaggacaccacacc

SEQ ID NO: 13275 - DNA, 432 bp, Saccharomyces cerevisiae
acagtacgttgaagattatgtattggtagttactttgtacttttatgacgcaaaagttggtatttatgataattatttagttatcgattgagtcaaatcggcgaagtatttttggcgctgcacgacaaggtcacttgtccagccctttacttcgtctgtttttatgctagctacagccccaaagaaatcatcgaagtttttcgttcctttgtattccctctcgtactcaaaacattgtacaagcatttcatatttatcgatatctttcacgtatctagcttccaatgaggtgacattttcataagccaaccaatcgtccataatttcctttgccgcgatctcattgtatggcttgatcagagcattacatagatattttatggtttcccattcccgacgatgcttttcttccttcccaatagggtcaactgg

SEQ ID NO: 13276 - DNA, 432 bp, Saccharomyces cerevisiae
agaaacgcctaaataacatatattttactttattgatagacataaatatatgagtacatatatatatgtgtgtatgtgtatgtacataccagttaaatgataacctttttttattgttgttatagcgtgaaaaaaggaaaatacagtgaaaagaacaaaactgaagaggtaagagtaggctaacaaagaagaaaagtgagacaagaaaatacagcaggattctgaccgaatgaacaaaacgaattggaaggtatctgtaactacattcaattgtggtaaggaatttcccgttgaaaattcgaaagcaatcgttaagcaattgcttttcccctacgatgacggcatctcccaattggaattgcaagatctatatgtgttggggttccaagaagtagtccccatatggcaaggctccttccctgctgttaatcg

SEQ ID NO: 13277 - DNA, 434 bp, Saccharomyces cerevisiae
ctctgatttcactgtcattgcatatatagtttaatattaataatatttttttcaattaatatttcgtgaatcttattagagatatattatatatccgtgtctaatttttagttacttcatccaaaaacgtcccgtcgttggccagtctatttctaaatttgtcccaccatgtatcaaacctcttgatgggcacgtttccctgagcatctaggaaccctgataaatagttatatgcatgctgaacgattttggcggccaattcttgtgtcaatgaagggtaaacttgtgccaactgccctgccgtggtaatatttcgaattattcctaagttaggtcttgacaagatcaatgagttgttcttttgtgcttcggcattcatgctggccttccactcttctaatttcatcattccttgttctcgaggctcaatggaa

SEQ ID NO: 13278 - DNA, 420 bp, Saccharomyces cerevisiae
gcatagcttaatccgttttcacgattcataatataataaataagaaaagatatatcatataaacgttataaaattaataaccgggtaagtgtagaaaagtgatgcgacggtttattttctcttcctcttgcgattgaatttaacttgcagatagtgaccataaggcaactacccagtggcaaacagttttgataacgcccagtacatcaacgagcgagtataaagactttggtacattttaaaaaggaaacatatattgttttcattgctagacccttttagtctcacctcaataaaactgctttattcctcattgggctttttattctttaattttgcatacttatagcgtgaaactgggcatttaacaaaagcaaactattttaatagtagcatcctgctttctttgcccctccttct

SEQ ID NO: 13279 - DNA, 401 bp, Saccharomyces cerevisiae
cttgtagcatgatctttttacatttttttggtttgtgtacgtatcccaccgtacttaccatcttctctcctttatatatatatatatatatgtatattttcagtgtatatacatacattcttatacaataccgtataagaacgtatgtatgtatgtatgattttctcacattaatgaacaatatcatcggaaacgggcctttggtttttaagggaaaatgaagaacaataaatgccttgctaggtcttcctttatcatttttggaagtcaaatatgaaaaacacttccaagggggcgtactacttcaactaataaaatgtcacacactaataagatcgcatacgtgttgaacaatgacacggaggaaacagcctcgccctcttccgttggttgttttgaca

SEQ ID NO: 13280 - DNA, 482 bp, Saccharomyces cerevisiae
taaacttttccaccaagccattcttcaaatgtgttttatttctataattggatataaattgtataaacggattatttcaatccttgccatctttttgttaggggccattgtccacatttcattaaatagatcgaaaaaaaataagaaaacaagattcgtaaagtaatcacgattttaacgtagaaaaatacgggtcaaacagaacttgaaaaacatcaacaaaaagtaagaaaaaagtcttcgttgtttctattggaaaaagaattaactgtcatctatcaaccaagttatcaaatttaatggaatctgaaatataaagattgataatgtgatagggtaatgaaaaccataaaaaacaaaaggagaaataatcgtaatattataatgtagaaataccgattttctttacaatggaatcccaacaattatcaaattgagaattgggtgaattttgagataattgttgggattccattgtcgat

SEQ ID NO: 13281 - DNA, 496 bp, Saccharomyces cerevisiae
attggctacctaagatgaacgtcctatattgtattatttgtgtatgtatgtatgtgcgtgcctatgcaatgctacatgggcaatagccccacagaatgcgagcctgccctttttcttctggatctaatttttttgaaccttctttggaaaactcttatgcaagcagaaaaaagataaatgcccatgatcaatagcaaaatctcgctataatgccatatggtcagcacgaccttgaacaaccgagagtgaggattgtttgaagttttctgttcagctgactgtgacccagtcttgatgtttggttgagctttgatcattttccatttggtgaactcatcgggttccctgtcaaggacctcgccaaattcctgctccaggaatagctcagcttcctttgcgtaatcataggtgtcctcaatggacgcatccatgtcgttccaatggaattcgctagtggatacgtccagcagctccactgtctccgttaattggccat

SEQ ID NO: 13282 - DNA, 419 bp, Saccharomyces cerevisiae
gattgtagtaatgttatggcttgaagtatcttcacttattctcgacaatgttgcatgatttttgagccaagggaaaaaaaaagcttacgtagaaatcaataacgtatgtgtatttatatatgctagaagggaaagaaaagaaaacagagagatggtaatattaatctcaataataataataataataataataacaataataataataataacaacaacaaataatgattatactgcttttagcgcatatatacagttttgttaaagagtttcaaaattcttgtatacctggtacttttgcccatcggggacaggtgcattaccaggtcgggaagctaacccagtagctattccaacgccggccgctgcgtccaattccaatggattatcgctcaagaacagtacctcgctagccttcg

SEQ ID NO: 13283 - DNA, 430 bp, Saccharomyces cerevisiae
taggcagtcgaactgactctaatagtgactccggtaaattagttaattaattgctaaacccatgcacagtgactcacgtttttttatcagtcattcgatatagaaggtaagaaaaggatatgactatgaacagtagtatactgtgtatataatagatatggaacgttatattcacctccgatgtgtgttgtacatacataaaaatatcatagcacaactgcgctgtgtaatagtaatacaatagtttacaaaattttttttctgaataatggttttgccgattctaccgttaattgatgatctggcctcatggaatagtaagaaggaatacgtttcacttgttggtcaggtacttttggatggctcgagcctgagtaatgaagagattctccagttctccaaagaggaagaagttccattggtggctttg

SEQ ID NO: 13284 - DNA, 470 bp, Saccharomyces cerevisiae
taagagaattgcattatggtcaaccaaaaatcaaaaaattattagtaatatcaacatatgtatatttaatgtatgtaaacaatgattaaatattaataaaatatatctacatataagtatacgcaaatggggtttttcttcaaaaaaattgtttgctggtgttttcaaccttaacgacaaaacgaatcataacgcggtaaaggggaacgataatatataatggaagcattaagcaaacagctttgtaatacgttttacagacactgaacaagacaagattttaaacagcaatgattataaggcgcttattttcaatttcaaatcgctcattcttcttgaagaaacctcaatttgatgtaaaaaaaataatagagatgattcctcagtaccaaacttctatccagaatagagagctgatagaggcggatagtattatacgaagcttacaactgttgggtgaacggtatcaa

SEQ ID NO: 13285 - DNA, 432 bp, Saccharomyces cerevisiae
gattagaatagtttttccattttaccataatggtagtctatgaaggtacctaatttttcatagacacaaaacaaagttcaggcgacgaaacacaaaaatcgccatatatatttacgcatatgtatgcattctaggaaacagaaaaaaataaataatatagttccttcttgtgacttcctctccaacccgccgcataatcgtcggcatggttaaacatgctgtatcggctattaaggaaagaaagtatacataaaagaatgaaataaagttgtccaaatggtgaagaatttaaaaaaatgctacttcgagctgctactatgagtttataggctgaacatagcatatagcatttcataactgcactataattgaggtttctctgttttaaaagcataatcccaaataattctgagttgacaaaatagcggccat

SEQ ID NO: 13286 - DNA, 436 bp, Saccharomyces cerevisiae
tgggtgttctcgttctacttttctcttctttttttcacatcttttactagttccgttttttttttttttaactcttctttttcattttccggtttttaataatatttctttaaatttctatattcaataaaaattcttcctacatatatatcttcatattcaaacatttatagtatttttactaattttttgttgttttaatatactataataatattattattactgctactactattattattattattataattattattattatatgtcatacataatacattctattgattgtctttgtcttccttttctttctcctctagatactactaactttacttcaacttcgaattcaaataatttatttcgtccttcaaacttgcctcttctacagtttttaccagctcctttgtacatttggcaacatcaaacg

SEQ ID NO: 13287 - DNA, 477 bp, Saccharomyces cerevisiae
acataactccatgcatgctacatagtaactacgtaaatcacctgctacctctctgttctttcgtcccgcctcgaggttgtgctgcttttgtacctattgtggctgtcggtgttacattacggtgcctcggtgttacgcggtgcttcgtcctggtggtccacgcggccttgcgctttggccttggtgggcttcgaggctgtattatataaatgggcctgatgttcgttaaaagctgcagtattgttcctgagcttgtttctttttcaaaggtttccttttttcttagtggggtcctttcttacataataaagtaaatagcctgatacatataaacctgtattgttgccattacagaaaaaagccactttctatacaaaaactacaataaaatgtctgctgatttcggtttgattggtttggccgtcatgggtcaaaatttgatcttgaacgctgctgaccacggtttcactgtttgtg

SEQ ID NO: 13288 - DNA, 449 bp, Saccharomyces cerevisiae
atatgttcttagataaaattccttacacataataatctgttcttttatttctctatttaccatcctccccacgctgtgctttccaatccgccgatccactttctctaccacgattagatgatttcgaagcggcactgacgctttcggatttcgtttcttgtgtctttcctctaatcagctctatctgttcctgctcatcgcgacatgcaagttggtatatctcgtcatcatttaacgaatacctcaacctcttcgttataaattgacaaaggaattttaaatcttcttccttgatttgatctctgggcagctcgttttggaggatatagcgtttactaacgtcaacaacgccatctttaccgaacgcaatacagtaactcattttcttgttccagttaattgaatagatatatggttggtcgaatgattgctcacaggagtcgacatga

SEQ ID NO: 13289 - DNA, 421 bp, Saccharomyces cerevisiae
cgtaagtagcttttccttatagaatgttagagtagagtacgtaattacatctgcacttatttaataaatgcacttactaacaaactgggttctcattggtcagaagtgtcccgggtatccgaatatggcttcgatgaaatttttcgccatggagctgcgatgcccgatatttgtgtataaaacatggaaatgagcttatatagtgactactctgcattttcgttatttctagagcagagcttaagttacccatagttatttctatagcttgccctatcatccatttgatcaacaatagggaataactgtaacagtaagtaaattatggatggttttcgtgtagctggtgcgttagtagttggtgcgttaaccgctgcatatttatattttggcggaaggttttcgatagcgctggtcatta

SEQ ID NO: 13290 - DNA, 438 bp, Saccharomyces cerevisiae
aattaatgggtagggttaatagcttattcatatatacacttaatacgattaaaaattatttatattctcatcatcataagatgaagatgcaaatatcacaacaattatataacgtcgtttgtttgtttggtgacacattagtgtttcattccgggtagctattttgtttttctcatgccaagaattctgtaaggcacttaaaagtattcctaaataccactttcatacatggttaacaaggtaaacacaaaacttgcattatagttaaaagggactgtttgatcattaccctttttctggaaagcggatatttattatgagcactgaacaggtcggtagaaagaaatcgtatagatgggttagcgcatctcaagcaagttatgacggcgctggatgggacagtagtgacgaatatgactactcttccgaggatggcac

SEQ ID NO: 13291 - DNA, 457 bp, Saccharomyces cerevisiae
ggcgtatcataatctaaatacatatttacatactatacatagaatgggcctggaagtgatagattcattaatacgatgttattaatcttatgtacagctagcctttttttcttaatcttgccgagctttggggatcggaaaataagaaaacatactgtaaactctagcaactagtgcaccttaagaacacccgtagggaagcaggaaaagaagtaaaattgggccgagagcagagatattatcaagtatctagttactaagatgtcttcagatcccttgcagcaagtttgtgatttaataaagggagatctatcacttgaaagggtacgagatattaaggaacagttgctaaaagaaaaatccgttgtagaataccaattgaataaagaatcagacaaatactatggcgaagtcgaagaatccctcaaactactgaatctgtccaaaaattcggtca

SEQ ID NO: 13292 - DNA, 458 bp, Saccharomyces cerevisiae
aggaagtagaaatacttatgaaggcatgcatgcatgcatacatatttatatatatatgtctttaggagtatgtattgcatttaatcgaaacaaacaagaaaaagaagagtagatgtgcccgtttctgtcactcctatttactgacactttcttgacctacctcaaaccagttccagttccggcaaaaagtgccgcgcggcggagaaacatctccaccttatctcggcgccaaatccttatctctcgtagctggtttgcccgcgataaggcgggcgagttattttgaagttttccataaactggttttccatctcgaggtttttcctcgctttccacgctatgaccctttttagttaaggtacccgatggcatactttatatattatatatatatgttaagttaatatgttttagcagatttgatatgctgatatgcagcacggactttccctctcctt

SEQ ID NO: 13293 - DNA, 416 bp, Saccharomyces cerevisiae
cgagaaagagagggacaagatgcactgtgtaaaatataaatttcgttttattttcttttatattttttaaaaatctttatctagtataactttccatctctttgttatggtgaaaacaaaaaaaaaaactgacttatttgaatggtgccgataaccttagtaaaggaaaagggtaagcaggactctttatcgtgaacacggttgtcaaagcagcaaagaagacataaatgaataaggcacaaaaggaggccaaaatagcatcaatgaagtacgctttcttggtctctggatacaaatgagaccgcaagaattgtatacccttgaccaatacgacaaccaacgcggccaatgttccgtaaataagaaccatgacttgagtttcaatggcgaattggtgttggaattcattgggcaag

SEQ ID NO: 13294 - DNA, 414 bp, Saccharomyces cerevisiae
tagattgttccgaacttgttcagttgtatgtaaaatagtttccaaatgcgcccatttatacataattatctttgtattctgacctaaactaaatatatatatatatatgcacgtattaaaaaaaaaaataaaagcaaaaaggtaaacaaagagaagtaatccgcaacttgtacaaaaagaaaagaagataaaagaattgtatgtattaatggataattgtaatgcctgggacaaattattgtctcagaatgaatccacaatcaacagcacagagactgctacgataacagcaatcatatattccccatcaagtaaaacactgcatcaatttataaatatctgttttccagagggaagcaattcaatactggataccactttgattaattacgccaccataggatggaccaacga

SEQ ID NO: 13295 - DNA, 497 bp, Saccharomyces cerevisiae
tgaaccgtcagaagttccgatagttcgaactgtttggcacggctgacgaaatacttttaacgagcaagttagtctacacataacttcgtacttaccaccgttttcttctggcgcgcctcttcaagtagactaccacttccctcttgtaatagttgttatatatgttttcatagtctgatttaaattttacgcatattcatcaattaacccaatgcaccaaaaaggcgggaaagaagcagtaaagcaaaggcctttgccaagccttcttatcgacagaagcagcctcaaaaggttccttcgagagcggcgcgcgtatttattcacatcgcgaatcactggacccttaaaataaaggcgcctattcacgacatctgccacagaaacaactgttcagttatcctagcagcagtttttgcacaacggtataaacctgtacaaaactttagcaaggttttttaacaacaaaagtgcttgagggacacaacacaaactataga

SEQ ID NO: 13296 - DNA, 469 bp, Saccharomyces cerevisiae
ctgcacaagcggtttatgaataataaattcccaagaaaatacatatataaacatacacatttctcttttgtaaatagaagaattaaaataaaagatttttggtatcaaataaactggatgaatgttacatgtaccaagtgccctggcaatacaataaagctattggtctggaagtattgatattattcaaatgtaatcttcgagagttactgcgggtaatacacacatgtgtcacatatttttctctcgagtatgaaaaaatttcattacctttgtaaaagcttaatacgatcatttcaatatgactagtaataaaggggaaagtttgcgaaaatggatgatttttcaagagataccgaaaactttgtttgctggttaaaaactaccgctgaaattgaagtatcccctaagatagaaatcaaagatctttgttgtgataatcaaggccgcgcagtagttgccactcaaa

SEQ ID NO: 13297 - DNA, 450 bp, Saccharomyces cerevisiae
taagggccattcatcccacaatctcaatatcagtatattctcttatttattaattgaggttgcgtatttatgttttctttgtggtatataatatatcattatttattgcattttaaaactttttttttcattatttttctctgttgaatgcagtcaacatctcccttaatattcgatactcatctttaatactatcagcaaaaagtttaagataaaatattcttaaaaacgatttcgcccaggatcgaactggggacgttctgcgtgttaagcagatgccataaccgactagaccacgaaaccactatttgttgaaatctttaacaagcgaggaaactttagtgaaatattaaaaggactaaaccggaccggttcttctatttctacatatctaatcacccaatgtagtttttgaatatttgtgaatagttggataattgttgggatccc

SEQ ID NO: 13298 - DNA, 420 bp, Saccharomyces cerevisiae
tgaagaaaaggtcatgccatgatttatttaattttatataaaacatctaagcggaaaagttgaactgttccgcttcataggaggagagggtttttttaatgagattttgttacataaactgaaactatccattttgatgcaatgcctcttttttgttcgtacctatcttggagcatgcatatgaaaaacctcgtttaagcgatgcgatgcgaagccgtatgttcaacaatgcgcattctgtttacattattaaggaagcatctaagaaacagctcaggattatattactactaacatatttctaaagttgacagattataaaagttacaaaattgtcaattgaacagatacaaaaattttataaatgtttaagaaaagcaggcatttgaagaatgtgtcaaatgctatcaaatccgcgag

SEQ ID NO: 13299 - DNA, 450 bp, Saccharomyces cerevisiae
aataagtcatgagaaagtttgaatatataatttaaagtacttggtatatacacattatattttatgcatgttccgaaggaggtatttttagtttggcttttttttcttattttttcttcaatttacttgataaatgaaatgcaaggaagttcagtttgatattatataagcaatagtcaaaccatggcaccaaacccaaacaacaataattgggatgcaaaggtagtaccccattgtttcatccaatcatttttgtttttaaactcccaatcttctactattttggttaaatcaacatatagctccatggtaatttggtctagtatttgattaatgttaataagctgtaaatctgacaagtttttgaccatcttacagcgtaaaacaatttcgtttgcattagtatttggttgattatgaaacttgatgatttccttcgtggaattggaa

SEQ ID NO: 13300 - DNA, 447 bp, Saccharomyces cerevisiae
gcccgactgataacaacagtgtagatgtaacaaagtcgactttgttcccactgtacttttagctcgtacaaaatacaatatacttttcatttctccgtaaacaacatgttttcccatgtaatatccttttctatttttcgttccgttaccaactttacacatactttatatagctattcacttctatacactaaaaaactaagacaattttaattttgctgcctgccatatttcaatttgttataaattcctataatttatcctattagtagctaaaaaaagatgaatgtgaatcgaatcctaagagaattcaacagcgtaaaatacaaagaggataacgacaacgaaaaaaaatacactccctgattatgatgcctctgagcttgacattttcgttgtcaaccaagaaaaccatgagccaaaaaagcgtcctaacgctcccagtag

SEQ ID NO: 13301 - DNA, 437 bp, Saccharomyces cerevisiae
ttacatagcaacaatgaaaatccgaaaagtcgagaccttcaggtcattttcaatttggattttgtcatgtttttaagaatcttccgcaggcaataatacatctcatatgttttacatttttattgacaaattcccaaattaggcaaaaattcctcttttttagtggttagaaacgccattcttcccattttttcgcgatacaaaaaaagaaatatatggaaatgtggaaatgtcatcatcagaagtctcgaaggaaagtgtgcgctttaatcatccccatactagactttgtaggagaagataatacaattttcgttttatatttatacagttgattgaccgggaaacgaagaaacgcaagagaaaacgatcaaaatacacctgttcttcgttacgatatagaaattaaatgtttgttcatcgtctctggacactcg

SEQ ID NO: 13302 - DNA, 444 bp, Saccharomyces cerevisiae
tgacatatatatagctcgcagtagaagaatgcagcgtaacataatataatataatatagtacggcgccgccctccattagaacgcgcaacacaataaagacaaataaaagaatcagctataaagctggccattgcatggttcgcgctggaaagagaggaaaagcgtggtgataaagagcgaaccaagcatattgttttccaagaatgagcaacgaagattacggatacgactacgattatttatttaagatagttcttatcggcgactccggtgtgggtaaatctaatctgttgtcgagatttacaaccgatgaattcaacattgaatccaaatccacgattggcgtggaattcgctacaagaaccattgaagttgaaaacaagaagataaaagcacagatttgggacacggcaggtcaagaacgttacagggccatcacgtct

SEQ ID NO: 13303 - DNA, 405 bp, Saccharomyces cerevisiae
gctgtaagcgagatacataagaaaacagagtttctctaaatatattcttcctattgatctttggcaatccaacacatatgcagttcgtgcacttgcgttataagcgtgacttctcgcttggtttttttttataatttttttttaaaacctcattctaagtacaactttggcgtttttccaagctactacttataattatatggtttatttcataaatatatatatatatatatatatatatagaaaatcaatatacatttaagccttactggagatgacactatttttgttcacattttttcttatgctctaaatacctcggcctcatacgcagagacagtgttgatatgtttttatacaaagtaaaggcaaagagaaggcacagacaggatttcacaggcagct

SEQ ID NO: 13304 - DNA, 484 bp, Saccharomyces cerevisiae
tttattagcattgatattattattttaaaaagtctatttacttgtatatttatccgaatatgccatcaatggctgatttgttcttctttttccttttctttttcttcttacagttctctgtcagaggctttggtatagacgttatcactagttcgttttcttgaacgttgttgccaatatcttcatctataatttctccaagttcttcgacatcgttcacaaccgattttgcttttgttctcggtaagttctttattaagcatccacatcttataaactcagtttcattaatctcccataatctcatatacagtgccctcacatttgccagcaatgttactagtgtacaacccaacgttacaaattgtcccagcgcaattacgccattgaactgccagtaccatctctttaactgtctaaaaagtgctctctgtaatagcctgtgcaacttgacccattcaacatctttaaggcgtttggcttg

SEQ ID NO: 13305 - DNA, 436 bp, Saccharomyces cerevisiae
ttggcgtgaggataaatagagaataatcctaagactgtattttttttatagtaataaatgcgaaatcattagccacttattgaaagtttaaacttctatcgatacccacaaaaatactaaagaaataaaaaaaactattatcaatgaatttagttccgcgatgacgaatttaaggtgtgaacacacctcatcgctcaaatatataggaaatgatgatagctgtggtctacttttcaatacagaaataatcaggttattttcgctcaactgtttgttataatcatctaccaggctttgaaaggtttccctgtcatgtgtctcttgtgccacgaaattttgcgttgtgcaaaataactggctttccaaaaaggcaatcatttctttccatttcatcacttcattagttataaaaaggagttcccattgcaggagaaaa

SEQ ID NO: 13306 - DNA, 442 bp, Saccharomyces cerevisiae
tagcacataagtaaaaatggaatacggtaataactatatagaaatatcttctgcaggaccaaggttactgagtggtgaatgtaaaattatttattcgcttgcgttatatttacatgtggtatatccggatgcatagagcctactatagaaattttgggattttatcatgttctttggcgatttcattcaaatcacctggttggttcatcatcatatggacatcaccacttaggtaaaccttttcatcttcttttttcgacttttctaaatcttttagaacattcaaatcagtgacaatcccttctttgttcttaacgccagcatctggagttttttcgattacttctttttttgcctcgtctattatactttgccagatctcttccaatgactcttccttaggaaccacaatatcagtctcatcttccttcatcccagttgc

SEQ ID NO: 13307 - DNA, 496 bp, Saccharomyces cerevisiae
tgagttctatatgtgataaaatgatgattattgtaaatccaaaacgtaaaaccgaaaatatgataaaaacgagaaaaaaagtaagttaaaaaataaaaaaataaaaaaatgaacgccggccccagagggaagaacaagctatttattttcttttttactttatctttcatggtcatatatatatatatatatatatatatatatcttctataggctactatacatgaaggcgttcgcccttacaacgttaagtttttttccctattgtaccgtgtaagtttcaattattcgcataattcatgaatgaacttcttcacatcggttgatttcattagggcttcacccactaaaaatccatggacaccttcttttttgtatttttcagcatcgtccctggtggtaattcccgatagagcaattagaagaacatcctttggaatagattctaccaagttactggtggtatttaggtctacgttgaatgaatgcaggtccc

SEQ ID NO: 13308 - DNA, 490 bp, Saccharomyces cerevisiae
gaaattagaaccgaatcaaaatagttccgatcctaacttttctactaatctttgagattttatctcattaactctttgaccaagctatgaaatgcgtaagatgaacttttgtttgagagtgttaagtatttaggcgtctacgctatgatagcctcactctaggacgactgcttttttggaacaacttgttgttctccgatggtatattgtgtgtttatgtattgttctacgtactcctccgtctctttttcgagggcaacgctttgaactagtattttccgttatagtatgtcccccctatatgcaaccccttgaatggacgaatctctaaaatatacaaccttttcctctataggaaacaagtagggtcttctacgctaaggattacataacgcatgtatcaaaaactgattttaattgattaatttcaaaatgtcagcgtaggttcacctagacttgttttatagctccattcaactggcggtagaca

SEQ ID NO: 13309 - DNA, 493 bp, Saccharomyces cerevisiae
gcgtgaagaaaagcaacaaaaaaataaaagcatgtgcgaactctagtttaatacttaataaactattaatactttacaattagcaatctataatatacccaccttaacaaataatttttcctttaaccattgttaccttgtttaatccgcgacgccgcgctagggcatgtgtgatttattcatttactatacagccgcaaagaaacaactaagaataaaatatccgacaatccatatcataccaaaattttgggatacttggtcaagatgcgaactgagttagttcccatttggttttgtaaactcaatttttctaaagattcttgcaagaatgcgttttcttcatctttgtcctcactttcttcatcatctaaatcttccatgacacagcacaacaagtagtccttgataatgttcactatacccaacatctctacgaaatcatcctctatctcgctttcgtcatctacttcttcaatcgccagcttactca

SEQ ID NO: 13310 - DNA, 481 bp, Saccharomyces cerevisiae
ctgtgaaacgggcgtcctgctttttcattctacacaggcatatgtaacagcagtgtataggctatgtaaatcggcccaatcaacaaacaagcgttgcttattggacttgctactaccccaacaaaggagagagcctttgattgcatcctcggaagagacggcataaacaccgagcctcatcctacaatgaaaaaccacgccagttggatataaaccagaaaagggtttcaattcagtatccaccatgagcaagacaagataagacaagattgcataaaaatgagtgcttccaaaatggccatgtccaacctagagaaaatattggaactggttcctctttcgcctaccagttttgtcacaaagtatctgcctgccgcgcccgtagggtctaagggcacttttggtggaacgctggtatcacaatcgctgctggcgtcattgcatactgtgccattgaacttcttccccacatcgctacatt

SEQ ID NO: 13311 - DNA, 433 bp, Saccharomyces cerevisiae
caaaaagtataaaacacttcggttaataataaatgatatgtgaatttttttgaaaatatgtaaaataaataagtaataaataaaaataagatgtgtttatcgtaatgtactatacaagccttccaagccgacttctgtaataaaaaaaaaaggtgcagcttaatgtttgacggttcctatcctctctcccttataagctgtagttaaccaatcaactcaccaaacaaaaatggggtgaatactctaatagctgtgatcaaaatcataataccttccaataaagccattggtaatcccaagaaaccacgttcttccatgttcaagtaaatggtgtaaaaagcgacagcgaagaaaaccctggtcaattgcaaaggctttggcaagacaccagacagaaattcaacgggtttgttgacacaatcgccacctcttt

SEQ ID NO: 13312 - DNA, 428 bp, Saccharomyces cerevisiae
caatgaacaattttccaacgtataaattaacttatcgtagttcgataaaactagacagtacttatatattatctaacatcagatggtttgtctttcattatttatttagtgattaatgctagctttaagcaagcttagttgcctcaagaaagattaatattaagctactgaggatatagcattcgaatataaagatataatcaaagctcataattacaaaataccctgtgattaggatatcattattactaacaacaccgttcctaaactagcagaaagttgaccaactgtataaaaattaaatttgttcgtaaatacatatacataaaatccgcattaaatgtggactttcagttgagcaagtgttaatgaatatcgtaggatagcaaatgaagattcgaatttgatgaggtctcttgttccgagaa

SEQ ID NO: 13313 - DNA, 450 bp, Saccharomyces cerevisiae
gaagcttctaaacaaagtaatgctatatacgaaaataaaccacatgggaatatgttaagcgcatgcatgtatgtaataaaaacgaagacaagtccaaaaaaaaaaaagaacgaaaaagaaacaacttttatatttgtatattagagtataaactaatatccttatttcaaactatcacattccactattttttttgtgttctcctcagtgttgagaaacaaattccagaattacctgcaaggaatctctcttagattcatccagataatttatgattttttcgtacttaccggcatcttcgttttgcaaattcttgaaaaaggtatgtacttcctggaaaacattaatttggtctaacactgtctccttcatatcatcatcacattcgataaagtattcttcttcttcttctggggtcaggtctccttctaaggatttgccctcggtaac

SEQ ID NO: 13314 - DNA, 445 bp, Saccharomyces cerevisiae
ggttttatctaaaagtaataatcaaaatatttgatagatttatttactttactgtatgtaaagaaaatgtggtcagtcctcacggccacttagttactgatggttatttattatggaaaaaaaaactgcactttgctacttcttctatttatattatgtaatatctactccggttcaaatattttattgatctcttgctcattctttttcctcgtttcaggaactagtatccaactgaatattatcaacgctaataggcaagcagcaaatatgtatcctagtttgaaatcaattttggatacaatcattggtgttaaaagtgatattaagaaattgaacatccaattgataaatgtgcaaatagccattgatatggccctcgttcttagagggaacaattcggacactagtacaaatgtaactgggcccaatgttattgcaaacc

SEQ ID NO: 13315 - DNA, 408 bp, Saccharomyces cerevisiae
aaaaataaaagttcatgtcaaggcatataatgaaatttccatacacgcatacataatgtataaacataaatgtattcaagaagcttaagaaataaaagtaatgaaccttgagaatacatcaagatataactcatcacatgttaaagaacccacacaccacacgcgcgagaactgggagggagagaaatttagcaaataacaaaatttaggccttggaagaaaccatagcaatgcaataatcgttattaacataatatctacattgagaacttcttgggctagtggttttgctgcaaactggaaaattgtatcaatcttttaacgttagctaaacatcttctgctgtgttagcattaggaggaagcgaaaaggaaaatacataatgaaaccgacacaggattcacaaga

SEQ ID NO: 13316 - DNA, 437 bp, Saccharomyces cerevisiae
tacggacaacatactttatatgactgatgatgatgtaacaagcatatgcaattatttggtttccctaaataaaaaatcccaatcaatatcttgattattttcaagacaattactaggatgttcttctatttttttatttttatttgtatattgtatattctaaaaagaagaagccatttggtgggctttattataaatattaagaggcatacctccgcctatccgcctatcctcgtcatgaacaatcaattaaaagcgcttataaagcgatatacaagtacagtacgcgcgatttctacaatacaaaaaatatacatcaagaaaaaaaatgtttccaaaaattatctaaatgcatcgaaggcattaggagaagtagctgtgaatacaacaccaagattcataaaatgaacacacggttccttccgcttggaaaataa

SEQ ID NO: 13317 - DNA, 494 bp, Saccharomyces cerevisiae
attccaaattgaaacgtaatactatcttattgattaaaatcactatttacttatctaaaatgtacctgcgaagtctgcatgacatattctctcttcttttattgcgcatacctcgtttactcatactcagatgttctacgacgttttctatggttggcagtagttacctattgttgacactccagtattgggtgtttcccatccagcataatcccggtaaaaaaagacaccccagaatctaggagagctcctttcgaaggtggaaaagcgcgttttgctgtcaatattgatgtttattagtaagtgtttaccgtttcttgatagctttccttacgtaacaattgttcttctgctttccttcgtaggaggaacgcgccaaggcaatttttctcgagaggtatgaaaaaaataaaaaaagctcatttccatgacaacttcaagtaattgaccatctataggaaccctaagacttttggcaacttcgacttagagct

SEQ ID NO: 13318 - DNA, 415 bp, Saccharomyces cerevisiae
caactcagcaagatttgattttttgtcttgaattcaatagttaagtctataaatgtgtaaaataaagaaaagtcttttttaaagcgtatatatcattgtgctcacatgtgctaacatgtgagcactccaagctttctcttgtcagctggatatttttatattttggccggtttatggatagaaaacacgtcaaacgttcgatggatcttataaaaagtaatgatgtaaagcaaggtacaaaaatgaaagaagtacggtttactgttatataattttcgaaatcgttcaactctcttaaagttcctcacgaaatagatatgattgctaacataacgcaaaatttagtacaagatatatgatttcttactgctggaagatatcttccaatcttaatcttggggctatgttcatggat

SEQ ID NO: 13319 - DNA, 441 bp, Saccharomyces cerevisiae
aatagaacaatacgcacacacacacacacacacatacatacatttaagaacattttgtaaagaaagagaatttttttttttaaaaaaacagctaatttttaaactgaactagagtatatgcgtacttaagtttatatattccacctcgatttaagcgttttttttttagaatttttttattactctgctattcattgaatataatattaaggaacatcacacatcataaagaaaaaaccatgtaactacaaagagttccgaaagatttacttcttggttgggtcttcttcaccgtggacacgaccggaaacatattcgacggcatcgttcaacttggacttggcggctcccatgtaatctctagcttggtctgccaaagattcaccttgaccttcagcgttatccttgcctttttcggcagagtcgtggacaccttggaag

SEQ ID NO: 13320 - DNA, 413 bp, Saccharomyces cerevisiae
taaccactacacaaataggtatatcatgaagttatattctgaccgtaacaattcttctttctttgacgtaaactttatggcgggtaacgctcaaatagtttcttgttaaccatttcaaataacaataagtatacaactaaacaaagtctgctacttgttaaatataggagtataaacaagataagcttgctactttttcagcacaaccgccacctctcgattgcatacaatggattacctaaaaccagcgcagaaggggagaagacgtggtctttccataaacagtctttcggagactcagcaatctgctatgaatagttccctggaccatcttcagaatgacttaaacaggataaatcttcaatggaatagaatactgtcggataacactaatcccttagaactagcgctcg

SEQ ID NO: 13321 - DNA, 480 bp, Saccharomyces cerevisiae
cacaaggactaggatactgttatttttatagccaaaaaatgaaaaaaaacagcatggcatcttgttagttctgttgcaactcgcaggaagtaacaaaataaacactataatatttccatatatttatatatatgtatacaaacaccttgttaacaaaaaaaaaataaacgaactaaagaaaaccgtaatgcagagtacaccttgaagagagagaaaagaaaatctttgaatccatagcataatagcgatcaacgaaactttttaagaagtaaaatgaactgaaaggagaaaaatataacggaatcccaatgtataataataaatagagagcggaagaaaaagaataataaggggaattgagggtatcaaaatacaagacattcttttaccgaaaagaagaatgacttaatagaaaacaaattcagcagatccagataaaacagaaactgtgcaaccatcggaaccatctccggtgaaaga

SEQ ID NO: 13322 - DNA, 466 bp, Saccharomyces cerevisiae
caattttagagtattctgccattttttttatttatttatgcacatcgtttaaaaaagttcatttgcagcggaaattgcacctttgctctctcgtccctgtctctaatgaggcacactggttacacatttcatgaaaaaaaaagaaaaattgtatgtataatgcttgtcactttttttataattgatatatgtatatgtatatgtatacatacatatatatagttgatttagaatttatttatattaaacaaaagacgaagagagggcagataacaatatttaaaatgtttacaaaccttgttgagctcttcttctgtcacgttcttcagcaatagacaacttgatacccttaccctttggcaaagaaatgtaaggcttaccttgttcaccaatgacgaagacattgttcaatctagtgacgaaagtgttgtccaaggagtccttgatgtgaaccaaatcgaaacca

SEQ ID NO: 13323 - DNA, 426 bp, Saccharomyces cerevisiae
ttatagaatgtaaacggcaaattttacatataatcattatttttgttgcatttgcttagatcttatgtaagaaaatagattttctactctctttgcataggatacatccgcagcaaaattatattccgcatcatttgcggtaaataaagcttcattccgcatttctttatctctttttgctttagatttttggaaaatttctgaatccatatgaaatagagtttttcgctccccaaaaattttgcgcaattccattatgtttattggttgaatggtccctttttctgacttaaatggtttattctcaacataccattcgccgacgtcatctgttatctgcaaaactctatcggtgttttcttgtatatcaatttctaagctggatagccattcagaaattgcatctccgatttgtattggcaacct

SEQ ID NO: 13324 - DNA, 410 bp, Saccharomyces cerevisiae
ttttgaattttgaagaaagccattaatatttaaatgtaattttgtgtagaattataataaattgatgtttatgtatagatctctcgaaatatatttaagaatatataaataataaatgtacaacaataagcatagaacatggaatgagtgttcaaactatattcgtttgttttttagataggagttctccagacgttttcatccaagttttgttttgcatcatttaaagctgcagcaagaactttgctttcttcacttgcagactccggtttgacttgagtttttttaatggaaagattcctcaaactagcggcattgacatttacatttcttttcgtgcttcttaaaatcaaggaatcatttgattcgagattctccttctttatttcaggttgcgatatcgatggaac

SEQ ID NO: 13325 - DNA, 407 bp, Saccharomyces cerevisiae
ttcaagtgaatgttaacaaaaatatactttatagaaagaggatagagctaattttctctgtttatcatagatataagtaattgtgtagtatcccaattttgggtagaatgtggtatatgaaaacagggcatatgaaacccataaggcaacctaacactttttccaagatagtatgataataaatagcggtaacccagagaatacatatccaaattactaggacagcgcaaacaatggcaaggcaagctcgtacccacttattcacaacccaaaacatatcttcagcttgaacaaatctactgaataagtgaagttccatccaaagaatcatgcttatactcacaagaaagcagaagtgtccactaatgtcaaacccaccatcccatttcccattttctagacggcac

SEQ ID NO: 13326 - DNA, 406 bp, Saccharomyces cerevisiae
aaaacgaagtgatatctttacatctttttagctctttcttacaaagtaaacgtaaaaatatccgtaaatataacatataaccattatctatagaaaaaaaagaaccgaaaattgtgtcaggccctacttcccgtgagctaacttcattcttgtcgaaaacttgactagggtcgtccagtcgcaaaacatatcacatttcggacatttcccacctcgaggtatcaaatttcttctccctaccatcaactgttcatcatctagaaagtacctgtgaagacatttcaagtggttaacacacccacagtctttattattgcaaagcgctacaaacggcttcagattttgctcttcagacgtgtagtcaatttctttctcacaaatttcacatcgcactacccctgtagtt

SEQ ID NO: 13327 - DNA, 497 bp, Saccharomyces cerevisiae
atagattcacgtcctaaatcaaagtttaaaaaggaaaatacttattaacaagaagagtagtagaagaaaaatacaagaaacataaacgtagaaaacttttagtcaattctttaagcgaagaatacgaaagaaacatcaagaaaacaaaggaagatgcaatcatcactcgtcatatacacaaataattccctttagtgcaacaaaccgcgaaaaagcataagaaacataaaaaaaatataaaaaaaaggagataataataagatgtgaaggatttgaattagtggaaaaatgataagtctacactattattattaacgaaatgcaattttcctttattttcttttattactattatcattactattattattagtattattatttttttacttatttttatattaaactatgttaaattactatattattattttgtctaactctatattgaggctgtctttcgttgcactgttaagaatggtcacgtcttcctttgg

SEQ ID NO: 13328 - DNA, 500 bp, Saccharomyces cerevisiae
aaaaatgaattgcccgtaaacatttaaatcataccgaggtagaaggattatggcatgttcctttttttttagagtatgtcaactggcgcagtagatacatgtttttctcttccacgtcgaattttgttatatacatagcataatcgagttgtatgcaccctttttgtttatctcgttagtaactcggggtaggaataagacatccacaaaggtgacagaacaaaatcatcctagccttgttcataatctacctctatatagccgctaaaaaattagtagtattttgactctttaagagcacatttattatcaggctgcttttacatacttcttttgtttaaaacatttaaagacgatcactgcccttccaaaggacaaatatatatacacaaacactaggccaaaagttcacttataataatttagtggtaattatgttgggtaaagaaattgccaatagtcttttttttccgtattgtaaggtgagactgaggtagcgg

SEQ ID NO: 13329 - DNA, 488 bp, Saccharomyces cerevisiae
aaccttaaaccaaacataattaaacctgtatttcatatattatttccacttagcttagccatccacaacggtaaagttacaaatatataagtaatagttgctttcataaaaattattaacacttctttcgaactcatcgcagaagtgtcgccggcccctcaacttcgcgccgtatcgcttttttttttttttttcaatacaggatcaagacgaaaaacacttttctgttcttgtttgtctctgttggttggattatatctccaacaaaagggaaaatcccagtttgaccttattatattagaattgtcttttgtcttctttctttcattttgtacatctttctgtcttctcaaatcttttttttattttttgtatatataaaactaaagctaaaagactatggatacctctcacgaaattcatgataaaatacccgatacattaagagagcagcagcagcatttgcgccaaaaagagtcggaagggtg

SEQ ID NO: 13330 - DNA, 419 bp, Saccharomyces cerevisiae
aggctgacgtaatgtctgaaaaatatataaaaaaagcaatttctacggtgcatggacaaagacacagggtacgtatgtccttattcctctttttctcccccctcccattgacaattatgataatgacataaagttgtttatatatttttgtttttatatagatgctcattcagggtttgttatatacatagacataagagaataactttttttctttctgtatttcattttattgtttataatgttttcctctaccaagaaaatagggagaaatggaagataaagaaacactctcctctattcctgttgatattcagattcaggctcgctgtcgtttgagttcgagtctatgcctgattctccgttgtcatcgtcgtcagaaccatcacttgaagtagagttctgtgctttttcctcgg

SEQ ID NO: 13331 - DNA, 408 bp, Saccharomyces cerevisiae
ctcttataatttgtttccctcgacttctctatttaaatccaagattttaactaataaactatttaataataaaacaattaactctttatatggaagccttggaaattagccgccaaaatgggatatacattccgtgcgaagtgaccgcgtggaaggccgggtatcatcttaaaaatcactagtttcttttttagcggaatgcaataaaggtgctttgtgctggtgtggtttacacggaacatctagtagctaaaacttggtaactcaatggtgatcagaatccatagaagcatttttatttcttaaaatgggtgctgctccttccaaaattgtggatggtcttttagaagatacaaattgtatgtacacttcggagtgaggaaaagaaagaaaggggaaattaaccga

SEQ ID NO: 13332 - DNA, 466 bp, Saccharomyces cerevisiae
caaatacgttagtaaagggttttcatagtagtaatatcatctcaaaaattctgtaaaaaaaagtgtactagtatatctgatggtgttgttgcgaatgcccagtagttcatatagttctacttacacctcactcatctaacaaggtcggttgattagttcaattgtttcagtgagaagattttaacgataacacttatgtactaaggtaacgtacctaccaagcatacaaaatacgtaacaatataaaaagagacggttaataagttccgttaaaatttcgtcatccagttattagaaaactggatggaacctttttcttgcacattaaaaatggcatttgtccttgtcaggatttgggaataaggctcagttaaccttattaacttttgtgatgtttttaacatgacatattacaggcgtcaggatgggcgaataatctagaaatcggcaaaagaagcttcgaaaa

SEQ ID NO: 13333 - DNA, 472 bp, Saccharomyces cerevisiae
ggcaagctttctcgcatttctttttgttactgatatacacatacctatacatacacatgtctttttaacatcataatttttggtattctatagtgccttccaatttcttaacttcagctacttttcttacggctttcattaaatcatcagggttgatgtgatcacggtcatctcttatggcgaaaaaacctgcttcagttgcacagttacgaatatcagcaccattgaaaccatcactcatttttacagcagcctcgaagtcaaattcccctgtttttttgacttttgcagtatgaattttgaaaatttctaatctgccggcctcatttggcaatgggatttcaactttcctgtctagtctaccgggcctcaacaaagcaggatctaaagtatctggtctattcgtagccatgatgattttagtctgtccaagattatcaaaaccatccatctgggtcaacaactccatcaa

SEQ ID NO: 13334 - DNA, 482 bp, Saccharomyces cerevisiae
tgtaaggaattcactagttcataagcatatatacttgttttaatatattccctaaaactgaggtatccagttcttttgttcttattcgtttgatcatcctttacgtatttttcgtctgcggcagtggaaagaacttaaaaaacgaaagataataaagaaaaaggccagtcggcacgaattaaagaccacctgtaagaagattaagacaacggtggtataaactagtgtcgaagtccaaaatgcctagtcatcgcaattcaaacttgaagttttgcacagtttgtgcatcaaacaacaatcgttcaatggaatcgcataaagtcctgcaagaagcaggctataatgttagctcttacggaacaggttcagctgtgagactgcctggtctatcgatagataagcctaatgtgtactcatttggtacaccctataatgatatatataatgatcttttatcacaatcagcagaccgttacaagtcg

SEQ ID NO: 13335 - DNA, 487 bp, Saccharomyces cerevisiae
tcaattaccttatttatttcctcactattttacctatcacaagtatatatttaattgttttgacctgaaacataatttatgtctagctgcaatgaagacaattgatcgactttcacaaactttttcaatctactaatctttggaagcattttttaactgtctcccactcttgttccatgacttaaatttctcttcctccaaattaactgaattttttttctggattgatgttctttccaattgttgtggtaatccacagctggtataacataaaaagaagttttttgtaaaaaaaaaaaatttctcagtaagcatataagcctcagtgaaataaaattttaacaactacacgctattctattccatttgccctgcttttctcgcttcgttatcacctaaccactaagaacatactaataatacaaaatttttatccactttttaccaacagattttcatgaaatatccatcttctttccgaattctg

SEQ ID NO: 13336 - DNA, 417 bp, Saccharomyces cerevisiae
aagaaataaagcttaaaccaagggaagcaaaatttgaaataccgaaggtagaacaataaggatgatgggaaaaaaaagataattttttttttttgtttttccctgcttccttcttgtttattggtattattatgttacgatattcattcattatcctattgatattttctttatattcactaaaaaaaaatttattctataagactgactataattttttttactcccaactgtaagtaaataaagactcacctacgcatacattttttatatatactataagatgtaggatcttaaagaaaaataaagagaaaaagagaagcacacaacctgcgataagttgtaagtttgcctcaacagctattctactcactttttgtatcttcggttagtattattgggaagtcatgttcatcg

SEQ ID NO: 13337 - DNA, 421 bp, Saccharomyces cerevisiae
ctctcttaacctcggcaataaaaaaacatttttcgcaagtttagcaggtcaataataataatatccttataaattacactcagttttttattacatatgggcctttagtatatacatacgcatatatcttagctttaccgatcttctaatattgcggcctataacgcatagaccataaaagaaacggagcagatgcaattcttcaaaacacttgcggccttggtgtcgtgcatatcgttcgtcctcgcttacgtggcacaagatgttcatgtatcattcccctccaccgcaggaaagtctagggtaatgatcggtaaagttgaacccagaataggaatcgatgaaactgttccgactacaatcacagttgaagaccctaacgaggtgattcaagtaaatttcgccattgagtctaccaaca

SEQ ID NO: 13338 - DNA, 494 bp, Saccharomyces cerevisiae
tgagtttatgctgagtttttgcgcatcaatattatttttactactactactactactactactactacatactattaaatatactaaataagaggaaaacgctttggaagtgactggcgccgccgctggctactataatagcagcgactgtaatttaatctcatcccgtcgtttggattacctcttttactcgccgagcgaacgtgcaccaaaaagggaaaggaaaaaaagaaaaaaaaaggaaaaaggaaactcaaaacttggataaatagaagcactcaaactaaattaaactgccaaaaaaaaaaaaaataaaaagggaaaagtttaaacatcaaagtacacctttcacccctccacacaccatggaacaacctgatctatcgtctgtggccatcagtaagccgctgctgaagttgaaacttctcgacgcccttcgccagggaagtttccccaacctacaagatctcctaaagaaacaattccagccgcta

SEQ ID NO: 13339 - DNA, 425 bp, Saccharomyces cerevisiae
aagatctaaggtttgtaactgagaaaaaaaaaaaaaacagaaaaagagagaagttgtacattcacgtgggccttatcgccacactcatccatctccaatgatttattttatttgccagtacgtttgatatgacatcgagttatgttctttagttactttcaaacttggacaaccatcccgcattatttatgagtggtatggtttcacttctttatttataaatatttatactacgaaattatatatagattacatttctaaaacaacatcaaatataaggtttatttatgcaacatgcctactggattagaagagagaacacacagctcacaggccaagcggaaataaagcagtcttttcgcaaacttgtaaatctttttgcaatttaaattaatcaagagagggcccaggaggagaggagtttt

SEQ ID NO: 13340 - DNA, 490 bp, Saccharomyces cerevisiae
tgaacaaatcgctcttaaatatatacctaaagaacattaaagctatattataagcaaagatacgtaaattttgcttatattattatacacatatcatatttctatatttttaagatttggttatataatgtacgtaatgcaaaggaaataaattttatacattattgaacagcgtccaagtaactacattatgtgcactaatagtttagcgtcgtgaagactttattgtgtcgcgaaaagtaaaaattttaaaaattagagcaccttgaacttgcgaaaaaggttctcatcaactgtttaaaaggaggatatcaggtcctatttctgacaaacaatatacaaatttagtttcaaagatgaatcagtgcgcgaaggacataactcatgaagcctccagtatacccatcgatttgcaagaaagatactcgcactggaagaaaaacactaaactactttatgattacctaaacacgaattcaacaaagtggcc

SEQ ID NO: 13341 - DNA, 449 bp, Saccharomyces cerevisiae
aattcagcgtcgtcgaacccatatgtattattaaacaataaagaacaaagacccgttaagaaatatcttacaccttttagattaacgattaaataaacaagaattctcgatttatatctttttattgaatgaattttttgattctttatgacttctgtaccctctgtgctaccaaacgcgaaagctacagtagtttatttattttaatgttagattaaggaaaccgccagaaaagaaaataaaaaaaaaatggagagaagagactgctagcggcaaaggatggaatatgaagatttggaactgattaccatttggccttccccgacaaagaacaaactttgccaatttatcaagcagaatctttcaaaggagcatgttgttacccagttattttttattgatgccacaagctcattcccgctaagtcaattccaaaaacttgtaccgcc

SEQ ID NO: 13342 - DNA, 424 bp, Saccharomyces cerevisiae
gacctgtgtgtggtcttttcttggtcaaaaacatccgtagtacctcgaatatatatgcttacatatataatgaaaaatacataatagcattttacatttattttatttccaggaaaaaaataaatcgctagcgtatcactagccttttccatcttcagtttttttccttcctctttttcgtctcgataaaactcttgaccattagatgctattactcccccacggagcccttcccacgctaagggggatgtcaagggggggactgaagataaagcttattatattgacggcgatgatgaagagggcgtacgcataaaatgtcgtacaagatccataatctgcaatattgttccctcaacagtactaataaatccaaagggcgaaggtactttattatataaacgcgcacggccattgtatataa

SEQ ID NO: 13343 - DNA, 463 bp, Saccharomyces cerevisiae
aagaaggactaagatattgaaaagtcctaatgtaagataattaccaatttcatattcattgtcgatttcacttcgcttaaagaatttttactgtttgttttttgtaaagcctttccaataaaaaatagaatgatagataaaggtcataactagaatggtggcgaacaaagcaaaacttaaattatctctgcatacaagcgtataatttccttatctatagtaatatataagaactagaaatctgcctattaattaattacctccctaatcttctgggaattatgataagtcaaacctggcgcctgagtttattgcatataataatttctctctcaaaattgttttgtttctataatctggcaattttaataaattaacacaggtagatgccgtaggcagcctgtatttctctgtccctgcatttctgataccaaattttggatctaatgccttgaagccttgc

SEQ ID NO: 13344 - DNA, 408 bp, Saccharomyces cerevisiae
ataagtacgtaagaatccgtaaaaagggttataactaaaaaaaaaaaaagaaacatttcaaaaataattaagtcattatatgattatacataaaaaaaggtgagatacaataaaactactgtcaccgctattaacactaattctgttctgagctaattggttattcctacaggaggaacaacgccctctctgttcttgttctttggagtgaagtacacaataaaatggccagctttcttgaaggcatgacctatatattgagcatcttcgtagacggagtagcccagcctacctaactcggcatttgatttcctgattatttctgcgattggtgacttttcgatgacttttgcgacacctgatgtatccagtaaattgtaattttcatcgaatgttagcgaacccact

SEQ ID NO: 13345 - DNA, 443 bp, Saccharomyces cerevisiae
aaagcattaccgtcacgcatcgtgttgcaaatagcatatacatatatatatatatatatatacatataacgtatacgttagaaaaatttgaatacacacattcatttatcctattattatcattttcattcttacccgctccccgctttcatccggtggcaaaagtaagaacaaataaaagctagacctagattgaagaaactattaagtaccaaaaagcaaacagtgggcacacgcgaggaaaccacattatatttcgcaagatgtttaataatcatgaaattgacaccatattaagcactctccgcatggaggcagatccctctttgcatcctttattcgaacaatttgagaaattttatgaagagaaattgtggttccaattgtccgaatccttgactaaattttttgatgatgctaaatctacaccattgaggctcaga

SEQ ID NO: 13346 - DNA, 436 bp, Saccharomyces cerevisiae
gaatctattcaggatgtaacttaatggcatatgtatttcaggatagaatatcgctcgatgaattcctgtacagacaactacaaacggacgaattttgtctgaccaagttaagaacagagaactaatgcataaaatttgttttgctgcaaaagtttccctttttttagagtataaatatcttttatagcaaaagacttaaaacaggttcacgtttttattagccgtttttgggccggtttttcgatgacgaacaaggaccaaacaaatacagcatcaaaacaaattctagaataagaaggcagaaagggtaagggcataaaggaaaccttcttttgtggtgatgttgaactgggtttagccaaaattacaacacatattaaagttttgttattttgcgataaagttattgctcttgagcatcaaagaaagtgggagg

SEQ ID NO: 13347 - DNA, 471 bp, Saccharomyces cerevisiae
acgactgcttactcagggagatctccgaaaacggcaattgctgtgcaccgtgcgacgttatgatcgccgcctgtcccgtacagacgaacaattgcaacaatgggcggttgtttagagaggttttgtgccgcgcccgggaattaccgggggcacagcaaaatacgaaatttccggcaaaatgtctctgtacgaaaatgaggccagcctttattcccgactaagccgtacgattatagtaatgtcacacgaagtggatactatacgagcagcgcacatacaatgtgcgtgcaagatttgccgggttggacaatcttaaaggccgataatccacgaaaaacgagacaaacgaagcgctggccctaaacgaaacgaaacgaaactaagatttcaagataatcgcttttcagatgacaatagtctcttgcagaacacaataagtgtggtaggtatcttgcaggagacatcgatttt

SEQ ID NO: 13348 - DNA, 438 bp, Saccharomyces cerevisiae
catatataaatatctgtatccttctttaagaaaacacaattgcatactttttccattataactgactgtttcagatcctgcaatagaaagtattttttaagtaatgaaatagtgcttccattgatagtaagtgagtaataagacgatcggaaactattaatataagtatagtttacatatatatatatatatatgtgccagacgataatatcaccgtagtttccggccgggttatgccacgcgaaaacgcctcgagccaagggaaaaactaaactacaaaacaaaacaaaacaaaacaaaaacatctactatatcgttttacccaattcagtatatccgtctacaacagttctcgccacccaagatctgtaaacttacaactgcaaacaaacaatgagagaagttattagtattaatggtatgttcgatttgcccgtc

SEQ ID NO: 13349 - DNA, 491 bp, Saccharomyces cerevisiae
atacccagttgagaagacgagctatttttctcatgtttcttttgtttattcacttttctatactttttcttttctattgaaatatatattatatcttatgtatgtttttttgtattataaacaagcaaatttcgtcttgccatttaccttctgatattaatcacatgtatatctcaattcaagtttttgttaagataatcagcgaaaagcggaccgatcctatcttgatctatatctcttagtttgttgaagttaatgaattgccttttcaatctctgcaattgcgccaacgtaacgacgttaccaatgggcaagtctacgaagaagcaaccatcatcattgatatcggtaatcccttcggaaacaatgactcttgttccgttacttaccccgccaatagaagtcaggcttttgatgtggttcattatggtttttattatcttactagtttcgatgtcgagaacctggatgaaattggactgagacgcagg

SEQ ID NO: 13350 - DNA, 476 bp, Saccharomyces cerevisiae
aaaaaccattgaaatctgtataaaaaatacatacacatacatatatacatacgaaggatttatcttctcattgatattctagtctctatttcttccgggaacccatctcttatacaatacttcaccaacttgaaaactattgaacaatttagtaaagttgtttgatttccatagtgctatcgcctcctgttccgagattagtctctccacgtagcataacacaaacgtcttctttgcgccgcccacaacacgggctatgctagaataccacgtataatctttagagacgtcgtggtcaagacccataacacaaaattcagcgtgttgaaatggtggccctctcttatataataaataatcgcagccgaattttataccagatcttacgcaccaaccgtgtgatctgtagtgatggtatataacgtatgatctgacaaaggagtgaatatctttatatttggcatcgaattgaaaca

SEQ ID NO: 13351 - DNA, 500 bp, Saccharomyces cerevisiae
tagtcgatcgtttcttattaaccaataaaattttcctttttttcatttatgtttcacttgctatttttttccttccccgttattatttttgttttagggtttctgtccactttgaacagattgtgttattttccaagaacaatacattattgtaaaaaaaaaaaaaaaaaaaaactaaactaaaaaaaaaaaattcactcttaaagtttagagttatgttctctatctatctttatctttattatatactattaaaaaccaagcttctggacattgtactattttataatcgaatttttttctctttaatttttataggaatgcatgttacttgtaattcttaaatactaagatttaatacctgttatatatctatacgccattgtttttgagatttatccatgctcacaatattataggggtagaacagtggcaattcaatcaggttaagtcggtaaattttgcgtgattcttttctatatcaaggaaaacgctgtcgt

SEQ ID NO: 13352 - DNA, 469 bp, Saccharomyces cerevisiae
aaaatgaccctaaactacttctaaaccctctcgatttctttcacgttcatacaacacctagttttatttattttcttttcaatctgagtagttgagttttcgatcactcacatagaactattttttgccatttaaataaagtattctctcaaatgatgcgatactataatactctttgccatatattacattcattcataaataggctatgtttctatatccgtttccgattctgtctgcaagcaaggttccctatcattaccggattgttcactatggttggagctcttcttttcccctgcacttgcatcagtctcagattcagaaccagaaatgtctccgtaatcttcatccgatcttcctgctgatatttgaataccattgtcttctaaagacactaaatgtttttgaacatcactgctactatcagattcaaaacttattgattgtgtgtcatctccaaaagagg

SEQ ID NO: 13353 - DNA, 400 bp, Saccharomyces cerevisiae
cactgaacaggaaattcgcatatgaggagatcttaatttatctcatgaagtaatgatacctcagcgatgtgctcgctcgttagtatgcttcataaattcattattatttttttttggaagtgtttttcgacaaaagttgcatttttacgaaggatatgtaaactcaagaagtactaaataaatataaatacaattcgaaaatttgaaaaaagtaggagacaacactttccttcctcacgaagaagttaagcttgggtttgtgacttactaacgtcaacgtacaatcgcgttacaaacaagatgcttgcattcttaccttacattacaaggacttagacgaagaaaaagttcagaaacactgcttacactattcaccagacccgctccttctcctaacatc

SEQ ID NO: 13354 - DNA, 412 bp, Saccharomyces cerevisiae
gcaatgccaatgatgaatatgtattgactttttttttctttgtactattaaataatacgtgtaattgttttccttacgtctagttaaaaaactatttatttatttgtattttaatgataataagcacttttttcctcgctgaaaattaagggaaaggaccaaatacaaaagtgattagaaggataacgagtagagaaaaagggaagtaaaagttaaaaactagaatcctagtatgacatgcattgcccaatttgccaccatagagcgcatgtagtgtactgtgcacattgtatcaatacgagcccaagtctgctactgaagctaaaactagatttaattttattaaaggatgagaataaagaacttaacgggaaagtcgaacaaatattaaacgaggccatgaactatgacc

SEQ ID NO: 13355 - DNA, 496 bp, Saccharomyces cerevisiae
aggattgaaacttctttactgccttttttccacttgcgataccgaggagtgtacatttataaacattttagtagcattctttagcgtatataagattttaactaagaaaagaaacgaatttacggagtttcagaatcagtttcttgccgttgtagaaaatgtgaggggagtttccctctacttgtatcaatgttacaagacaggggtagaaacctattacgtgttggaacttattttcttgaacactctaatcataaattctaaaaaactgtgactgtgttttcgtcacaactttgcggtgtacagatgtcgtcacataccgtgtgttgtttgggtgttttcctttcagctttttttttttttgaatttttgaatttttactttcatttgctttcggaggtcccgcttccgacaatagtccgcttcatttgtcccttcccatgaaagttcattcctttgggcagagagaccgtccttctgggaggagatggaattg

SEQ ID NO: 13356 - DNA, 431 bp, Saccharomyces cerevisiae
tagccacacaggcacttataaacttacatacactcgcatacactcacctactcacacacgcactcacacacacactctcactcgcacaccaaggacaattcagtacatacacaatttttatataagtttgataaactaaaagatgagggtgagtattcaccttattaatagttacagcctttatcgtcactagacacgacagcattggtttgtcttttttttttttttttttttttcctttccatcgttgtagcggatttggcgttgaagtattttgatataagtaaaacagaacaccaaatcaagaataataaaggaggaaaagtcgtcaaccaagcggattctcaattggtagaaaagcttttattattttctgttagccgctcttgggacccgttatttctgaacctatttttccttccgcactttgt

SEQ ID NO: 13357 - DNA, 488 bp, Saccharomyces cerevisiae
ccaaattagctttctttctatttcttaattttcttatatctataatagagaaaatattatacttatttatttgaagtctactttatttcacagttttctatttgcttctcacgttctataatatagtggaatggaaatatcaaacataatttgctgttctctaaaacacttgatattgatgcataaaaacatatatagatacatatataaatattacgtggtaatcaattggtagttgccattggtttattttgatgcaataccgtttctttttttccaccttaataaccttcttttcaagtcaccctcagattgctggtagatgttcagcttcttatcgaaaaacatttttttataatcatcaccgtgtttcttatataatttttccaaccattcttcttccctttcactttggctacgttcctttctgataactggtctagacgcaagttcttctaatttcttaaccacttcggtctcctcggtag

SEQ ID NO: 13358 - DNA, 402 bp, Saccharomyces cerevisiae
agcgattaaaagtatttgtgaatgataatattcttcattgtgtactctatacattgtggcagtgctaatatttatttaaattcataaatttccttttgtgcatgcgataatacagctgctcttttcgtccccacaattctttcgagtgaaagaccatcaagcttgctataaatgcatctaacagtggatatgtttaaatcggtattacctagaaaggcgttcttaccaataaatctgacaacttcattgtaaaattcaggattgtttggaggcttataaaaaacgacgctcttgacacccttgatttcataacgtctataatggtgcagtctttccgtatacaacataacttttagacgcccctgttgaaacaatgacctatttgcattgagctgtctttgg

SEQ ID NO: 13359 - DNA, 454 bp, Saccharomyces cerevisiae
aggtatacgtatttaagacatcataggaatttttttttttggatatgttcaacctcaagtctgaacactataaccctaggccagacttgtcttttcaaatgaatggcggattggtttatagtttgcacatacctttcttgtcttcattggagctgagcatcatgttttgaagcctcttggcaacttcatcaataaactcttctgtggttacatatgatgatctattagtctttccaagcatcaatgctaaatccttggtcatttttccgcccacttgaactgtgtccaaagtagccttttctagtaagtttccaaattttataacatcatctgtattgtctaattttcctctttgtataattgcccttgtccaggcaaatattgaggctattgaatttgttgatgtttcttcgcctctttgatgttttctaaaatgtctggtcaccgtaccatg

SEQ ID NO: 13360 - DNA, 440 bp, Saccharomyces cerevisiae
aaacaaccctacaaattgttctggtaaacagatttgaccagctcatcgcatgaagatttatcggaatggcaatttgcttattgcctattttattttttcatcggacattacaaaatttcatatctcttacatgtaagaaaaacttctagtttttgtactttcttaaaaaaactatattcagacatgccaattctgtaaaacaaattaataatatgtacttttatatctaccaaagatcatccttggcacatgcaattgattacaaatacgaacattacgcaaaggttttaaagctagtcacctactagggaagaaatgtggaggctacgggcataaaaaacatgcagtattttctcacgctctctttggcgagctttgaacagaagatggtgtctcctgaatagggcttaatgagtagtcatttgagaactccggtgtgg

SEQ ID NO: 13361 - DNA, 469 bp, Saccharomyces cerevisiae
tggcaatcgttaggagctttttgatccgattatcgaaagatagtatgttgaaatagcatatctgatacgcaccgtatatatttattctgtctttatagatgaataataagaattgaaacacctaaaacatcttgatgactaggttagtatatatatgtatacactcatttaatgactacactatgaagcgtcggggtaatgcatgtaaataaatagaaataaatcattgaaacaacgaaattctcatgtatgcctgctaaggattcaattttttgatatgtacggtcataatactttctgcttaacaaaaaacgagcgtaaacttttcatttgccatacacaaattataatgagaagagtaacttgagttaccgtccaccacattgcgcgagaattcacagactctgatatgtctctaaaggattcttcacgttctctcatcagttgttgctctctcctgatatccacg

SEQ ID NO: 13362 - DNA, 488 bp, Saccharomyces cerevisiae
agtttgtagatcaacctatttacgcgtgaaatgcatatgtagatgaatagtcaagaaaagaaaaagaaagtgagaatatatgaatttttttaccttgatttgaagataaaaatttgttatattgttacattgagtatactaaatatattcgttgcatttttcgaaattttgttgttcggtgatagcccttaaaacgtcttcatcaacaacgtcttcatagatctctttcgggatttccgacagtcccgttttcggtttattcaaatcgttatcgtgtataacggtctcatacacaatgcttgtgtcgctgggactatcgttttttgatctcctccatcctaaaacagtggttgactgtgtggattctggtatgtgtaatatatttgtgtatgcatctctcaagccttgttgatctacaagaagaaccttcactctatcataaaacaaatcgctattaaatctactacacgcagcagaatgctgataga

SEQ ID NO: 13363 - DNA, 428 bp, Saccharomyces cerevisiae
gttttcgagaggatttttatccatcatactgcagattttcatattatatgttcattagcttttcacgcttcctctcgatatttttttatttattttcggtttcatttttgtactagtagataaaaatacatacatgatagcagtgttatacaattgatattcgtaaatttggcattcagcattttaggtaaattccgtgcctcttttcttcttctctgatttcaaacattatttgtactgcgatgaataaactaacgcttgccaaaattacaaatttgaaaccagatacggtacagaacatatcgcttagtaattttttagtaccgtcagagcccaagcagaatccaaaaagattagcgatcatcataacccatatgttgaaaacagcaccgacagcgcaaacgtgtctgtaccagactgcgtcggta

SEQ ID NO: 13364 - DNA, 454 bp, Saccharomyces cerevisiae
taaataaaactagtatacagcaaatactaaataattcaagaaaaaaacattagatagagaggggcagatgttcaagctatacccattatattgatccacacttagtattaagatacgtctgtgaaggatgaaaaaaaatgtataatgtgactagaggaagtaaggagaaaaaacgatagtaatcgtattttaggttgtgcgtttttataatttttttttttttgtaattctatgcaaatgtaatataagtatatttaaagaaataatgagtcctgtgaaaacaaaaagaaaaaaagatcattaatgtatgttaacgtatttgctttgcaaattttaatttatttgttgttaaatgcattttttttttgtcgtttcagcgagttttcttgaggttgctactatcattaaaatcacaatccacagaggaagttgatctctttttcagttgggtggg

SEQ ID NO: 13365 - DNA, 410 bp, Saccharomyces cerevisiae
accattcattatgttacaaagatagcatttcaattaggattacatacgtatatgcattgctctttataccacaactctaagaatgtcgaaagttatatggcggcggtgatgttggaaaaaaaacgcggccgttttataaagaacaataatcgtctgactaggtaaagtaccagataagaaccgtttttattgcgcgtattggtatgttttttaaacggaatttttcaagattgttaaatacatcaacgatatatccattttaatcaccgtttacctttgtgtgttagctttgtatctggaagttttttctcttttcttctttgtccttgccttctaccattttgccttttgttcgagttcgtgattacatcaggcatatacaacatcacgtttgttgaaacactggctgc

SEQ ID NO: 13366 - DNA, 488 bp, Saccharomyces cerevisiae
aaaccatgttgatgatttgttatattaatatctacacttaaaacattttcaataattgtcgggaacaaatcgaaatattatttattcttcaaatatgacaaaactaatgtatattatatacatgtcaacaccaccatgactatatgtttaattgatgtataatcattccatttttacacgtgctctttcttggcagcggttaagggaacctgatgatagaccatgcaataaaaaagaaagccctgtagggggctcgaacccctaaccttatgattaagagtcatacgcgctaccgattgcgccaacaaggctcttttgttgaaataaaaaaccgaaacatctttatctaacgaatatttggaaggtgaacctaacgataaaatactacactattcatattgactgactgtatcaacgacgtttaacagcgattatctgcttatctcaatatgtggttagcgattacttgttcaagtcgttgctttacg

SEQ ID NO: 13367 - DNA, 478 bp, Saccharomyces cerevisiae
actaatttgataaacaggctaaaggtttgtattttttgtagttttgaaactgtgtatagaatgtttcgccgcatcgcagatatctgcagggaactgttgacatagcatcttctgtggacgtgacaacgttacgtatattcgttgataccgcaagtctatagcgtatacatgctaaggcaaaaagtttcaaagtgaatgcattatgtatttatatgtaaataagtaagaaaagtgggattttgaaaataaaggtgtagtaggacagtaagtattcaatgaaatacaattataacatatcttcatcgggcgttcctgatgcttcatccatttgagaatcaatggcagtgtcaggcattgattcgtcaattgtgttgttgttattgttcctaaccatgttctgattacgaagtcccatttggagattcctcatctggtcaggtgatatttgcattctattgccaaactgacgccagaaatt

SEQ ID NO: 13368 - DNA, 420 bp, Saccharomyces cerevisiae
cattagtaccatttgcaagacattgtataatatttttgttgaaagtctttttcgattcataagcgcttttttgtaaatttataacactatgtgtatgcacaaatttcattcgatgtttttgatgctttttacatccccttttgtgtgggaaaggatacaatagaattctacaaacttatttgagtgattatacgagcattagctggaccttttgtatttcacgagattacaattcgggaactatcaaagtacacgttaaaattcagctcgggtatgttaagtactagtaattacctctggtacctactgacgtaattcccacccttgggaccttgcggaagcgcctgagtattgctctttctatttccgttgtacctttgattttcattggctctatgggcagcaccgctatctcgtgta

SEQ ID NO: 13369 - DNA, 405 bp, Saccharomyces cerevisiae
taaatcgcactttgtatctacttttttttattcgaaaacaaggcacaacaatgaatctatcgccctgtgagattttcaatctcaagtttgtgtaatagatagcgttatattatagaactataaaggtccttgaatatacatagtgtttcattcctattactgtatatgtgactttacattgttacttccgcggctatttgacgttttctgcttcaggtgcggcttggagggcaaagtgtcagaaaatcggccaggccgtatgacacaaaagagtagaaaacgagatctcaaatatctcgaggcctgtcctctatacaaccgcccagctctctgacaaagctccagaacggttgtcttttgtttcgaaaagccaaggtcccttataattgccctccattttgtgtc

SEQ ID NO: 13370 - DNA, 499 bp, Saccharomyces cerevisiae
ctgtccccggctttaggctgctgcaaacgcaatgtaaataataatacagtttaacttgtacgtatctttgttatttcagaatatgcaagattcctcactcggcagatctcatcaataaacgttagtatcttgaaaaatacgcagatgttggtacagtctcttgcagagggccagcaccgttagaatgttgtgttgccaccgtctggctcgaaaacaggtcgatctgtgtaagtattgtcctgggtgcagttatttgtagtagcgattttcgcgggcagtggaaaagaacgggtgcagtgcggcgatgagtgcaattagctgccgaagggtttgcaccggtgattccgagaccttttgcacacacttgtatatatttagggaagtcacggtaactaatggatttcttctcaaatttgagacatatggattagactttaattctgcctggtactaagctacttttcaaaggtatttgagatatttcgtaaattttgcggcc

SEQ ID NO: 13371 - DNA, 402 bp, Saccharomyces cerevisiae
ggaaagaaataaccaataataataatttattaacctctttttttcttattaggcttctcagagacaactgtattatttatgaaaaagaaaagaactactcatttctaaaacagggaagggattctcttattattgtagtacaaaattagtgggaactgaataatatatgcatttaggtaaatacgaaaaagaaaggaaacagttatatatatagttatattggatgatgtacacgacacagtctgccttatcttccgacgtcagacttcttgtaatactctttaacaagtcctaagacaccacccttattgagtatgccattaccattgtaatttgagtttagcattttattatggtctattacatcatgattagggaatgcgcccgaatcaaggaaagact

SEQ ID NO: 13372 - DNA, 438 bp, Saccharomyces cerevisiae
ttgtaaacgataaatatgccataaagatctgcgaactgtacatatccatatataatgcgtattatttggtgactatagcactggcttccgccatctcactaagaacgaagaggtataataaagcattgtgatgttaaagaatgacgattaaccagcatttacaacaacttctcttcaacagaatagacaaaacaacaagcagtattcaacaagctagggcgccgcagatgttattagatgaccagctgaagtattgggtcctgttacctatttcgattgtcatggttttgacgggtgtactcaaacagtacatcatgacacttataacgggaagcagtgcaaatgaagcacaaccaagggtaaagttaactgaatggcaatatctacaatgggcacaattattgattggaaacggtgggaacctgtcttccgatgcat

SEQ ID NO: 13373 - DNA, 481 bp, Saccharomyces cerevisiae
gtgaagctgacgcatagataggatatgtaattctacatcagcttgtaaataaacaaaaatgactttcaatatccttcaaccgttcctgactctttcctgctgacccgtttttccaaatttctcgtcgaacttgaaattgaaaaaaaaaaaaaaaaattgaatgaggactcattaaacagatgatgccgtaataaatgcaatatatcttgctatttaactctttctttctttgaaaaccttgacatacgtatttaaataattggctgtccctgcctcgaagtatatttctcttctacttttatcttagcgatatccctaagagtttaatcctcccaggtccataacaaaagaagtcaagttcaatgactgattatattttgccgggtcccaaggccttatctcagttcagagtcgataatctaattaaagatataaactcctatacaaacagtacttctgtcatcaatgaattgcgttcgtg

SEQ ID NO: 13374 - DNA, 497 bp, Saccharomyces cerevisiae
cattcaaaacgtgaacatctttgttattcttctgtccttaaactactaaacaaaaaaaactatgaccattgattgtgcaaagaaaagaccacgagaatgtctaggaaatgattgtaaatacctttattcattggaaaattcttatctataaaacttataaaaaattaaatactgaatttattgctctgcatcataaggtatatatcattcaaacgtgaactcagttagttacgttcatgttcaaagtttttaagacaaaaactcccattagtgcggtgaaaatatagcaagcaatagacagaggcttcttgaaaaaagagcttttcgggtagtcgtactttatcaagacttggccattggcaacttgactaatcaaatttctgtaactgaaagttaatttaacgtgacctttatttaggtcaaagtatgatttctgggtttctatagaaacatttgtaaaagggactggagaatcaatatcgaatatttcggcccct

SEQ ID NO: 13375 - DNA, 459 bp, Saccharomyces cerevisiae
aacatataaatgtgtatgacaagcattatgacttctattttcgttcttttttacttgcgtctacaatatataagcatataatcagatgaaaaaaggaaaaggaagcggtaatacaaataaacaaagaagtggaaaaagtcgccacagtgtaagcaaatgagtcacaagagaaggggcctggtaatatatcaggatcagaagcagcaacaacaacaccccccggggcagtccctaagctctatatcctggtctccaaccaggcgacctcatcaccctttaaaacaacaaagcaccaacagtttctcagaaatactatcgaaatcaagtgtgcaaccgaacgtgcaacatgacggtaatcatatgcccatttcattgctagttctgaaacaagaacatcataagcagcagcagcagcagcagcagcgccagaatatccgatcacaaaactctacgcctccc

SEQ ID NO: 13376 - DNA, 474 bp, Saccharomyces cerevisiae
acacgtaatcgccttacctacgaggggagaaaacgttccctctgcatgtatatatatatatatatatataaatattaaatcttgaatattgttggattaagcatgtgcttgacaaatggtgtatgggtttgtagacgatgagagtggaagggagattaaaagtttattgcagatgcgaacatctgcacaaaagtacttgaatgtactaagcagaaaaagttctaatacatattagcaggaggcccaacagtcacacaagttcagcagaactgccaattaatcgaaaagaatatgtatgtttctaatgggaaagacacttgccagttgttggggcccgtgtctctttttgtccagacattgatgggtatgacagccgtgattgtgttattggtgaaaagaaactatgagcatccaaggagaaaaatgattgtgtggagttatgacattggaaaacaaatcatcggctctcttgga

SEQ ID NO: 13377 - DNA, 440 bp, Saccharomyces cerevisiae
aaggattaaagatgctaagagatagtgatgatatttcataaataatgtaattctatatatgttaattaccttttttgcgaggcatatttatggtgaaggataagttttgaccatcaaagaaggttaatgtggctgtggtttcagggtccataaagcttttcaattcatcttttttttttttgttcttttttttgattccggtttctttgaaatttttttgattcggtaatctccgagcagaaggaagaacgaaggaaggagcacagacttagattggtatatatacgcatatgtggtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatt

SEQ ID NO: 13378 - DNA, 401 bp, Saccharomyces cerevisiae
taatatgtaggatagaatgaaaggaggagtcaccataggtgaaaaaaaaaagcacctattgcatataaagtattcaaaaaggtgttgaaagctcttcctgtatatgaccctgtatttaatgtacgcggttaaaaaatttttatatttttaaataagtatcaacttggataatatgatcttgcccgcaaggtggttttatatgaataattactttttttttttttttttttttttttttttttttttaattgaacaatagatgcagaggaatgctccaaaatttatttccttgaacaatattacaagaggcagatatatacttttccttatttcccttagtaaagaatgatgcatgtatactattacaaatttaaacttcacccccaccatggatgcaaaac

SEQ ID NO: 13379 - DNA, 440 bp, Saccharomyces cerevisiae
ttatttataagtgttgttagaggctgcaacaattagaaactagtgcaaaactagtatatttatttgtatatgtagtagtaaaataataggtgaaaaattaacatgtgtttgaaattccagctaactattggttatggtgattacacgctaagtgtagagttctttcaaatataccatttatcctttagcacggcttcactatttttttcgtcttttttcaactaagcggaaggagaaaaaaatttcaagttatgctcatcactcttttattacattatggtagctataaagtggcttatgttagtgagttgacggaaaagagaaatactttcaatagaccaatacataacaaatccttttgaacaagatgcatttgatgtacactttgggcccagacggcaagagaatctatacattgaaaaaggtcaccgaaagtggtg

SEQ ID NO: 13380 - DNA, 411 bp, Saccharomyces cerevisiae
acaaatatattaggttcaaggtcttcgcaggtgtaagaaaacccgtggtctccatattcttaagtatgataaataaaaaaaaacttaataaattattaattgcttcaaacctttttctttttttagtttttaatatttcaaacgttatcttcattgaacgcccaaatagggaaaaatcctggcaaattttttattgctgtcatccaaggctatgctagaaaattcaagagcttggatgatttaaaaagacactctcaatcgagaaagtttattctttgttattctgctttacctgatcatattccggcgtattgtttctaatcaagtgatttcgatatccagttacgaaccatttacaacattcctgaaaatattgcgtatcaatgatatttgctccttctttctccctca

SEQ ID NO: 13381 - DNA, 418 bp, Saccharomyces cerevisiae
acggcatatacttacgcgcacatacatatatacatatatattataaatgtaacacttgttttacccgaaacggcgaagtaattgtgtaccgccgtgcaccttttcctcgagataaacatatagcgatgacttagagaacaaagtagtattagtatcatatacttccaacgttaatcaagcgcaataaacctttgttcgtgtgtttcaaagttattgcaagagcgaagttgaagccatcttttcacgagaagttagctgtggttcgagtctgtcgcacgccgtgtaatgtaaggatcttcccttagcttttctgatccggagcccttgagggatattacgcatcgcgtatcttcatacgattactgtactttgctgacttgcattcttgatattgggctatagttggcacttcgctcgt

SEQ ID NO: 13382 - DNA, 451 bp, Saccharomyces cerevisiae
gcttatcctatcctctatttccgccctgccccatcaaaaggaaggaaaaaatagtaaatacgggacttcctgtgtcgttttttcatttcctaggtttttttcaagtcttccctagtagtgtatgcacaaatatataaaattaaatacgtaaatacagcgtgctgcgtgctctactcaccaatatcttcaaaccaatcctgaggtctttcatcgataaattgtttcatgatctttttacacctctcatcgtcaacaacaacaacctcgtgacctctagtttgtaaatatttctcgcccttacttttgaaattaacgttctcaccgacaacacagcgtggaataccatacatgatgatggcacctgtacacatgtcgcatggagacagcgtcgtatacaaagtggtatctttgtacactttgccctctaatctcccacagttttccaaagtgg

SEQ ID NO: 13383 - DNA, 492 bp, Saccharomyces cerevisiae
cgcttttatgaacatattccgatatctctcacgatactaatattcgaaaaatctttctccttcgccgcgatggatggaagtaaaaacacatatataaaagtataaaatgaatgctggcgtattcttacatacaagagatttgtaaaaagtcaatgaaaagttctccacacgtgtttttctcttttactttttttttcttccttttggtttccttttttctttctcgtcgcttttatttagcgacgcagcataggaaacaggggtaaagtgtcataactttttagagaaaatgatatatcattaatatgcacacgtttatataaatggagaaagaaaacaaagaacataaaacattttgaagcagagcggtgaaacgcaactatattttactttcatcctctacgtccattgtaagattacaacaaaagcactatcgatgccagagtccagattgcagagactagctaatttgaaaataggaactccgcagca

SEQ ID NO: 13384 - DNA, 401 bp, Saccharomyces cerevisiae
cctaaacgttccttgaagccaggcatgctaatggctcctgtccctattacatattcaaccatttgatagacgaatatacaaacataaatagagtttataaaatatgctcaagacttgctacaataaacactacgctcagacttcatgctgatttcaatattgtatttcgaagaaagtggttgctcatttattacctttgaactttcactttggtattttgatattctcgaggtttcccagtctggcttgaacttcagttcgccttttgaaagtggcaggattataaggtatatttctgtaatgtgatggtgcagtgcctcttggattccagtctttatcgtaaaatatacttcttataccgagttcaccgttctctttttcacgacccagtgagtgtccag

SEQ ID NO: 13385 - DNA, 479 bp, Saccharomyces cerevisiae
taggacgggaaaaatgagaaaaaatcaaaacaaataaagatatacgttattgatataggataatataaataattgtacattattacagtgctgataatcaatagtcctgcatacgtagctaaaccgtggcaaattcgacaatatatcaacagtaatgaagcttaatttgaaatatttttcctttataacgttaatggactctttttaatgatgtcattattagaaagagattttcaaggaaaaagcgttgactaatagcgacacaaaacatgcttctgacactggataaatgagatatcagaaaaaatttttcatattttacatcttataggtgctacaaaacctgtatgattcgaggcttgctagtatagaatggcagtagaagagggtggttgcgtgacgaaacgtttacaaaatgagctgctacagctacttagttctacaacagaaagtattagtgcgtttcccgtagacgataa

SEQ ID NO: 13386 - DNA, 433 bp, Saccharomyces cerevisiae
aaagccgccatttgtgtctcctcatacttacatagaatagccctcttctattatccttcgcttgctttctagcactcataactaatgtagtttaacccgcttgtatatcttctacatcattaccccgcatgcttttttttttcctctagagaaaaccggcacagattggccggacccggaacaggaaaaatggccactgaaaattcctggccagaccacccctgagctaagggagtttagccgctcaagcttttatttcctctgatgtaatatatcacacacccagacacggttgccaaggcctcgacggaaggccgcttcaagggacggggcagtggctatcagaaataccttaatatcatcaatatttttcatcaatcgcaaggtgtcaaacatcaataaaggatgatgctcaaaggtttatgcccgatgt

SEQ ID NO: 13387 - DNA, 412 bp, Saccharomyces cerevisiae
agacgttaaactaaagttgcaaatttttattaaagaaattctatagaaataaaagaaacaaatttataaaaagttatttacacacatacatatattaaccactcttagtttgagatgacacaacttttaatgatctacaatatatccatctgggtctccacggctgcaattttgaaattttcttagcgctaaaaaaaagaaatctaactgaaaaaaaaaattatacctcagctcatcgaatgcatctaatacaggtataacgcagagaaagcagtaaaagcagcaagaaattacagggaagatggctggaaatgcaaactcagtagacgaggaagttaccaggatattaggaggcatatatcttggcggaatccgtccaattattgaccacagaccattgggtgcagaattt

SEQ ID NO: 13388 - DNA, 432 bp, Saccharomyces cerevisiae
tagataaggacgccactgacttcaataaaacatttaataataatagtaacagtaataatgaggataataatatataataaacgtgaattttctttagcattatatacgctaattctttctctatttgaggggatactctcgtatcctttttatctcgatagttgtagttgtacttgttgtttttattaacccttctcataatatataataaaaaagtacattgacgtcaattatattgcatataacgcgatgtggaactaaacttcttgtatccgctaataactttatcaacagccttcaggaaatccttttcagtagccacctttcttcttgctctaatggcaaacataccggcttctgtgcaaacagatcttaattctgcaccggtagagtttggacacagtctggagataagttcccatctgatgccac

SEQ ID NO: 13389 - DNA, 478 bp, Saccharomyces cerevisiae
taggtgcatttcttatttcttaattttattgtagcttttttttttcaactaatatgataattatatatataccggatttgttgaaagccagttttgcaaggataaagaaactgcgatttagcaaaagtccctttaatgcttcttccatctttgatctactttcttttgagtattaggtgtataccatacactttcagatccaaaatcagcctcggacatttttacaaacgaaataaggccattatccataatagcgataataaagctccgatatcccgtcttcaatctacgattttgctgtatgtgaggtgggtacgcctttctcttctttttcgtgctagactgtgcagtttttttttgaaaacttgctttcatagacgactcacttttttcagtttgagatttcgcgctcctcttatgaatatattcctttcgtgggatatcttcaacgtaggagtttgtctcccaatcgtcatca

SEQ ID NO: 13390 - DNA, 481 bp, Saccharomyces cerevisiae
accgtattttgctcgttccagcctttccacgtttttgttatctaagcaacttggcacatttccctactatactacaaaccgatacgtaaatacttccctaaatagcatatgaattattcagtaatttttaaggatcgaaactgcacctcaactattcgttactgtggttatgttctcatgtattgatgcaaatcatgggatatttgctcaagacgacggtaaaatgagcaaaaatggcacgatcctgaaaagagcacttttcaagattcgggctacaaaatgcaacataaaaaatgttgtattgtcatctcgagagggtcttgtatgttttattcctcttatgattagttcacattagtaaaacagatacgcagtgtgctcttaataaacaactactccatagctttatttgcataacaaaacttttaagcacaaacttaaacaggtggagtaatagttcggcggcgactcaaattacatt

SEQ ID NO: 13391 - DNA, 413 bp, Saccharomyces cerevisiae
atatatagatcgcgataataaacgctcatccgttccatagaggtatctgtatttaatgtagtgtagcagatatagaataaaataaccttaatgaagaaatagaatatacgtatgcttctccttgtctaatcttttgtaattatatatctatttcaattaaggctcagatacttaccataaacataaataaaaagcagaaaggcggctcaattgatagtactttgcttttagttgaccttcaacaattcgacgtcgaaaaccaaagtactgtttggtggaatcaaacctgggaaaccacgtgggccataagcatatgggccagggatggttaacctagctttttcaccaacagacaactttggaataccaacatcccaacccttgatgacttggccgacaccgatgttacattg

SEQ ID NO: 13392 - DNA, 402 bp, Saccharomyces cerevisiae
gcaaggtcatgaactgaatctttttttccggctgtcctcttacagttgagttacaatattttgccagaaatatttacatttttttacccaatctctataataattattttaattcctaatccgcttcaggcccgcggtcgttgaagtgctatagtttatattcagtacattgtctttaatctctcagtattattttatcaatagtaaatacttcaagtccatcgcacggcgtggtggtgataaagggaaaatgcgcgcgggattagcaaaggcggccaatggattaagggtgacaagatagcaccacatcacatcacatcaccatcagtaatggagaggaaatagggtataaatactcgtcagagatcaatagatattatttcgcaacgtcctttattgttc

SEQ ID NO: 13393 - DNA, 440 bp, Saccharomyces cerevisiae
ttacagaggtatatccgtattttcatttctttatttgatagtacacgtgattgtatacccaatgcatatattactaagaactttttataatgatgtaattcaaaatgaaataaattactgattcatacgcggtcaaaaaaaaaaaaagaatatgacggtttcttatttacaagcttttctacatatgattcaaattattctaaaatgtagcccttttttgttttcttatctccttacgcttttgatttgccactttcttagaatctcttatcaatattttatcaccaaaaaattcataatcttgcatgtaacgcctgtccatattgaattcatccgttatggccgcatcattcaatcctagtttttgaatagtccagtagtatttttcaggattatctcttttcaaatatcttaatattgcctgcctttgctggactaat

SEQ ID NO: 13394 - DNA, 415 bp, Saccharomyces cerevisiae
cgctatcctcggttctgcattgagccgccttatatgaactgtatcgaaacgttatttttttaatcgcagacttaagcaggtaattattccttgcttcttgttactggatatgtatgtatgtataataagtgatcttatgtatgaaattcttaaaaaaggacacctgtaagcgttgatttctatgtatgaagtccacatttgatgtaatcataacaaagcctaaaaaataggtatatcattttataattatttgctgtacaagtatatcaataaacttatatattacttgttttctagataagcttcgtaaccgacagtttctaacttttgtgctttgacaagaacttcttcttcttgctttaataaaaactgttccattttcgttgtataacttgaatcataagcgccaagcagt

SEQ ID NO: 13395 - DNA, 477 bp, Saccharomyces cerevisiae
acaacatctattatgggaacatcccgctgtactatgcggtctcgtcctctacgaatatggctatttgccttcgtatatacctttctataccaagtaatgaatgtcttgagggcccgtatggccgcgcgaaggcttagttaagatgtttcagcaaacggcagcatgtgaaaaaacccgtagaaggtccgcatcagccttccatgcccgtgcacccacggctcctcggaggccgggttatagcagcgtctgctccgcatcacgatacacgaggtgcaggcacggttcactactcccctggcctccaacaaacgacggccaaaaacttcacatgccgcccagccaagcataattacgcaacagcgatctttccgtcgcacaagttaaaagaaattgttgaaaaatacaaataatcgcgaacaatacgttgttgctatttaacgcttttggtctgacagtaagtgtgcctttcccaatcac

SEQ ID NO: 13396 - DNA, 405 bp, Saccharomyces cerevisiae
tcattatgattatgtcaagcacctgtaaccttgatcacatgcgacgggagttctttttgaaattttttggaaaaattttgcgatgagctgaaagatgaaaaaaaaaaaagtttcgagtatagttctaggtatgtacaataactagtataatatcaataatagtaataatagtatcgttttcaacaggtagacaggagagcagaccgcagattgaaccgcatcccaatgaaatccgatttcaagttctctaaccttttaggtacggtctacaggcaaggtaacatcaccttttccgatgatggcaagcaactactctcaccggtggggaatagggtcagcgtgtttgacttaatcaacaacaaatcgttcacgtttgaatacgagcatcgcaaaaatattgctgcc

SEQ ID NO: 13397 - DNA, 400 bp, Saccharomyces cerevisiae
ctatgaataaaagtaaaaataaacacaatcaactgtggacgaggttcaggcaaatatcatggtgacacgcttatagatagttatcgggtaagttaaaaaaccaaatagctgatgtatgtatatgtatgcaaaagatataaaatatatatttctattacaggtacaacaggtccagtaagaagccaagcaaaaaacagcattatcgtctagatgctcctttcttcgccagaaaatctgccatttcatttcctggatcaccatcgtgtccttttacccattcaatctgaaatttaccattatttttgaagcactctttattcaactcatagtactttttaactttaacgaacctctgcaccaaaggaacaattaaatcagaattaggtagcccttcaagttt

SEQ ID NO: 13398 - DNA, 414 bp, Saccharomyces cerevisiae
tggcattgaaatttagcttttttttatttaggagaaacaatatatatatatatgtatatacgtatgtatgattcatattttaatcgcatttttatttcatctaaaacaattactctttttgattatttatagaaaaaaaacaacaatgatacgtttgcttcgcgttatgtcaatagaaaatgtaaaaggaaaaagaatgtgttgctattcgttaggcggatttacggatggaagacatatctatgaactgagcttacaaacgcttttagcggggacagttaatcattttacggatgattttataagaataaactatttttgaaaagttaggatagtattttgtacatttggcaccgaagtaattcaaaatcgaggaagactcgcacacttttacaatcacagaaggcaaaaccc

SEQ ID NO: 13399 - DNA, 412 bp, Saccharomyces cerevisiae
aatttttgtggaatagaaccgcgaatgcagtcacttcatccatcaactcatgtaaatgttagattatcgaaaaaagggttttgattacttcattaggtttttttagttttacaattttaatttatctaggtaaatagtttaaaaatattcattgaaccaaccgtccaaattcccgttctatattctgtcatgacttacttattcacgttgctatttattcgccgcatattcattctgtttttggcataaggacccgtccggaaacagaacatcaatttattaaatacgtccattcgtaagcttaaagatggaaactttggcgagcagtccctgacaagaaaaataacagcaagaaataatgattttaaccacagctagattaaattgtagaccagtcaccgttcctcgtcta

SEQ ID NO: 13400 - DNA, 481 bp, Saccharomyces cerevisiae
tattgatacgtcatatttctctctatttatatttatttacttcttcaaagaagctattgggtagagtcccaatctcttttgcgtatacccgctacaccaccttcaaatctagataatatacttcgtattcttttattcccgacaagttcattaatctttatgctcttgaatgacggtttggtcctcatttgcttttctggtgtatatcttgccttaggagggaggatccaatcagaccttctacgtgactccaaaattttgggtaccaaactctcatataggtcttggattttggtctccccttcatctccgtcatgtccgtcgccttcttcatcttcttctgaccccagtctagactgtgaacgtcttttgtctctttctgatatccttgatgatctccttctaataccatccctttcagttatatctgaagcaatgtcaatattttccacttctgatattggaattggaaatggcaatt

SEQ ID NO: 13401 - DNA, 447 bp, Saccharomyces cerevisiae
tatcaagcggatatctttttttgttcattatcatgtccatagtaagtatgtccatatataaatcggataattaatattctataaaattacccattaaataaatttcatttattttgaatttcatttcgtgtgatctttagaagttggttcgcgaatgggccgtgcatcctgaaacatttcaaactttaggtaaatggtcataaagctcagtgctttttctttatcttttgcattttttttttcttgcctctactccaaagctgtcagtaaccaacttggtgctttatttttgtctatttttactaaattagtgtcgaaagcttctataagcaactctacaagaattctaccacctctgctaccagtaaagcgtctatattcttcggatacactggctaagttccaacccattattcttctgagacatccaatgactgtcccagtcct

SEQ ID NO: 13402 - DNA, 453 bp, Saccharomyces cerevisiae
aggagcaatgcaaaatctaggggtagaattactttttgaaaaggaaaaatattcaggtttgttgtttttatgtaagttgtatgatttgatatacatatatatatatatataatatatattgtacatgtgtttttccggggaagaatggattatccggaggtgtgaataaaatgatgacgattataggtttgtgttgtaatatttagataactcaattctcgccagtttgaactccaacctagactggttcaaagcttttgctatcaagatgagatatatggaattttcgtctttatcgtccacttgtatctttatttcctcgtcatcttcatcaatattgattccattaataatcgatttatcgctcagagtgttgaccaattcggtcttgttggggaagaaatgttccatttttcttcccaagttttgaattctttcacaaacccaggcaat

SEQ ID NO: 13403 - DNA, 405 bp, Saccharomyces cerevisiae
aatcttgatgtacgtaacgcactttcttctcgtgtcaggcccaaatcaacgcacacagcagtgcttcgatctttgattacaaagtagataatgataaatggaatagataaaagtattaaaacaacgtctccttgaaggagaactatacataagatatgaaataagtaggtatcgttataagtttataaggttatgcaagcggagaaagtctctgcagacattgctatcaaacttcgttccaacccagggagttttggctagcaattggtcttgaaatttttggtatggaactcgatgtattgtgcctggttggagttgagtcattatttgtcaacccgtgaccatagtaactatcatccatccaattttgaattcgcatagattgtgttatggattcttgaacgc

SEQ ID NO: 13404 - DNA, 426 bp, Saccharomyces cerevisiae
ccaaactaagttcgcgttttatttaaatttttttctttatagggcattatttgtacttttttttcttacgcgtctttagcaaaggcgggaagtacaataactagttttgtgcacaacaaaaatttgcgtgattgatagaaggcaaaaggatctttcgagaaatttgtattactggcccgtgtaaaaaaaccttaacaaaaaatatcaggtccttgctccttcaggtatatctatatgctctcatagaattatatttgatattgctttttggaccacattaaaataaaaggagctcgaaaaaactgaaaggcgtagaaaggaatgggtatccaaggtcttcttcctcagttaaagcccatacagaatccagtatcactacgtaggtatgaaggagaagtgttagccattgatggctatgcatggcta

SEQ ID NO: 13405 - DNA, 442 bp, Saccharomyces cerevisiae
cgtttgatgataaccggtgccgctactcgctgtaatatataccttaatgttggttttgttatattttttttcattacttttattttttttttatttttctgattaatatttatttattctaggtacatcaagagcagaacaaatttgccaacttaaactacatatgctgaacaatattctctttttaatttctagcttttaacgcaatgaccattgtggacaatgcgaaatatgtcaaaaaaaaaagcagccagaagaaattcttcggcaaaaggaaaactactatacagattgagaagcatagaattaggtattagttacatcagtaacggggataacaaaaataaaagggggaaatgatgacgatgttcttgcaagttttattaaattgtgctttggaaagaaaaagatgaatatatcttgcaggttagagggtatttcc

SEQ ID NO: 13406 - DNA, 417 bp, Saccharomyces cerevisiae
ttctatcgatggtaaagagtatgtgtcacgaaatcatcttgatgccgcaatgtacgagcaaaaaaagaaaagagaaatcaatcttaacaactcaaccatgccgagtgctactatagtacttttctttattactacgtatgtaaattgtaacaaatgtgtacttttatgtgtgttcttaaatgggaaactacttagcgttttgttcatttccagtgttaagtaggaagaatgactgagcgaaaaaaaccgtagaagtagaacttaaaataagaacggaggctaaaccaccaaaacagctcatcaacagttaaaacaccaccaatatttccagaaaaaagaactgtagatatagtctcattagtatttagaagaaagaggattttgcaatggcaggggatagtataagcgctgacggca

SEQ ID NO: 13407 - DNA, 490 bp, Saccharomyces cerevisiae
agacaatcgcaagagggtataattttttttttctcgttattatcgctgttggtgggttttttcttttcatatatttctttttcgcttagtggtttctactgttctgtctccggttagtgtgtgctacttcaaccgaagaagaagaggcttttcaagaatgcaaacgtgaggttggcgcgccctcctacaattatttgtggcgactgggcagcgacactgaacatagctcttgaacaagacccttttttggctgcaaggagcaagactggctggggttccacctcaaagagccacgctctgctttttttctatctgtttgtgtcatatctatctgtctatttatctatatatatatttttttatataaaactataaagaattcttgatgtatgcccttaggttgggcagcttttcaaccttagacttgatgctaacgccgctctgttccttctcccgtgctcccgcaagcgaacatctccccctaactccg

SEQ ID NO: 13408 - DNA, 424 bp, Saccharomyces cerevisiae
cgtgatttacatatactacaagtcgccagtgtaactcctcactgaatatgattcatacatacccgtatgtattaatgtataaatgttctcagagcaaattttatcgatatcttgtttgccagtggtatgcaggtttggcaaattttttaccataatatccgtttatagattctggaaccttaccaactttcttaccgctaattacttccctggctcgctcctccactgcctgggtaaattgttccttcaactgactcagttctctttcgtattcaatagcttgcttctcgaggattttttcaatgtttgtcagctcattttcatagtccagtaacttcctttcaaatctctctaattgcaacgactttcttgcagttcgtatctgaatatcttgcagtaattcaaaagtggaaggcctggttct

SEQ ID NO: 13409 - DNA, 491 bp, Saccharomyces cerevisiae
tttcatttcaaacaagaatagctaacttttgtctctttatttaccactacatattacattagcctatatatactcatacgtttctctctctttactttctgtacccccgaggaaaaatacataaattatttttgaactttccctgcttttttaccaacattgctacagtttaaccattgcagttaaaagtgctcatcgtgttagttaaataaataaataattaagagaaataataataaagtatcatacataaataagaataaaaaaaaaaaatgaaaaaaaaaaactgttaatttttttttttactgatttacaaattccttgtacctctatctcagcccatgcatatattggttgttttactgcttgataccactagaaacctctagttgtttaacgatggggtctctaacattagggttcaagtcgtcattagttaaagatagttggcttgatgtccataagttagactcttccacaaatccgctctc

SEQ ID NO: 13410 - DNA, 423 bp, Saccharomyces cerevisiae
gactccgcttaaattcatatatagaatttcgaacatcgtaatataattatattttgtatacttacttaattcccgttttcttttgtatgaatttttgaaaaataatagagcaacattatacttttaagcgcggcactagttcatcaatgtcgggttttgccaagcaaaactaattggggcagctatttatatttgaaagaatcagcgtcactgtcgacgatacaacaaatagccgccgaagttcctgtaagcaaatataaaaactaaaaactcttttgttcttttctcttgttccttctcacttccttttcattcatacatacgttcaaatcaatggaaatagggcatcttcccaagtaatcttgaaaaaattaagaagaaagaaacttttaagaaaagaataggcaatgctaatagaggaga

SEQ ID NO: 13411 - DNA, 406 bp, Saccharomyces cerevisiae
ggatatcattgctatgtaaacaaactaaatgcgagggttgagtacataaatacaaagcaagacttttatcatacataacacatataacaaccaatgcatgcatcctctcgacaatagttttgtgcgtatgtctttgcgaagtccaaatactactcacatccatcttttattttttaatcccatcgcagcgagtttaagcctgaaaaatagtgaaccagttgaaaaacactaataacatcgatgcaaaactaactatcaataaactgttgtgtttttagaactctgtacgttgtttcctatcccaagagttcaataagacgcagccaagcttttattctcttgactcgtccatcatagagctttatagaaatgtcagagaaggcttctgaagagagacccatacggc

SEQ ID NO: 13412 - DNA, 445 bp, Saccharomyces cerevisiae
aatttcttcttgtccgccacgttcttgtatcttttatttcatcctatgctctcgatgaatgagatctactttagcaattgatacagtataaccctgacattacatttagggaataatcgccccaatataggttacaaaacattaatatatatgtaaatatatgtgcgcgtatatatatatatatatatatataaagggaaaattaatattctatcattaaagtgaagaagaaaggtggatttaaattccaagtcttttcaattgttctaaacgttcatcaatggcatgttcaaattggtttgaagtatttgtccgctcacttagtaacttggcatgaatacattgtagcgcttttatggagtcagattcattgataacgcaggatatgtttatttcatttgccccttgagaaatcatttcaatgttgatgccttcttcagcaaga

SEQ ID NO: 13413 - DNA, 405 bp, Saccharomyces cerevisiae
aacagctctgttaccgtaggtttctgttttatatatatatatagattaagatgcataggtatatagaccggcgccattttatattatttcatgccatgaatatatactgcaaaaaatgtgacaatgagtaaattgctaactagcgctacaatgtgattatttttgctacacacgtttatccattgaatattctatttacaatgtatggcgtattgatacacatgtacctatatatatcaacaagtgcttttatcttaacttttatgaaagattaatgattggtttaatcatcaacgatactccgttccatggtgtgacttttttaaggcttgtcactgggggaaagcgacggttggttaagggatgaaagaaattaataacccacttgcgatcatcggttatcct

SEQ ID NO: 13414 - DNA, 494 bp, Saccharomyces cerevisiae
gagatttttttgtaaataagagttacttttgtatgttgtattacgggctcgagtaataccggagtgtcttgacaatcctgatataaacagtcttagggaagtaaccagttgtcaaaacggtttatcagattaattcacggaatgttacttatcttatgtattatataaaatatgaatcatactaagtggtggaagcgcggaatctcggatctaaactgattgttcaagcatttatacgtttgggtagttcagctagggaaggccgtgttttatctcatgttgttcgttttgttataaggttgtttcatatgtgttttatgaacgtttaggatgacgtattgtcatactgacatatctcattttgagatacaacattgtatatacacagaacaatgagaaaaagttccactcagtaattaatattcttttacccaacgtttccttataacgttgttattgaaaaagggatattatatgaatccacgcacctgatc

SEQ ID NO: 13415 - DNA, 401 bp, Saccharomyces cerevisiae
taggtgacattctgataatacgttaagaagaaccaaagagttgaaataatatgaactcacgtgtaacgccgcgaaacaaaaaatacattttagtaccttccattacattttacgtaactagataaacttctcattgtgcaccatcttatcattattacttgatcgcctaatacttttattcttctgacacctattaccctcctttccatattttggatagcgggaaactaatgaaaaattttcttccacgcacattgaaaaatatttacgaattatatttcaataacatctcagtacatagtatagtatctcgcaacacacagctcaaaaggtcaaagataattcaaatgactaccgagactttcgaagacattaagctagaggacatccctgttgacgac

SEQ ID NO: 13416 - DNA, 454 bp, Saccharomyces cerevisiae
ccatagcgcaattctatgtaagtaattagttttttaacggaaattgtaattgtaactgtcctagatactatggacattcaatctgattgttacccggaacatttgcttttgaaaggcatttttagtagcactaatatattggcagctaattgaaacagtaatctacaaatatgagtaagctaaaccacctcaacaaagctattcgtggctagtatatgaccttgaattgccatggaaaaagaatcagtatacaacttagcactaaaatgtgctgagcggcaattgacctccatggaattttcgaacctttacaaggaattctttaatgaaaagttcccgtctttgattcaagaggaagaagaagatacaacaacaactgcaaatataaatgaggtcaagaaagcgtccgatttggtggatacacccagcaacaacacggctgctactgcagata

SEQ ID NO: 13417 - DNA, 419 bp, Saccharomyces cerevisiae
gcactccacgagttatgctcttttcttttgtacccaataaataaccctttgttttatgcatgcatataactatataataacatatatgaatattttgcctattagcacgctcttcccataaactaaaaaaaaggcttccttcttttgaaaggtttcattgaattttctttgccgttcagtatattttgctttttcgttttttgctttttgtcttctttgtttgaattgtcggtcattttgagctcctgtatcacactgtctctcatatccttacatctcctaatattgatatcaatatcatcttcaaccttgtccagagtatgttcatagtgttcaccaaagaggcctgtagttgtggcctcctgatcatttttaatacgcttgatgtcgtagagtaacccaccatattccattaacca

SEQ ID NO: 13418 - DNA, 428 bp, Saccharomyces cerevisiae
ctcagaacagaattagtgttaatagcggtgacagtagttttattgtatctcacctttttttatgtataatcatataatgacttaattatttttgaaatgtttctttttttttttttagttataaccctttttacggattcttacgtacttatttaatctttctagtagacaatctttctaccggtgaaggttcttcttgcctgttgtctgccttctgcactcaattcatcattttcatcatcttcgtccaccttggctctatttaagactttgatgaacgagtccactctgaatctcattctggagtgcatgtaggctttagagcactttatgtgataatggaagtagtttctaaacaatgttaactggcaaattgaatggaattgcaactcttttgtctggaaatgacgtgggaaaagaacaaacgt

SEQ ID NO: 13419 - DNA, 434 bp, Saccharomyces cerevisiae
atacaaattccaattggttatgacagtaaaatactcactaaaaacagataaagaggtcaccaccctggcggtatgcctggccgaatcttcttccatctgttctatgtcataatttccgtttcttacggatatatacatatatatcagtgtatgtacttatgcatatgttaaattagaagactattagtcagaatattcttcctctatgtccaactcttccaagtcttcattctcattcactaaatcacccttcttgatttgtgttaactcacttggatctagaggaccaccaatttcttggagtaaagcattagcaccgcccaataattcttgcacaatttcatctttgctgtcagcattgacacctgcttgcaatgcaaaacttagcgctaatcttgagtcatagattaactgggagattggttcgtgggata

SEQ ID NO: 13420 - DNA, 437 bp, Saccharomyces cerevisiae
acttaaatagagttatcattccttatatatatatatatatatatatatatatatatatatatattgtattaaagtacatcattatttaaaaaaaattctcacttgggcatctcacctctgtgctcaagcaaaagaatcttttggctcattttccagaagatattttattagttcgtagatattttgtctatcactaactgtatgaatccatataccatagacctcatgcttcaagttcttaataatgaccaattcatctttcacctctacccccatgcactctagtgggttaagtgtatcctcttctgcattaaatacttttcttttatttacgacactattgggaacaatgcccatagaaaaattgtcaggattaattcggtttaatatgatcaatccataattgtatatgtcctttccacttaaagttttgccgc

SEQ ID NO: 13421 - DNA, 413 bp, Saccharomyces cerevisiae
gggaggcggtgaaggttttttgacaggtgtatgtgtattgctagaaacgcaggctccattctatatgcacgtttgaagatgtggtatgcgtatgtatatatatatatatatatagactaaagatagatagcatagattttatcgttgtaacttgcgataaagatcatccaagacgtctctcttaatttgcagttcttgttcacgttgatggatgatatcctgccattctgatggacttttacttaataaatccttggtatcttcgttttccgatatcaaagatttacaaagtttcaaacgatgtctaatcgaacctgttaaggtttccaattgatttgagagattgtttggatccttccttatttggtgcagcgaataaaaaatatgcggtataaattcaccgttggaactgg

SEQ ID NO: 13422 - DNA, 455 bp, Saccharomyces cerevisiae
aagattaataaagaaaacatgaaaatcataaataattaaaagtaactggacgaacaaaagattttacgtgagacaggacaaaaaaaattaacaccagcagtatatgtatatatgtacatcgtatatgaatatgccatttcaacaaattggatatggttgtatgtttggctttttcttttcctggattccggctgtcaaatactactacgaatagagtcagaacaggcttttctgtcccttcctcctattgtttcctttgctctgtccgtggctactctcatctttttctattctaagagaatttccatctgttaccacatgcttcacatgtacagaaagtggtcaatggttcatccgcagatcttgtttgcaattgatagtaagataccttcttctctttacatttaccacatgtaaatctatcggtgactgacctttctatggtggcaccctgt

SEQ ID NO: 13423 - DNA, 440 bp, Saccharomyces cerevisiae
tggtaatttgcgggtctatgtatttatagaaataaaccatctgcactgatatatgaatatataagtagacatgaaaataactttcatgtagttgaccgggaagagttcaaactctcatcctccagaaaaaggcctctctcagcagcttcatccataatcttttctcttcttttctgttcctcacgataataatttgtctggaacttgagcaattgcttatcagctctgaagacagcacccattgaaatccaagaacaatgataaaaaacacgcacttgagttctgacatttctatatactgatgaaaatcttctcaacagcagcgctgaggcaatactgaagagagcaccttgggcagctcctatacatgatgcaacagtaatctacgaatgagaaagaaggttaattagacttgtgttagcgatttattctggggtgaa

SEQ ID NO: 13424 - DNA, 456 bp, Saccharomyces cerevisiae
caagacggaaagattgaaagagtagatagatgtacattttatttaaatattagttagtcgttattgtaactggtaatcagagcaagaagtttttctgtactttgttctctgcaggcaactaagttacgggccgacaaaggcttatgatgtgcgttttttattcaattgatagattcagtcagcattgacgtaatgggaaggctagaaaaagagaagactgaatttggaaacttattcctcaaagcagaccagtacttccaccgcatttctgtacttaaccaagcacgacagtggtctatcaggcttggatctttcactacacttccgccaaagttttttttttttcctgtttatcccagatcacgtttgttccattaaggaggtttactatcatctcatttccatttacacatacacttacatatacataaggaaacgcagaggcatacagtttga

SEQ ID NO: 13425 - DNA, 419 bp, Saccharomyces cerevisiae
tctcagtaagaaaaagaagatgaatgcgtttatagtattttaagttgttcaatagaatatcttcaatatgttcatatgtggactaaaagaagattttggtatatgtctataaatttattgttggtaaacgccattaagcagctttccaagaatatgttatcattgaggagaagtacgaaaactgattatgcacgattaggaaaaattctgcaaggagtattaaaaaatggccttcgagaagaaatgaaatctctttcgatgagcaatggtcttatggataatttgatagacatatgaaaaagtcaaaagtttttttggccatatgcagtaaaaacttacccttcaaattgcaaaaccattagttttattatatttttttttttttctttcattgaagtatacacgaaatcccatacgca

SEQ ID NO: 13426 - DNA, 432 bp, Saccharomyces cerevisiae
gagtactaacatatcattcactacatagtactttataactaaactgtaactttcagggcatcgtaacctgacgctttaccatcaataacgacacgagaccgctttatctatgatactggaacaatcaacatgattgttataaatgtactcgacaggatcatgaaaggataccaacttagttgccggttcattgaaatggaaagctcaagaacgtatactgaaagagagcgacgtctactttgcccacaaaaatctactctctgaattgaatagtatttagagattgcataattcaagccctcctcgaggaaaggatataaatgaaaataccgtttttcctgctgatggttatcgtccctgtcaaggatacttctcggactcgaacaacgttacagctcaacttaaagaaggctaaatacgacaagggcgctt

SEQ ID NO: 13427 - DNA, 468 bp, Saccharomyces cerevisiae
attaccttttgttggcatctaaaatcaaaggagcactcatttagtctttatagcatgcctttttctagctatttttaatgacgaatatatatgtacatagtatttactgtaaaatgtatgaaaagaagcttaaaattattacgtgtgtttgttatgttctcaatttgctgaaccactgctatcaattattaggggcacagaactatctttggaccgtctttgactgtctggctctgatgtgctagagttgagttcagaagtatgatgtttgagatcgagcgatgccttggcaatgcttaatcttttcataatacgtttcttttgccagctaataggtagatatgggatatatccgcattttccttctatcattagaagcttcaaagcgtattttaataccaaccagtaggcgttgtagctaattacagagccgacggtagcactattcgtccaaccaaaaatggcagt

SEQ ID NO: 13428 - DNA, 474 bp, Saccharomyces cerevisiae
caacttaattattttcttcttttgtatatctccattaatgtttattagaaattgaattttaaaataatacatcgtatcttcctttttcgactggcagtaatataacgtataatatatatattaggtgtgtgtatatatatccgtattgtaatattgatagtaaaaatacgctaaccctgaaatagaaggcgtatgataagacgtactgacactacgcactaccacaatatatgcgtatgtgtgtgtgtgtgtgtgtgtgtgtgtgtgtgtgattgtattggaatatatatacttactaaaattagcttatatggttcgcatattgactatttataaggatattcaacttgtctgtcctttcttaaccaaattttcttctttctcttggtggtaacatgttccacaaacttctcagtacaatgatccactttgaatttctttatgaaaacagggtcccataattcagaaccgacg

SEQ ID NO: 13429 - DNA, 439 bp, Saccharomyces cerevisiae
agagccctcggtagcataacatttttaattattacgactgttttttttattcattatgtagagataattaaatgttatagatgctctatactcaaacggtggaagaaaaacagcgaaaaaaaataaccgatacccccttttcgaatacaaatgcttgtatattcaattatgaattattttttttttttttcatttcttatattattttttgttcgagaatcactttttcaagatggtaacaacatcttcgtcttccaaaatgtgactcaaccccacgtattgaggttgatgtttgacactgctaccgtaaaccagagcatttctaaagtcgtccactaaagatttatgaatttggttacaaaaatccttgacactgcaacggtctgatcttagcaccacagggtcggtaaaatctggtatttggccctttggtttagtg

SEQ ID NO: 13430 - DNA, 418 bp, Saccharomyces cerevisiae
tgcctatatagagtagagaagaaaaatacaatatggaaaaccacgcatatatatatatatatatataaatacatacatatacataatacatcactttacttaaccgtatacaagatagagcaacatatacatcaagagtgtaaacctctcatatgtgagcggatgttccgatccatcccgaacgaaacaaagcaaaatcaacaagttgacatcgccgtaagttttcaaaaatagcccttttaaaactcgaagctctacacaatcgcagcaatgatgttggagccttcacctccacctttaacaacaacggtaacaccctcccttccgtccagtttaaagaaatctgtgacagataatgaccagaataataacaacgtgcccaggaagagaaaactagcatgccagaattgccgtagaa

SEQ ID NO: 13431 - DNA, 401 bp, Saccharomyces cerevisiae
ttttatggttccttactctcgcaatcatgattcactttgattaacattaaggataatcgtacttcatactctctattaattatagaattctatatgttatataagataaaatatattcattaaaaaggaagatcttataatttcattttagcaagttcttcttcaatagcgtttttgaccaattcaacgtcagctctttcgatgaattttaatttcttctttaatgtggatagtttcttcaattcctcaggcaaaacatccttttcaaatgaataattggaaaatccagacaatgcattgtttacagcatcggcaaatttagctgggtgagcggtagatagagaaatgtattggatggacttgtcattatcttttgcaatcaatctttctgtggcgcaaac

SEQ ID NO: 13432 - DNA, 440 bp, Saccharomyces cerevisiae
tagtgtacaaaaatatctatatgggtcatatataaaccaaataaagcatatataacatctcccttcactcttccaggtttgagtacgcttcctctaaataggggacgacttgctttctggtggcctcgacgttcagttgcttaaacatcgccacacctccatcaagattgcccccaaataattgaagttggagcttgtcgctaaccctttcaatgagttcacgtaccacgttagagtctcccaatatgaccaattctctgtgtgaatcaccagctttcctccatgaagtcaacagaaccaatacatcgagccccctctccgcctgaaatcttctgcattggttgacgaaatctgcttcaccaccgtgttcattgaatagccaagacattctttttactattgatgaaagaccaatctctaaccctttgtgtccctttcct

SEQ ID NO: 13433 - DNA, 403 bp, Saccharomyces cerevisiae
ttgaggcattaaaaatgtaccccatgaaactcttgttaaatttgtgcaggcatgaaagctactgtattttttcttaaagtaataaaaataaaacacaatgatattaaagaaaacgcatgcaactatggacacttgctatgtcgtgaatatggcaccacgttggttacttagctaaataaaaaatcgtaagtactcgcattttttcttctatattcactttgcttctttggacagttatttcaataataaatatttctttttttctaatctcccttatcacctaagaggaaaaagtttgaaaataaacttatggctagaggttatttggtattccgagaaaacatttgaaactaggaagtttacatatcagtgcaattatgtttccttcgatgattcacgtacc

SEQ ID NO: 13434 - DNA, 450 bp, Saccharomyces cerevisiae
taagcgcaaccgtgataaaaagcgcaactgtgtaaaataacaagtatgtacgtactaactatactaatcttatttggccagagaccagcctttttgtagacgctccatgacttgcctaaccgcagcctgatcgttctcgaaattgttcttcagaagagcctcgatatcatcccagggcacagtgagttcctgtggaggagcaggagcaggggagttagtggatttctcggcttcgggttccttagatatagtcggattcggcttaatcatgactgtgattgtggaattggcaggcgtgaccttcaaatccgataagaacaggttatcgtggaggactttgcccttcaaaagcagttttatctcgcttatgtgggaggccttttcctcgctgatcaagtgctgttttatttgtaagatagtatctgatgggctgaaatcatgctcgatgga

SEQ ID NO: 13435 - DNA, 465 bp, Saccharomyces cerevisiae
tcactttcaagctgtagtatgtaaacgatatagatgaagttttcgtgtgtataaatatatgaactctagagtgttgcataatttgaaacacagcatttcttttcggagagctcgtttcaaaatgaaacaaacgccgttgtccgttttcgtctcaatagaaaaagtgaaacagataaaaattgttttaaaagaaacgaatttgcaacatcttaagatatatcaaaactaatacaaaacagcctaaaaaagattgaacaactcttcgcggtcaggtctcgacaccataaatcgaagtactcgtacgctagttttctcgcacatagtaccactacgttccttttacaattagattacttctttttagttgacttttttgagacgttcgtgccattcataaaataggaaaagataacaggtaagcactgaagacttgttttataagtgtcccaagcgagacctagagtg

SEQ ID NO: 13436 - DNA, 439 bp, Saccharomyces cerevisiae
gttacagcatgttctgcttaaaaatctctttccaagccagaaatgtgggaggacctattctatatcatttcaaaatcgaactctatatctttatgtataacttcaaacgctattgcatataaacaattactcatatatagtccaaatgcattcataccatgttatactattcaattctagtgtcgttgtgcgtgatttttcacttttgaccgtaaatagaatttcggtgatattattttaactctcgaagaaaataaagtagattcatgtacacgtatatcaaaagagtacagtgaaaaagggataaaggatacactccacttagaagggcgcaagatgagtggaaaatttgttcgtgcttctaaatatagacacgtctttggccaagcggccaaaaaggaactgcaatatgaaaaactcaaagtgaccaacaacgcat

SEQ ID NO: 13437 - DNA, 429 bp, Saccharomyces cerevisiae
ctgaattaacatgttctatctaatatttatttaacatatttttgacctcacaaactttttttttttttctctctgtcattgacatttttttaatgtcacaaaaagaaaaattaaatgtattataaaatttcatttaaataggaaaaaacccgtgattactaaaggcatattaaagatctattaaagatctattaaagctttctgctaccagtatggataatattttaaaggcatcaaatatggaagggacttcaacaatgacagttacctcgcgtagttctgaagactctagttgtatctcaaatcatgaacaagataccgatacacataaggacggcgacacaagtggtctggaaaacagtaaaatttcgaagagaaagtggatgaaagagttttttaaactttccaaatctccagcttccaaaagca

SEQ ID NO: 13438 - DNA, 408 bp, Saccharomyces cerevisiae
atttactgactaaaaaatccagaagtattatattcattatttcatgaacaactcaacgatgtacatatgcacatatatatatatatatatatatatatatatatgaaagacaggaaatagaagttccctatctttttcttaatgacattaaaaaacttcctttcatcgcctactgccttcgcgtgtgtattgaatgctcattcgctctatacaatctagaactctccgaaatttcgttctactttgctttcgctatattaagctgtttatataaattacgtaatggtatatagtcatatagctaaattcaatggttcgtttctatagattggttctccttaattttaattttttattgcgtataacgtgagagattattttcaacccccccaatacttacgaaacttc

SEQ ID NO: 13439 - DNA, 500 bp, Saccharomyces cerevisiae
tgaacaacttacacattcctattcatgaaaaaacataattttataataaattgtttgtttgattcgattagtttatttaacttgattaatttaagtatttatttttttttaatttgttgttacacgaggagtattaaaaatatgacaaactgggatattacaacatagaaacaaagataacaaaagctatctattttaaaaaaattcatattaagcaaactggtacaaagtgttttaacgttattaatgaaaaagaaaacttgggaaacttctgacaaaaacagaatttagaaggttagaaggagaatgagaaaaacctgtaaaattaaaaatttttatgataggagcagaacttttgtatatcgtaaagactcacataaatccttcatcgaagaatccagggggtttcctcagtggttgtttattgtttcccaaactatttatgctgtcatctcgaacatagttttgcgacctaaatcctccgtccgaacttgaggtat

SEQ ID NO: 13440 - DNA, 424 bp, Saccharomyces cerevisiae
tcaatgcttctttcttgcgttctttttgttgcgcccatatattattttatttattacattcatatagcaatatttaccttattttattggttacttttctatacgcaaaatcactacactatgttatgttaaggtctccgatacgggaatataccaatcaatacttatcacttcggattttttatgggtcttatccccactgttccattttcttgtttaaggcatcccggaggataaactaaaaaggtggcccatcccacccgaaatgaaagtaatcatctgctagcaaaaagtaaagaaatgagagcatgctgtgatgtactggtggacgaaattgtgacccatacccaccgaagaaacatccgcatgacgtgttactgttacttcccggattaagggatgcattctaactctgtgcgccctt

SEQ ID NO: 13441 - DNA, 431 bp, Saccharomyces cerevisiae
agcgctctaagaaaaacggtatgtatacgtatatagaaaaatacatacatgatggaactatacagcccttgaaaaaagaacatataaaattaagtcaaaaaatgctatagcaaggttattatggttaggtttgtgactttctgttgagtcacgttctattcaaattcatatttcatgtttccgatttcttttttttatagattggcggccgctaacggtttctcgagaaaggcttatcgtgccattcagcttaatacaaatatattaaaaaaacaagatactttatactcacctttgtatgttacgatcgataggagaaatcgataatatacgtatacgataaagtctgtacaatatgactgcaccacacagaagtactattcatattcttgggttgggtgccatgggtaccgttttggcagttgaccttt

SEQ ID NO: 13442 - DNA, 453 bp, Saccharomyces cerevisiae
gaaaatttttaatagtaatcctaagcaaatataattataaactcaaataaatttatcaccacagaaatcatataatatacatcattaattttgactcaataatcttaaattgcgcggtgcggtgcgcggtaaattaaagtttttgtatgtctgcattaccctgccctctggcatataaatgatgtatgtaaggaatggttgacttgacagaaggtcaccgagaggctacaatttgtcaggaacagtcattacgtagggattttcaaaagtttgactgatgtctacaaatatattgcaacatgttaagcaattgctccataacacgagatgtatttagcttttttcacaacaagactggaaatcttaattacctagataacacaactcagaaaccggaagtttttgtaagtccaaattctacaatagtttcagccccaactttggactcttttc

SEQ ID NO: 13443 - DNA, 475 bp, Saccharomyces cerevisiae
atgctagcctgaaatgtattattgtgtacaatatatcatctaatgttttctactcgttataagtctatttaccagccgatcacttaaaaaagttatatatctctttttatcataatgaagaagatggcttatgcttgattttgactttggttgaggtatttcttttccaattttttgacttgaatgtagtcgtatatactcttcagggtgataaatagcccaagaaatgccacaaaaacagccaaccatggtatgttttgtttttcttcatccagaccgtgattcaaatgtgattcaaatttatcttgtgtcgttgattgtgaatttagacgaacatcatcgaattcatttggatcctctaattccattctatttaagcttttatttttgccgacttttgaagtaacatcattgggaatcattgaataaccatatccaatgaacgttaaccctaatccaaaccttgaaccttgct

SEQ ID NO: 13444 - DNA, 407 bp, Saccharomyces cerevisiae
aggccataattcacactgaaaaaaataacagcatggaagtgatatgtaataagtataacctaatccgatatgtaactattagatgctttttcgacatcgtacttgacctgctcggcggttatcatagcgtcttctttagccttttttttttcgctcagtcatcggggccaaaacaagaaaggcgaagaacagaaaaatgaaaaatgtaactggttgttgtaaaaaccttccagagaaataagatgaaatgtatgttgctggcacgaacgaagacaaataatgggagtgaagcaaaccccaccagtccaggtgaaagtaagcgacgcggattccaccaacagaaggaaatctagtagccaggaaggaaaccctcagctggttcaattaaaggcaaagagcgacaaaga

SEQ ID NO: 13445 - DNA, 478 bp, Saccharomyces cerevisiae
gctaagcaataagcgatttaatctctaattattagttaaagttttataagcatttttatgtaacgaaaaataaattggttcatattattactgcactgtcacttaccatggaaagaccagacaagaagttgccgacagtctgttgaattggcctggttaggcttaagtctgggtccgcttctttacaaatttggagaatttctcttaaacgatatgtatattcttttcgttggaaaagatgtcttccaaaaaaaaaaccgatgaattagtggaaccaaggaaaaaaaaagaggtatccttgattaaggaacactgtttaaacagtgtggtttccaaaaccctgaaactgcattagtgtaatagaagactagacacctcgatacaaataatggttactcaattcaaaactgccagcgaattcgactctgcaattgctcaagacaagctagttgtcgtagatttctacgccacttggtgc

SEQ ID NO: 13446 - DNA, 475 bp, Saccharomyces cerevisiae
gtaccggataacagagtaactggtaaaaacggcaaaaaatactgtaaggaagttgtctatatatgtacatatggatattgcggtataataaaaaagctttaaaattataaagaaacccgacttttatcacatataattatattataaaaaaataatggcatctgtatgaactcgcgattaagctcacttttttctaatgatcgaagttttgtccggttatccaactgtggcaagaacatcgcgaggcggagctaaacacagaatttttgtagcgcgatgagaaacataacgcctctttagataaattatcatcaccttttttacactaaataatgaagtagcatgctcagaagtgcgaatgaatttttgttcttttggttctagaagaacggagataggaaacctatgatgtaagtatgaatgacattaaacaattactttggaatggtgagcttaatgtgctggtatcgatcga

SEQ ID NO: 13447 - DNA, 402 bp, Saccharomyces cerevisiae
atgtccacagagtgttccgtttgataacttccaacaaaaaaacctgagaatatatatatttacatttatatacttagttgcaattagctttgtgcccactgagtgcggttgctaaatgtcttatagtcccaaaggatgcaaaaatctggtgtagtattcgccctttgggagtggccttaaacccatatacgactcttgctttcccattcgagtcatatttcaaaccaatagaccaaatacggctgagatatgaatcttctttaatgcgcctctccacgtaattaaactgttcaacgtctccaatctcataaaagaaggagtctgtcttcggcagccaataatttactagatttatatagcattcaagctcacccactagcgctagccttggttcgaacagct

SEQ ID NO: 13448 - DNA, 425 bp, Saccharomyces cerevisiae
tgctgtaatatcaatttttcatcaattttatatcgctcggtctttccccctttcaacaaagcttctgaatcatgtataataagtagaaaatatagagtaaaagattattgttcaggcaagttccttcctatcaattctttatgcataatctatcgaaatcatcaaaatatggcctatatattagcctatatattagcctatatattagcctatatattagtccatatattgcagactgaatttttttttctaaactatccatgtttgcaaggaattatcataaaatgagcatgttgcgatcaaagaatttgaccagtcgccaccgtaacacatcgaatcatggcccttcttcagataatgttgaatttgaaaatactcatcggaattatcattcatggtcaccaccttggcaccattgtacatgc

SEQ ID NO: 13449 - DNA, 488 bp, Saccharomyces cerevisiae
tgaaaatcttcccttggcttttttatggttgaataaataatcattgtttttatctttcctatgctttttttttattaatttgtgtaacgacttctccctccagcatacgctcccagacttttttgtttttgttttaatataaataattatgtatatacgtgggcaccaagttgagggggaattccttgtttatagttatgatacgtctcatatccttgtccttactttcacaatggtctaaaataaaagacaagaaaacaaaactgcaaatatattaaattctatttttcttttttagaagaagctattaataatagatcaaatgttccagccatttatattcacattgtatactccttcactttggtttacacctacattcatttgtgcagttatgctttgaacttcattcaaaggtcgccaagaccagatatggatctcctctgaaatcttctatgcctgtcctgcagatacgggggagagtcgat

SEQ ID NO: 13450 - DNA, 450 bp, Saccharomyces cerevisiae
tagatcaataagattcaaataaagcgcacgatatatacctattttcctatatatgcagataaaaagatagcacgttcattgctagcaggccttacaaacagactgtccgatgcctttactaccccacaatttatcccacttgtgattttcaagttcggcttttttttttttcatcatgtcgtggcaaacgaccagtattttctatcagaataagaaaaaactataattcactgcatacaaacgtattgactgctcccctacagcggaagatagtaagaatacaacatcgtaactgtttccatatttatgtgccgatatggtaaaagtgaaatctaagaatagtgttataaagctattgtctacagcggcaagtggatactctcgttacatctcgattaagaaaggtgcacctttggttactcaggtcagatacgatcctgtggtgaaacg

SEQ ID NO: 13451 - DNA, 445 bp, Saccharomyces cerevisiae
caagctgtaattaaataatcaaatgtctataatctccctgagttgcctctttttctatactcaattgggtaattgacgcgaaacgcgttaaagtgcaaaaaaaggcctggaaattatatttaacgcaatgaaatattttcataatatgacattcatgcacagctgtattcattcttctactttgtagtttgttattcttctttatcggtttcgttttacaaaagattttagcaaggaagcagtttttaaaccaatcaatggtatacacaacaccgcaacaacagcagagattcagctccacaccgcaatctagccacactcttatcttctcgccaatcagagccccttcaatgcaaacgccctcctcattggattaccaatcaccttcaattgttgtgtcatcgtcttcaatgaaggttcacggccggtcttccagtttcggtaa

SEQ ID NO: 13452 - DNA, 445 bp, Saccharomyces cerevisiae
tctttgtaacttgaacggatctttagtatatagaaacatacagataaactgattatttattggtatacatgaaaaaggcgacaacactacgatcgacagtcaagccttttggactttgaataaaatccagcacttctcgcatgcaacaaaagaaaatcttctatataagctgaactacatttatctgtgtcagccaactgcatgttttatatcacttctttttggaatattacgagtagattcatgaaaacgcaaacacttggtttactctttcgggaaatttaatgctagttcgccgcctcgaaaatgaaaagagaagaagagaccagaagagcaacttcgcattggcactgtttatttctttaagaacatcttcaatactaaataagacaacccatcttcagttatttttactcttggtagagcccaacttaggatccttttg

SEQ ID NO: 13453 - DNA, 463 bp, Saccharomyces cerevisiae
gcagatcaaaggcaaagacagaaaccgtagtaaaggttgacttttcacaacagtgtctccattttttatattgtattattaaagctatttagttatttggatactgttttttttccagaagttttctttttagtaaagtacaatccagtaaaaatgaaggatgaacaatcggtgtatgcagattcaacaccaataaatgcaatgtttatttctttggaacgtttgtgttgttcgaaatccaggataatccttcaacaagaccctgtccggataaggcgttactaccgatgacacaccaaggttggtttttcaaatttttctccagttctaaaaaatcggaaacctcttgaggtttcattgcatctttcaaatcttgtttgtttgcccataccagcagtactacattctccatctctttctcacctatgatactatataactcttctttggcctcttccatacg

SEQ ID NO: 13454 - DNA, 457 bp, Saccharomyces cerevisiae
atggtactcttgcatatgtaacctttaataaattttgcaaatcgaattcctttgtaacgtgcaaagcattttatagcctggcgctcgcattgttaagcaacaggcggtgcggcaacgttgaaatgtttcacgcagggttttttacgtactgcacggcattctggagtgaaaaaaaatgaaaagtacagctcgaagttttttgtccatcggttgtactttgcagagtattagtcatttttgatatcagagtactactatcgaagcatttttacgcttgaataacttgaatattattgaaagcttagttcaaccaagctgaaaagaaccattattcaacataattggaaatcatttcgttactaaatcgtccgaaaattgcagaaaaatggcacgtcttcctctaaagcagttcttagcggataaccccaaaaaagttcttgttcttgacggtggtcaa

SEQ ID NO: 13455 - DNA, 429 bp, Saccharomyces cerevisiae
aactgaacttccattatcctgtatagctctactgtataaaccttctatattgtaacctcatgaactcgcacatgtacaaaccttcaagagaaccggcaccaaagcgctaccatctggttgcttcatcgcttatagtgagtagttttagatttgaaggttatcgctcctggcaaaaatctgaatccacacaccgcataattagcggttattattactcaatttccggccggctttaatatactttcaccgaaaggtctctatatagaagctatttgctgacacttgcttacaggaatcgattatataagaagggttctgcatctggttgcctacttagttttcggtatttttgaagattagcaaaaagatcaagatatcaagtattttcatatttgtcattttaatgtttcgctcgggttactatccaac

SEQ ID NO: 13456 - DNA, 497 bp, Saccharomyces cerevisiae
ttaaatttttgttaggtggacctgcctcccatttttttctggcattccttttgggaactttttgttattttttggttctgcaatttcgttcagtgtatggtagaaaatatcagttgggttatcccggtttccttggcgttgttgtcgaagcgttcatatttgtaacgcaatggagtaaatataaatgtgatatgtaaaaaaaagagttataatttattctgtttctttaaatagtataaataaaaaaagtggaaaatacaaagacaacgtgggctgattacagtataatcaaccgatatggttttgccaaccagcaggctttggcaacttgtttatattgtagaatttagtagtacatgaataactgtgccatgtgaaatctttgcttggatcacagtcacatttgttagccagtctgatacttgtgtctattggacaggagtgaaatggaacatggtaataaccaatatcaccgaagtgatggatttcagagcggt

SEQ ID NO: 13457 - DNA, 422 bp, Saccharomyces cerevisiae
tattatttaggctgtttgagtttggggcggaaatgtatgaataaattgtgtaatatttagtctttacttcagcttttgtttttctaaaaatttgtttttaatgttttattgtctgaagtaaacattaattattagcttgagaattgctctacatgtatatataaacggcaaggatctactctttaatatagagaaatgtacatacctttgaaaacgcgttttcagagtttagaatgtataaggtaaccttagaaccacatctcttattgccagactctcaaaggtgaactgatattgagcctattttacccttgtttatgttcactttctcaatgcgaaaaaaaatcaaaaagaaataaactttatccttagagttgaagaattagaaagagaataaatcaaagggatcagttgggaaagct

SEQ ID NO: 13458 - DNA, 479 bp, Saccharomyces cerevisiae
tagacacttttaatggtaaatatcgttgtaataatataagccaacaagaatatagtccagtaattatgctatttgcagtaactcacatcattattctctctgttcatataatcctgaataacaggttaccctcggaagtgcatttagccgtataacaagtagctctttaaaatcagtagaacagatacattaatatgtgataatacggctgtgaggaaaaggtgaagttctggtgatgaatatagactgtttgtgtcgttgggtagttctgccactgctgcgctatccacttctggtagctcttgtattgagatggtatgtaaagtagaaaataggcatgaggttagaaacagcgttttttatactaacatgacgaactaacctaggtctctaagcgactcgataagcatttgtctaacaatctatacactactgataaatgcattcctcattgctaattcctatataaagcggtcggg

SEQ ID NO: 13459 - DNA, 414 bp, Saccharomyces cerevisiae
cacaatgcgtcttcagtttccgggggcattgcgtatggaaaatcatgtcactttttttcttccactttttcgtttgacttatataaacgcactttagtatagtttgctttatgtattaggttatcttggtgttctaattgatgttcttgcttccatttgtcattcgtcattccagctctatttacctgcccacgcttcgatttcgaggtttacttactgtaatctcaagaaacatacacatttccacccctcataaaatgttgcctctttcaattgagcagagaagaccttcccgctcccccgaatacgatcagtctactttatcaaattataaggacttcgcagttcttcacaccgatttaaacctgtctgtttccttcgaaaagtcagccatttcagggagcgttacattcc

SEQ ID NO: 13460 - DNA, 461 bp, Saccharomyces cerevisiae
tgtaattccaatatcgtaagcgtgggttacgcacaaactgtattttcaagatgctcacaaataatttagtttcatatatacgcatatatagaaagtatccatctataggtaatcatgaacaataaaaatattcacgtttcaggagctattgtttgtactcattacgtttttggatatcaagttgaaaatcagcccctttcactagatatcaagcgctataaaaaaattttaatttcgatgaggcatctttcttttctcttgtggctatgtaagcctaagaagccgtttacacatcaatgataaataagtatacaaaaagggttccattttttttttggccgctaccggactagcaagggcctaatggtacgctgagcgtagtacaaccaagcgcttgttagccgtagagttaagctcttgactactattacggtaaaagccgggaacgtgcgtaacaattt

SEQ ID NO: 13461 - DNA, 473 bp, Saccharomyces cerevisiae
tagcatagttatttgtaccaatcttatgatacatatttgaataaatttagtgcgttctctgtcagcgtcgttagtatttaatgcacagcatattatttcagaaggtcggccgactcctgcaactgggaaaaagaacttcaataagaaaaggcctgaacaaatctgcttggtaagggcccaacaacatttaagaaattgtacattttgaaagcactgatccatcaattaaagcaccgaacaacctcagagttgatacaattattagttaaaggataggatatgtcattttttgattctttacgtcaaaaggcaccctttttggataaactggcagacagtttcactccaacattaaccagagatgagaaattcagattaaaatataaacttccagctaatgaaaacattttggaagatacgaatgcagaagtttcatttgcaacttccattaaagatggaaaagggcattctga

SEQ ID NO: 13462 - DNA, 428 bp, Saccharomyces cerevisiae
gttaacgggcacagcgtcaaaaaatccgccaccacagttgatcgcgccgaaaacgagggagttgcgatgagtaaaatgaagggcatatataaacaagagtagacagagacacatttttcaatatcatatatatagatttaattggaaagacagttatattctaacgtcaaaaacttaacaagtaaatcaagttgcaatgtcgtcgcttatttcaaaaaccattaagtatgatccagccaaggataaattaatcacattagcatgtggatgtttttggggtacagaacatatgtataggaagtatttgaatgaccgtatagtggattgtaaagtaggttacgctaatggagaagagtctaaaaaggatagcccctctagtgtctcttataagagagtttgtggtggtgacacagattttgcggaggttt

SEQ ID NO: 13463 - DNA, 428 bp, Saccharomyces cerevisiae
tgctcgctcccgtttttacctttacataatataatctctaatttactttattacacaaatggtaactccctttaaataaacttaaaaaagaacgtatagaactctcttcttcaatgaatagtaatccaattttttttattaactatacaacgttatgactttaaaaattaaaaaatatgtttatgagtagtaagaaaaacaaaaggaaacaaaaacaaaaaaagttataaagcctatttctacttcctgtataacgaacacaaatggatattattctttatgcggatgggaaagtattcttagttttttttgttccagtctcgttatgataacactccgatcattccttatttttcttataatctgttaaccttcaaagttggtggcaaagattggatcaatttcttagccttaccagcatcgttgat

SEQ ID NO: 13464 - DNA, 475 bp, Saccharomyces cerevisiae
ctttatggaaaattcatgttttgagtataaattatacgtacgaatcttatagatatatatttttcttttaaaactccatttcagctcataagccgatacaaacaccttctatatattatttctctaacagctatgttaacatgattgcctttgtttatctactaaaggacccttctactttatctaccatacgcctatattttctctgtgtttcaatcatatcgagaaaaatttggtacttcgtgtctaaaagaattctatctggatgagttttctcatttggattgacaattcttgcattacccgttagctcttgcataactttccatagaaaacttgtcccgttatatcttccctctcctaggctctcctgtcccacggtcaatgaagcatccttactactttcctcagaggttttgtcaagtggttgttgtgtgcaaatcggaagagaatagttatttattttggcaggcgc

SEQ ID NO: 13465 - DNA, 419 bp, Saccharomyces cerevisiae
tagatttctatcttccaacgccttggtgaccgttttttgtagatagatttaggtattgcattgttttttactgtattatttatcgttctaaatatttgtgttttatactgtaaatatctctaatatttcaatcattacctttcaagctcctttaaagaatatgtatcgccttttcggtcgcgtgcttttatcgtggtatttactatgactttttaagctaatctatttttgcttctttgatgtgaagatcagacaattcaactttcagtttcatttgtttcgtaacaattgcttccgtttcctttatcatatcccattttctcttctttatagtaccagttgtagtgctaccactagtccctccgatttctttagagaataggacaccttgggcccaaccagcgtatgatccccatttt

SEQ ID NO: 13466 - DNA, 460 bp, Saccharomyces cerevisiae
aaaaagtgattctcgaacaaaaaataatataagaaatgaaaaaaaaaaaaaataattcataattgaatatacaagcatttgtattcgaaaagggggtatcggttattttttttcgctgtttttcttccaccgtttgagtatagagcatctataacatttaattatctctacataatgaataaaaaaaacagtcgtaataattaaaaatgttatgctaccgagggctcttcaaaagcgacctcgctttgtggtacccataagcattctgttatcgatcgtagagttttctggtaaattgacacatctcctcttgactgagctcgtctgcctacgttttagaatttcctgggtttggccaaactcccacagttctttatcattcagaatatcgaactcatcggatgtactgatggatatgttcagggttgctttcatatattgcaaagaatcctggatggtc

SEQ ID NO: 13467 - DNA, 437 bp, Saccharomyces cerevisiae
tatgaaaccgatttatctctccgagtcattattctctttaccttaatatatctgtaaataagcaaatgaatattttaatatatgtccaaggtttctttaaaagggattcttcagcataaagggcaaataactctttttgtttatatactgtctagttatatatatatatatatgtatatgcatttgtctgtgtctgtgtctgtttcctatgagaactcaaaaagtaactgaaaccgcggttgcttagatagagtcgataactgttcacccatagcgcagtcacaattcagcaaccagcttatcgtttccttacattgttgtagtattgattcgttcaacgcatcctcttgcgaacacttatcgtatgtaactagaattaatgataaaatgtcgaatctgtgagccactattctttcattcgggcaaacctttatgag

SEQ ID NO: 13468 - DNA, 468 bp, Saccharomyces cerevisiae
gcaatataatggacgggtttacatgtttaaatatatgtacatgtatgtagtcttatactttcaaaacataatcgcatgcgggtcatcaaaataaacctccattttggacttgggaaaaagaaaatttgatttaaactgttgtatgtagctaacaatacataaaactatttaaataaaataggaataagaatgctcaattaaaaaatgatttattttctaacaaaacttcttacaagtccttcttcaaagtacccatgaaagcatgcttttcagctggggtttggaatctacccttaccgaacttagaagcagtgtcaatccacttcaagctgacttcttccaaagcctttctagaagtgttggtgtacaaagactttctcaaagtaacaattctctttctgttacctgggatacaacctttaaccatgatgaagtcgttcttaatttcaccgtagtggacgaaaccac

SEQ ID NO: 13469 - DNA, 415 bp, Saccharomyces cerevisiae
tccatccacccgtattcagattggacattcgtttagcaaaagatttaaaaactacatttgagctaaactgcgggaaagatctacgtacatatggaaaagaaccagatgtatatgaaaaaagagttcataaccggtcacaatgcaacactttcctatcttgttctttcgttgaatttcactaaacaactaacgaataccaaaaaaatgatccgtattaagtaatgtatatacatatatattgtcaaatacaacaagatatttaataaacaaagaatagatgaattaggattgaaccggtaaaaggaaagctgtgaacatggtatttctcttatcgggcttttcaagatcaccactgagtggcattttaagcacatgaggagatgaacgtaggcagatcaaaacattcagccgatga

SEQ ID NO: 13470 - DNA, 410 bp, Saccharomyces cerevisiae
tttatgggaagagcgtgctaataggcaaaatattcatatatgttattatatagttatatgcatgcataaaacaaagggttatttattgggtacaaaagaaaagagcataactcgtggagtgcttacattgagaaaaaacttttataatagttacccatactgctacaatcagattgttcataaatttcattagcttttggcaaccatttcgacatattctctattctacgagtgcttgctggatgtgtacttagaaactccatattcacaacaccccctctattcatttgcttttcaaaatttgccattctttcccacacttttattgactcctgtggttgaaaacatgcccttgacattatcatcaggccaatgtaatcagcttcggtttccatctgtcttgatgctgg

SEQ ID NO: 13471 - DNA, 401 bp, Saccharomyces cerevisiae
atgcgtatgtagtgtccattgttattattaattttattattactttgaccattgtttaggtaaggtatgtaaactagaacgcttcaactgtattttttacgtaattatttgctgcatgtttagtttcgcaaagtttgtaccgtgacgaacatagcacgaacacaacatttaatagaaatagcttgggaaccaaaattttagaaatttttttcactaatgagaaggaaagcgttgcaaagtggcgactattttggttcttcaaatatttgcaggaaataaataatttactgtgcatttctgattacatttaggatgtaaattgacttagtagacgttccagcgaccattctcatttggtccttactgatatccatacactttatcctgtcgtgcaaggagtt

SEQ ID NO: 13472 - DNA, 458 bp, Saccharomyces cerevisiae
tgactgagtgattctagcaggtctataacattcaaatacagtaaataaatggatacaacattcctttgttttgtgtaaagtttaagtttctcttgcttccttcgtctcgttagacactgttttcttgggccattttggagctagatcgatttcatccctggggtatagccactctaagaggaaaaaaagcatgtactctacaattccacataacagataaagatgtttagcccagattccatctcttttgtaaagatttgctaccattttcatccaatctttatcatcagcggaagaagtagaagatatattagtatatatctctactgtccttttggctacgtccatccagtcgtacattttagacacgctatcatgaaaagaggaagtgtccaaagctttacttcttatgatattgatagctttatttgttgcttgaacaaggtcagaaacggatg

SEQ ID NO: 13473 - DNA, 445 bp, Saccharomyces cerevisiae
gcttaatgagattttatgtagttaaattttgacttatttaatttatgttttgtaaagaataaaatgagtatgatgaaggaatcttacctctattaactatttcttctttttttttccttcgataagatgtgcgcgaattcaatatggaagaaagcaatttggtatgcagatggtgttcaccggcagtgtttaagttacgaatatataaaaacaaattcaggaacccgccgaatttggcccaaacatatacctatatacaaattagtgaccatacgctattattactccgtcgtctaggagcggttcccaccatatctcccgctctgcagtaaacgctgatatttgtcatcagaagaggaattatcggtagcattaccatcgtcagaaaatcctgagataaatatatcggattcatgatccactgaagcatctgattcctgcgact

SEQ ID NO: 13474 - DNA, 483 bp, Saccharomyces cerevisiae
caatgattaaaatagcatagtcgggtttttcttttagtttcagctttccgcaacagtaaaattttataaaccctggttttggttttgtagagtggttgacgaataattatgctgaagtacgtggtgacggatattgggaagatgtgtttgtacatttggccttatagagtgtggtcgtggcggaggttgtttatctttcgagtactgaatgttgtcagtatagctatcctatttgaaactccccatcgtcttgctcttgttctcaatgtttgtttatatactcatatttctatgtgtttatacaattgctattgtttatataatgtagtgacattttctcttaatcttatactaatttctatgacatttatataagaagagacttatgatcaacataattttgcaaactttgagagaaatatgtctttctactgcgataaagttattatttagattacatgtcaccaacattttcgtatatgg

SEQ ID NO: 13475 - DNA, 432 bp, Saccharomyces cerevisiae
taaacgtagcaagcagggtacaccttattatcgacaaagtatatacacagttgtgactggcataaaaattcttttcatatatcttatcgtgtatatttggacattttataacacatcccactctaattcacaacttcattaacgaaatttaaataaatcacgacaacagttttgcttaaaactgaggaatattgaaaccaactcaaattcttcctaatttcaggcgtataaaaataacaaagtctcatcgagtgtcgggtaccattacacgaacatctgtctgcgttctatgtaacgaaggagaggtattatccaattttggaaatatccgtaatattgtccttagtgcacgaactatattatcccgcaaattcagggaaaagaaaagaagtagaaaaaaaaaaataccatgggagtcagttcttgttcagc

SEQ ID NO: 13476 - DNA, 446 bp, Saccharomyces cerevisiae
ccacaaagcaagccatttccgtcttgtatacatgtatataacaccaaaataaaaagaaccatgaattgaaaaacatacctcgttctgtggaagtaagtatttagtgtattaaagatatatacgtgcttctatagaaacttgaatcaaaaagtaccgtggacgttatccgatggcaggaatttattcaaaacaaggcaattctcgcgttcgtttgctcgtagtcttgttttgtcaaatagggtggataaaagctgaatcattactgaagaaaattcttaaaataacttaccggcaactttagaaataacatgtaatgcaacaacagaaaagatgaaaccgaccgctagaaacaacacaactaagggatctactcttagtcccgtagcctcatcagaataaatcttcaaaatcgaattattgctgttcgtgtttttctttggagcgga

SEQ ID NO: 13477 - DNA, 400 bp, Saccharomyces cerevisiae
atgtgatgataataccacagagagggaaagatagatgaactctggatatatagatatttctactgtgtatatatttctttaaggtgcactaacaaaaaagtgtgcatatacgcatattcaacaatatatatatatattacttcacatcatccgttctggtgggtatccaaccatcgggagataaaatgttctttattgcgataattaactggcttctctttttttgacgagatttaaattccaaatagcttattccttcatactctggtcttatttttttgaatagttcccattgtgcaaaccggcttacttgcgattgacagtgtttcctcagtggtttcgatgatttggtataaaatccattcctcacgccattaagaatcgcttcttcggtgctaaa

SEQ ID NO: 13478 - DNA, 413 bp, Saccharomyces cerevisiae
aagacgtaaggcatgaaaatattagggtatatagatacatattgaaaatgatagtagagccaatgaccaaaccaagaaagcctacagtacagaggtgccaaagtttttttactaatggggcaaatcatttttattgcaaaaaaagcactcacgatgggggtcgaacccataatcttctgattagaagtcagacgcgttgccattacgccacgcgagctactgtttgttggaagttttcaattattaataagtacataccaaccttagctaacattactataacgacgctgagaaagctatacaaaagatttatcgatcgagaatcattgtttcttatttttttcaggaaggatgaacacattgttcagaatattatcaattaataatttatcgtacggacggtacaacagcaa

SEQ ID NO: 13479 - DNA, 475 bp, Saccharomyces cerevisiae
ttgatgattgtgacgacaagatttttatacatatacatatacttatttttatctatgttacataccgcactttaaatagtaacgacatatatctggtagtgcggtatgagttatgtaatacactaaagtatagttttgtgtagcattttccatatgtccttgcattggtattgtattataataatgctgagagaagggttactctatagctcatttggccagataatacggcgagttatgtgcatataagaacaagtactagtgaaattatatattattgtttatgatcaacagaatcatctctactacacactgcattatgaactgcagccacatttatctaagggcggaacgtacctatgaaatgtctctactacttttatgaagatactgatttttagtttgtcacaaattttacgattctgaaaacacatatactttcttttatgttgatagagcaataacacaatggcca

SEQ ID NO: 13480 - DNA, 413 bp, Saccharomyces cerevisiae
accataaaatttaactgtagtcgcaataaaagatgaaaagctaacacaattatcataggacactgtaatccagactttaattagtattaagtattgagtacaaagtacaaagtattatactaacggtagtttgggctcttcgattacccatacacttttaatggactaatttcatcaagtttcattcgaaaattttcttaaaatatatatatgcgtagtggtatagtattcatatttcatgaacttatttcataaaaaaagataaagcaaacctaatatttggatcggcgctcgaaattattctcagtattcttcagcattagacatctttaacatatcaatctttaaaaggtttcttcttcttctgtagctcggaatataagcattcatatatgaccatgttgtaacgcgat

SEQ ID NO: 13481 - DNA, 460 bp, Saccharomyces cerevisiae
cttggcaaataaaaatatataaaaaatacagaaaaatagttataatacctcgcacacgcttttcgtagtaacagcgacataaagataaattctttaaagggtacaatccatcaagaactgactgttttatttaattcacactactgaacttcatattaaagtgtcgtcatttaagtctagtaggttatattaatcgcgcacaatagtttttttttatgcaaactgtatcacgaatattttttcagttttcggaccattttttgacatttttaaccagtttttaacatttttatggtagcgttcttttatttttcacgtaattgcattgaaatagacataaacgtataaaataatatacaagtaattagagcttttgaacgagattgtttagtggttgttttaactccttcacagaagttgaaaacttcaacgcattcatagccccacatatcaacacaaa

SEQ ID NO: 13482 - DNA, 402 bp, Saccharomyces cerevisiae
catttgtaatttgaccgattactgtacatttaatgatatataaaagatgtatatatataatatagaacatatttattcgaggattcattcgaaaaaaaaagaaaactttagtgacgagattgagtaaagtgaaaaactgaacaaattttcggaagccttttgattctaagtgcctactttgatatcagtagttgatgtattatagtatagacctattattcattaaatatactcagagcgctcaagtctgcttcttcaaagtgttcaaccgagcttgcaagtcatcgtcaggattaccgtgaaattctgatccggcgccaataggttcaggaatccccatcgctgtttctgcgatcggcgcattagaaaccagattttgaggcgtgctttgcaactgtgaat

SEQ ID NO: 13483 - DNA, 458 bp, Saccharomyces cerevisiae
ggtatctatatatttatttaatcgtggttcgcagtgtacgacataaatgttgcagagaaaatgcttaatgatcatgatccctgttatagcttatatgaaacagccagtcatataacatagaaattcattattgaagagttacaagctgtaacatttctctggcatattaacaacttaagaatttttattcttttattttatactgattagcatcgctacagaataattgtccgtaatttgtcctcttcatgatttatgttatatatgttccctttatggttataaatcttgaaaggggaatgatgtttatttgttatttatacagaaggcaaagaaaaagaaagaaaaccgccaacaggtttttaagggaaataacgaaaaaaaaaaaaatgaggaaattaaaaggaaagaaaaatggtgttatcaagccctgttagcagagcctgaacggcttgtta

SEQ ID NO: 13484 - DNA, 454 bp, Saccharomyces cerevisiae
ttctgagccatctctcctgatatataagacagatattaataaaggtgatatgatatagatatataaaaacactaaaaaattaggcagtatgataacgaatatctaatatgaaaaaaagatgaagatagcagattaaagatagacattaactccgcttaatgtaaataacacaatatgaatacctttttcatgccaatgcacttgccgcttccttaattccatcttgacttatgcttttgctaccttcacgagtgacttcggaatcattttcacccacttcaatggttttaatgtttttttcctgagtcttaccttccatgacgacttgttgaacttgctctttttgctttgctctatccctcattctttcttcgatggtaccacgaacaagtaatctgtacactgtgacttgcctcgtttggcccaacctatgtgccctatccatagcctgtga

SEQ ID NO: 13485 - DNA, 445 bp, Saccharomyces cerevisiae
acctcaacagctacacattcttttataatccttaatattctatatatacatatatgaaaaaatagaaaacgcgaaaacttgtcattttttttttaggcgtttttataatatactgaaaataaaaagaggctctttaaatgttgacactctactccaatatcaactgtaaaaaatctctttatctgctgacctaacatcaaaatcctcagattaaaagtatgtcctccactaggccagagctaaaattctctgatgtatcagaggagagaaacttctataagaagtatacagggttgccgaagaaaccattaaaaaccattagattagtggataaaggcgactattacacagttataggttcagatgcgatatttgtggcagattcagtctatcatactcaatctgttttaaagaactgccaattggaccctgtaacggcaaagaa

SEQ ID NO: 13486 - DNA, 499 bp, Saccharomyces cerevisiae
tttaaatccaaagaaaaataaagggcactacatagaacaacacaatcaacctacatagctctctttttttttttttttttttttttcttttttgttttttctcaattttcttcattttttgcattgttactactctcccattaagggaaattctaccaggaaaaccgaagaagacaaatgcaaaagggaaatatgaatacgcatgtatgcgcgcaaaaccgcacttacagagggcattaggacattatgtttgatcatgacgtcgaatatctgatcactgcactctcttccgaaacgaggatccagtatgatcaacgcctgctagacgaaatcgcggccaatgtggtatactacgtcccaagagtcaaatcccccgacactttgtatcgcttggtcggagcacttttccgatcgcagttcattgtccaattaccaccactacgccttttgcacatcgtcaaagatgttttcctttggaaactggaagtttctgagccca

SEQ ID NO: 13487 - DNA, 409 bp, Saccharomyces cerevisiae
atgtggtggtgtatgtgccataaatagaagcgcatatacttctcacataaatatatgtatatatctagtgaggtgccatagtattgcattaacagtgattcacgtcactctaaacgtcgcttctgttttttttttgaaatttttttctcacagctgctgaaaattttcgagcgaggcgatgagatgagctaattatatcaagagggaattgtactagtaatactttggtacacacaagaacaagcatataggtatacagtcacgactataatatcataaaatgagagtcagaaagcgccaatctagaagaacatctaccaagttgaaggaaggtattaagaagaaggcttctgcccatagaaaaaaggaaaagaagatggctaagaaggacgttacttggagatcaagg

SEQ ID NO: 13488 - DNA, 458 bp, Saccharomyces cerevisiae
ttctaggtttcaagtaaaatcatacgtatataagtagaataatggcatgagcggtgacacattgtgtatttgcaccagaggtggtcatcaatagaaaagtgtcacaatttcaacgataaatggccgcttatgtcgcaccttttgtagtattacccgcaaaggatcataatgaagaactactatggctacatataaacagagcagttagatacagtgcgtcttataagggcatttttgagcataaagcacaacaggttgaactcaagaaaactacatttcactatcaatggcacccacacaattggatataaaagtcaaggccttgaagaggctgactaaggaggaagggtactaccaacaagaactgaaagatcaggaagcacatgtggcaaaacttaaagaagacaagtcagttgacccatatgacttgaagaaacaggaggaggtccttgatgaca

SEQ ID NO: 13489 - DNA, 481 bp, Saccharomyces cerevisiae
taaaagacctgatacttattgacacaaattttctggatgacctttttctatatgatatataaacgtcgctattggatcgtaggttacttggccattatttgagcgtaaccgttcacaggatgtgggctttaaggaatacaaaatccaaatatggaaaaaatttgatatcaatttagggctttaatatctaaaggtatttatttttttcacagttttttttctgttaagctgtctgcaataaggaatgctcctgacatgaaattcgaaaaggaccggaaatagttggagcacaagactgcaaactaaaaaacaaatttctttggaatttccttacgcttatagtatatatcttataaatattaaaattaagagaattcaattattttacatcatttatacaactgtacagggccgcacatgatcactataacaatagagcggcggcaccagcaatagcagcggcaccgaaaacaccgttatt

SEQ ID NO: 13490 - DNA, 462 bp, Saccharomyces cerevisiae
catatatagagaaatacttcatcgtggtatataacccaaactaatagaaataaatatagtacgatcaaagtgatagagaggagccagtatatcccgtatcgtgcgataaatatgaaaattacaagaggccattctcgagtgaaaagatacattattttttcaagtagaaacctgaaagaacttcagtaagataacttagcgcacactttcctactttaagctcaccaaatggcatccccaggatcgacagcattaccacacaagcgacaaagagtccgaaaggcttgcgtgccctgtagggaacgtaaaaggaaatgtaatggcaaatctccatgtgaaatgtgcgttgcctatggatatgtatgtcattatattgacggtcgtgtcccttcggcatcacctcaagtgcaacaagtaggtgaaacatctcctgatacggagagcagaccttttgttcttccg

SEQ ID NO: 13491 - DNA, 462 bp, Saccharomyces cerevisiae
atcctatgaggatataaacagtattaaaaaaatcttaccataaagacatacgacatttcgaggcgtttttgcttttcttttaactttcgttggcacaaactgaaatatatgtggaatgccctctgaaaatatactaggagttttgagcgatccaaacattttcttttctttttttctcttccttctagcgaagtcctcttgcgttagctgtaaacaaaataagtcaatttcattaatgaaaagtgacattatggcggtagctctctctatctttgttcagttatcaacatatagtcatacttaaagatataatagctcatagtcatatatagttctttatacttgaaaaagtgattcctaaaaatctcaacttttttcacattgtatttacaagataataaaattattaccatatttaaacgaaagataaattttgaattaaggcggtcgttacatcatacc

SEQ ID NO: 13492 - DNA, 423 bp, Saccharomyces cerevisiae
aagtttatttgatacataatccggaaaatgtaagatatgccaactgttaactagaaaacatctgtactctatatatcggaaacaaaaactttacgggtacaaccatgatgaataagctcgaaatttttgccttccatatgagtcccattttggtgaccaactctcctacccgaattactgtgatgatatatactcttcgttttctagtaatggcttcattttgcctaagttggtcaaaattgttgtgggcggcttttgtttgcaccgaggagcgctcagttcgttataataccagttttgccactcctaaactactaaagaaataatagaaagatatattcatcaaacataatcacaatcaaaaaaatgtctacatatgaaggtatgtaatgatatattatgaagtaagttccccaaagccaa

SEQ ID NO: 13493 - DNA, 438 bp, Saccharomyces cerevisiae
tattgcgaggagcattaattgtatttagttaaaagaaataaatcacatttgaatcaatcagaaagaaaagtgaatgaataaacaattatatactttttgtaaaacctttttttcatgtgtaaccttttcttaaagaagtaacaggaaaacgaggagcgactaagtgactacttgatcgttcgagtagaacttaaaaacaaaaaaaattaaatatttacagtgtaaagagaggctgaagatcagtcaaaagacgcgtgcaacaatacacgacgatcatttaccatttctcaagtaatacatatatgcacgttcatgaacaggaacatcaaatggtgaaattacttcggattggcctggtcgagcgacgggatcccttaggtatacagcgtggcatgtcttgaaagatatttccaaatgatgaggtaaaatggcgaaagg

SEQ ID NO: 13494 - DNA, 481 bp, Saccharomyces cerevisiae
tgttgctaaatatagaaatgacattttttgcaagactaccgtctttcttacattttttgtaatgtgaatatatctgtatactttacaaccgaaacgacatttaccatacttataattttcgagttcttcgctgtggacaagagattaagtgagatcaataacttcgataagagtatctcccgggagtacctcgtcatcatcatcaaggattacaacttctaaggagctgctaatattatcacttattatttgatctttgttattcttcgtctctccgcaccagcgatcatctctatatctcctttcggctgcaaaagccgccaactctctcggggaattacctctatctatagatgatataccctctggatgcaaactccctaacttcacacctttgcccctttttctcactatccctgtgttagtacttattcctgtcataggatatctatttgaacgtaagtttgctcttccaccgaga

SEQ ID NO: 13495 - DNA, 444 bp, Saccharomyces cerevisiae
ctatgatacaggccttcgtcgtagctttccgtgaatatagcatgcatactctataatatgtatatctctgtatctaataataattaatgactttcattcttgaacgcgttctgttcgataaaaaagaaaggtatccaaacaaacgccatttatgaaaacggaggaagaaacaacaaaatagtaggaataactactcggtcagactgaaaactttatccgtgcatacgtcgtggtgtttatctttgattgtatcatattatgagctccaacaatgaaccggcccaaagtcgaacatcatatttcaaattgaatgaatttttgtccaacgttaagcattacaagaatacctttaagggtgagattcagtggtgtaataacctgtccttaaacgactggaagacacactatctgcaaattaccagtacaggtgcactaacccactca

SEQ ID NO: 13496 - DNA, 412 bp, Saccharomyces cerevisiae
tttcgaaattacttacacttttgacggctagaaaaggatatacatacatattaaaatttttagtaacactctgtgctttttcaaaaatttgaggtacacctaattctcccacttgttgcttataccaagtttgaacaattttaatgttaagcacaatagattggaatattatcatatggtggttcagagagtagtagggtgcattttcattcctgttgcctcaatgtgttttctatctgtatttacgtgattttatgaagtggtggcatcgcttagatgtggtgcataattagagactaatttttgaaaccacgcatgaatgtcaagtaattctaactgagcatctgtcatcaatggcacttgcaacttcaaaaaatcccaccaatattttgacggcaccaatttacctttg

SEQ ID NO: 13497 - DNA, 437 bp, Saccharomyces cerevisiae
ttttccttaagttaattgactggccaatcttttgaatataattgcgcatcttccactcttattgataaacgttacggaagtatttaatgtacatatgtaggatagtattaaataaacttcaaaaaattaagcctccgcaaaacgcaccatcagtagttgactacggggaagtcttcttcaggcacttgacagttttcattaatagaatgatccacccattcaggggcaacgaccctggctattttcggtatagtatcagaagcctttatttgttcttttattttttcgtgtacctcattcatgcagtctttcctcaaaataggatcagtatatggtataattattaagttacaaagtgactgttgatctgttatttttccaccaaacaacttaattttcatttctataatgtcatcttctgtgctaattttgcgacg

SEQ ID NO: 13498 - DNA, 452 bp, Saccharomyces cerevisiae
aaagagtgtctgtttatagcatatatacgtacatataatatatacgggaaattaaatgaagttgatcaccattaccattatcataaagaacttactacagagaaattttgacgccgaaccagcatacgtactgacaatgggtgtagtaatccaagttgaggatgcagcagcaacaaaagaagtagcaatcccactggaggaaagtcgttgctcgacataggtcgtagttgttggctttggtgctgaagttatggccacttttgttctcgttattatcgtcgttactgatggaattacagtttggctggaacttgttatggttatcagttctccattagtatcactggatgtatatgtaactggcttcactgtagtaattgatatagtggattcagttgaatgcacttccactgatgttgttgttatggcacttggggtaatgacagacgtca

SEQ ID NO: 13499 - DNA, 457 bp, Saccharomyces cerevisiae
catagtgcatattgaattgattagttgaagaagaaaaataatgtttatgttataagaaacaataataaagagatttataacctaacctaattaaatagcatgtagtcaacaaaaagggagtaaaacatgcagtggctctatatatataattatcgtagaataattcaaaaaaaaataaaaaacgaaaaaattcattcttcatcactcatcaaaggcactatttcgtcataacgcggaggctcgttaccatgagagagtagcgaatctgcggagctcgaacttactattccttcttgttcttcatcatcttttacattcgctaaagtgtaaccctttttgaaaaattcgttctgtttgtccttagagttttcagtggtagcgtttggaatcctcacagtaccatttgcttgtgataagccatttgttggtgatgaattgtgagatctattgacgggcg

SEQ ID NO: 13500 - DNA, 412 bp, Saccharomyces cerevisiae
ttacattacgccaagggttgttataaatatttataaattaagacagatatataaagttaaaataaataccaaaagaacatagacaatcgtaagagaataagaatcctttatcctagagccatccatctgttatttttgatgttgctgactttttttctgataaattctattattttaatagtaaagaggtgagtatttcgcctaaacgtaaacaaaacgataataaaaaaaaaaaaaaatgaagacaaaatgttcagatagtcaattatattgtaataacatgaaacggaacaataacagtacccagaattcaatttcaatggcgttgtgtcttcttttctctaagaactttcataaaccaagtcgtacttaaccgcgctagcgataaccctgctaactttgtcgcagaggg

SEQ ID NO: 13501 - DNA, 410 bp, Saccharomyces cerevisiae
tttgtcggctgaaaagaactcttttacgtgaataaataatatagattatataaaagaatgaatagaaaaatttaaataaataatgaataaaataattaaataaataatgaatcctgtgattaagttagcgtgtactttggtccatctccaccttcgggtactttccaagtaatatcttgtctgggcgccttaatatcacaggtcttgcaatggatacaattttgtgaattgatttgcagtctcgtacccacaggcgatttttcatctttgacgaattcgtagacacctgctgggcagaacctcgattcaacacctttccaaacgggaaagcttctctcggcgtactttaccatatcttgtccaggaaccctcaagtgacatggttcatcatcatcatggtaggttccggt

SEQ ID NO: 13502 - DNA, 479 bp, Saccharomyces cerevisiae
ggcaagtatatatagcacgtaatcttcacataatcttcacatacatatttatacatgattaaatcctccgggtaataatacgtcaaattaacttaactaccgatacgatgcttcattatgataacgataacaatggcatctataaatgattttattcctcgttaggccagtattagggcagtaaagactgtaatgaccagtacaagaacgttgagatacgcacaggttgcctgtgcttgtatctggtgtcttttttcagctggtattatctttggatttgctgctttgaaacctattttaatttcagaaggtgtataccatgaattgtgtgatcctaaggatggtgatagattattatgtactgcacaggatctgaaattaaattttatatttgctctcagtgctactgtaacaaacatcatggcccttcctgtcggtaagattttggatatgtatggacctcgtgtctgcggaataat

SEQ ID NO: 13503 - DNA, 478 bp, Saccharomyces cerevisiae
aattaggactaggcgatatagatttgtatataattttatataaaaggaaatatgtacatcattttctttcactgtaggcagctgtttcaagttctttttttattggagatataattatttacattattgttatagaggacacacgaaaaagcaagaagggaactataagaaaaataaaaaataatgaagaatacagatctgtaattagtcatttcaagtgagcgtaataagtaaagtaaggtagaacggaataaaatgctcaagcgtattgttggattgcctgcaaggcgttgctttcatagaacgtcctttttgctgggcagtgactttgaaactgtgcatattcccaatacgaaccactttaaagatttacttatagagaacggtaaatttcaagaggatcaagcaactacaatagtagagataatgacagatgcaattaggggcggggttaatcatgtttcacaggatctggcaa

SEQ ID NO: 13504 - DNA, 456 bp, Saccharomyces cerevisiae
tttcattgagagtcttactcatcttcaggtacaattgcacaaacagtccttttttttttctttagttctcctaacctaatatgtcttgatacccataaggactgtaaatactattacgtataaattaagcggaggtgtgatttgttatatcaactataatatgattaaataaagccatttattatctagtataatttccaatcctgagatgtgactaacgtgagcgcttacgaatcttcgcatcatacacctgtggccaaggctggttggcggtttaagtccgtctgaaaacttttttttacgtcatttgaagatcaaaagtattgaacatatacctaatgacacagttttttacactttttttgagttaaattattcaaggacaaaaaatagtgtgcgtaaatggaagaaatataaacgtatatagaaaatcatttacctctcctgtagcaccgc

SEQ ID NO: 13505 - DNA, 428 bp, Saccharomyces cerevisiae
catatgcaggtctcgatttccaaactctttaaaagcatataatagataaaaaactaaatagactactttgtggcacaaagcagaaaagtggattgaatatttttcaatctaaaaagtaaatattatacaaccaaattgagagagtaaggagaagtaagaaaaataaattgcttgaaaccggcagaaaggaagcttgaatatgggtcaggacgtgaaacatatcattttttcaacgcttccttttgagcgttcagtaaagtgaacactggagcattcaacttactcctgcctttcaagaaatccaactccataacaaagttatattccaaaaggttggcttcgagttgttcaactaattcgccggctgcagcagcagaaccaccagtggcaataatgtcatcaacaatgataacgttggaacctgctgg

SEQ ID NO: 13506 - DNA, 462 bp, Saccharomyces cerevisiae
tcatcaattaatcaatatggtttggttagtggtgactaccttttttattctcgttatatatgtgtattagaaataatttaataaccgattatttattgcttattttactggtcccagttttccaacaggacttcttttatgggcaaagtgaactcaccctcttcattgacgtattttcttgaccaaagttggccagtattattgtgttccataggtatcaagtgcgttttagtttgcaggccaattttcgttattatgcacgctgaatgcaacgctatttggtcattgaacaactctggaaaattgacagtgctgccatgtctcttgtcgtttaatatgggctgatttaaaatttgagagacgtgatttcgaatctgatgtttttttcctgtaaccaattgtaaaacaatacaattttcgtcaacttctttgaacttagtaatctccctaccaccatgtgaa

SEQ ID NO: 13507 - DNA, 479 bp, Saccharomyces cerevisiae
aaagctttgtaaatatgatgagagaataatataaatcaaacgctcgctgattaaggtgtcatttattttttttaatagaggctttgtcttttataattgtgtattttaataatatgattatagtatattttcaagaatagaatttttgcgcatgtaacttcgttcatactcaattcacagtaggcagctgtatttgtatccgtactactggcgtacgtgcgatgaattaatcgtatcctacggcaccttgtaagcagtcgagaaatttttttttcactttttccttttcatacctatataaatagaagtgttcttgtcgatttgaagaaggtttatttcgtttcgctgtagtttttttgtcattgatcttttcatttttttatttcaaaatccccatcaactattacagtcgatgaggataggttatagttcatgtgtaacatctgtgttttaaaataactctagttatccggggcgtt

SEQ ID NO: 13508 - DNA, 495 bp, Saccharomyces cerevisiae
ttatcggttgaaagaaaattacacatcgatttatgcaggcaatcaactatagtatacacaacatatactcctatgacttgtagatttcttgcctaggaagactaaatacgtttaattctaagattaggagcccatgcatttaaagttgctttttgcctgtgcgggacaattttattagtcagtatggacatctccgcggggaatttttttatcggcagagctgtttagacaaaggatatagatagtataaggtgttagtacacacatttcaacatagttatattaggaagattgccacaaatttcctcttttttttttttttcttgtttttattacacctccgccccttgaataccttagaggttaagaagtgaaatgccaagagaaagcctaataggacacacagtatttaccacgggaaaagcgcgggatatttgaatcagctggagattattatgtacgccatgtatatttttagagacggcttgtaacggg

SEQ ID NO: 13509 - DNA, 440 bp, Saccharomyces cerevisiae
cttcgctaatatatcaaagaataaaaaaacgcttacttgtaacatatttaagttaataaatgtcaagcggttgctcttttcttataaaaatatattgtatgggtacaaaaattttgacaccactacttgggtaaatactacatatgtaaatttttttaattcttgaatttaacagacctcgtcaaacccttcttgatacctgtcttttcaccttcatagacgccagattgaccaccagaataaactgcacgaaccgacttgagtttcttttgtgccttttggtatttctttctcttcttgacacgagagtttctgttatccttgtttcttttaggcgttagacccttgttctttaaaatttgataattaatggcacgcttaccatcacctgagacattttcagccaattccgccaattttccttcccttgcagcaataac

SEQ ID NO: 13510 - DNA, 446 bp, Saccharomyces cerevisiae
tgaatatatagatgtttagtctcttatagaatggttcttcgtgcatgcctcttaacataccaaaagtgcattacatatacttttaaacatactctcgcagaaagttaaagtccctttttttttttttttttcattttttgtttgtattttcccgttttgaaaaactcccactttaatgcaggacatcgttcaaaacaagctttaaagatttgacagtaaaatcctcactttactcaagacatttttctcaaaaaaagagaaagcacagtaaaccctccttaattttccttttgcataataccagacacttaaaaatgagcaaagacaaagatatcaaagtcactcctggaacttgtgaattagttgaacaaatactcgccttactctcccggtatctctcatcttatattcacgtgctgaacaagttcatcagtcatttgcgaagg

SEQ ID NO: 13511 - DNA, 444 bp, Saccharomyces cerevisiae
taagctttcgagaaaaactttcttttaacccctctaatctaaatataaacatatagcttatagaaatgaatgaatattttaaatagttacggatacaaagagttcattatagtgcgggcagttagtacggtatcgatttatcattggagatctgcagtgttacagaagcactgctcaccagttgtctacggaaggacgttgagatagttttaccacgtttgagctaaaagtttctaccacaagagcctttatttgcacatggcagtgaatgcatgattaaggatatgaagaagaaaggaataactaggaataaattttatttagagagggtatgatgaaaggagagcctcgttatttatgacctgcatttttatcagcatcttctttccagctcccgctaaacatgtgctttacaaaagccattttgtcgtcactagactgggc

SEQ ID NO: 13512 - DNA, 468 bp, Saccharomyces cerevisiae
atttcttgcaaacataagtaaatgcaaacacaataataccgatcataaagcattttcttctatattaaaaaacaaggtttaataaagctgttatatatatatatatatatatagacgtataattagtttagttctttttgtaccatataccataaacaaggtaaacttcacctctcaatatatctagaatttcataaaaatatctagcaaggtttcaactccttcaatcacgttttcatcataacccttccccggcgttatttcagaatgtgcaaaatctattagtgacatggaactcaaagaaccagttgtttttttgtcctttggtccttcgctgcttccctcggcatcatcatcatcatcatcatcattatcatcatcgtcgtcatcatcgtctataaaatcatctcgcataagtttgtcaacatcatttagtaattcccatcgctccgggtctccttcgtaaat

SEQ ID NO: 13513 - DNA, 460 bp, Saccharomyces cerevisiae
aaaaggatattcattgcacgcacaaaccaaatacttcaaatagcaaactaacagtaagaatatataaaactatacatacgtatacataaaaaaataatagggaaaaaaaaaggaaaccatatgagtttgaatgaggcgacgtgccatattaaacaattatattttaacacttccgcactgcacctatttagttggctgatttgtgacgtttttaattccgatcggcctgaaacagcgaagggtcctggaaaattaagataataaaacgaaatgaaacccagcaacgttagatgatgctcaaaaaaatatagagacagagaaaaaccagaatacaaagagctgtttaagtggtcaatatcccaggtacaccgagcccagtcacatcgaacttataatggatgcaaagaaaaatactggtgaagccaataatgatgtattggaagaggaagcagcgattcag

SEQ ID NO: 13514 - DNA, 446 bp, Saccharomyces cerevisiae
taaatatagcttgattgctgcgcggttgaagatcttttgtacatacaataaatattctttatatatacagctttcgatattcaagatttaaacattaaattattaaaaagaggtctataactagacagttgctacatccactcttttcttgttatatctttttaatatacaatgttatgtaaaactctctgatagtattatgcttattatttaaacaaggcatcgtttgataaaggatcggcggcaagaacattctctcttctcttaatttttctttccacagcagcttcagctctagactttgcctcctcagcagcttgttgtttaatttgagctcttacgacgtttggcgaaacatattgtttattttcatagatctttggaccaccaaatgaaccttctaggatcaaaatgacagtcataacaaacctagggccaatttccac

SEQ ID NO: 13515 - DNA, 480 bp, Saccharomyces cerevisiae
ttatctctgcggaagactaagacaatcaaaatatgtattcttactatcataattaaatatttttatcgttattaattattattattattactattattattattattattattattattattattatttattatttattaattattaattgttaatattattaattcttgtctattgtcttttgatttatctgcaccgccaaaaacttgtcagcgtatcagtccatgtgtgggaagggcaacggtaaacttcttatgggtggtaatgtttccagttcttgaacttgtgaatccgactgagaaatgggggtttgttgggtggatatagcagtattaatcatattcacccttggtgacaataataacggggttgtacttaacgaactactggaagccatcatttgattttgattttgattttgactttggtttgacgtattttgtgattgcagtagggtatgttgctcttgctgctgttgtt

SEQ ID NO: 13516 - DNA, 452 bp, Saccharomyces cerevisiae
acgttaggacttctttaattccctcttttatgctttagtatcgtcatattctttcatacccttccttataagctttttatataaaatatcccaccgggaaaagataaagaacggaagataaatcaaacaatgaaataaagcacacacatataaatccacatatgtacttatatattttacttcaaacaataaacaaacattttattatttatttttcccgtacatcgatgtacgtgatcggtttttctcattcctctcggatccttcgggaccaccatgtctcacccaccaaggtcaaaaaaaaaataaaatcggacgagaaaagtattgggcaaacaacaattatccacgtgcttatcacgtttttttatttaatgtagaatgtaaaccattataccttaaagataaacactttgttaattaatcattttagttggcggtcattttcattt

SEQ ID NO: 13517 - DNA, 448 bp, Saccharomyces cerevisiae
cccctctaaatatactgctagtcaataaaaacacatagaaaataaaaatacagaaactacaaaaggcaaaaaaaataaaagaaaaggtaataaattgaatgaatgtagatatataaatatcaatagaaatacgtacgcggaattatttctctttgtaacaaattgatcaaaagctttgtattttttttttttttagctcggctgcgcgctattacagtaattacatgtaaataaactattccaaagaatacaaaagaagagcttacagtagccagtcaaagtcgctgtgaaacatacacggcgttgtagtcacagtatggaacacaatctttcacctttacagcaagaagtattggacaaatacaaacagctttctttagatctaaaagctctggatgaaactataaaagaactaaactattcgcaacacaggcaacagcattcacag

SEQ ID NO: 13518 - DNA, 408 bp, Saccharomyces cerevisiae
atcaagcgagatctctgtgtgtgggcacgcaagacgaaaagacaactatatacacagctatatatgtagtagtagcctcatatacgtatggcatcaaacatgtagcataaacaacctaaaaggaaaacaaagactgagatctaacccaccacagtttctatttgagccttcccgtcgcgcgtgatttggagatacagattctaagagctttaaagaacgagatactctcctgttttaaggactcaccggcatataaggcagcaaagtcgccggtttgaaggttcaggggccttgaaggtagtatcatttggaaaacagcaagagaatatggctggacaccatcacgaacatgaacaagagcgcgaccacgagcaagaacacgaacacgattcccttcaacggcctact

SEQ ID NO: 13519 - DNA, 464 bp, Saccharomyces cerevisiae
tctatgaaaccaacctctgctataacccgtcaaataactaataatatctatataggtcaactagctagtgcaatatcatagtaacaataatattaataacgtcactttttttccagggtaacccaattgtggtgggtggcggccgaggtatcccttagaaaagaattttttaagttctttctcatctcttaccagtggagaagtacacgatatttgcaaagtctgtcatcagggcttgataataaagctgcattagatcttagcaaaaactacgagaagaacattgaatattgtagctgtatttgcatacataaactttatcattgttcgttagctagctttgcacattaatttttcgatttgttaccgccaatgaccgctaacaatgacgatgatatcaaatcacccattcccattactaacaagaccttatcccaattgaagcgctttgagagaagtccagg

SEQ ID NO: 13520 - DNA, 481 bp, Saccharomyces cerevisiae
ataagcgtccccacttttatttcttttccaagcatttgtatataacctttttttatcctatttgagtatatgttaaaatacaatgtcatatttacttctgttaaactaatttcatattttaccgttctatagaagcctaaatagattgacctcctgttcataatctactattttatcagaaaaatgtaaaagcttagtatgataataattaatggaaaagttcgttaaaatatcgcgccactaattaataataatgaagcgggtaacattaattgtcttaccaaggcgacaattcccttttctaaaatttcacagcaaagaagctttagaaagtgcagtaaatctacaactcataagaaggaaaaaaagcgtgaacattcaaatcgacagcgtaaccttctgtatttatttctgtttgttgtactttcgaactctcgaataccatagaggaactattagtctccataatgtcacaggcagc

SEQ ID NO: 13521 - DNA, 448 bp, Saccharomyces cerevisiae
agagttgattaaaagaaaatgaccttttattacactttctattattaatgtcaattaatgttaacccatgtttttcttttgtgtctataattctttttttttatctctaagcttttgaacaatgaattttttgttcctttcttttaataatacaagtactaccccatgaaaccaatattatcatgcatttttatgaatgtcaagaataaagatactgttattttttgtgtcttattttttttctctttgtttatttaaacgttttctaaaattaaaacttatgtatactggaatatgtgatatagacgatttaaaagataattccaataaacgtccctcggatctcatatttataaaggtacccttttaatacaatatttatacatgtgcgttaaatactttgttctcttattatctatgaacttatcacgaagaacggagatgtaaa

SEQ ID NO: 13522 - DNA, 500 bp, Saccharomyces cerevisiae
ttgtttctataatgtacacaacgtcaataacataatactacgtagatgaaaagcggaaaaattcattacccgggagcaagcaaaatactagtagtaactaatgaaacttctttccattattattgatgagttaacttatgtagactcatctttgaatcccctatcccaacataagtcccggaatggaactccgtagtttttctagacagcctgatggcatacttgctaacccaagattgggaagggaggaagtattggaaggtgaacatccgcaagatgctagattagcccgacaaagcatttggttgagcccaagtttaattgcggagtatatacagctttttttcaattttattataggaactataggactgtctcttgctattaaattcattttgatgataagaaacgatgttaacttaaaactggagcataacgtgagggaagaattagataaaattgcaacttgcaaatcaaggtattttgaaaaccagtgcgaa

SEQ ID NO: 13523 - DNA, 421 bp, Saccharomyces cerevisiae
attcctaacgttgctccaatgacgctgcaatagcttatgtttatctgcaacgtacttttaatagttattccttcttgaatctctataagtatatctataccgggtgacaatttgatattttcgtacgccgttatgtgttggtttttggtcttactgataaaatggcatcgagcttacaactgaagagaaagacgatgcatcagtcaacttaattctctaataaaacagacagcatttcctcggatccatttcgtacatataaaatccgaagcttttcaggacaaaatactatttttctgtcactactaaacgggatagtactaaacgggatagtagagatagctgccaaataagatcaagaaattgtgattttaaatactttatacgaagatggtgtacacaggatttggtttggagcaga

SEQ ID NO: 13524 - DNA, 431 bp, Saccharomyces cerevisiae
tcattttttacttaaaactagtcatttcattaataatacctatccaaattttagtatgtcgatggagaaagctgcctataactttatggtaaggaggtaattgaagcagagtacagcagtcctttgatattttatctaaatcttaaatatctcttttatggaatttgtgaaagtcgtagtgtgtcgcatggttttttttcttaagaagttagctctgtatagtccctgtatttaaagagttaatatttcgataaacctgcaatgaaaccctttcttggcaatttggctatatttaaagtgtgaacaatggtcactgaatttttatacggccctcaggcaaattttatgaaacgttaattgcgtgtttcagtattatacacagatgcaaggaagataaacaaaactgcataagctaacttccgtcctggaaa

SEQ ID NO: 13525 - DNA, 418 bp, Saccharomyces cerevisiae
atgtgatgcctgccttttttgctgtttttagttattgggattgatttcactaaaaatcaagaccactaaataaggctattgtttattttaatatttattgcacttgtatgaaaagtaccaaacttttgatactgatattacacttttagtcttgaactttcttcgttaaattgctgacctactttctgttcttcgactccaaacaacgattcccaaatgtattttcacagggccgcattatttctttgatttcgtttttttcaccaattttttcttgatgtgcttcttgacttttgttttccttttttctctttttgcatctttagcttcctgcttgcgcaatttttttaaatccttgtcctcatgtttcttcccctttaaaacttttggttcatcatcgtcatagtactcgccctcc

SEQ ID NO: 13526 - DNA, 432 bp, Saccharomyces cerevisiae
ggccccttgttaataattcttgcacgcatacttttgttattttgttgctttatcggataaaagttaatataaatcgatgtaaataattttatataatcatacaacagggtaataaaaagacgaatatattcaaatgcgggttctaaatctaagtttcattctcactatcactgctttcttcctttgcctgttgagagagtagttctttccatttttgagtgagctctcggattgcttcaggatttaaactagcttctacgagatcctgtggaacatgattttcggagtgctcttttgaagcgaatctccccgtgttatgcctcgtcactaaccttaattcataatcttcaacatcattcttcggaggtgctatcgcagcaatctcgttccatgaaaatagcaaagaatctgtcttcctggcaaacggattta

SEQ ID NO: 13527 - DNA, 400 bp, Saccharomyces cerevisiae
gatgtggggtaagaatggtactgtaatatagttcaagataatagtacgtaatgtagggagcctgcttctgtggtatataaataaatactgggcttgcgtttatttttaaagaatcaatatttacttttcattaacaaagggcatacgcccttaaaacaaaacaaaaaatccagatcatgcgagctttgcctttttcagtaagtttccctaccttgcagccgagacgcgacttcggaacgatgccagcatacgtatttaccattattaaaaaaatctgatggcttgatactgcgcgtttctttttatagcattaatacgcacacatacgcgcattgttgtttactataaataaaccgtggggacctgacccagtcatcctccctgtgtttacagtgcggtg

SEQ ID NO: 13528 - DNA, 436 bp, Saccharomyces cerevisiae
ttggataaataattcgttacatagttatataaatgtttacatgagattcaaagcttcatattctatgaaatctttattttttacggctttaaatgaagtgcgcgcagccatgtaagctaagcgtaagagaatgaaatattataaccaaccttcagagagcaggtgatgacaaaagttacgaacacgagtttgcatcctaataataatgtttaaccgtaccactcaactgaaatccaagcatccctgttccgtgtgtacgaggcgaaaagtcaaatgtgatcgtatgataccgtgtggaaactgcaggaagagaggacaggactccgaatgtatgaaatcaacaaaactaataacggcttcatcttccaaggaatatctccctgacctattgttattctggcaaaattatgaatattggataacgaatattgggctg

SEQ ID NO: 13529 - DNA, 412 bp, Saccharomyces cerevisiae
attggccacacattaaaggaaatgactaagataaaatatacatatataaaaagataaacaaataagtataagtttggtttcccttcccgttattatgatcgctcgtgacggatcgtctttgccctttttggtaaaacgtaaacaaaataacaatagaaaaaataacaactttatcaatgtttatttttatttattaagtatttgatgtgaagtagtttttctaaatgctacttcattttgacattgtaattcaattactatcaagtcatacccttaaatcgcaccaagtagagccccccatggattttgaaacgtcgttcgaagaatttgtcgaagataaacgattcattgctctagaggtatctgataatgatgacgattgtgacactgatttgactgctgacacagctga

SEQ ID NO: 13530 - DNA, 431 bp, Saccharomyces cerevisiae
tcgaatgtttctttcttttattcaaagatgaggatgaatattatttattaaaaatgcaatagtagtctataaaatatttatgtagaaaaggaaaaactaacacagacatggctttttcacccattctgtgacaatgagcccatcatgcaaataagtgattttgggtaaaagtttataatggaagaatttaggtagtaaaacgaatttaactaaccagaaaaagaagcatgcaactattaccagtaatgacatgatttggtagggcggcaggaacccaactctgtttaggctagggtcggcaaagaatggtgccatcaacatgtataatgataatgtaataatggctaatactccaaaagtagatgcacgaatctctgggacttcgttcttgtgtttgaacctccaaataaagagcccaatagcgaccaata

SEQ ID NO: 13531 - DNA, 402 bp, Saccharomyces cerevisiae
acagctgataaactctgtctaataaccttttatactctatagaaaagataaaatttattactaatgttacattaaggtttgattgactatctcgaatccaaatttttagaaacattcgtttagcgccttcactgcagtaacgttccaagggcacaaaaacatacctctttgtatgcttctcaaattcttactctcacaatatagtttactcatctcctccgcagtaactttattttgtccattagaagctattcttcgttgaatattcttatctaatctctcccaaaccttgaggttattagggaaaaagtacgcactcctttgccatacttgtttaccggtatcgttacgataaagtctcttagtaatttcttctatcagatatggtgcgtctttgtgctt

SEQ ID NO: 13532 - DNA, 409 bp, Saccharomyces cerevisiae
tgtgattgagaataattagaggcaatataaagtaaaattaaataatagtgcacgtatacatactatattagtaacctttcattctctctatggataatcttaaaatcccattactttcaatatgccataacctactgtaacaatagcggcataacttaacaaactggctggtacacctctcgtaataaatgtacccacggtcaaatatctatcaccaacttcatcaatcattgaaatggcagtcacgttggggaaaccagaggttggaagacccatagcactagagcataatagggcggctataacgatcaatagtctagaatgatcacctgaaggtagattggaaccgatctcactcattaatggtacgatgatcattgccgcgacggtatgggagacaaaagtggcc

SEQ ID NO: 13533 - DNA, 452 bp, Saccharomyces cerevisiae
ttgtgaatgaaagtgaagagaaatagttttttactctattttgtattgtagctacttaagtaaatgattaatattctcaataggatgcttacgaagaaaaaagtctttttttattgttttattgttttattctttgttggctatgtagccatttgccttttcagtataatcttactaatataaaaatctcaatcatggtgagaaatcgttttataagaaaaatgaaaaaaaacttgtttaaatcaaatcacttatcatatttgaagagtaaatggaaagtaaagatcactggacaaataaaaatggattttgataatttactaaacctagaagaacagtattaccaagaaggttttctggagggccagaatgagaatataaagcagagctttctagaaggtaaacagtatggtttacaagtgggattccaaagatttacgctcctgggacaa

SEQ ID NO: 13534 - DNA, 428 bp, Saccharomyces cerevisiae
agcagttagaagaaagaattttgaagtcaacatgaagagaaaataaaaatccaggtagtgtggatcagtgccgtctttaggatccaagtaagctgtaatcgactggcattgtcaaggacaaatgtagacagcgaagcagttattttacgtacacaattaaattcgctccagatttcaaaacttctttatacctttacaatatttggtacttatgtacaagaacttcttgagcttccatagtcgtatgtgtgttctatatattagcaattaaacgcagctgatctaagatatgttcgtgggtaatgattttcagatagagtacaatcaatgttttcttcgatctttaaagggtttttcctttataaagaagacaccacacaacagtctagaaagtaaacaaaacaaactacgacacggcttgttttagg

SEQ ID NO: 13535 - DNA, 420 bp, Saccharomyces cerevisiae
taaatattcatgacattatctatgctgtacatattgtttaaaacaaaaactcttttaaacttttctaattgcaaattcaaacaataattcagtgatgtttcttgcttttggagcaaagggcaatgttactctatattgtatgtataatatgatagatactcttccgtatatatagtatatagattttcgtcaagcgtttcaattggaaagtgaaagaaaaaaataagaaaaaatagaaaatacaattaaattaatcgaaaaaagaagtgaaaataattgagtagttcgtattaaaccttgtaggtctctaagtgagcattttcctccctaaccaatgtatggtgatggccaggcgctctaataactttattttttgaatccatggtacaggcagcaatggcggcaaaccattcatcatta

SEQ ID NO: 13536 - DNA, 500 bp, Saccharomyces cerevisiae
taaatgtatattgatataagtgtaggtacaaacaacaaatataatggcattctttaagtcgcttggtcttaatgtataggttaaaatagtatcaaaattttgtaactatattcatttcatctggtctaaaccattcacgtctcagcacattccaagtcaatttcgccaagaaagaggctctttgttcttcatttgcgcaagcttcaatatatactttaagttttggttctgttccggacccgcgaatagtgaagcggatatgctcattctcactaccgttacttggtctagcagatactgttatcatttgtgatgtaggatcgacgggtagagtaggtttatgatttatggtatccgattggtaaccagtggttaaatctcgatagtaaagtacttcgatttcttcaccaatagatgaaggatatgacgcgccctcaggagtgtagacattcctgatgtagtcaaatatatcttttgtaacagttggatttggaacgaca

SEQ ID NO: 13537 - DNA, 414 bp, Saccharomyces cerevisiae
aaaaatatataagaaaaaaaaaaaaaaaaaaaaagagagcctacaaagtgtactattgtcatattttatatttctaatacaacgtatataaaactagagagaagaaattttataagtgaaagtgaatgtggatgcgtgcgcgtgtgcgtgtgcgtgtgcgtatgcggatatgctattattcctcgcggatgtagaaggggttgtggttgtcgtttgcattggacgtctcgtgggcggtattgctgtcggtggacagatgcaaggaattgaggactctggtgtgcgctaccgaggctgctttgtcgttgtaagatgacatgtcgtcatcttcatcgatatcgttatcgttatcgttattgttgtcttcgatattctgcgatgtgtcctgaaagtctgtattggagtgcagcgatc

SEQ ID NO: 13538 - DNA, 443 bp, Saccharomyces cerevisiae
ttgtaagcccctttgccgatcggccactcgttatgctcataatatatgtacccttattcattaaaattaatatatatatatgtatactaacaacggagaaatgcttgaacttttctatacttctatcattgtatgcaaaatactaactcacttatttgtcttctttgccgttaaccagatcactttctattaaacatatcaaatccaaaaattgacaaatttaaacccttaccgccatcggaattactatgctctttactctttttatccaccgatatgggtactgagtctcgtttatggcgtaattcatcattcatttctgaatcttttcttccatataactgccaccaccattggactttcttcagatccggcgaaatccactccactttttcttcctcttcaaggttttgatcgtgctcattcatgccgcttctttttct

SEQ ID NO: 13539 - DNA, 492 bp, Saccharomyces cerevisiae
atcgttagcgttctttctacttgtaaatatatacgtaaaattatatataacaattttatatgtgtcattaaacggaagacgttgttgctatcacagtggattgtgttatttgggtatttggaatattacagtgacttcttgcagcgttgttagtttttgccatgttctgcaagtacaaggttgaagatgtggtcgagactttgatagtatccttaaacaacttcatttttttattttgactgggtaacgacctggtgttccttctagtctcaccgctagtggcttcttctttgctgactcttaacttttgcagcgcctctttggtgtcgagtaactcgtgttccagtagaacgttgcgttccagtcgtcggtcactctccaattgtaatgtctctatcttattcctcagttggatattttcattttccaactcatctacctgtatctctaaatctgttatctgtttcttattgcacttattttgttgttggc

SEQ ID NO: 13540 - DNA, 475 bp, Saccharomyces cerevisiae
atcgtaggttgttgcttacctgctttctagctttttactatcacacgcagggtgtgtggagtgaaatgctgatcgagtatgtatatatacatataagtactttgtatagaatgaaccacaagtttgtagcatcctttctcttctcttccatcctgcgtgctgctaaaccccgcccggcgcgaaaaatccacccggggtgctttagcgtggcttacgaagacctttttaaacatacttatactctttctcgaaggaagaaaataatgcagaagagaaacagcagaaaaaaaagaaatcatattaaatttcagaatcagtctccttttgcttctagtcatttaaccatcaaacgcgtttaaccgtttagaaaaccctcttcaacaactatttgttttgatactaatattagcacatctctattgccatttaaccactaattttccgtatagcgtttatgtttgatgacgtcccaaga

SEQ ID NO: 13541 - DNA, 454 bp, Saccharomyces cerevisiae
tatgtatctatatattgctgattgcatttcagcttttaacgaaagtccgctatgcaaaacaggtaacatagctgtaatacgtgagctcaaccagctttgtttgatcttttcttatttcgccgttccacggttttccgtgatagagcaagcaatattgatttgaaaagaaaaatgaaaagcggtcaaggttaaaaacttgcaataagggtatttagcactaggtagtcgcaggtaagcctcttaacaccacattcaggtatttgaagataatacataatgtcgattgttggaaggaatgctattctgaatctaagaatttcactatgtcctctgtttatgggcaaaagatcgtttgtatcctctccggttagcaatagtgcaaaagctgtgaaattcttaaaggctcaaagacgaaaacagaaaaatgaagccaaacaagccactttgaaagcgt

SEQ ID NO: 13542 - DNA, 438 bp, Saccharomyces cerevisiae
tttgttgggcaagccatataaaatcatgcaaatgctgtaaatatttgttctattttccccgtagaatggtttattcgatatattacatataataaacgaaaaatacatatgcacagtatatacttttccaaaaaaaaatcaaacactgtttgagcgtcaagaaaccccaggcggtgcccgacgataatgcgactgcattatctcctacgcttgttgtcgtttgcctttctttggtttattcttcgttcatttttggtcaaatatctgaacttttttactcttggcttcttcttttgtttctcatccacgcccagaaacttcgcgtatttggtggctctatttatgctttgtttgagtactttttctgccttttctaatttgacattatttagctgggctaaatattcaaagttatcattgggttccaatgtctccaat

SEQ ID NO: 13543 - DNA, 446 bp, Saccharomyces cerevisiae
tatcgaatcatcatttaatacacaaggcaagtgtacacttcaggaatgtactgctgaaaaaaaaaaaaaaaaagaaaaaaaagaaaaagatatcttggtttgaataagtaaaattaatagaatccagtttccagtgatcggtacaggctaaataataaatatctctacttttatttattcttttcgttttcttgtgttcaggatagatcaaagagcagtcaaaggtcatcaggaaaatgataaattcaaaaaaccgagagttaaaggcaaaactacaaaaaagagcaatgaatatcgagatcttattaagtttatatctaaaaaaagcctgtgttaccaggtaagtgtaagttattagagtctgggaggtttgaaccaccagtcggaaggtccaagttattggcggaagttgcagctgcagctgcagccccagatagaagggtttc

SEQ ID NO: 13544 - DNA, 471 bp, Saccharomyces cerevisiae
atatattaccaataggccaccttgttacgtaagtcaatatggcatgcattcattcattatagttaaaaaaaaaaaaatagtaggaagtattcaaatatagatagttttgtatagttttgttatttttttaaaatctttgtaaatctctacattacacaaatgacttttatgtttaaaagagatgagctgcgttacatcgtagccttcagatacgttagcaataataaaaaaatgaataaatatttactacaattgaaactgccacctgtttatcatttttcaataaggagatgaactaggccatcaacaattactaacacgcacacacgcactactacaactacttgattttgaattatatgataccaagtgcctatgatttacttaataacaacgctcactgtattgttttattatcgaaatataagacgatgaaattgaagatgagaagtgaaccactcacaccattcc

SEQ ID NO: 13545 - DNA, 439 bp, Saccharomyces cerevisiae
cgtaaatgagaacttacggggggtgcaatttattttttttttttggtttattttattttatagaggcatctaatgcaagtagatttatatacaattatacttaaaattgatataccttagaacaggtcggacacaacgtgtggtaactccaatatatcactaatgacaatagcgccttctggtgtttgccccaaaatttcatttacttcattctcaactaaatgaatacatgttttcatgcccaatttgatacctgtctcgatgtttttcccactgtcatctataaaataagcattctcgtatcttgccaacccgctttccttcatggctttttcaaatgctttaacatgtggtttgcagaccagcgtatctgtcctagagtagtcacaatatgtcaatccatcaaataaatccgctatacccaacaatctcaggcaac

SEQ ID NO: 13546 - DNA, 500 bp, Saccharomyces cerevisiae
cgctaaatcatatgagatgaaaagaaaatagacagcaattataattttttcattatttttcatcacagaccaacgagaagaataaaatgattagcatgaggtgacaatcatttctaaatgagcaacatatacttatatatataagtagatacatatatatggaagggagaaagtaagacactgcatatataccatataagaccagctaaaattttcttctatccgctttgccttgtgatcataagccttgctgtaacctttcttgaaacttgctctttgcgaaaccccacgcgcctaagaaacccttatccaaatctaatgccatttggggttcgttcgtaggtggtttagaaactctggatgcaatagtgttagagtcagtttcgaggataacaccattatcaatggtttcatcaatagctaataaaaccatatcatagttttcttggatgttttttttgtccattcctgagttcaaaatcaaatccaaagctcctctg

SEQ ID NO: 13547 - DNA, 473 bp, Saccharomyces cerevisiae
gacatacaaaggaacaaagtctgtttgttttaaattttagctgctatataattttattttataattgtaatgtatcactactcctcactgtaagcgtgcaattctttgggcagctaaggaaatgattaatcaaaatgggaaaaacaccaagccaataatctatcatttctataataatgatttcatttatcgtacatatttaatataaagaaaatgttaacatttaatttttttctttttcattcgctgtcaaaaattctcgcttcctatttaagctttcctggaagagaccttggtgttagaggtcttgacaccagtagaagaaccggatgcaacggagccggaaacttcagattccttcttgactgtctttttaccacctttcttgtaagattggatgtagaaggaaataaacaaaagcaaataagatgttagaatcaaatacccataagcagcagcagcctgagtaccat

SEQ ID NO: 13548 - DNA, 433 bp, Saccharomyces cerevisiae
tagctagaagttttgtaggtatatgtgatttaagatatagataataaaagatatatatatgtaaatattatgaaggggatattagcgtaatttaaactattgaaataccggcttcaatatttcagctaacttgccatttttcttcaaagtttccaaatcgctgttaccaccaatgtgcttgccattgatgtatacgttaggtacagttttttggcccgagatttcttctaaagcgtcttgaatctctgagccattgctcatttcatctaattccaacacaagggccttggatttgggaacgttcaattcttggaagagggtagacaaagtagctttacagtaagggcagtatgtctttgctgcaacaaacacttccttttggccaatcagatcctttacgtgagcaactgtttcctgggataccatttttgga

SEQ ID NO: 13549 - DNA, 476 bp, Saccharomyces cerevisiae
aaaagaaacttagaaatcacaattagctatatttccatacggttcttttcttgtgaacgctgttaacattctgtatacttaaatgaaaatttaatattgattttttcttgttgcagctaaagataaaaaaattttcttttccaatcgttgaatagatgtactgtagccggaactgaagttaaggttgttagattgaaaaagaacaacagtgtactaatcatgctaacgatgacagcggtatcgttgcatacttagaatacataaaaatatgcttccaatcggatttgaaccgatgatctccacattactagtgtggcgccttaccaacttggccatagaagcttctgatttgtgttcatttgattgtaagttagagtatttcaagctctaactcaattatgtgaactttcataaaattgtgttatttttgagaaatatgtgagttgttagataattgttgggattccattgttgct

SEQ ID NO: 13550 - DNA, 491 bp, Saccharomyces cerevisiae
aaataacaacaaaaatcctctctttgaaacataaggaaaagtcaagcttttttttataagcctctaacattaataaacgaaatttgtatatatgtatatacatatacggagtggataataaatagaccaaactttttgttattatatacgcccacattcgtattcattgctttcttgaatccaaatgctttaaatatggagataaaaatccgccatcgccatatttattcaagtaatattttttaactctcacatcttgaaatattgatggttttgatgacacattaaagtgcaagccttcattaaatgcgtttatcaacgaccttgactcatttgcataagcttcaccacatgactcccaccaaaagcctccgcctaaattgttatgtgtcacatattcagccttagttttgactgatttagtgttatcataactgataaatattgaatttttttcatcaaagcaatatgctgaaacatattttggatcg

SEQ ID NO: 13551 - DNA, 413 bp, Saccharomyces cerevisiae
taagcggaacaagtatacattttattaacatagactacatactaatctgtaacatttctataaaaaagttattatcatcacattacacgatagaaacacttccatatttttttacactgaaaggggcacctagaagattaaacaactaaactgaaaatatacgtgctagaaaaagggttttacagctttacttaggcgttgcgagtcacccaaaagagcagttgaaggacgccgccgtttcactagatacatatatatataatgtcagagaaattccctcctttggaagatcaaaacattgatttcacacccaacgacaaaaaagatgacgacaccgattttttaaaaagagaagcagagatacttggagacgagttcaagactgaacaggatgacatattggaaacggaggc

SEQ ID NO: 13552 - DNA, 431 bp, Saccharomyces cerevisiae
aggtgattatgtaaaacaagcgtatttttttatttataaattatggtaattttcatttaagacctctaaattcatctaatcgaatatctgtgtcatggagttatggctcccccatgcacaccattttctctttttttgtttctgtgtttcccttcatctcctttattatgaaaagtacaagttttatataatttcaacgtcggaggttatccggaaatctatagttgaatttttgcaggattatacttcgctcgaatattgtgcgtgttaaatactcagcgagaacaatacttccaagttagaaaagggatttgctcatgttaaagcaatggcactccgaatggacggtgtcaggaattcttttcttcacatcaggcttcgcatagaaaatggccattggcaaaaggttactggtgaacaaaccagcagaa

SEQ ID NO: 13553 - DNA, 463 bp, Saccharomyces cerevisiae
tacaaaaaaagatttgaataatataaaaaatagcgattatattcttttcatttaacagctttgttaagccatatccttacatacatctttccctacataactaacctacccattttaagtactttttctttacggacgcaacttttttgtcatgtgtaatattaacagttttaatctatatagaggaagaggatggataatattacaaagtgtatataggttgtatatagatacatgcatatgatgggaagactatgaagagagagatagtcatcatggtaagacatttatccagaaattcatgaattccgtttcatgagatattttgtcctcacacctaaacatcaaatgatttaaaccttctgataagcgaatatcaaagatttcggttatattattacgtttatcattatcgttaccaacaatatcgttattgttgccgccgccgattgtcaaattttct

SEQ ID NO: 13554 - DNA, 446 bp, Saccharomyces cerevisiae
cagaaatcgtccagctaattattcatgaacatttacaatacttcatacatttattattttgataacttttcaaacagcattgttttacttttgtttattgatttttacgtaactgtatatacttagacataattaagaaacgttatcttttgtgatagttcttctttttctttggagagcgaagaatggaattaatatcattcttattcaatacattgaactctgagccttcaaaccttttctgtcgtgcgcttaaaggcgtttttctcaatgggctcagggatttcgatggtctattttggtcttgattcggcaggtaagctccgcccttctctaaattttcatttgacgatgattgagccaaattgttatccaaaactttatccctataatatggggacattctaggagaataatgaaaaccaatgggatgactttgatggtca

SEQ ID NO: 13555 - DNA, 489 bp, Saccharomyces cerevisiae
accttaattaggactagaacacttttgtatcaagtacaaatgtataattatataaacatcacagggatatcatattccatatgatgatatagcatttactttacttcaaccagtattgtctaaagagaacgagtttagtattagtaaaaaaattaaaaaaaggaagcgtacttgaaactcaaacacaaacgagagtacaaagggcattgctagcttaaaatatttaacaatcaacttcgtcttttgccagaagactacattttgtgccatcgagaagttagtccaggagtcaacacattaattaaacatgcccgctcgagaatataactatgtagaaggttttggtgggtacggctcgttggacgatgatgattcagatagagattctgaacgcaggaatcacgatctagggcagcgaactataaccacaagtccaacaggagtatcaagacatgctgcattaaataggtacatgatcccaggccgtat

SEQ ID NO: 13556 - DNA, 442 bp, Saccharomyces cerevisiae
agaacatagagatagaaatggcatctatatatgtgtgaccaacaatacatacgtttttattcttctaaatatgaaactgaatgtttttctaggtttgctggaatatatattacactggcaaaaattgttatgctatgctatttaatgttcattgtttttgcagcttgataacctctcttaaggcgccaaatggatttttttggaaatcttgattggttaggacctgattgaatcttgcagtttcgttagcagccaatgcctttgcacccttttggttcctgatatttggctgattcttttttatcctaacagaaccaggttctatctttttcaagttcatttcctttgtgtccacaaaccttattttagaatccatgtcgatgtcatcatcgttattcatgtctttgctactattttcaataatgccccgtaaatccttttc

SEQ ID NO: 13557 - DNA, 427 bp, Saccharomyces cerevisiae
cgttgattttgttaccactggaagcaaaataggaactggtggccgaacactttaatactcgtgtgcataataggcctttacgatccatatttatatatgcatgtacatttgctatttttttaaagatttgtaatgtattctcatgcctttagacttgtaaataacagattctctacttacaaacccctctctttgctttgccaaatgaattgacgttataaaacaaagaagtgagaattatgaatatatttaatattccccgcatagacttgaatcaaaaaacgttagttttagaatgacagaagccatatcttcgttctgattcaacgtgcgaaagacgcgacagacatttgttggggttgtctttgttactctcttgattttcgatagattccgtactgttaccagtttgcttttcccccatttt

SEQ ID NO: 13558 - DNA, 474 bp, Saccharomyces cerevisiae
taaaaatttggaagactttatatcctttatttaaaaaaataatgatgagatgttttgtatatacagaatgagaatatgcattattaacagaaaaagacgacacgagcgttatatactaagtggcatgaactctttcaccccgtatccttcgatagtagtcttaaaggtggtacataaaataaagaaaataaccgattcaatagataagcagcggaaataaagtctttttcctatcttgaaatctccaaaataaaagtaataaagtactgctaaagttgttcaaaaccaacccttcttcttgggactatcgtttttggaggaggagctgttacccaatccatatgccttcagtacattttccacatctccaaaggatcctctgtctccttgcattacaacagtagctctacccttaccattgccagcattatttacatttcccgtaaatatcatttcggcaacacgtgagatatc

SEQ ID NO: 13559 - DNA, 401 bp, Saccharomyces cerevisiae
tatatattattgaaaagcctatgtacaatatttgcggtcttctttgatcttggtagactttatggatggagaataataaacatacatatatttcacttagagggtttaggagactaatgcgtgaatacgcgctggcatgtccccattcatgcatacatatattcgtaaacatacacatattcataaaaattttcagttatattatattataatctttttttaactatacagagaagatattaaaaaaaatgtatccaaagtgagttaaaaaaatcggaaaaaacaataaagatccttttctagttactttgctgcattaacattagtccatgtcaacatcaccttcagtgtccttcttttcttccttcttttcagcttctgcctttctttgagcagccaac

SEQ ID NO: 13560 - DNA, 436 bp, Saccharomyces cerevisiae
acttgaatcttgtacgtaaatgcacactttctctatacatatatatatatttatattcatgttaaagctctctccatgattctctcaccaactcccatctggtgggctcacccgctgatttcgtatcttcgttcctcaagctttcattcaatgaataatgcgttttcgatgaatcttgttgttccttctccaaaataacaaatttctcccatatcccagaattttgccacaccagaaccaacgaatcgtcttgttctctattattagagtcttgacaccagccaattctacatctgtctttatagaactcgttatcgtgagttacatcaccactgttgtcatttctgtgagcgtcaaagattgggttctttaagtgagcattgcatatcgaccacacagagtccaaatacttgggcctccataggcccttcggtat

SEQ ID NO: 13561 - DNA, 438 bp, Saccharomyces cerevisiae
cctgtgtagcatgctcattttaagtatatctaaatattattttgtatatactcacactcctctatagaaagcaaaaaatttcaaaaacgtttgaaaagctttgtttaacgatacttgtacttaattttagagtcagtttcacccctcctctcccttttcatctgccttttggatttggattgtccctcattagcattttttgagcgattatctgcctgagtttgttgagcgccaggcatgaacatgtttttgaggccatataacttgtaaccagcatagatggggcacaatagtagacaccaccaaaatttgaatgtcctgaaagctataataccaatgttaccaaaaagtgatagatatatcaaatcaaaaaaatatgatatcaaatttgtattgtcgttcaagtctataccttgttttactacgcgattgccatca

SEQ ID NO: 13562 - DNA, 420 bp, Saccharomyces cerevisiae
acatataactttgcaaatgattcaaaaattcaaattttctctctctctctctataaacataaatatatatgtgtatatgttttcttttttttttttttttttttttgaatgatattaagttatacgaatgttcgataatatatatgtatgaataaataaaaagtttttaaagtagccttaaagctaggctataatcatgcatcctcaaattctgttaaagtaggtccctcataaacttcattatacagcacgtcgtttggtactccaactgttcttgcctttagtgttgatagatctaaaagatcaggcttcaattccgcaatgctagtaacacctaatagtctcatagacatttcaatttcatctcttaaaatttcaatggctttttcaacaccattacgaccatagcatgagttcgca

SEQ ID NO: 13563 - DNA, 414 bp, Saccharomyces cerevisiae
cactgttatttatatacatcgggagggagtttaaaaattgtatacactaaagtgaccttatgaattggagccattttcaacgttttagagtgatgttgcatccttttcatcagatcgggaaattaaaaaaacggttatagaagggctaaatgtaaatatgtaaattttatgaagtcaagagtaaagaaaatcttcggttgccgatcaaatacactcttacaaaataccctaaactcagtttatctttccattccaactgattatcgcgtacgccttggtgaccaaccataccctaaaatgtcaatttccggggcggaaggggtccttaaactgcaaagcctcttcccatgtaaataaaataaatccgtagaatttattaaatattgtcatattataagtcgggaaaggccttct

SEQ ID NO: 13564 - DNA, 437 bp, Saccharomyces cerevisiae
aattcagtacataatacctcaaaatacgtaaaagctttaatctaatttcatacaccaatgaatatattattacgacatcaatgggtcccatttgtttcttctcagtttgttgatccacttttacttgtgaggcaaagcttatataaatacaaacacagcatataccttgtgatttcgatacctttgtcactctcttttgtcacggctttccggtgaacagtaaacagcccgtatacaaaaggcttgcgttaaaaggaatactaaatgtaaagcatacttgctttttttccattatatacactgctaactctacataattcgggaataaaatataaacatatttgacaaattcttttgagaacccaaaaaccaatatatatacaggtaagtgaaaaaatctcaactatacaagaaccaaccccttataattgtggggc

SEQ ID NO: 13565 - DNA, 457 bp, Saccharomyces cerevisiae
gcatcacatcgtaacgcctttctttaaatgattcaatttttgtagtttatatctttacttttgaaactgatttctcatcccatctagtattgtaattgcgtacgtatccaatatcattaccaacgccgggtatttttttctagtatttcttctccatttcgcctatggaaaacggcaaaagggtaaaagaaaaaaacaaacgattaattcttctttgaattatgtaaaaatcaaaacgcaaccgcagatttaatagagaccagaaattcggattactattgactttgtgcaccaccttcaaatttactcattgtttaagacaggcagtgggaaagaagccgtcatattgctcgaatccttaacaagcaaaatatacaaccactaaattattccgaaagggcctgcttaataatttgcctactaacttgtgcatagaacagcaaacagaaacaaagcg

SEQ ID NO: 13566 - DNA, 452 bp, Saccharomyces cerevisiae
ggttaacacatgcagtgatgcacgcgcgatggtgctaagttacatatatatatatatatatatatatatatatatatagccatagtgatgtctaagtaacctttatggtatatttcttaatgtggaaagatactagcgcgcgcacccacacacaagcttcgtcttttcttgaagaaaagaggaagctcgctaaatgggattccactttccgttccctgccagctgatggaaaaaggttagtggaacgatgaagaataaaaagagagatccactgaggtgaaatttcagctgacagcgagtttcatgatcgtgatgaacaatggtaacgagttgtggctgttgccagggagggtggttctcaacttttaatgtatggccaaatcgctacttgggtttgttatataacaaagaagaaataatgaactgattctcttcctccttcttgtcctttc

SEQ ID NO: 13567 - DNA, 494 bp, Saccharomyces cerevisiae
agaacctagagtcacgattgaaatatttaataataaatgctatgtatcatagataaactagaaagaggcaagaaaaatttaacaagtttcttaattgaatattattttactgtcactaccattattagacgccatctcagcgtgtgacatgataatttttctttttttctttttttttcctcaaggcgatgatatgaaactttcaaaaaatttatatgtaaataaaaaagttctacgagggtttaaatacggaagtttatttagaagatatttatactctgaatacacacgtagagtacagtaaaggttttttagatctactaatgaccatatcgttgagcaatataaagaaaagagaccattctaaaatttccgatggaacttctggtgaatcatcgcttgtaaaaaggaaacagttggaaagcgccaccggagatcaagaggaagaatatacagaccatgaaatcattatagagccgttgcactttgctaat

SEQ ID NO: 13568 - DNA, 457 bp, Saccharomyces cerevisiae
tcttgttcctttccaacatataaagcattttcttccatagagttacgtactattccaggaggcttttcggactcataccatatagaaaactatttttatgcttcttcatttacttctacttgtttatgtttatttgtaaaattacattatttaatttcttgaaagtaaaaaacttgaatttctgaaataaataaaaactagagaaaaattaacgatgaggcatgcgacggaaatcaatattgaaacttctcaaagctgaaccactgaaagggttctttaggacaattttcattcccttaatcaacaaaaaatgactaaaacctacatattcttcttagaaaaaatacatacgcaaaacaagatagaagagcaactgttgatacgatagcaagggtgacagagactattcaattatatgtcttttattttcattcttatcaccacttttccgttttca

SEQ ID NO: 13569 - DNA, 427 bp, Saccharomyces cerevisiae
cctgtaaatgagggaaaaatgcaaataatcttgaatgatactcaaaacttttgatttattgtaatttctttctgaaccatatttattacattcaaacttttttttttttgccttttataaaaaaaaatacttataagaaaagagaaagaaaatgacagttttctatgtatcattaaataaacatccatatacaaatatagcgttatgttttacttttattatttacatgcatagaagtgttggcaaaattctttacgagccacggggctgctatttcaggttttatttccatcttaagccatcgttaacttcttcacattttctttcacaaacaattttacatagcgattggatacccagtttccctcttctagaaggaatcacattggcaaagtgatttagtacttctctttcggtaactttggcg

SEQ ID NO: 13570 - DNA, 415 bp, Saccharomyces cerevisiae
atgtgcttttgtttatttcctatttggttattcacacatattttctttcttccgtctattaaaatattcatatttattttttatttatacatatatatttatttattagtcactcagttcgtcaacgtggttgttcttccatcatgatttttcttatctcattatcgtggttttcattatcttgcacaggtccttcatttgtatttatcttcagattattcaatctctttaatagatcctcgctactgctttcttttggctcgtgcaaatcctggttcttattttcttccttattattattcttttcatcaagttctaattgttctaattctctttcaatttcttcttctgcttcttcgtcttgacctttattataatgagctaataaatcattgacctcttcggtacggtcatg

SEQ ID NO: 13571 - DNA, 412 bp, Saccharomyces cerevisiae
tgactcacccatactttttctttttttttgcatttctaagatttcatttttagagtcagattccccatgaacttaacttaggagagattttataaaaagacaaataagcaataaaatatatccttcttctcgaaatccagatatatatgtatatatcgatctgcttggattggtacaagacgatcaattcttgtcgagtgaaacgcctagggatacagaaaggaaaagtaggaattcgtgattgctagtattctcattctgtctaaagtgccttttttattattatctgtatgctttttgtttctttaatgatgaggaacgaatttttatactacaaaaaaataatgtttacaatttttatcaatgtattgaaacattttaatatttgttaggattcgcctttatttcacaa

SEQ ID NO: 13572 - DNA, 409 bp, Saccharomyces cerevisiae
agcagaaaactgggagaaatggaaatgaatcaaatcatacatatcaagacattctagtttttataaacctataatttatcgcaagaatcttgggtgttatgtgttgtatttgcggcatcatttcaaaataccgtctgcattacccgtctccgtcacgtgaagtaaaaatttccaaaaaatattgaaaaaagaaagaaaaataagatccagaattcactgatgatgagcttatggtacggcatgattaactacgcatttgtatattaaagattctttgattttttccagagcattgaatacctcaatctataagtgtattataatggcatgcaattttcagtttccagaaatagcttatccaggtaaactaatatgcccacagtacggtacggaaaataaagatggcgaa

SEQ ID NO: 13573 - DNA, 494 bp, Saccharomyces cerevisiae
gaaatgatcccgtcccgtttttcatttataataaatttcctccacgcaggtttaatgtataagttgtaatggtagcaaatgatttacagatttatttgcaagtaaagagactcttttttcgttttgtttttcctggatccgcaacacaaagtgtattacatatggatacatggaatatctttacagtgctaaatatattaggttaaaaaaaggtcgttttctgtaaagaatgctttttcagcgttaactttacgtctttttgataataaagaaatttaattaggtgaagcggagatattgaatattatgtactaatgatatgatgagtaggcgacgtaactatcgcgtatataacatgaatcaggtcgtcgaaaagaactagaccttcattggatataccattcttaggaagtattttttaatgcccggacctaaaagaaggtcatatttagtctttctttcttttaatttaccccaatcttcatcggcagaat

SEQ ID NO: 13574 - DNA, 485 bp, Saccharomyces cerevisiae
gcattttttttttttattttatatgctaattatattactgatatacatatttgccattttgttactgcaattggtatatctcactgtatataattatatattcaattcaaatgatagacacatggatcttcaagaggtaagaatatcgataacaaagagaaacaaatccattatggctaatcttttttatttcagtttactagtattgtatttttttttcttttcttgcatatctatttcaccttttttttgattatttttctttagttgtgccctttaaaataaaactttaccatttttaaccttctttagaaaggttcatatcactcatgaaaaatactagatcatcatcttgatcatcctcgtcattatgcatcacaccaactgcatcattcccattatgattgttattgttactattactcctattaccattatcgattaacttatttgcaggtttatgaaatttcgcctgagcttgaaag

SEQ ID NO: 13575 - DNA, 490 bp, Saccharomyces cerevisiae
gattcaatcggcaaggtttatcgtaaacactctgtgctagaggaatattgtatacacaggatttcataaagttagtaaatgaccggcatttatagtttgttcttctttgcatatgtcttaataaatattcgtcctacaatttcttttcatactaagagttttgttatgattgccaaatttctcaagccaagaacaggcccaggaaaactttgaaagtgccatatcagaaacacatttataaggtagtttcgatatacggcaatactcgatgcatgcccaaacttgccagccgctcgcgattgaatcttctacaatttttaggtgaacatattcagaggctgaggccttatttgatagtaacatcaaatatcactcccacaatttacaatcactgtcattggtctcacaggatccttttctttctagaactcccctaatatcaactttttactctactgtggctctaaccacgtgtatttttcaggcccat

SEQ ID NO: 13576 - DNA, 401 bp, Saccharomyces cerevisiae
gacatttgagtatgcaatgaatttgattgtattgtataatacctatatagaaaaggaactaatatatatagcgtctactgtggttactgataaactaacaggcatttagaatttgaaaacatcatatacattagatgtgtccaacaagagataccggaatgttctgaggggaagaagatggaatttaaagctagtttgaaataaaatggaagattgtgatttttacaatttgaatttaaaccttttttcctccttaggtgaggttaccgaatacttgcgcacgtcttcatctgagctataaaggaccctttctataaaggtaactctcgttgaatccttactcacgagtaaaactatttgagagcgagttccgtagtaatcaccatcaggaattgaggcac

SEQ ID NO: 13577 - DNA, 451 bp, Saccharomyces cerevisiae
aacacatatatcgttatgcatttccccagaacttatttactacatatagaagtcttgtaatacggccgaaatacagatgctttatagtagggttattgtttctattcatttttatttcagttgggctttacgctttccggttcgatatactgttttaccttacggaatgcaaacatggtatagaaatatgatgccgcttccttttcatccccttcaacaccatatctaccatcagatctttgtaaaccttccctcattttaggcgaaaacctctcaatccatttgggaatttcttggacaaaaaatttattaaaaggcatttgcgatactagttccaaaccgtattcatcagccaaacttcttaaggtttcgaatggcacaacatattcaggaacattatctatagcatcttctagccaataagtatacatttgaccataaggcgatgtga

SEQ ID NO: 13578 - DNA, 470 bp, Saccharomyces cerevisiae
tgtttcttcatgtaattattcaaaatattgtgtaatcgtctatttgaattcgttttcacggcagcatatttgaaaaaaaaattaatttttacatctaaacataaaaaacctaatcgttttctttccatgctgttatagagacatttattagtacgaatattttcctttctttacgagcactatagacagtaatttatataactaagaaaatggtatgctcaaaaatcaacaatatgactcttagggaaatcatgaatctctggaacaggtatttctgggatataatatacttccccattttcattaaccctttctctatccttttcgctaatagaataaatttctttaacgttagccttcaataaatcaagtacttcaacaaagttcttttgaatttggtgagcttgctctctcatgtttcgtctacaaagaccctcaacaactctcacagcgtctggttttgtttggtt

SEQ ID NO: 13579 - DNA, 485 bp, Saccharomyces cerevisiae
ttactagtacttaacatacccgagctgaattttaacgtgtactttgatagttcccgaattgtaatctcgtgaaatacaaaaggtccagctaatgctcgtataatcactcaaataagtttgtagaattctattgtatcctttcccacacaaaaggggatgtaaaaagcatcaaaaacatcgaatgaaatttgtgcatacacatagtgttataaatttacaaaaaagcgcttatgaatcgaaaaagactttcaacaaaaatattatacaatgtcttgcaaatggtactaatgcgaatatttagtgactacttcgtccactctacttaacaaaccgttctttcttttatcgtcacaccatgaacctttaatggcgttcttagcgatacgaccccatgtttcatggtcccagtgtgggaaatctttcgaaacttgagtgtagacatctaagatataaccaccaaaataggcggggtcatcagaatttaa

SEQ ID NO: 13580 - DNA, 496 bp, Saccharomyces cerevisiae
ggacacgacgtaaagtgcagtagcttttagtgataaaatcaaaatagtattgttccgtttccattgctgctcggaacaaaaaagctatcaacggcaatgttattgaatcactttctcattcacccttgttactttcttgctattgacttaactcttatttactcgtccatatattatcaattgcatatatatacatatacatatatatattatcatctagattaattaccgttcatatcataactcattctgaacaaataatgatcgagtacccaccgcggttaatgtcccagttttcatttttacccgatatcctgcagagaccgagaggcatgaaaaaaaaaaagctagttctcaactgcattaattgcagctcgtattcatggttcaacataaaagaacttacgctacagcattccatttgaataactcagagtattagtaaaagaaatgtgtgaagagaatgttcatgttagtgaagatgttgctggcagtc

SEQ ID NO: 13581 - DNA, 415 bp, Saccharomyces cerevisiae
gacgcattttgatatataggagtttaatactatagccataaaatctaaacagaatggaaacggacatacacataatatacgctcatatatatttatacataacttcaatgtcttgaacacgtaaattttagtgtgagaaacctttttcactccgggtaatacctgctgtagtcttcaaaaaaaaaaaaaaaaaagaaaaaaaaccagccatggaaagctctttatttttttactttacggcttttttcccttttcttatatgatcgatgcacgtaaagaacaactgtatttttttgtttcaacactaacacgagcgcaatattcttttttgttttctctgttactctaattacctgagtcctattcttatagtattaaaacagcaaataaaaaaaatctaaagggagggcagagc

SEQ ID NO: 13582 - DNA, 495 bp, Saccharomyces cerevisiae
aatatgccgacacaagggagtatatatataggattcatttagataatagaacaaaagtaaatagatgcctctaaggttttatagacacgaatccatatttttcactttcggtcactcacaacggttttttctctactataatgtggctgaaattaaacgaacaggccaaaatgtggtacgcaatagtagccagtaggtgaattaaccataaataattacgctaattttgccttggtaaatttcataagaccaatgatagcaggtgcgactgctccgtcaagtcagcatgaaattttgatcgcatcgaatctcatcaagaagccatcaacgtctcaaaataaaacgccgacagctcaatccagttcaggtaacaatggagctgctgatggtgcaccgcagggttaccatcatcaccatcatcaccatcgtcatttatggtggcctcggacaacagaccatcaatattggtgtgtcttgaggaaaaaccaatttgcc

SEQ ID NO: 13583 - DNA, 420 bp, Saccharomyces cerevisiae
gcctcgctcaaaggagaccctgtgcttacacgcagaaaactggaaataacgacatattgttgtggctgtggccgatgcggttcgtatatccattactaaataattaaatacgtaaatgaatgaatagactgatatgattgtgatttttacgtgttggctatattgtgcctttctgcattcacctgcgcctcctcatgtagaaaggcgttgatcaaggggaatacaggagaagtatttttgggttcgtgttttggtggggttccagccacagaagggctctcggcagcgaaacgctgactatgctgagaatactgccaaaaaaaaaaaaaaggcagtatgtgaaacgcaggcagagaaagggtgaaattctacataggatgagagaatctcataattacagggataaaactgtagctttgc

SEQ ID NO: 13584 - DNA, 441 bp, Saccharomyces cerevisiae
aacgaataaggggaagaaaatagtaccatgggttataaatgcatgttatttatttatatatttttacatattctatatgtatgtgttatacctttttctttttctcgaaatgtctatccagtctattgctgccaaggtttaagatcctaggacagccatctttatctttacctaagcggcagcactcccaacaatagaatgcgtcattgactccaacatttagattacaaattatacaatttttagcttgtttaccaaacgaacagttttcacatactctaactttccttttgggccttacataagagtcgcagataggacatttgccatcacatttttcacaaagaagacctgtctgtacaccaggctgctttaggcacattattagatcaaactgatggcgggacatgttttttttgttggaggcttgtatgtgtgtgg

SEQ ID NO: 13585 - DNA, 421 bp, Saccharomyces cerevisiae
agggtagcctccccataacataaactcaataaaatatatagtcttcaacttgaaaaaggaacaagctcatgcaaagaggtggtacccgcacgccgaaatgcatgcaagtaacctattcaaagtaatatctcatacatgtttcatgagggtaacaacatgcgactgggtgagcatatgttccgctgatgtgatgtgcaagataaacaagcaaggcagaaactaacttcttcttcatgtaataaacacaccccgcgtttatttacctatctctaaacttcaacaccttatatcataactaatatttcttgagataagcacactgcacccataccttccttaaaaacgtagcttccagtttttggtggttccggcttccttcccgattccgcccgctaaacgcatatttttgttgcctggtggc

SEQ ID NO: 13586 - DNA, 478 bp, Saccharomyces cerevisiae
caactatagattactgtcgtgcataaatatcttgctaatagttgtacagtacaacgtttagcacgacaaaagttcttaataataaatattacatcaaataccctaccctaccaaatattgtatgtaacgttatagatatgaaggatttcaatcgtctttatatattgaatttcggctttttatcaaagggcttcttttcttcttttatcgaaatgttatcatcgttaaattttttgtagaacatattccagattttaacatatttatttagcctttggatgattggatcttctgacttctcagattctaaaattttatttcgtatataatatagtttccttaaagaatcgtcctcacgcatcattctgtcttttttagtattaggtgtctcattttcgtcaaaagtggtttcaatttgcaacaggtaatcatgtaaaactttgtaatgtttttgtaatagtgggtttttgaaatcgga

SEQ ID NO: 13587 - DNA, 411 bp, Saccharomyces cerevisiae
tttttatctccctttacaagagcataacggctgctctacacctatgtcgttgtttttttttatcaactaataatatgtgttcctctcatttggacaatttttagctagttctaactttcactacaatatttaaataaataaacaaccataaataaataaatgaaaaacaactaaaccgttagaggtggactaatttactgttaatgacagtaatttttttttttttggctgttttcggttattccggatatatatggattgatcttcatttaccccacagttagtttatccgaaatttgcgggaagctttattttttgttaccaatggatcgcgatttgccatgactgtagaaaagaaaaggttaactgaaaaattcaactttttcaagcggactgagtagtagtggtccc

SEQ ID NO: 13588 - DNA, 414 bp, Saccharomyces cerevisiae
gaaaaataagttcccacaaacgtagtggcatcatgttagcatagttttctctctctaatctttctctgtctacatatatatatatatatatatatatcaatttcaaatatgtctcactgtatattaaattcaaaatagaaataataaagccgatttgtaaacagcactaagaaaaaaggcgatgatattacttattaatattcgttgccaatatagtattacatatatctctatttatttctctttttttgtttttaaggcgtttcagtttgctgtctccttagtcttcaaaatacttcgtattccctaacttatgctctttgatgtactctggaccgtactcttcgtattctttcttactgataactgttttcctatactgttcttcgtttcgtgctagagctgccataccct

SEQ ID NO: 13589 - DNA, 489 bp, Saccharomyces cerevisiae
tgcgtgacgttgaatcgagaaaaaaagctacttttaacgaaacctttactagttatcctatatgggatcactagtattttttgatttacgattcaataaatagactagagacaactttcatatcattccttaaaaaatacataaagcgcaaattcaaccccattgatacatatataagtagttctattatgactttcaagaacaatagtagcttttctaaataatcaataagtagcacaaaatctgtctgtttgtacgcttatatttagtttgcgtttatttgcgagcgccacgagaaggggcaggaaaaaaagatcaatagtttgcaataaacatcgaatgatgatttcaaccaccgatacataaaccagcgaggctttcaaggaagaatgaacgtgaactcgtcaactcaaaaagaaaatgagccagcatattaggaaattagattctgatgtttctgaaagacttaaatctcaggcatgcacggta

SEQ ID NO: 13590 - DNA, 468 bp, Saccharomyces cerevisiae
tcactgaatttagcgaatacatgggtatggacatgaacagcaatgggcactgttccttctcttacatttctcttttatagtttcaatttttattatacactaaggattcttcttttctagggtacgcaaattaaatgcaagcaagatcatataacattgtcatagtctcatgcatggtaaatagggtgaacgaaaaaaattgggagatcttgccgacggctacgtatatatatatatatatataaatatatatatatatattcatgtatactgtatatgtacaatcatatataaagttactcttcccttttctttttttttttacattattacgtatatactgctttattatcggaaagtagcagtttaattaaagcaacttctgttgtttttcctctaaaacacaaatcataggatatcaactgcaacaagatgttggatcatttgtggatggcctttgcaaattaa

SEQ ID NO: 13591 - DNA, 408 bp, Saccharomyces cerevisiae
ataagaacatggacaccgcttttcgtcccatgtatattaaggaagaggagattgcggtgatatgtattctgttatatgtcctattctataacccttgaacaatatgtaaacgatttttacgttatgaaaatcactattatccccacaatagtttattataacaccgccgccaagacaggggattgaaaaggccttccgaggtttatccatttttggtaaaagcccgccacgccttcaggtgtttgagtatgaactggaagagttatctgttaggacctcataatcttgaacatatgagataatttaatatacttttgttatggattgttccgttgttttaagactatatggctttgttttagttttagggtgattgtggatatcacaccggtcctcaagaaaatcgaa

SEQ ID NO: 13592 - DNA, 478 bp, Saccharomyces cerevisiae
gtaaaaaggggaagcgatcttaaatccacatgaatttcctttctctttttcttcttcttctgttccctttttctttcttcttccttcaacgtctacgtaaatataatgtataacatctccactttcctttcccttatagcgttatgttacctgtttaaactctaaattcttcatctactactgctgttactacatgtatatatgttcatttttttttttttttttcaccacggaaaacgtaaaaatgagagcatttgtaacaaataaaggagaactgttcaatcaagtgacatacaaaaactctctccaactctacaatcaccaccgtaatgtctgatgctcaattcgatgctgctttagatcttcttaggaggctaaatcctaccacgttacaggagaatctaaacaacttgatcgaattacaaccaaatttggcacaagatttactatcttcagtagacgttcccctatccacaca

SEQ ID NO: 13593 - DNA, 402 bp, Saccharomyces cerevisiae
gttgccctttccttctttcttaccaactttaatttctaaggcattgacattgaaattgacattgtcctctaatgtttatagagcaccattatttgttttcgttttatatattattatataatggcacagaataatttataattctttttttttaagtcattgaacagtcgcactaaccaaaagattaaacaccaccagagagtagtttttccagcctggcaatctcttctaaagaagtagcttctgctaactgctttttcaattcatttcttctctctactgtcatcttactcaccaccaaattcatgatctccatcgttttatctctggatccattatctcttattgcagtatttactgggcccaacgtatcgccgtccgcctgccttggaaagctcattg

SEQ ID NO: 13594 - DNA, 444 bp, Saccharomyces cerevisiae
ttaggtaaaaataacatccgttcatagcatctttataattgttctttgatattaagtgtgtatgctcaatacacatcacccaaaacatttttattcgaaataagatgaaagccatttatttatatatacatatataatattctaaagaataaggaaacaactaatcgaactagcatagccttttccatctttgttttcttgcgcagtaataaatcgtttcagttaggcctggcaataaagatttgctaatcattgaaaaaggtgtgattgattttctcacttgaagtatgtctagtatttattaaacaattataatggtgtaaactaatgtctcttcaagcaaaacgtgcttaaaagtgtccatgtgatgggagggatcatattttcaaagaggtcttcaaacgttgaaggataagctcctcttcatcatcgtcaacccagttg

SEQ ID NO: 13595 - DNA, 478 bp, Saccharomyces cerevisiae
aaatatagttgatggttcactggccaaaaatgtataaaagaaaaatttatctgtaaatagtgatcgaaataaaataagataataactaaagaatatatatgactttactgtacagatctataattgaaaaatgacgagaggtcctgtgaaagagtctgcctgttcgccatcttcacacattcaaccaattccctggtgcgcttggttacttccatcaggatatctgctaatttttgatagaatcgtttcttcccaagctttgtggaatcgcatccataagtacacaattccgataacttttgcgagcaatctgtgagcctttcaataatttctttacagtgctcgcctaaatccagtttaaaacttttttggaccattgctttggtagtcatatcaatcaccgattccaaaataggaataatctcgatggaattttgacataatctcgaaactgatcttgcggacttgaacaattttg

SEQ ID NO: 13596 - DNA, 431 bp, Saccharomyces cerevisiae
tataccctgactccacatacctattcaacgaacacattcgtatcttaattatatgtaaacaaaattatatgatagttacagaataattgtgattattttctccttctactcatcttctcttatattggaagaatacatgaagttattgattaagcaaaattgaagggaagaggctcattttcttccatttataaatggagagcttgagatgcctccaattgataaatttttgtaaagactttcaagaaacatgtctaaaaagaattgacagcttcgaacctttctgcataattactaataccaaattagtgagaaatggggtatgtcgaggaataaaggatgcaaaagagagagtaatgtcatgcaagttgtgagtttgaaatgttcacacgtttataatgtccatactccgtggcgtgcatgtgttttag

SEQ ID NO: 13597 - DNA, 495 bp, Saccharomyces cerevisiae
tcttagtgagacacaattaaaacaacaattattttgtgaaagataacagtggaaatctatctagtatacatcttcgtatatattttcttacataacgcatttagaatttttttactcaaaaaagtcatccttttcatcttctcccacaacttgatccaattcttttctatcctgtgtaggtgatacttgtgatccatcctcatgatctttatcaggtgataatgttaatccgatggaatcttcatccaatttctttcccttcaatatctcttcgaaagatacgtttaaggtgttcgcatccattctttcagctactaatttaagaaattgttctcttctaagatttgtcaattctacgccctttgggtctgtagatggtgtatcattcggatatagtgcaatatacttttcagttttgggaaaatttatcacgtaacataattcaattttagtggctctcaacttttgttgtaaatctttatcatctgcgccaga

SEQ ID NO: 13598 - DNA, 417 bp, Saccharomyces cerevisiae
ttctcaagtgggcgtaatagaggaaaaaaaacaagtgaacgaaccgaaaataataagagaaaaaaagctttatatgcatgtatgtatcattatgattagtattataagtattataatctaaagtacgaagcaaacaaaaaagaaaaaagaaaatgaaaaaatgaaaggaagggctaaccttgcttttcattccatctacagcagtcttcaaacttaactaggttaccaccaaatatatctaaggaactaccgaatgtcaaatctacttttccgtgacttagttcgtctactaatttcaaatcatcaacacttttggccccaccagcataaacgattttcaaatcatcgtaatctttggtccattcgaaaagcttagaaaccaataattcatcgataccaccacacaaaccttcaacg

SEQ ID NO: 13599 - DNA, 462 bp, Saccharomyces cerevisiae
tttaggccgaacaagtgtcctcaatatcttctaatgcgtcaactattcataatttatttataattatattttttagtccatcataggaaagggttttctttttactatatcgaaatacttatatatagatatcaaaaaaagaataaaaatgaaatacctcaagaagtcgtttaatcttccttctagggtttctttcaagcggacgttaaggagacgtaataaaaattttctcgcacgagaaatttgagcaaagagcacgttgcgaatacgttttatccattcatcgtttttaatttattaccttttctttcgatgctgtttattgtcactcatgagtgcttccgttttttccatcgaaaatttacttttttagactgaaaagaaaatgaaaagttaaaataaatttttaccagaaaatgctcatcgcaggaaaatgacaatactattgtgagcttcccgagg

SEQ ID NO: 13600 - DNA, 429 bp, Saccharomyces cerevisiae
tgaaataacattcatcagcaaaattaataaactaaataaaataaataaataaataaataaataaataaataaataaataaataaataaataatatacgatcataaaataaataataactcaagctttttagacttgactagctaattctttcaatagtttgtaatcacgttgaacgataccaccattacttggtagatacgtagtgccgtccattaggaacttatcgacagaggcagcacattttctaccttcttggatggcccagacaatcaaagattgccctcttctacagtcaccacatgcaaaagtctttcctccatcaatagagtatgaggagtcgtcgagtgtggcaatcgtaccacgtcttgtcttcttaacttcgttatcgttgccattgatcaattcaggacccacgaaacccatagaca

SEQ ID NO: 13601 - DNA, 403 bp, Saccharomyces cerevisiae
aaataactgcaggaaatgaaaatgaaaatgaaatggaaaaaaaaaaaagaaaatttaacctatttaaaataatacaatgtattacatatttatcacgactgtttacgtatctctactcaatttactttaaaggctaagtgctcattctggctaccttacatctatctataaaacgttcaaaactcaaacctcactaggcctggagaaaaagggaaaaaaaatatctcccgggggcgagtcgaacgcccgatctcaagatttcgtagtggtaaattacagtcttgcgccttaaaccaacttggctaccgagagtgactattttgatttacttcaaaataaagtgtcagtactacccttattatatgaatgttgtcgtaacctctcggattatatgtagacaatg

SEQ ID NO: 13602 - DNA, 477 bp, Saccharomyces cerevisiae
taccacgtaggatggatgtgttcgaatggcaaacaatgggccctcacttttatctgatgcaatttctaccttacccgggcagcgccaatttatgaatacaaatactttaacaaattgcactattgatgtattgacacatttgtatatacatatacatatattaataaggagcacgaatttttgacaagtagtgcacgcaatatctacattagttagcttttccattgacgctgaattttattttggcagcccagtagatcgttgaggagcttttttcaaacactttttctctcttaactccacatacttacgtaagaaagtgatgacgaaaaagaaagcagctactaattatgctgaaaggcaaaatttagccagtgaagattcttcaggtgattcggttcattttaaggactttattcccttacaagagttactgaaagataaaaattatgttccatcggtggaaaatttggagaa

SEQ ID NO: 13603 - DNA, 497 bp, Saccharomyces cerevisiae
tacgctgacaagtttttggcggtgcagataaatcaaaagacaatagacaagaattaataatattaacaattaataattaataaataataaataataataataataataataataataataataatagtaataataataataattaataacgataaaaatatttaattatgatagtaagaatacatattttgattgtcttagtcttccgcagagataattaattgttctcattttcaaagtcatctatatgtattgattgagctctactgttgtttttaactttattgtggccccctaaaatataatttttaccagtattaaccattttgctcttattagtacttttactgatggtggaacccttgaaatttgtcatgggcgattcaatccatagattgttattgctgcttccactagtgttcttgtatggaattggtgtcgtaggtgccgtagtcatagcatcggttgctctagttaaggtggttggttgtctcgtc

SEQ ID NO: 13604 - DNA, 470 bp, Saccharomyces cerevisiae
tagagagctaacttaacaatctcgtttatttattatttttctttatatctatagcccatacttgtatatactacgtgtaagtactagatataaaacgaaaaaaaaatacttacaattatttttttttctttactgctctattcttttctttattctattcataaatgcaaacaattagttatgtaattttaaaagttgaaaataattgactttgtcaaagagtaattaatttttcacaaatcatcataaatgcaggtatcaaaatattgtcattaagcacactattaccttctagcactccactcagtgtacaaagggtaagcaattgtaaagtagttaggtggttaaaaattgcagctttatcaaaacgtaacaataccaaacaaacgataaaactcgttactataaacgcaagagttccctctaaagttttttgtgtacctttccaacgaatgcggccatacctttta

SEQ ID NO: 13605 - DNA, 430 bp, Saccharomyces cerevisiae
cggcaagaaaatccactgtttatgtattgattgcgcaatgcagagatagatagatatagatagataatggacgtagttatagaacagaaaatcggtagatcgaaaacacaggggaaaaaggggggggggggggggagacagcgcagccacgtgacgggcttcctctttggaaagtggagcgaagttttgcggaagctactttattccggcctggagtcaaaagaggaagctcggtggcaaatagcttcctctttgtggccggggcgcggggggacgaggcaaaaagcaaagaaaagcaaaaaaaataaaaaaaaaaacaaaaaaacaggggtatgagaaaaagacacgcttttccacgcgcagcaaaaaggaaaaaggaaaaggaaactctttattattggaccttaaacctgaaaacgagacgaaccgt

SEQ ID NO: 13606 - DNA, 412 bp, Saccharomyces cerevisiae
gagtagagcacgcagcacgctgtatttacgtatttaattttatatatttgtgcatacactactagggaagacttgaaaaaaacctaggaaatgaaaaaacgacacaggaagtcccgtatttactattttttccttccttttgatggggcagggcggaaatagaggataggataagcctactgcttagctgtttccgtctctacttcggtagttgtctcaattgtcgtttcagtattacctttagagccgctagacgatggttgagctatttgttgagggaaaactaagttcatgtaacacacgcataacccgattaaactcatgaatagcttgattgcaggaggctggtccattggagatggtgccttattttccttataggcaacgatgatgtcttcgtcggtgttcaggt

SEQ ID NO: 13607 - DNA, 465 bp, Saccharomyces cerevisiae
aacaaaagacaagggaattgttgaaggggaggcttctaatggctttcagtttctgtgaagagaaggctaacagctcaatggttcgaaaggtaaagaaaacggcaggtcggtagcactcgattttgctagaatggaaatcatatagagaacaattgaatagtaggccttggtttttagtgttgtactcatcatggtcatatgtgacataggtaatgtacatatatatataaaaaaaaaaaaagcaatgctgtgagatcattcgttacttacgaaatacgcagattgcaatttgaaataagctgtgttttcttttttttcctttttttttcttttttttggcttgttatatacaacttttttctatttctgttctttttagaagtaattaattggtacataggaaataaatatgaattatattaaatgaagtaaaagtaaaagaaaacggggaaatttatcgttttg

SEQ ID NO: 13608 - DNA, 424 bp, Saccharomyces cerevisiae
taaaattagtgccggcttttttttagcgcgtactttaacgaaataacacatgatttttcacatgatttttgttagataaattttttatatgtaaatgatgatagcgtaaaagcactgttgataatttgtttcaccattatgggtaaatgtgtttttctacatgaccctcgttcattatgatatttagcgtgtatataaatgtgaattccaaattattaatgaggcataagaagcactatcctttctcttcggatgaaaacaagggagaagaaacctgtgctggtattaatgctgaaatgtcttgctaagaatcatacaaggtggtagttttatttaataaagaaaagaaaaggactagatataaaaagtgaaatgaatataagatagcgttaagagatgtccgcagtacttgacacataattta

SEQ ID NO: 13609 - DNA, 426 bp, Saccharomyces cerevisiae
ctacataacgtagacgcttcaaaatagagtaccatttgtacttacatcgtgatcacgtttcttttttcgttcgagccgtgaaaatttttttcctttcagcgaaaaatacagaaaataaaatccaactgaatttagcgatgagatgatcatttcttatagggattgtagttgtttgaatttgtaggtaaatagttatatcacctactctccgttttcatatacacggaaatagcaccataatgtcgaaaaggtctatcgaggtcaacgaggaacaagatagagtggtctctgctaaaacagaatctcactctgttcctgctattcccgcctctgaagagcaagatgctcccaagaatgacctagaagaacaattgagtgatgaatttgatagtgatggtgaaattattgaaattgatggcgatgatg

SEQ ID NO: 13610 - DNA, 401 bp, Saccharomyces cerevisiae
cattcatttccagcataccactaaaacattcgtatatgccacataataactagttgagaaaaccatagatatttatatttatatgtatttgtacttctttgagcaatgtatatttaagactgatctcaacttcagcaactgttcaaattcactgtttttcctaattaagcacaacatgaaaaactagaattttagaaagaaaaggaaaaagaataccagatggtagttaatttctcacaaaagcactgccaggtaaaggtatacagcaaggatggactctcttgaagctagattacaattcattcaggtcctgaagaacctgcaaaagacgctgcacaagaccagagactctatcacatcatcgtcgaccaccacaccaccgtcatcgcaacaaaagctga

SEQ ID NO: 13611 - DNA, 415 bp, Saccharomyces cerevisiae
taaagtagccatgtttaatcagcactgatcgtgggaaatcctgatgtccaacggtgagtttctgatttcccagtcacggattccttttgagaatcttctcccgcgaataaattattggctctgtgtaatatttaaggtcgccttctttttcgtttgtatagtcagcagttaagtattcattaattttggatgatgcaaaggtccatattcgatttctgatagcccttcccccttttttgtagcgaattgtattattgttttgtattgttttttcgtcattttcttcaatttttttcaagttttactttcggaagaattgctgaaagtattttctgttaggatatgtaaaatacaagcataaaatatgtttcaggagaagaaaatcactcaatagtgccacaccattgttaacgag

SEQ ID NO: 13612 - DNA, 459 bp, Saccharomyces cerevisiae
aggttaccataaatcaaaacactgatgtataagaacaataatcttctacatatgaatatatatacatatgtatttatttattttatttaatttttaattaggatcgcgagaaagagaaaaacaaaactaacttatgatggaacgtatcgagaggaggtgaatatatatatataaaatgactaggctagaagattcagagcttcatgtattgtcgtagtttttttggtttgacttttttaatcaaatttcaaatttcagtaaataattggttggatattactatgcaaaatgcaaccgtattttaaaataaaattaaaagaatccaactcatacaatgaaatgttttttatattaaacgtgcttttttttattattttttgttcttattttccggctttcggaagatgtagagtggtccggtatattaatgcttgaactaggaaaaactatggatggggc

SEQ ID NO: 13613 - DNA, 424 bp, Saccharomyces cerevisiae
aattgaggaagggtttgccggcgtgcttgcatgcatgcttgtatgtgtatagtatatatactttgtacgagaataaaagaacatattacaattgtacattatagaaagcttacaaaaggtggcagattaaccattagtattaatgtttggtggcaagcaactcttttactagatacacagcataggaaaatggatacaaaaagatgctggtgaaaccaattgaacaagtaagaatagacttgcaatcaaaaccatgtcatatcaagagagcaggatcattttcaacaaattatacaacaaccaccactagattcttttctagcgttggcgcttgaatttttttgtggctcagcagactgtttacttctcgaatttaaggcattattttgattaccacgactaatatcacttcgatttccgttgc

SEQ ID NO: 13614 - DNA, 417 bp, Saccharomyces cerevisiae
tttcattagttttcacacaatatcaattttgttagagatacactgtatattattactagttatttcttatctcttgtagcttcctctatacatgctggcatttttttacatagttctaatagtataatatacatataaaaaagaaaaatcatgcgttttatatatttctataaatacattcatacccaaattatggaacacgttcggaatattacttaaagaatactgcaataatggaaagaatatttgaaatgaataaaaagtatgataacaaggttataagagaggtacaaataaaataaaacaaggaatgaagaaaaaaagcacaaaaaaggcaagatagtaatgcctcacagtattttgaattctgttagtagaggtatatgatcactaggatggttttcattgggtaaaccc

SEQ ID NO: 13615 - DNA, 460 bp, Saccharomyces cerevisiae
ataaagtgaaatccgtagctacataaatgtgcatatattaatatacagtcactagtacatatgtaaacgtcggaccactcgtatatgcattttcttttggatcacaccctttctgaactatgcaatgaataacgttaaattcaaataagtgctttagccttactctgcgtactagaaaatgagctgcaacatttcttattaaccctcattttcatttgactcttcattttcatgaatgtactgttgcaaagatatttgtctaatttgattcaacaggtcctcatcttgcattctttctgcctgaaggacagctaaatccttttcattaataaaggttttgatgttttcaaccacttcgattgattcttttgacgtaggcattggtggtaatacgtcaaactcatatacttcattatcagaccagataaatgatggaattgcagccattacagaagactcc

SEQ ID NO: 13616 - DNA, 465 bp, Saccharomyces cerevisiae
ctagaacttttcttagaacgctatcatttctttatttttttttctcccctgcacttgtcttttctatcagtcacctgcatgtatttagtttttattcttctatctatagtacagagttactttgatatgtaaaaagccatcattttgtcttcatacctgccaaaactataacagtacactctagttcaatatttttgacacttttcatgcttctcgccttttctctgtgtatgcggatgttatcaataaagaaaaatgctttgataccagaataggaactacatttttttttggctcatcgacgaagtgataaggagcctggcaattgaaaatcaatcaagaatattttttgcttccaactacaagtaatgatggtgtttattttgcatgaattttggtattattgcagaaatacaagtggtaaatagttttgtaaacgtatatttcaagttggaatgagatgcg

SEQ ID NO: 13617 - DNA, 458 bp, Saccharomyces cerevisiae
gctaagagacgaatttagtttgttttgactattcgtttaatgagtacaaattaatcgcacccacacatgtacacacacacatatatatctttatatatacacataaaatttattcgtaggagaattctgtaatactattgactacaagggttcttattgctattaataatgttacatgtatatgcttatatccaatatatacccatcgccgcttattcttcgtcatcctctattagagttatttttcttctttttctgactctctccttccttatgtggctttctatatcgttttcatcctgctcttgtccttttctcttcccatcctcatcatcatcactgtcttcttcatatgtgtcttcctcctcatcattttcttctgatatttgctcatcctcaatgtcatcatcaagggtaaagtcttcgtcttcgtcttcatcttctttggcgttttcacc

SEQ ID NO: 13618 - DNA, 407 bp, Saccharomyces cerevisiae
aaaaacacgctttttcagttcgagtttatcattatcaatactgccatttcaaagaatacgtaaataattaatagtagtgattttcctaactttatttagtcaaaaaattagccttttaattctgctgtaacccgtacatgcccaaaatagggggcgggttacacagaatatataacatcgtaggtgtctgggtgaacagtttattcctggcatccactaaatataatggagcccgctttttaagctggcatccagaaaaaaaaagaatcccagcaccaaaatattgttttcttcaccaaccatcagttcataggtccattctcttagcgcaactacagagaacaggggcacaaacaggcaaaaaacgggcacaacctcaatggagtgatgcaacctgcctggagtaa

SEQ ID NO: 13619 - DNA, 443 bp, Saccharomyces cerevisiae
gtttgtctccctcactgttttttacattcactcactcccaaacttatgccatttctatcatgataaccaaaaatagtcttaacaaaatacatataagtaaataatgctaaataaaaaagcaaaaaaataaaatttatatcacacttgtaaaacctttaaatgatcttcttttttacctgttttattcacttgtttttttttttctgagttgttgcgccttggaagaatggaaaagcaatagtttcagtgactatagtatacaatcaaaacacccgccagttcaaaactattacttggtcactaacccccaagtcatctctagcaatttaaatttcaattttaagaaaacctttatttatccaacgtgaacaagtactttcaagcacttctgcccaccgctatatcgtggaaaaatgtgtcaagctaccaatggcccgagtaga

SEQ ID NO: 13620 - DNA, 472 bp, Saccharomyces cerevisiae
aaggttttctagatttcacattgcgtaactagattttcgtgcacactgctacatgaattgataaaacaaaccagaaaaagtaactaagaccaatattttcaaatttttcatagtatactttatatcgtacatcttacaagcaaaaatcaaaggtagtgtctatgtatgcaaaaaaataggaaacgaaaaataaatataaataaataaagccatgaaatgtagaaaggctatgcaaaaaagaaaaaaataaacatcaataatatttggtcaaataaattaacagaacgtatgctgttaaaagagagcaggcgtcatatgatgcttccagcatagtagctattctcgccaacatttctccttagatcaactctcctcaactcctttaacctactaatcaaattgtgtgtaatactgtctattctcaaagttggttttccaactttcattttgtccatatcaatgtcatcatcca

SEQ ID NO: 13621 - DNA, 425 bp, Saccharomyces cerevisiae
aatcagctgtgacaagtaagttaattatatagtaatgctctagtttgtatgtaatattatgtataagttttctcataaacaaggcttctattttcaaaaaacatcagcccctttcctcctcttctaataatttacaaataggattcagtacaaagttttcccaatctttatcaaacttcaaatcagagaatttatacaatgaatactgctggtttcttgcgcccatcacccttaggcagtcatagtccagtttcgtaatttgtaagaaaaggtcggacaaattagggtatctcagaggatctttggttgtgttataatcaggatcactcggctctttaaagaaaaatccagtagtttcaccatcatcttcgagttttgcaaaatatttcttttgtaactcccattgtggtggagcttttccgata

SEQ ID NO: 13622 - DNA, 431 bp, Saccharomyces cerevisiae
ctcgaaagaagaaaaatactacaagcataatctacaaagcaaaaacagggcttgtcctgtagaaatgagaaaaaccatatattataaataagcacatattccatatactttgaatattgttttgcaattctgatccacactcttttttttcattttttcaagatttcttgattaagtaaaattaaaaaaaaattcgggaactcaagctaaaactggatgcgtctactcatcacctatagtctcaagattgtcgaagatacagattttgaataaatatctacaaaaaagttacatagtaaattgcgaatggaaggaaaggttgatgtcttgctaacatggctgaaaaaatcagataagttttatatagcaccaaacatcagcatctgtgaatcgccagaaactggcagagggatcgtcctcagtcacggttc

SEQ ID NO: 13623 - DNA, 478 bp, Saccharomyces cerevisiae
tgaggtacaaatgatatatactacgggtatagatatacgtgcatttatatattaagttgaagtcttttcccgtttctgtttttgtatatttatgctcatgcccatctttgcacgacaacggagttcagcagatcagcgtccttcaatgttgtctcatcgttgcttattggtttgataggaaaggcataattcaaggtgaaattcctcgatgggtcagtgttcgcatttgatgtcacatgctcatacaaaaactttactgtatctgtggaattgcagtgcaaaacttctcttttgccatttgcgtatctaatttggatggaggtgtcgccttgttttggctcattgtccggcatgggttgttcctgagcagcgggtgtctcattctttggaacctccgcaggtgacgattcacccgggataggagatcctagtctttggccctggcctgaaaaaccgcccagttttctcgtcggagctt

SEQ ID NO: 13624 - DNA, 486 bp, Saccharomyces cerevisiae
atgaaactggtaatgggaattttttccttttgatataagttggtagtctctgtaaatatataaagtcaaactattcgtaatgtgtatataacgtggtcttaaattatttttattcgtatctctcccttttatttgcctggctttggtgtctcatagcttcttttctctcttttaagctcactttactgacttttcctgccgacctttagactttttactctgctcagtaatttgctgcccgtcgatttctttttcatattgggctcattgtagcgcacacccaaataaacgtcttcctcatcttcattgtgatcatcttggccgtcgaaatcagtagtataattggacttatgcgttctgttaggagaattaacggttttcgaccttctaacaccttcattgctgtgaccaacatcatagttgtctctacttaaactcaagtttcttctaacgcctgtcatgggggcattgctatcaccggatcct

SEQ ID NO: 13625 - DNA, 474 bp, Saccharomyces cerevisiae
cttaggagggggcaaaagacttatgtgtaaattattatatgacatggcgtaagataaggattatgttctgttgtttttgagctcgttgatgtatagatatgtaaatatttataaatataatatttcttccaagtgcgacatacttggtactggcaaaaaacaaagatgagacttttaaagccactgattgattgattaattattaagtaaaaaaaaaaaaataaaatgtcggtgtaatttggctccacgatcgcatgcgtatacataacatgagattaccgaagatttttctgaaaggtaatgcattatattataatcattaatagaagtagagcctaaagcctgttgaaaacttgtacaatagaggaaaaaaaaagggtcattaatcgtcatgtttacctaagagcgtctaaactttttggtattcttctggggtaaacgtaaaaacattgcaccaagggcaaaattgaaaaa

SEQ ID NO: 13626 - DNA, 448 bp, Saccharomyces cerevisiae
tgattaaataatacttatacttacctattacactcttcatattttttttaatgtaaagaaagtaaaaaaaaaaaaaaataaaaaaaagagaaatgctctttctttaccttcacaggtgtattattatgttgttgtaatatccgggtaggtttattgatcgaggcgaggcgaaagggcatattcgaaacaatcattatgataataatgtcaatatagaaattgaaaaaaaaaaaaaaatcctaccgccgcatcgacgctcctgttagacctttgaacggaaatcacccactctttactgtatatattttattccacctctgtttccaacgaccatttcaccataccacacaactcccatgaacataaaggatagaacttcagaatttcaacaaagtgtgttgagttacaagaaaagaaacaaaaactttagagaacagcagagggaacg

SEQ ID NO: 13627 - DNA, 497 bp, Saccharomyces cerevisiae
aggcttatatgaagctaaggtctctcatatttctagcatataaggtatgcgttatctctatgtctacgaattatatctgtttatagtgttttattttatatagactcgctggctcataaaaaatcaaccaacttttattctggtttgcctcagtcgaaatgttgtcctttactattgactagtgttgaagaatttccggatcttatattttcgacaattgagttccaacatacattacagaaaaaatacaaaaaaaaaatacagaactatcgtaagataatctgcttttgatataaatcataaatcagtggagcatggggatatattcattttggatctttgataggcattgtaactgtatatttgatagagaatggacattggcgtccaatagcgcaagtggtacaataaactccaaacagaatgaagaagatgcaaaacttctgtatggtatgatattttcgttacgctccattacacaaaagctctccaaaggg

SEQ ID NO: 13628 - DNA, 427 bp, Saccharomyces cerevisiae
aagctaaactaaataagcaagagtatactcattctttttttgctattcctccatacgtacatagacccttgaacctacatatccgcgtaagaaactattaataacctagcacctgcgttaaatcagaaattcttaatcgcgttttacattcccaacgcgttcaatctatttacacacaacagctttcggagtcgggcttttgcttcatacgtattataaaaatttcagcgattgctgaaatatgcaaagaacacaggaacacgaataaagtcattgagcctcgttttcagtgaggtatcattgtctatcatatcagctttctttgctcaacagaatcgctaaaagaaagggcgtgttattaacagtagccaacccaataatttgaaaacaacattggacattatagatcaacgccatcttttcagaa

SEQ ID NO: 13629 - DNA, 407 bp, Saccharomyces cerevisiae
ataaaggtaagggtatcgtgaaataatatttttgtcattgtagttcaggccgtagaaactaaacagtagtagaataagctagtaagtaaattaaatatcaaaagttaataataaccaggaaggcaaaaaaccaacaaaaaaaggaactatgcaaaatagagactacataccttcaacacaaataaaaaaaaatgcagatattgtataatgggagtgtattataatccgggaggcccttgcagtcccggaggtgtaggtttgttaatgtcattgcccatgttattagaaaaccctggaggaccgcttaggccaggaggaggtgcaattgaggattgtaccgtagtcataccgggaggtggaggtagcgaaaatttcggttgttccgactctggagggctttgtaatgg

SEQ ID NO: 13630 - DNA, 423 bp, Saccharomyces cerevisiae
tgatattagatcaaagcctaagaaaaaaactaaaaaaaactaaaaaaaaaaagtcaatcggttctcttttctctgacaacaatggcaaaagatcaaagagaagcgtacgtcacggcaaaaccagcgacccttcaaaactaaattattatgcatgtatataatagacaccctatctaaactaccgccttatttttttttttatacaggagcaaagtgtcttttttgtgatggccacgagggtcctttcactcatgactccttaatcagcatcttatgagctggattttcatatatcggcgatttttttcatcggtaatgcacgcagtaaagctgctcgctcgagaaaaattagtaatatatggaagaagaagcataagcataaaagagaaaatccgctgccccaccgtagaaagcaaacaaggc

SEQ ID NO: 13631 - DNA, 484 bp, Saccharomyces cerevisiae
tcttagtttcgtttttagtaatgtgcacttagccttttttatatcattattattaattactagaattcatttttgcgtagtagacctacacgggatgaaggatatctatatgaaaagtaaagtaacaataggagataatgaaaaagtgatatcatacgctaacgaatgttcatgatggagccaaattcctaaaaatcaaacaaacagaaaaaaatgagaatgatgtggggtactgaagttttatttttcatatttatttttaattatagtaagtagccatttctatatatattcaaaaattatttgaccctcgtaacatctgccactgcactgaaaagaacaaggcaatggataacgctgataaagacgtcagcatgaactttcaattcactgagatagcaacattttcgaggattatataaggggtactaatctcttctagtcatcgtttgaaatacattcaggctgagaaagataaacgctg

SEQ ID NO: 13632 - DNA, 421 bp, Saccharomyces cerevisiae
gttggcatttgcttctccacctcacctttttatgttcttattccctcttgtatccattccgtcctcgctgaacccatgaaaagaaaaaaaattaactagtcacatagttaaatggcgctgttcttcgctgcgagcggaaccgggcctgaaaaaaaattttctcttttcctctccagatgactcagtaatatagtagtatattatataatgtaacaaaagaagagactgaagttttattatgcattgtagcgcctgtaatctttagtaacggattcttgtatttttttgtaaacagccaagaaaaaagtagagatgggcttgttaacgaaagttgctacatctagacaattctctacaacgagatgcgttgcaaagaagctcaacaagtactcgtatatcatcactgaacctaagggccaag

SEQ ID NO: 13633 - DNA, 458 bp, Saccharomyces cerevisiae
cagacaacgcaaaatgatctacttaatttataccgttttttatacgtataagagtatgtgtacataataacaatttattagactatttctttctgattgctttttcatgtcaaaggaaggagcagaagagcagtaaagatggcagttattttaaaaacgaatttcgagaaatagttggtataaataactataaataacgttttactgttttaaaaaagcgatccgttaaaaggccctaacgattctttagaaacttgaaacgttagcggaagagcactttgttttaaaccgtagtaagaatttttttatattttatttcatttacttattttttttttttctttactccttttttttatgttacttagacaaatttcattatattaggtaaagctaaaggatggtaaaaagtctgagtggttcttttaattaaggtagcaaaagttgatgaaactgga

SEQ ID NO: 13634 - DNA, 471 bp, Saccharomyces cerevisiae
aataactttgtttctcttcccttttttattttgtttttttttttttacttttgcaattttaattttgcattcagctacaggtgtgattgcatacccgcagagcaagtacaggaagcataagaaaaatagaatacgaaaagcagaaaaagaaaggcaaataacaatcactcaagtactacaactgcatgaatttatcgtatgtaatgtacccaacgtaaataataatattagtattttaaaatctatgacatcagatgtagttatcttactgccagccctattaatactactttcttattatcttcttcgagagccaccttcgtcatcgtcgcagtaagcattgtcatcttcatcatgcacgtcggtaacggaagcctaatctcaatatctactagtttactctacgccatttggagcgtagccccttctccttttgactctctgacttttccctcccctccttctcttctg

SEQ ID NO: 13635 - DNA, 434 bp, Saccharomyces cerevisiae
agctaatagcgacaacaggaaaaaaaaagagagatttgtgcatatctatgaagtatgtctaccacataaaaatgaccttataacacaacttccttagtatggaagtaatacatatatacatatatacatatatacatacatatatatatatatatatatatatatacatcttttgaaccaattccctatagacttggttgtaattcgttagaaagattttcattaattttatttatctttttcagaagtccgttatatggatccatcaagtctacgaaatgtgcaatatccagaatatttgagtcatcccgtattgaatcgtcctcgctatcttggctcataattttgcgatctccctcgtatttgcctagcaaagtagaagtcaaatcatttagcctcttatttagcttcactttgtcgttcagtttggcttg

SEQ ID NO: 13636 - DNA, 442 bp, Saccharomyces cerevisiae
ccgtgtaaaaggttaatgagcaaacgttccttgcttgtgtcaagacatgttcgggcaagatataaataaaattcaaataatgccaagtatcaataaattctgtttacatttccgcactatagtgcattcttgaaatcgaaacgcgttaagttctcaataaacaacgcgttaccctctcaacagaaaataatgccccattgtcctggggtgaatttaaaatcaaatgattataatgtgcgctattgttgcactgcttcccaggccgaataagagaggcaccacatttatcaaactggttacgttcgttttctgaaaatcaaacaaaaaatgtcgagctcctccaaggcttctgcaagttcatccttgtcaagcacagccacctcttcaacttctgcaactagaggcagcgacggatgtgttgtttgcgattcaactgcatcat

SEQ ID NO: 13637 - DNA, 410 bp, Saccharomyces cerevisiae
tataataagacacggacgcacacacaaaagaatagaacccaaaaagagagactaaacaaataatataataagttatagaagttaataatactcctactattttatattttttatgtaattactaccactgcttaaaaaaaatattgcaaaatatcataaaagtttttactcatcctgttctttcccctccagcatgtgctcgagataagtcgaaggtgtaggttttcttttggactgtacgaccaacaaattacccttactatggttacgatttacgctaccatcactttctggtgaattaagcagctttcgacttggtgaagatgcaatttttgcgggtttccttatgtcttcacccacctccttttcattaccgttatcgagcgacgatgcggatgatgaagagattg

SEQ ID NO: 13638 - DNA, 482 bp, Saccharomyces cerevisiae
tggcatatacatatggaaaatgattttatagcacgattcctcatacataataataataataataataggaaacaaaactattaatttttgtaaccgatttgaactcacattagggatccacgtcacgccgtgcgcggaacggtaggatgaaaaaggataaacagaacttacatacaaaaaactcaaatcaacgcaacaggtatgtagtgaagtaaaactagacaaagagaaggatactttagttagatataagaatagtatgaaaagattaaaaattaaaatattagaagaacaaattataataaaagaaagcggggtgaatgataataataataataataataataatattagttagaaataagacttcttcataatcgttaatgaagaagtgcatatgatttgttattttttttctggtatttttttcatttttttcgggttttccttgggtataattttttgtttcttccgaaagacgg

SEQ ID NO: 13639 - DNA, 477 bp, Saccharomyces cerevisiae
ttttcatgataaatgaatgccaatttgccaaacgtaccaaaaagagaccaatattataagatttataaaagaaaagctttcatattctgcgggaaaagagagaccacatactcagtttatcgctataattttaacggtatatatttatatttttgtaaatcaatgaaacagccaactaaattctgtgtagagttaaaaaaaggacattaaaagtatttttctttgctgatggcactcaagtctaatcttattaaaaaaaatcgattattagaataaagaaaatgttattcagttgtggtaaaatcctaagctcaacaattcataacttaaagggataagaagcgacgacatataatatgaagagtgacttgttcatgatacaatggaaagctatttattctttttctaaagattcctgtattttccttaagaacttcctgcatacaatatacagcattgttgcctttatcgaaacga

SEQ ID NO: 13640 - DNA, 480 bp, Saccharomyces cerevisiae
tacacggtccaatggataaacattttttatcaacactatgatatataaatataatagtttttcgtatatatattcctttttttggtcaatttttgaaattttcgtagaaaagggagagacaaaacacattatatcaatgaaaacgtacaaaaagtagataaagtcagtgcttaaacacgtcttttccttaaaaatactttattatttttattttattgagagggtggtttaaaaatagaaatagagagagaggtacatacataaacatacgcgcacaaaagcagagattagaaacacttgtggtgaacgatagatggaccactttcgtcgtattcttgttttgagatccacatttgttggaaggtagtcaaagaagccaagatagaaccaccaatccagacggagtactttctttctggaggagcaatgatcttgaccttcatggaagatggagccaaagcggtgatttccttttgcatt

SEQ ID NO: 13641 - DNA, 425 bp, Saccharomyces cerevisiae
gtgcctcaaccaaatttgacaatttaattccatgggaggtccgccatcccttttcgctttttttataatatgtgtattatttatacaaatatgtatataagtatgtactttttcaatggacaattcgattttaagagcgtttttagtgacaacgatgaacatcaactttgtacagtatcaaacgatttatttttaacatattattataacttctgaatggcgttgccatcttggccaaaatcttgtcttttctgtcgttttatggcaggcttttgttctttgatgttaattcggcaataccgacgcctttgatgttcatcaaacagtctgaaaaaaatacacctaaatgcctctacaaaaaaaaaggtaaggtaagagtgttattgaccggaagctgtaagaaactgaacacgtggaaaatgcac

SEQ ID NO: 13642 - DNA, 438 bp, Saccharomyces cerevisiae
tctgaagattaagtagtcaaaaatttattaattaaatagttggataatatttgtgctgggcattagaagtcaatcttgtcttttcctttatatggtgcaaagattatcatggttaacgaatctattttttttcgtgtcgtttttgtttttgtttttgtttttgttttgtctgcttgacactccataggaagagtaaatgaagaacctaccagacctagggaccaaatagcattactaaactacaaagaaacagctatctttacagtgtaaagtatttttgagtttttattaaagagtttgaagttgactatgtcaggagaagaagaagtagattatacaacgttacccctagaagagcgattaacgtacaagttatggaaggcacgtttagaagcttataaggagttaaaccagctttttagaaactccgttggcgac

SEQ ID NO: 13643 - DNA, 418 bp, Saccharomyces cerevisiae
tgtgtatatgtctatgtatgcagcgctgaagccttttcagggttgttgttgttgttgttgttgttgttctttgtcgtgggctacctgctccatgtacagagtgtgattaaccaagttcagataagcatacatgaagttacttagtaatacctgctcgcgcagtcccctcttcgaattgctcaatttcaagtgactcagccggtatatggccctttcgacgttaattggtagacggtggtcgaacatgataaccgtagacactgtcagcaaaggcagtgggaacccaaaggcactgtctgtgaattgaaccggggagtttggtttgtcaggttttttgacgtctgcaaatgtaagctttcttgggggcaatatggaggtatgtttcaatggtggtgccgctggagcctgagtttgagct

SEQ ID NO: 13644 - DNA, 462 bp, Saccharomyces cerevisiae
aaaaatgctctcctcagcaccaaaattcatctatctattaagatgtatacatacacaagtgcaccaaaagtgcttagtggtagttatatttgctgattatatctaagttatctatttactttctcggattcaaaattaaccatgttgggcaaagcagtggattgtaagggaaattgatccactttactagtttgcaggtggatagcggggatgacccacttaccacaactgcacctagatcctttccagttgtaaccgccaactttacttgaacagcctggacatgaaaacttcccttctaactcttgcttgccttgtagttcaggttgcatccattttaaaggttcgatgaaaaaatgagagcaatttgcttgtgactcttgaatatcaataatacgatgggagttggcggccctcttgatgaagtgtccctctgatgattccttacttggtgggtcatgc

SEQ ID NO: 13645 - DNA, 418 bp, Saccharomyces cerevisiae
aacctgaaatagcagccccgtggctcgtaaagaattttgccaacacttctatgcatgtaaataataaaagtaaaacataacgctatatttgtatatggatgtttatttaatgatacatagaaaactgtcattttctttctcttttcttataagtatttttttttataaaaggcaaaaaaaaaaaagtttgaatgtaataaatatggttcagaaagaaattacaataaatcaaaagttttgagtatcattcaagattatttgcatttttccctcatttacaggctattttttcaaggcctttcttctgtttctaacaccttctgccaatagctccaatacctgttcggtggactcccagccaatacaagcatccgtaacagaacaaccatacttcaatccctctctgccaccttctttg

SEQ ID NO: 13646 - DNA, 473 bp, Saccharomyces cerevisiae
atttgtaaaggttaaaatagaaggccgatgaggccttatgtaagtctaatatggtattcttaaaaaaaaaaaaaaaaaaaaagcgtcttagagggaatataagagaaaagaagagatagcataacacatgatttatttttatttttgcgttttttttttttcttaattgtttatcaatgtatctgtgagagtatctacataaaaaaaataaccatatgaagacataaatttaaaagaacaaaacgaacgaagggaagaggtgcagaaaggaaatttatgtatcacaactattaaattcagttgaaaatccaccatttgaaacttttttcttaagcacttcactgactttttcaactcttaactcatgttcggaggataacgtattagaagaagacacgtaagaaggatctgttgataaaggcatgggcttgcctattgctgtatatgacgaagatgtcgataaaggcgtctgg

SEQ ID NO: 13647 - DNA, 446 bp, Saccharomyces cerevisiae
gattaaagattcttgtagccgaatattatttataacgatccatactgcatattaagtaaaattatgaagtactaagtaacaatttttcaattttatttaagaaaagagaaggaaaaaaaaaagaagaaaattttttgatagaagaaaaaggtaaacgatgattgttacgtaccaagtgttcttctgagctatttggtaattacatacttcttcgaaatgtcaaggtaaatacttttctatacgcacacgaaactcgcttgctgcaacaggtattacgtcaggtgaaaaaagcggccaagaggcaatgccgaaatacaatgcgtgtataacaggaagaggaggggtataataaaatcaccatagtagaaaagaccagaaagatttctattgcaatcctgtgtgactcttttggtttttccctttggtatctcccggttcttttgtca

SEQ ID NO: 13648 - DNA, 496 bp, Saccharomyces cerevisiae
tggacggacaaactcgttactattactctactgtctttctaaaataaatataataataaaaaaaggaataaaatatagcagcatgggcttgctttgcccatagtgtatgcacatatatatatatatatatgtatctatccctctcctcttgtaacagtatatcttccttttcattttcgttgtgtatatgtatgtatatagttctaaatttgcgattataccttttcaaacctctcaatgttgtattgtgctaaaactatgtacattttagagaaaaagaaggaagcaaaacaaatacataatatatacaggggggccgttctttttgtttttgaacatgtattaaagagtgctcaataattgatctacaatatcaaatttcttctttggtgcatcttcagggcgtttccagtgttcaggaaactcataatcccgcttctttttacgtaaactcttagctatagtatgccttgtgtcaaggggaacatcgctaaaa

SEQ ID NO: 13649 - DNA, 481 bp, Saccharomyces cerevisiae
attatgtaattccctgaaaacttcctcgaaatttattgcactttttttactcaaaccatttaataatcatatgtaaaacgtataaaatagtatccattccactgtactcagtgtcttacgtaaagggctgtatactggcactaccttttactatggatatgtgctagctttttcggagaagaaatgttcgccttacgctagaaaccggggttaagggggcgtgagaatgaatattggcagacaagaaccgagatagaatcttaacacaaaaacagttcatcctacttctacgcctttatacagttatactgaaagatctttgcataggggcatagtttaaaataaaatatagggttgtcatagcaaacatgccaaatgtgctttctgatgatgaagagctccttaatggactaggaagtgagattatgaaaccctctagacaaggtaaccatatggcaaggaccgtcaaaaggtgggtaaa

SEQ ID NO: 13650 - DNA, 415 bp, Saccharomyces cerevisiae
atgcatcgatcaatcggagtcgtcctcctttaacttcacgaattagttgccactctcattccccacacataaacttgttttatggcatccttttcatttagcatgtctttatttccaaacctttcctcgttctttgcattcatttagcgtttgctcgagaaagcatcacgttttcacacattatcgttcgtcgctataataaaaatagttatagaatttactcagatttacatgtcgtacctttttaattgtaaaaaaaaaaattttatgatacataattacctaaatataattcagaatcaaacatacttatagctatttgtatgctattaggtggtcctgctataaaaatatcgtttataatactttatattttatctttcaacttagtcgcaattgcagaagctttccctga

SEQ ID NO: 13651 - DNA, 488 bp, Saccharomyces cerevisiae
gagaaaaactaatgaagtgattaacaataataatttaataataactcgccatccgaccttgtataatataatgtagcatatatgtgcacggatatatatacatcttagaaaaaaatgaaaaaatgaaaccaagaaaaaactaactgatggtgttcggacaacgttttagaatgagggtatctaactttcttctaccattctctgtccaaaaacctagaaagtaaagtccagccaaaccaagatgtgttttccaacgacgaagacgctgcgcttggtgaacggtttaatgtttctccagtgctctcatctgtaaatcgtgaccgcgatgacgaatctatatctacgtctgacaacctgtcgaattcaagaggcatcgagtagtaattgaaaataaagtcacgctgggggaaaaaagatggtatatcgtcaaatattctttcatgatggtatgtcaataattgccggcgagttttctcgcggtagcatgt

SEQ ID NO: 13652 - DNA, 463 bp, Saccharomyces cerevisiae
ttcggtcgatgactaaatgttaattgattaatatttttgctaatcattgaaatgattggttttaatggataaatctcgacattcgaatagatagcatataattcaaaaacgattataatgggatatatatataagtttaataatattaactcccttcccatttcttgaagagaagagatgtgttaactcctccaaatccgaagctgttgcataatgcgtacttcggattagctcccacaataggtttgtctcttatgaaatgtagcttatcggcctcgttattttctagagtcagaacattgtccaggtttaaggtatgcggcatcttatcatccttcaaggaacaaattgtaaatatactttctacggcgccacgtgcacctaaaagatggccaattgcacctttgttactggatatgtacagtggcttgcttttggatcttcctggtaagagtgctgaggc

SEQ ID NO: 13653 - DNA, 408 bp, Saccharomyces cerevisiae
taataggaaacgtgacggcagaaacgcattcatcattgtagggggaatatatatatatattaatattgtttatgtaaaatatatttgaatataaatttatcagttcgcactgttcgtggttgaatccgctgttgtagatgattcctttatttgttcaaactcgttaagatcgcagcgaatttgagaattcgtatcccgcaactgagcaaataactgttgtatttcattttgcaacatccgggcatgctctactgacgctgtagtcttttttttctcttcagtgtccatggctacttcgagcttctctttattgctagatcctttttaaggttatctcaaaatttttcaagttgctgctgattttagttaaaaataaaatatcaaaacgccgatgagacaggcaggata

SEQ ID NO: 13654 - DNA, 476 bp, Saccharomyces cerevisiae
aaatttctatttaacactgcagaaaactgtgttcatttaaagaaattcttgcgggttaatgctattatgatattttctgttgatttggtgataaattatattatatgctatatactaattcctttggaaataaaagaaggccttaaaattaccctgcggaggggactattaaatagaatcatttatatgaatactaaggagagttcagtatcaagataacaacgaaagtttgaactgctaaaattattttcaagtattgctgaccgttaagaaattttctgctccattaattcattgaggcgaagacaagcgcacttttactcttgtgtttataaagctaaatgacattgtggctcacttcaatagccgtactctttgaactaaaaaataattctaagacactgagtttcacgtcaattgaaaaaaaatatataacaccagcttcattacatgttagtgtgcctttaatttggcgt

SEQ ID NO: 13655 - DNA, 438 bp, Saccharomyces cerevisiae
gtaaagcttcttgaatcaaaggaaaatgttccttttgatcgctccactaccgagaaagaggaattggtgtgataagtcttctcaaatagaaagtaatagtaagtatttttttttttttaatctgaactctgtaataactaaaattagagttagcagcacgattcactaacatagaacggctagtactgagttttgcctttattattctccgccattttttgccaaggccgaaaatatgctggaggtgcgaaattcggagattcgggtttcatgtttctggcccggttgttaacggaccctttatctcatcttctgatcttggagtttcttctagttgataaaaccatggtgaagctgaaaggtttgaagaatctctatcactgtagcaaaaaaatcttcttacaacaaaaaaagtaagcaagcaatcagcgttcaaag

SEQ ID NO: 13656 - DNA, 494 bp, Saccharomyces cerevisiae
taagggatttctcttaattttttaatctcttttttgtattgggtttcgaaaatataataaggagccctcagacatttacgtatcctttcatgtatgattattttaagtattttgtattttttattattattaatgtaagcataatgcttttgtagaacttgagacaacccggacgggtccgatgagtttttttcttcaaacttttatagaaaataataaatggtgttagcaccactcagatgtgatatttgacgtgtcgattgtgatacctgaagacgctattggagagccattgcaacgcacagtccaacagtaataagctctgatcgttttgaaaaagtatgtttctttccattggacggttgtcttccgatcaaaattttatctcctatacaatttcttcctatttactaacgaaaacctgcgaacctgtaaactacatgatttttaatattagtgaacttcaatacacctcaacaaaacaaaacgccctt

SEQ ID NO: 13657 - DNA, 445 bp, Saccharomyces cerevisiae
ttgctataagtggaaaatttcttttagaacaatattcgtagatcactaagtaacatttgagaccgaaaaaaataatagcataataaaaataaatactaaattttaatacaacagaaagtcttatacctaaagcatgatttttccttttattattaagggtacggttcatacaaaggaaatttatgtcatcgtgttttaaagaaaaaaagaaagccctgtagggggctcgaacccctaaccttatgattaagagtcatacgcgctaccgattgcgccaacaaggctattctattattggaaatctgacctctcaggtttaatatgtaattaagaatctatagactcgattatccacatttctttcttttttagtcttctgagatttgggtgaataattctgagagatgggtgaatttcgagataattgttgggattccattgtttg

SEQ ID NO: 13658 - DNA, 443 bp, Saccharomyces cerevisiae
aaaatttgaaggagagtaaagaatacgagaaacgttattgatttacacttataccttttgccttacagtttatcagcactcggacctaaatacatatcatatagcagacggcgtccctctgtctatccttttaagaattttttccataataataatttttaataatatctaaatataacgaaaaagattgaattagtgtaaataaaaaaaataaataaggaaaactctagctaaattaacaaagagacattcatcttttaaatcctaacgagcttgcagcctcttcaatttgtttttgcaatacaccttcatgatatggactactatttagcaacgataaaaatttgtccaatattaacacatcgcgattccaataagtgtcgaatatatactcagctattccgtgcacattttcgtctctagtggcacttggaaatctcatg

SEQ ID NO: 13659 - DNA, 449 bp, Saccharomyces cerevisiae
cattgagccttttgatcatgcaaatatattacggtattttacaatcaaatatcaaacttaactattgactttataacttatttaggtggtaacattcttataaaaaagaaaaaaattactgcaaaacagtactagcttttaacttgtatcctaggttatctatgctgtctcaccatagagaatattacctatttcagaatgtatgtccatgattcgccgggtaaatacatataatacacaaatctggcttaataaagtctataatatatctcataaagaagtgctaaattggctagtgctatatatttttaagaaaatttcttttgactaagtccatatcgactttgtaaaagttcacattagcatacatatattacacgagccagaaatagtaacttttgcctaaatcacaaattgcaaaatttaattgcttgcaaaaggtcacatgc

SEQ ID NO: 13660 - DNA, 449 bp, Saccharomyces cerevisiae
tattagacgacatcgtagccatattaatatatacatacatatacacagatacattcatctctccaactgtatgaggacttctctaccttgaatggaacaccaaagccaggtagatactaaaaaaaactctttttatgtcttggtacagagaaaaatgctccaactggtatcgattatgtgttcatcgggaattctcggcttttccccgcagcggcggagtgagtattctaaaagttggttggcctttcaattgccgcgtagtcaacatctttgaggttttatataagatcgacgttttccttatcagcactttgacgttttctctcgaaaaataacagtgactatagagcgatagtccagtttttttgtaactgacttttaggtagttaggattaataaggattgagtcaatacaatcgaaaaaaatactgaagcattgcaactgaaca

SEQ ID NO: 13661 - DNA, 419 bp, Saccharomyces cerevisiae
ctgtgattatacgcaacgatattttgcttaattttattttcctgttttattttttattagtggtttacagataccctatattttatttagtttttatacttagagacatttaattttaattccattcttcaaatttcatttttgcacttaaaacaaagatccaaaaatgctctcgccctcttcatattgagaatacactccattcaaaattttgtcgtcaccgctgattaatttttcactaaactgatgaataatcaaaggccccacgtcagaaccgactaaagaagtgagttttattttaggaggttgaaaaccattattgtctggtaaattttcatcttcttgacatttaacccagtttgaatccctttcaatttctgctttttcctccaaactatcgaccctcctgtttctgtcca

SEQ ID NO: 13662 - DNA, 424 bp, Saccharomyces cerevisiae
taaaccaatggcaactaccaattgattaccacgtaatatttatatatgtatctatatatgtttttatgcatcaatatcaagtgttttagagaacagcaaattatgtttgatatttccattccactatattatagaacgtgagaagcaaatagaaaactgtgaaataaagtagacttcaaataaataagtataatattttctctattatagatataagaaaattaagaaatagaaagaaagctaatttggttccacaaaggctctataggtagtaaacgcctcatcttcagcttccaaatcaacaggcaaatgtggagcgatgaaaaagacaaaaccgggttcagctttcaatttttggccatctgctttaatgtaaccattaccttttgtagtgattaagatacttggaccatcaacaccttca

SEQ ID NO: 13663 - DNA, 440 bp, Saccharomyces cerevisiae
tagggaatagtggtgaaagttacgtaaatatatacatatagagcggaatggtactgcatatttttattatttttttttttgaatatatataaagcatcgtcgcttaagactaaaccttcgaggatctgaggccagcgctggatctaaagatggcgtcgccctcggcgtagcctcttccaacaccaaatccaatgcctagccatacaggaaatgcacggcgcttgaagaataatactgaggtgaacacacccacgccaaaacccatggcagtcttgaccagcatgttggacaggacaatatcccacttagtgtcgaggatcgtggacacggagctgccattcttgttagaatccttggagggagtgcttttcgctggttgttgtgtttgtgcttgttcggacatggtatattttgtctttttccgtgtttattccctctcg

SEQ ID NO: 13664 - DNA, 461 bp, Saccharomyces cerevisiae
catatccagtattaactaaaagtatatatttgaccaatacctgacatatcttctaaagcatgcctttagccctataacgagctaatgttagctccatctttgcacttatgattggatcagccctcaaacgcttttgtatctttgcagcttccgcgaaggtagtagcttgaagtttttcatccatagttcttgctaaaattgcagaatcttcaaacaattctatggcctcgtcaattttttccatttgtaattttagttgtgctaacccgatcttcgcttgttcagatcgtggatctaattcacaggcttttgtcagcagcttaatggctgcgttgaatttctcttcatccaactgggttggatcttgagaggattgtctagctaatatagttgctttcccaatcaagggtcctatacccacatgtattttttcttgcacttcttccaaccttttagcaata

SEQ ID NO: 13665 - DNA, 469 bp, Saccharomyces cerevisiae
ctggaagaatagcaatgtcatactggccatatgctccagcttttacttacgcaagtaatacttacagcactgtaaccataggtacatatacgtgaaaatacgactatatctaatctaatctgtcatttatttatttatttaccgtcggaaaaccaagtccgcttgaaaagggttacccatctggcggctatgtgtgcggcgattccgcaggaccgaatttaatactgcctgacggcgtgccacaacaaggagcaattggggtaaaaatacacattaatagttgagtaggacaagtaactacgagtcaacggcggcatcaataacaataacaaaagttatactgtcgacatcaacactgacaagcgtttactcattgctgctgtttagtcagaattcttgttatataagaacaaccggtttctaaaaaatacattaccttttggtataatcctttttgtgattgtcacga

SEQ ID NO: 13666 - DNA, 455 bp, Saccharomyces cerevisiae
cgttttcatcaccacatgttttttttttttacgactatatccctttcccctctaatactctttctagcctttttttctacctctacatatgtttataaaatatataccactgtaacaataagatcgacagagcgaatataattctttgagtaactaatatcctttggcttattctctgggcttattagtgccgcaaaataattacccggcggcgatggaccagttagcttcgaccgtttgcgattccggggctaaggaaggggcctctgcaaataagaaagaggcattacacataaatgattggcaaagggactgcgggagtcaagacctacatgtaagtccgatttacgataacggtttagattcattgggtgtgtactatttatactttaacaaacccgtgtgttatttaataagatcatatcttgtttgtttttcgccctcaattttgtttc

SEQ ID NO: 13667 - DNA, 496 bp, Saccharomyces cerevisiae
atacataagacatgtagaacaagaatgcataaataactttctgttaccttattgaaaagaaaaaaataaaaaaaatgaaaacgaaaatgaaataatatctctagtagttattctatggtgtatgataactaaacatatttattagtttttatatactctattcaaaattttttaccagtttttaactttttcgaaagatatctgttactatttttgaacttttttttttttttttcattccttttttagttgctattatcaaaataaaaagactgtaaattattatcaatgtcgttatttgcaattggtgctgcattttgattatttgagttttccacagatgagttcgcctgatactgtggaacgaaagtatgaccatcgtaaaaatttctttcactgttgtttgaaacgtttgagcccatcaggtcgcctaatgaaacagttgctgaagtatccggagatatatttccaatgtatgtatccgcagacttgggtt

SEQ ID NO: 13668 - DNA, 487 bp, Saccharomyces cerevisiae
tgaaaataatattgacgttcgcatttaatctatacctataattctgtacttatatactgttccttaattgaagatttcaacatcgtttttgatgtaggtcttttcacctggaggtgcggctggggtaccgaagactaattgagcttgtacggtccaagactcagggattttgcttggcaaagcagcttttatgtaaccattgtagtgttgtaggtgaccacccaggcccattgcctccaaggcaacccacgagttgatttgagcggcaccagaggtatggtccgcgaaactagggaatgcagctgcgtacgctgggaagtcagcctttagcttttcagttaccttgtcgtcggtgaagaagattacagaaccaaaggcctcatcccttgctgaagcaggcctcttttgaccggcagggctttctatagccttagtcacttcgtcccaaacttttttgtgagtttcaccagtcaagataacagcgcga

SEQ ID NO: 13669 - DNA, 500 bp, Saccharomyces cerevisiae
tgacgagcaagacatattctatttagtatttttttcccttcaggaaacggtgattaatgtcttcttacaagttaatgaatagtatatatatgtaaaaaaaaattctgcttcatgtatatacgcacctcgttattgaggtattgcgaatgtagcagttgaataagcaaagacgaggtttgtacatcttggcatattaaatggttatttcggggtttgtttcggctcaacggtgatataaaaagaaatccagtactgtttaccattgtgcatccgtacatttgatttgtttacaacatcttcacatttccattgtggaatcattttatttttttcagaataccttacccgcaagcaaactttcaagcaaacttacaatttgcaaaatttcatcgaattctccgcaggacatattataaaagttatgtcatctcttatcacaacaggtctataagtgttccttgttcaattgtttttcccaattcaaaactcttcacggagca

SEQ ID NO: 13670 - DNA, 403 bp, Saccharomyces cerevisiae
agttcttatctatttcatttccaccaagatattgaacatgccatactcgtttctggttttatagccaagtttatagattctctaaggtgaaattatctattttttctttcaccatattatcggacatagatacatggatagaaaagcattcgctcggaaaaatcttcatataaactgactatatactttcagatataggcacactttatttcattttttatgtcgttcagggattttggaaaatctctgacacaatgcttatttatttttaacaccacctcttttcatggtaccatttgcacgctccaaacttgcatagtgacctttttcgattaatggaccaaagtaaacaaaaaaaccgtccttggtggcagcacgctgttcctcccacaataactccgaa

SEQ ID NO: 13671 - DNA, 427 bp, Saccharomyces cerevisiae
aaaaaaattaaagaaagtttcaaagctttttagtttttttattgtttttgtattttaatatgataattgcacaaaattccaatacgtttattttctaatttttgatttcgattctagggttatactttttctatctgttttgtctcttctcttcctctctggataaccacaatgaagaggataagtgacacattatatttctataatgtatttccgaaaattatatctgcatgtgattataccctccgtttttttgttttttcatttttatctttttttttttttgcttttcacttcattcttttttcttactttgctttccatgcttgattctttactattattactaacttgtgaaatagttttctaatttgctttttattagaaaagaaaccatcttgaacgtttgacaacactctgggaccaa

SEQ ID NO: 13672 - DNA, 442 bp, Saccharomyces cerevisiae
caaaactgtatatatgcgctaaaagcagtataatcattatttgttgttgttattattattattattgttattattattattattattattattgagattaatattaccatctctctgttttcttttctttcccttctagcatatataaatacacatacgttattgatttctacgtaagctttttttttcccttggctcaaaaatcatgcaacattgtcgagaataagtgaagatacttcaagccataacattactacaatctcagtcggcatgatcgctgaatagaatatttgctgcagcttcttcgtttttatcgcacgcaaaatacacctggataacaagatctctttcaaagcccaattcacagaggcgcgaaatagcttgatcgtcttcgggggtatagtcaacttggaaagaaccttcaccttcaccttgtcccagt

SEQ ID NO: 13673 - DNA, 472 bp, Saccharomyces cerevisiae
aggtagaaaattattcaaaccttgtaaatagtgttatatatatgtgttagacttaaaagcgctaataaacgttcctgctcgcatttaacttctgttccaattttcctattttttagttagcttgttcggcagatttcaaattcattgagtccgaggaaacaaaaggatgggaagagctcaaaatttggagatgggtttcatatacaacacgttggttagcaagaacctaaggatccgtctatagaaagaacctcgaaaaatcttcgaaagattttgttgactgagagtggaaaaaactgatattactttctcggtatagagggcaacatttgcaaaaagtaataaacaaataggggagcacaatatgcagttgagcaaggctgctgagatgtgttatgagataacaaactcttacttacacatagaccagaaatctcagataatagcaagtacacaagaagcgatacggttg

SEQ ID NO: 13674 - DNA, 476 bp, Saccharomyces cerevisiae
cgcatatggttctaatagtttccatagtaacaattgcttggcaaaaaaggtctggcttcgaaagatatataaacgaatatgaactggactgaacttagatatttttttctgtattaactaaaatttagcgcaaataataacaatatcaacaatatctgcaaggaagaacaatgagctgtaccactgataagttaatacaaaagtacgacgcccttgttaggaaaaccacagaacataaattcgctaaggaactatgtgccggaacattgaaggaccgtagtttgtacatctatttatcacaagatctgcaattttttgaaactagcttaaggttgatatgtaagacgacttctttagcaccaactactcacgctttaataaccttagccaaaaagattggatttttttctaatgatgaaaactcatactttcatgactgcttagaattattggcaccatccctcaccaaggaagaa

SEQ ID NO: 13675 - DNA, 414 bp, Saccharomyces cerevisiae
ggtctaattttcaaccaaacgtgttgtactagcatatataattaaataaatttctctagttatcacttgatttatctaataagagacgtcataaacgaatttttttttagcaataaatcctcaacgctttttgttttcatttttcggtctttttctaccatagaagataaacaagtagagcccatgtaatataatatatctacaacctattattacccaaaaccaacaaaaaccctgacagtgacaccccgttacacactcacaattaagtagggatgataaagtcaacactaatctacagagaagatgggctgcctctttgtacgtctgtggacaacgaaaatgatccctcattatttgaacaaaagcaaaaggtgaaaatcgtcgtttccagattgacaccacagtctgcca

SEQ ID NO: 13676 - DNA, 493 bp, Saccharomyces cerevisiae
cattgcataggcacgcacatacatacatacacaaataatacaatataggacgttcatcttaggtagccaattcacggtcttcttgtggtagtgttacttgcgttcgacggcgggagggttcttgatcgatccaatatactctgtggtgggatggccagaacgctagaattcgtctcaaacgtcctgttagagaatattgtgggcctcgtagactgtattgaatgaatgtccgagaaagtagacgacttcactgacgaggaacaaaacgatactagcggaataacacttgcgttgtcgttttgttgttgctgctgttgctgctgctgctgtcttactttgcctgttggtggttcatcccatgccactcgacggtctccttcgtcatcggattcgctcgaatgcaacgaatttcgatcaaccaatggtcgcaacgacgaactgatggttgttccatccggatccaactcagcacgcttaactcttgtggggccag

SEQ ID NO: 13677 - DNA, 429 bp, Saccharomyces cerevisiae
cgaaaatctgtcagcgtataacacgatcactcttccatcatataacaaatccaagtagtagagaacgaaatagtttttgatggacatataactacataattattacaaaaataacctcatttaatgtcctattgtttattacgagaaaatcttaatagcacttacggcattaagaatatttattactattttcaatttatcaggcacttattcaactaaaaaaaaaaaaaaaattctttgttttacaataatattaataattattttgaataaatatcgttacattctatcataatgtcctctacacggtacaaccaaactcacaattctatttgagtgggcgagaggtttgaattttttcttactgggctgtgtgtaggggtcatagatgtcgcttgtttgaatgagtgagggttggaaggtgcaata

SEQ ID NO: 13678 - DNA, 485 bp, Saccharomyces cerevisiae
tgattcaaggagtagggtaaagtaagtaatataagcgaagaaattcttcccataccttttcttcactttgcagaggggagtggtgcatatcccacaaagaaaagtagcaacaacaatgatatatatacgttactactaatgctttccttcatcgaaagtgtgccgaagtatttatttaatcttttagtgttcaacttactataatgtgatactttttcaatattgtttgccgttgaagcgatagtgctttatgtcattttatctttcttttacattgttttattttagagctaaaattgaacatcagtttgcaagaagtcagttggttggcctttgctattaagagaccataatgttatagtgattgagatcagtttcaccaactaataacaattaacccgggcggttagtgtagtggttatcatcccacccttccaaggtggggacacgggttcgattctcgtaccgctcatatttttactttc

SEQ ID NO: 13679 - DNA, 471 bp, Saccharomyces cerevisiae
ttaccatatatgcttcaacgtaggtctacataaagtattacgtacatttctatctagacaacactaaatgaaataaatacagacgccacttttttatcacgtttcttagcgttattccgcgcgcaaccggacgtcgctagccaagtttttcacttttttttttctgtgatatttttttttccaaatgagatggtaagatgagtacctatcaacaagtatctcaatcaataaagtacaaccaaaatatcaagtacgcagtctctgcttcatcccagtgtagatttgctattcgatttgtgtcataaacatttaacattgcgcccgtctacaacaaaggagataaatcaaaaaaggaaatggtacaagaacaggcaattttgagctgcattgagcagactatggttgctgatgcaaaaattatcaaagaggcagaacagcagttatttgagttccagaagcaacctgggttta

SEQ ID NO: 13680 - DNA, 497 bp, Saccharomyces cerevisiae
tcaaaaataacggtcatatatcgaagccaaagcaagtttttataactatttattcatcaactcatatatatctaaactaattctaagaggtaaaatcgctcagatgtgatgacatatgtttcaagccatatgcaagcaacaatggtcctcgcgagagggacaacactatagagccaggtcactttagttaccccacgattcttgagaagaaacctcaatcttcttgacgtggttcttaccatccttctgaggcttcaattttggaactgttaatgtcaaaacaccatttgcgtagtctgctttaatgttgtctgcatccacacctgggtagtctggcaaagtgatgactctcttgaacttaccagagctgctctccttgaccttgaccttgtctttactctcttcattcaaggtagatggaatttcaccagaaaccaaaatttggttcttgttttgatggtactcaatatcaatgtccttcttgcttttgacaccag

SEQ ID NO: 13681 - DNA, 410 bp, Saccharomyces cerevisiae
ttcctttttcaaaatgacgtttattcttcacttgtcactctttttacgtatagctgtgaacgcagtatgtaatttaatactgttttctcttgaaagtggttaaaaagtgttatatatctgaaattcatggtttaaattaaagaaatttcaaggcccgttaagcaattctgtcttcaacatcatggaactcaagaccagcccagtttcctgaattctgaaaacaaaaacctacgtgtttttgaaggtttctttctgtaccgttatccttctttaaaactatagaaccatcactaatgctgcccatcagccccataaactttgaactgtttagtctttcttttacatctttattggcactattattatcgcaaaactcaattatatcggaagccaaacctttcatggcagtt

SEQ ID NO: 13682 - DNA, 422 bp, Saccharomyces cerevisiae
agttagactgctacaccaacaaaaaataaaagataaagaacaaaaaagaaggaagaaagctataaaagggagacaattcatttcatctaatcttaaaagtttttatttaaatatataagtaagagcgaagtatttaaaaataaaaattcataaaagttgagcttgatgaaagttatatcttttcgagcggtatgtttctttcgtgtaaaattcttcttaaagtatctaacttctcctcatctttcaagtttcctttaactacaactttttggatcaattcaacgggaatactgctgcttaagtaaacattattgagcgacctgaacattttcaaagtttgaaagaataatggagaatggcagtcgatgaaaatatagacgttacttgaagaacgcattccactaataactcccttcgcgtgc

SEQ ID NO: 13683 - DNA, 455 bp, Saccharomyces cerevisiae
ttagtgttatcatcgttctcctttcactttttactattttttttttttttttttttttttttttttcctccatttgtctttcacttactctattttattttgttttattttgatatctactcttgtccataacatttatgttcccctatattcattatttgcttttttccattacctactttttgtacctcatctctatttttctgcaaaaatctttgcgctcttacgctcttcttatttctgcaacagatagagaatttaacattgtgtatttgaaatcatttgactgagaatactgttgtcatgtctttttacatagaaggaactaaaaaaatttaaaaaaaaaaaacacaaataacattatatttactgtacataataaatcaagcctgtttctaaccgtttatagaagtagttcttatatgttcatccgattagggcgtatccaaatgtcc

SEQ ID NO: 13684 - DNA, 425 bp, Saccharomyces cerevisiae
tacaattgaaaccgagaagtatatctgttttctatacaagtgcatatatagccacgaacttacatatactgtttcaaaaccctttgctcaacgttatcaagacaagtctcatgctgaatgatagtcaaatcgttagccatcgcatgcattgctttgtcaacctgtgattgtggagggccttgggggccctgagggccacctatcccggcctgaatacccatgtcctgatcgtttaacccaatcaggttgtagactggatttagcccgagcacagaaataaaataccatgaaatggagctaacccatctcacatccaggtcctgacagataataccggtctgtaacatctctttgaatttggcagtcaaagggaaaggtagttgcataagaataaatccagcaaaaaaatggttcacccaccacat

SEQ ID NO: 13685 - DNA, 417 bp, Saccharomyces cerevisiae
tatagtttttctcaacattcaaggaaagttcaattcacattgtagctataatggagaagtggttctgtaaagtttacacgtaatacttctgtctctaaatttgtatttttcatatcttgacaagaagaggtttactctctaggattataaataagtctacaccagtattcataaatagttaccacaaggccatatcgtaaattattatacaacctattaattacaaatagaattgcaatcctttcccatcggcgttgttgtactgttgcaaggctaatgacggctattattaaaaaatgttttagacctgggacaatcgttatccttttcttcattatttggatgtttgcgccttaaaattatcctgggcacgagtgaaacaaagctaaaacctttatttagcatggccattgaatg

SEQ ID NO: 13686 - DNA, 439 bp, Saccharomyces cerevisiae
ggttgagcattacgtatgatatgtccatgtacaataattaaatatgaattaggagaaagacttagcttcttttcgggtgatgtcacttaaaaactccgagaataatatataataagagaataaaatattagttattgaataagaactgtaaatcagctggcgttagtctgctaatggcagcttcatcttggtttattgtagcatgaatcatatttgcctttttttcctgtaattcaatgattcttgcttctatactatcctcaatgcaaaaccttgtgatcttcacaggtcgatactgaccaattctatgaactctatcaccactttgccattcaacactagggttccaccatgggtctaaaatgaatacttgcgaagcttcacaaagattcaaagcaacaccgcccgcctttaaactgaccaagaaaacctcgcattg

SEQ ID NO: 13687 - DNA, 427 bp, Saccharomyces cerevisiae
tgggaagattccgctctaccagggaaaaacaaaattatatagaaaagaaggtaagtaataagtaatacgaaaaaacccaaaaaaaaaattcaaataccccaaccctgtgccctttctatttttatggttgaaaaggttacagaggatcctctggagcggtgacaacagttgacgcaatcatggtccctggcggtccctaaggatatctcggaggaaccgaggcacggaaacggctgcacgggtacgccagataaggataattcagccgtcacgcatgaacagaaggatgagcatttgctcaccttcctggacttaacttgcgtgaatgaaaagaagaacaccaatgttagagtagggcttcgcaccaaactttaatcaagaaatctgaggagaaatgattctaagtctagccacgaaaactgcaaag

SEQ ID NO: 13688 - DNA, 494 bp, Saccharomyces cerevisiae
tagtatttatttaagtattgtttgtgcacttgcctgcaggccttttgaaaagcaagcataaaagatctaaacataaaatctgtaaaataacaagatgtaaagataatgctaaatcatttggctttttgattgattgtacaggaaaatatacatcgcagggggttgacttttaccatttcaccgcaatggaatcaaacttgttgaagagaatgttcacaggcgcatacgctacaatgacccgattcttgctagccttttctcggtcttgcaaacaaccgccggcagcttagtatataaatacacatgtacatacctctctccgtatcctcgtaatcattttcttgtatttatcgtcttttcgctgtaaaaactttatcacacttatctcaaatacacttattaaccgcttttactattatcttctacgctgacagtaatatcaaacagtgacacatattaaacacagtggtttctttgcataaacaccatcagcc

SEQ ID NO: 13689 - DNA, 427 bp, Saccharomyces cerevisiae
tcttctagttttcggtaaattggtaaaaaagcaaaaaaaaaaattgacgaaactaattctctattatacataatgtttttacttttgtaccctttaatttctaatgaatgttttatggaagcttcaataaatgcgtgactggctatagttgtcggatggcaatccattattatgtataccgtattattaagagtgcaactaggcccgactataaatctaacactcagatccttgtactgtaatgcatatttattttttcacaagttgcatgctaataataccatgatattttttgaagccttgaaaaatagttcaagcagctacgatatcatgaatcaatatactcattgcagcctatgtaatatatataggttccgtgttaccactcgtttctgatattttcgatatggctacactgggtttttca

SEQ ID NO: 13690 - DNA, 412 bp, Saccharomyces cerevisiae
gtcaatggtaactcagcctttcttttttgaaaattactattttcgactctttttttatacagttacatagtactacctctaatacacattcatgattaacaatgtttcaaacaatataaagtcccgataacgaccttttgaagtggtgacgttaccgctcttcgttgacaagattcaagagggctgtcagaataacagctatcatggtggaaagtaggtgaccctttgaacaaggcagcatatatccatcgactatcatgttcctaaaatgttatcatagccggcgttagaagatggcgcatattattattttattagaatgagttataacagtcatcaaacttagcgaaagccgaagtgtaagaactaaaaagtccactataaaaaaatgaatcacagcgtacaaaaggaa

SEQ ID NO: 13691 - DNA, 442 bp, Saccharomyces cerevisiae
gaattcaattagacatcataagaacatatgctttaaaaatttaaatataaacgaattttatttttttatctttatttcgtgggttaccccactagttaatgacgcgtcgtgcttttttttttcatctaacatacgctatagcgcattagtgtgtagtaataactatgatgtaaaggtgctggaaacgctgaccaaaaagccactattcaaacgtaaagtcctacagatttgatgtcaaaattgttcttagatgaactgcctgagtctctcagccgaaagattggtaccgtggttagagtgctgccaagctcattagaaatatttgaggaattgtataaatatgcattgaatgaaaatagcaacgatagaagcggacgccataaaaagcccagaatagatgtctcttctgacctgcttaaaacagatgaaatttcggaaacca

SEQ ID NO: 13692 - DNA, 487 bp, Saccharomyces cerevisiae
ccttcgtttaggttttctttggtgttgctcagttaactatgttaatctttgcaacaccagaagaatgagtggaacggatattaaaggccacattggtgaatagatacatgcgctaaataacacggctattaacattctacgagacagtttttcgattgatggtaaagaaagtttaaagcaatacgcattttgaatttcacgctttcgcgcacatcttctatttttttcaccttcaaaaaggccctttctctttgtctgtttatattatgattatattaaatataagtatcttaaaaacaataatatcgtcaagttatttagtcgagagtttgacactgttactatcgttgcttttattggtgaacaagtatctgtaagtgatgaatttttccagcattttcaaatctatttcgaatttccagttcccatacaccatagaggaaactgcaatcactgaaaccgccctttggcaatgtttcgatggtac

SEQ ID NO: 13693 - DNA, 481 bp, Saccharomyces cerevisiae
ggccgctaaaaataatacgaaatataactttattatcttgaattctttttttactgctttttcatacatacgtacatataatgatcttctcacttagtatactaaatttgtttcatgctatggttgatatttgagaaatcggaacttgaagataataagtttcttgggcgagggaaaaaaacatcggaccatctttcctgtcgttctccggatcagccctaggaaatttctggccggaactctccttagaaacaaaaaaaattacgtaattggcacaactttacgtcaacaatattcattacatcagaatgcgaaaaaaaaaaagcgagaatatctaagctccatgacaacattcgctaagctgaaaaaattagggaaataaacttttcaaattgctatgatataatttcgtttcttactatgtattttctacgtatatttttacactcttgactctttcctttttagtaatgtgcctgcc

SEQ ID NO: 13694 - DNA, 469 bp, Saccharomyces cerevisiae
cttctaccaatatcgtcattgctgtttttcttgtttttcactttcgttctttggattgtgcttcacccctcagtatcccttccctttgtttttatttcctgcgaacattaacaactgcatgaattttgtacttctccttttaatccacgttccggtaaggcatcatccaaatttttttattcgacctcgttaagtcatatattttttcccaaaaatacataaaacaataatgcagccttcttttcaatatttacaacttttcaatttatattgtcttttgttatttatactcttatatattaaatttattccgttactaaatacccttttgctgtacaaatatcatcaaagagaagtactgaaagcttactttttatgcgctgggtaatttttccggaaacaataacgaaatcatcgtcgagcaattttgctcgtacttcagaaactactgcgtaaacatttgaggtcg

SEQ ID NO: 13695 - DNA, 425 bp, Saccharomyces cerevisiae
cttttaatgataaaattaagtgagtcctttttataggaaagatgtattttgattatatgtaatgtacataagacggcggcgataataatgcacttagaaagtgaatcatgttcacctgtccactaacaaaaaaggaaacaaaatgttgctttcccacaggaaaaagaatgtttttgacaaaacactaagcgttatgtgaccaatgtataattgtcctcatcatatagttttatgcaagcataaataagtctttcttttagttaaaacgcgttacatagtaaaggtaaccctgaatgaatttttatttatatttttcttcgcatattttaggatcttgaaaaattaaccacaagttagaagttgatgagatcaggaattctaacaaaaggtcattggttaggtttattttgtaggtgcacgtttgc

SEQ ID NO: 13696 - DNA, 463 bp, Saccharomyces cerevisiae
gagtaaatcaaatatgaaaaaggcataataatgacgatattaggaagtaacaaataaataaaagaaaaatagaagaataaataataataaataaatactagtaaatatggcaaaggaatataccggcggaaaacaaggtaaaagcaaaagataggagacacgtcgttgctatagatgtgcatgttacatgaccgaacaaatgattcgtggtgatttatctacttcttggcttcaatcttttgactgttgtctttctcggaagaatcccatagactttttactaaaccaacaacaccatcattctcggtttctagtttatagattccaaaaagggagaccgcagaaccaaggcccaacatatacatggcgtacttgtgccaaacaccataaactctttcagaaatataatcggtgatacaagagttaaattccatgtaacaatatcccaaaagcatgacagaaa

SEQ ID NO: 13697 - DNA, 405 bp, Saccharomyces cerevisiae
aaataggaaattgtaagtaactggaaataaagtaataatattaatatattcaatactttaatattctacatacgtgaatatgatatatatatagtacagtttgttgcagcgtttctaaaaagccaataaagatgacaactgagtgtatattatatatgataaaacctaccctgctggttccataattgaatcactttattaatgctcttcttttgaagtaaatttcgtttcatctgtctagtaatgaaattactttcttctgaaagatgtaccctcagaaagctttgccttaccaccagttggggtgcacaaaattgttgagcaggattcgcaggtaactgcagtttgggcgtgtgagaaaactgtagtgatgttcaaacaacctgggcacttaacgtctaggaa

SEQ ID NO: 13698 - DNA, 451 bp, Saccharomyces cerevisiae
aaagtaattgtagaatggagtgttcaaaaaaaaaaaaaaaatgcacagaaatatatatgtgatcatatatatgtatatatacatattagttggtacataatccactattaataccaagcttgctacctaacgaaaataaatactttgtattgcacgtttttatcattctgtccttcgctttttggttcatattatcatcatccgttaccagcactgcaaactccttgcctttgttcttgttttcatcagtcaatctttcagcttgaaacctttggttcagtttggcgatagcatcaataacaaattcatcgacgtgcgtcttccaagtaatttgctcttcgaactccagattttcttcaacatgtgttgcaatattccccgtgaatctcataggaataattttcttttcatcgtacaactggcgaatagtaattaccgaccttgttgctgc

SEQ ID NO: 13699 - DNA, 461 bp, Saccharomyces cerevisiae
gatgattgagaatgaatatgtagtaattaatccctttaatacgtgtaattttagaaccacttctttactctgtttttaagttcaaagtattgacataatattaaaacaatacatgcgattcattctttatcattacctatatttttctaagttgttgaacatcttaaggaactcaaatgtccattaggacacataaaattaaatattatataatttattgctgttcctgggcatcatcgaaattgtcatcattgcttgaagacgcatgcaatccgctactaggactattttcccctatttgttcttgggttttgtcgcctatcgtcaagtttgtctttaaagttttttcattattatccttcttagagttctcgtctccagaagatgccctcttcgaggatatattttgttttacattagactcagcgttttcaaattcagtctgatcaattgcgctttct

SEQ ID NO: 13700 - DNA, 487 bp, Saccharomyces cerevisiae
ggaaaaattgcaaagttatgtcttcatcttacttttttttcgaacgaacaaaaaatacaaaacaagtaaataagtatatgtgtatgaatatacgtataataatttgaaacgtagatctttattattagtttcttgagtttcgagaattcgtgattcaatgttcattattttttcttttcttttcttttcaatagtataataccaagcctttattatttttcttccacttcaagaaaaggtaattctctcgctgacccaagaaaaaagctaaacagagagcgtagtgatgcatacaaacaactcatttacatgggaaaaaaaaggagagaggaaagcagcagacatatctcaaagctgggatacactcacaatagcactgttggtactcatttcaggtaatactcttggaaggtatcccttaaatgaacacatcatttggctcagtagtgccttccactaatttcaattttttcaaagggcatggaaa

SEQ ID NO: 13701 - DNA, 405 bp, Saccharomyces cerevisiae
tattgtatatttatataagtctgcttgtaggttgtattcttccatgcatgggacacaaaaacaaaaatacggaaacatattaatataacatatggatggaaggaaataaaaacattctagtttactatacttgtatttatgatttgaaatcgtttattggagtttgaatataaatattgggaacttgatcttgtaattcagaatcattagtatcaggtaatgaagacatggatgtattcgtatttgtttgattgtccaattttggtgttaccgtggaccccacataattactatttatatcatcgttttcatcattttctaccattgtgctattggcattactcagctgatacttattaatgctggtatggttattggttagcttgggtttcccatctgaattca

SEQ ID NO: 13702 - DNA, 400 bp, Saccharomyces cerevisiae
ctttaaatttgacgagaaaaccccaggaaatattccacacaaatctatgcacattacattctagaataaattaataaataaaaatatatacatatatattaatatgtatatatgtatgaatatagttttcattacaaaataaggcttactgtagagcatgttggaaatattcaggatcttcttctatagattccttgataatatccaaacctccctggaactccccattgatatataactgaggaaaagtaggccaatcagaaaacttcttcaagctttgtctaacgttttcgtctcttaatatatcaaaaaatccgaaccttatttggtgttctctgaggataccaactaactgtctagaaaatccgcatttaggttctgatgggcttcctttcatgaa

SEQ ID NO: 13703 - DNA, 495 bp, Saccharomyces cerevisiae
ttctatataaattagttatgcgttgtattatctatgactgccatatccaagacttgcacagttccctttttatcacatagggtcatcaaatctctataattgacaggatcgataagacctgtacatgtccaaggatccaattccggcttcgttgactctccaggcgatgaagctatcaatttactaatcttctcaataagttcgggttgtctagatggctcacttatggccactttgactttcatcttcgcccttactattggaataatttgcttagaaaccaataatttgatagcctctaaagcttgcaatttggcaggtttgttaataacagggctgaacttcagttcctgtaaagctttgtggatcattgtgggcggatatcttttctttgacacaggatttatacatttagcgctaactattgtaagcatttcgttattaactttattaagcattaattgtctttctttttccgataattgaatctctccc

SEQ ID NO: 13704 - DNA, 458 bp, Saccharomyces cerevisiae
tcccataggtgataagcatgcgcatatatatacatgtatatgcgtatataacactttcaccctcgcttctcaaaattctcccatttctcatgtacatataaatagataactaactgaattaatttagcaaaagcaattgcttttgcttttctatcttattcatacacaaaattcttacaccgatatatgtcgatacgaacacttcttagcctaatccgaccaatcatcctcgtctacatattttggctccttatcattacttgggggctgtgaatggactggcttagaggtagataatgtcgcattttgactttgagacggtagtggtctcccactaccaccagccatatttgctcttctctcgtcccagcaccttttaatatcaccaacaatttcctcgaggtcctccaatgaaactgaatcgttgatactctccaaaactttctggaccaccgatg

SEQ ID NO: 13705 - DNA, 457 bp, Saccharomyces cerevisiae
gcaaggggtaagagagaaggcaggtatttctcctggaagaatatatatatatatatatgtataacgaaagcaaaataaatactcgggtgaacccgtcatggcgaatagtgcaaatttaattaataataaaaatgaaatatcagaactaaacattaatttaacttatcttcaatactatagatagtcagccttcccgctaaagaatttaattattgaaaccacttacctaataaaaaaaaaagcgtaataatggccaaatgacttgaatataaaaggacaaaagcataaacttttaaaatattataatttttgaatttggttaaaaatttttatactatgattgcattaaaaatacagatagatgatgacgcttcagagagaagcaaatatatatgagataaagataaacgatagatgaatttaaaaaaaaaatgaaaaagaaaaattagaaaaggaa

SEQ ID NO: 13706 - DNA, 458 bp, Saccharomyces cerevisiae
catctattggtgcaaagagcaaagttacattatttttagtaagtacactaattatgcttaaactattaataggaaaattatggtgcgcatatacatacagtcgatattgctttcattttttttttttttttttttctatttttttcatcaaaaaggattcaaaggttaccaacaaaataaaaacagagtaaggaaaaacagatgtatctatatgaataggatttataaattctgttacaatttatcattctctcgtaatgatttttatgaatttcaccatctcctcaatatgggccgcaaagatgatccagtaaaaaacaatccatcggcagaagaggaataacaaataaagataacaaagtttgactactctttcgttgcaaagtacggttcgacaatatttattattcaatttcttcaatcttggaacccttcttcgcattttcattcttgccgtt

SEQ ID NO: 13707 - DNA, 435 bp, Saccharomyces cerevisiae
ggtgttactagacataatttagttcatatgtccatttctgcataatcatatatacttaaagtagcaaatgtatatagttttttcttccgattttcgaaactaatattagtattggaaatcggcccctgccattgtgcaatttacattattctataattaagcaaacgtgatacgtggatggtaataatagttacagttaaagtaagaccgcttaacatcattccaatctggcaattgctcgtcaagagaatatctggtgtaatcgcatttcataccatatgtagcaacatcgatctcaacaatttctttatatacatcgtaacacaacgatctgtcagcgcctaatccgttgaaaaatgagaaaacgccttctggtttaattaaacctaccacgacatcgtataagtccaatatgtcttggtagtgctcgctaaa

SEQ ID NO: 13708 - DNA, 500 bp, Saccharomyces cerevisiae
taatcccaaattaccttcatgcaatggataagtacgtatatattagagacgcaatcattattattactgtcactttcctctactcgttggaaacgaccaagctttttttttcgcatttttttcgccgttgaaaaatttttcaatgagaaaaagagctttgaaaggaatgaaaaattagctacaggttcgcagttgcacttgttagtagagtagcatagaaggaaaaaaaggagaacaaggcacatatttgcaatcttcacacaatagcctgccaagcccgagatctacgaaaatgtcccgtttcttttcgtctaattacgaatacgatgtagccagttcttcatccgaagaagatcttttatcttcgtctgaagaagatttgttaagctcttcctcctctgagtctgaattggaccaagaatctgacgactcctttttcaatgaaagtgaaagtgaaagtgaagctgatgtagactctgatgattctgatgcaaagcctt

SEQ ID NO: 13709 - DNA, 406 bp, Saccharomyces cerevisiae
tatggaaattaacgctatcagattagattattaaatattatatgtagactatattttgccaaaaaaaacaatagagatatcaacaacgaatgaaaatggtatgatgagaataaaaaaaaaggaaataaaaaaaggaaaattaaaaaattgagattagttgaattgaaaaaggaaaaaaaatgtttggtatgcgataattaattgaatgtgcacgatcgttactatcatgagaattaaaatttaaaatgtccaactttcgggcgtgaagagcggtgccatctattatatctatttttatttcatgctttttcagcaagtgcttgcttttcttcatcgttggactgtagtttcttatcattactgctgcctgaacggagagatatgaatatcatgccaatcaacccaa

SEQ ID NO: 13710 - DNA, 416 bp, Saccharomyces cerevisiae
gaaatgtgccatttgtatacgcagatttgttgtatacataatggtaggtatttatcgtgatcaagtctcaggaagtcaataagcatggtctattcttttcttttatgtagtttataataggcaactttaatgttcccagaagacgcgttttccattacttattatacccaaaaaaaaaaattaaaaaaaaacaacttcgaacatgcaaacgcaaagcgaaggaaattataactttgacttctaacctattaaagaaatacaaacaaccggcaaggagccactgattaccaggtatttatgagtagtattgttaataaaagtggtacacgctttgcccctaaagtaaggcagcgtagagccgccactggaggaacaccaactccaaagccaagaacccctcaacttttcattcccga

SEQ ID NO: 13711 - DNA, 487 bp, Saccharomyces cerevisiae
tgaggtccttgttttctgcgcgatgaatcacagcccaaccttcaatagtaaaaaagaagtaaaaatattcgtcaaaaattatgaaagatactttgttaatacatatcacagttacatattaaaataaaaaattaatgctcgcttcctttcacctttttttttttttttgtggctacgtttttgtgtcccatggcaaccatgatatgtcttgctaactgtcatttgccctttgtttataaaagaggccgcttttgtataatgtataaattattcttttcctgaaagtatttgtagttatccaagacaaaaaaccagcagctaacattgctacacataactaaagaacaacaccaagccagtaactagcacgaaaggaaggaaagtaaagttttgtatcccattctcttttttgatccttattgaaatgttaggattatatctatcctcccttttcttcgccttttttatggcacaagtgtttgctacc

SEQ ID NO: 13712 - DNA, 484 bp, Saccharomyces cerevisiae
aatcgaagtcgtgaattctcaatgacagcgattacgtacgtaaactataattaatttaagtattttattctgcatagtatattattgcggtgcactcaatttgccgaaagagacggcatatttaataatgacgcgaatgaatcaaaggccgccaaaggtaatcatagaccagagatgatttgcaaaattatttgacatactattgctagtgtaacaataacacagcataactttgcttagacatatatgtcatttaaggcaactatcaccgagtcggggaagcagaatatctggtttcgtgcgatatatgtgttatctacaattcaggatgatatcaagattacagtgacaacaaatgagttaattgcttggtcaatgaacgagacagatactactctttgtcaggttaggtttcagaaaagcttttttgaggagtatgagtttaaaccacatgagattgtatttggagaaaatggggttcaag

SEQ ID NO: 13713 - DNA, 439 bp, Saccharomyces cerevisiae
aagcactgaatttcaaaaacatttatttcaaaagcattttcagtaaaaaatgcagactttattattatttaatcgtgcttcttatatatgacattctaccaaatcggtagtcatgtatatttttttcgtatatactttatatatttttttctaaaaaactaatgacggctaaaattaagtcatagatgaataataagttcaattcaagtgagttggtagtatttgataaatctaaagtggatacgtagcatatgtattcaaatggtgtgttttaactcgtcggacacgacttctttctcgttttgtcaatcatcaaaaatatttctcgaaaaggggccgtcaaaaattgcaagcttggaaaatacaaactggactatgtatttaaaggttatagtttataataaagcataagaacagtggccaatacgaatttaaccgc

SEQ ID NO: 13714 - DNA, 460 bp, Saccharomyces cerevisiae
tgaggatagcaggtacatataaattgttacatactaagtcgatgagtcaaaaaagactcttatacatttatacattttgcattattattttttttttccagcggaatttggaattccgctctcaaccgccaaaattcccctgcgatttcagcgacaaagagtcataaagtcatcctcgagaaaccacgatgaaatatataaaaagcccatcttccctgacggaaactggtattttaggaggcataccataagataacaacgaaaacgctttatttttcacacaaccgcaaaaatggctgccgtcacattacatctaagagctgaaactaaacccctagaggcacgtgctgccttaacacctaccacggttaaaaaactgatagctaagggcttcaaaatatatgtagaggacagtccacaatctactttcaatattaacgaatatcgtcaagcaggtgcc

SEQ ID NO: 13715 - DNA, 460 bp, Saccharomyces cerevisiae
atttttattttctccttccatatgagcgacagcggttactagccgctgtcctcaggttaatgatccaagtccgagatccgggccgaatatgcttgcggggaaagaaataaaagtgcattggagaagaaaaggatatgctcttcaattagaagcgccgaaacactaacatcatgctagcgatatcatacgtacactatataatgtaaaaaatgggcttaagaataactctcttatttcttaacttttgttgcggttgaagagcttataaaagtactagtggcctaaagaagctacagcgccgataataatatcgatttcgacttttctagtatttcgccgatgattacaatgattaacaacaaaactttcaatagaaaaactacgggaacactgaagaagctggttttgtcatcagacaagtcactgcgaagatctttcaacggggcaagcagtactaaag

SEQ ID NO: 13716 - DNA, 483 bp, Saccharomyces cerevisiae
tgattatcgggaggccatgcccaactttcatcttataaatatatgcgttttctaccgttattataatttttttcttatgtatgatatctcaatatctgtaaatacaaaaatactaaccccacccccttcgtaatggttgacctaatagtccattaactaatccattcacctatacagtagtatactgactacagttgccatgacatatcctttccttttcggactatattaggcggaagaaaaatagcaataacaatagtaagaaacaataatacggggtttttttttttttgggcctacataaggtacttcaccccaatttggaaagagataacagagtctttaccacattataaatcatgctttgtcgcaatactgccagaacgggctgtaaattctttcgtttatatcattcgaaccctatcgaacatgttaaaccaattcatattaaacctttaacttatggaaaagaatcaccccagt

SEQ ID NO: 13717 - DNA, 439 bp, Saccharomyces cerevisiae
tgaatcgaacaacgacaaaaaaagactttattttttagataatcataataaatatatttattttctcgtcattaatctaaagaaaaaagggaaatgtttatagtcaaaaattgtatatttccgtgcactaataagataaattatactatgaaagaaagtaaggtatttctatttttttactttttgttattttatttatgtttttctaggaaatgtaaaaataaatcttttagtagacagcgagatgaaaactaatctgtgtgagcttcaatcaatcaatatgatttccccgcattttgtttgatattttaattgattccgattaaatccgctggtagcagttttgtttcaaactaattcagcctccttactccccatttccttattgaactttggggattcggagttcctttttttttccgccactccgataactaaa

SEQ ID NO: 13718 - DNA, 486 bp, Saccharomyces cerevisiae
gccaacgaaaaagaggtcctatatgttgggttagggcgttttttatttatttctctactgtttatcttttttaacaaagaaaatgctaggccctatggcctttggacatgatacatagtttttagtaatatttttttcaaaaagattaaaagtactataggattcgaagttgtaatttttggtgtatatacatttatttatttgaatcttttttccatgattctggaatgacattctgcgttacagtttgggaataaatgctcctttaaggaaataatatacagctttagtgtacagggttaatctatagccacattaaaaggacttgattatgacttaaaataagtgacactgacgctttaatattcagtccgggtgatgctgtcatctaggacaaaacaatgggagtggataagtaagcaagtaataagataaaacagtattagaaattggtagtaggctgaagcttgttgaagctggtggaca

SEQ ID NO: 13719 - DNA, 429 bp, Saccharomyces cerevisiae
aaaattcgttggtactagcttcgggtcggttagctgcgctgctatgcatttgttaatatctccatcgaatttttgttgtttcgttcaataactttattacttcccccttggactctttcgttctatcgttctacaagtccagccaaaatttttcccctcttccttttcttttgttcacttcttagctcacttatataattatatactgatatttggattcttttgttgcaaatatgctctcccagatttttctgttgagatgattcatgctttacatggattgagcattagagagtaactatatccaatttcgtaagacgagtatctactttcccttgtccccagtaacctcaggaacgtgacaactacttttcttaaactgtcaacagccaatgataccgtattcaatgcatgtcttgggattaagcc

SEQ ID NO: 13720 - DNA, 449 bp, Saccharomyces cerevisiae
ttgacagcacgaggagaaacaaaatcatgtacttacgtatatacacacaaaatcgaatgtatataatacaatggtttattatgcaaaaatatagaaattattaaggaacaccagggcaaaaagactatatatcattttttggtgcgatatgtttttggttgatgtttcactgccttaccatttccaaataaatcaaatactgctaaatcatcttcatttagtctaaagctaacagatttattattaacattattaatgtttgaattgttattgtcgaaattgttgtaattgttgttattattactggttccctttgacgacttggagggtcgcgtagtagaattttcatcagataaattattgacaattgcatttttgaacaattttttagttcttgttgactttttcttattctccgatttatttgtaatgtcaagtaaaggcgacga

SEQ ID NO: 13721 - DNA, 435 bp, Saccharomyces cerevisiae
tagtctaggtccggagcgggcttggacaacggtttccctcgttgcgacattgctcttttttttgttgagtctggagttcttctttgttgtttagttaccttaaacttactcattggatcatctttaagcaattttgacttcttcttctgcgaacttatggatgttgcggcaccagaagcggaaatagtagtggccgcccttacaggcggtgttgcaggttggtttagtatagatgaatctagttttttcttacctaataaatagtcttccttttcgtcactcagttttgcatcctgatacatccattccaagcccgacttcttcaaagccaagtcattcttgagagtctccggcttatccttgctcgattcgttcagcagttcatttagttctcgttctttttcaatttctttcaatcgcgtgttaagcttctgc

SEQ ID NO: 13722 - DNA, 491 bp, Saccharomyces cerevisiae
agattgatgtgagaatgatgcagaacttaccttgtcacgtttggaactcagttgtactttttcggtgtaaacaaatataaaactttagaatttacattaataagttatgtgctatttattagtttaatatatcaacattaattacatgcgagctatgtattattagctcaatcagcaggactaaaatcgaggaaaaagtaattttgtttatgcccagttcagttatcgtccatttgtagcaaatgtggtacaagttgacccatattttcatgcattgggccatgcagtaattatcacactcactttgtcataatgtatacaatggccgcttatttgcgactcgtctcatatttttcctgaaactgtagctgtgtgtaatattattcattaacttcgataattcggctacagaagacaagagctacatccttactggtgcgaataaatgacataatctgtcaagagtaccgaagtaaaagcaacgattgccg

SEQ ID NO: 13723 - DNA, 402 bp, Saccharomyces cerevisiae
caagacgcttgaaagttctaaaaaaaaaagcaacagggccttcattctttattctttttccccctttttttcatttccatatagctgcacattcaaatttaccttctgtaacttacttccaaggcccagttttcaagatatgtattctgtattattataattttactaatattattcatcgcttttgccagccacagaccccacacatttcggacttaacattatgactgcgcatgtccgtgcaccgcggcccaattcttgtttttttttttttgcggagaaaggaaaattatcttcaagcggaatagggccagctagtattgctcagatgtgcctgtggagagccgtgctacagggtaccgtcagcccctgagtataccagagagtacaccgtgcggagtt

SEQ ID NO: 13724 - DNA, 488 bp, Saccharomyces cerevisiae
taagcaaaatgtcgtacataccggcctctacttgtgtattctgtttacttcaatttcctatatgcgttctatatgtatataaactatatgtcagcagaaaattgtaaaaatatagcacagaattaaaggggagaagagtcattcacatgcaagtgcgcaactgctgcaaaatatctcttaacaacagttatttccatttgcctttttgttttcgtttggtgttggtgtcagactaatcgttggtccattaggagcggacgcaccattggcattcccgttggcactggagtcaccaaggtccatttgatgcttgctgaccttttgatagatggtattgattaactcttcaaaagccttatccacgttttcactgttcaaagcacttgtttctgtgaataataactgattttcctgtgcaaaagtcttggactcctccgtaggtacagcacgtaaatgggccaaatcagacttgttaccgataagcccca

SEQ ID NO: 13725 - DNA, 448 bp, Saccharomyces cerevisiae
tagagaatcagaaagtaagaggaaaaactatctgttccaccgtctttagatcataagcatgtctgcaaataacatagtattattatttatatctgtagcgatctttattatttttcattactgacacattttctcacagaaccatctacaacccgaaagatgccggaaacggtcttaggccgatggggtctattagggcctacagagacgtcaattgggctataagaaaaatgaaatcgaggaaagattttccactctcaaattaagtagggcaaaaatatgcttttgttcgcatgtggtgttattccagttgcgagtcagggtctgccgatatgctaaaggaggtcacgaaaacgaatctggcatttaatacctcattaagttacagcggaatcggccttctgttgcggaaaaaaaaaaaaaaaagaaaacgaacattaagcaccgc

SEQ ID NO: 13726 - DNA, 401 bp, Saccharomyces cerevisiae
actttttcctaaacagtatttgcagcattccaagccactcatatatacaagcaataagacatagatatcctcttatttaggtagtaagtttaattactttcataatatgaatttactcaccccatgccgagaagttactcgtgcaattcactacgataatgatgtatatagttgtattatcaatccttgcaacggtcctcatccgggcacacgaaggtaaacccttagatctgctaaaaaacagacgacagaaagactgttgcacccaagatcgataaatttgttctccagtccaagccaataataaatatattgcaacaccaatccacattcttcatgggtcaagaacgccccggaggggttcaacctcgacgagatactgtacgtgttacgaatggctg

SEQ ID NO: 13727 - DNA, 438 bp, Saccharomyces cerevisiae
accatacaacactaacagtaatctcgcagttttacaaataattgataaaagcaggactattttttaaccatttaatatacctattactattaatatcattaatattattatattatgtacagtcacttatttctttttttttttttctttctttctttcgttctatttccccctagtatatacgaattctgcacatcacagcaaaatatatggctatcacatggcacaggtattactaaagaagaagagagacagaaatagtataggcatgttttactagcttcgattttcttgacaaaaaaaaaaggaaatttgttctatttactttaaactttaatgccccaatggatggcacatataccaaaagttaaactttcgtagccagcagatttgaatcctgccttctcaatcatggatttgaacgtttcttggtcagga

SEQ ID NO: 13728 - DNA, 464 bp, Saccharomyces cerevisiae
tcccttaaagaagacagtgataaaaaaaatcacttgctcttgtcaaaaaaaaaagatataaacgtactatttatgtatcgttcctatgtactatctaacatgcttatggagaaattcttgatgatattcagattttgtcatatcgttaatgtatccggacgctgatttttttgttgcatgttccttaatatttgtctctttggttactttatggcgtccaaacgccgtgccctttctccacgatcgcctagacgaatttcctccctttaattgttcatttccttcaagctctgctttatcttccactttatttttttgagtaaccagcagctcttgcaacgagtctttttggtctttctcactgcgggtttcttggaggttcccactccccacaacatcctgtttctcttcgttcattactgcctcctctaaagatttatcgttgctcctatcttcttgcgcac

SEQ ID NO: 13729 - DNA, 421 bp, Saccharomyces cerevisiae
caataaacaattttcgtggtaaatgtatacaatccactgctgagagagaaaaaatttggtcccgcctatcgagggtttgagttttatatttttatatttacagagagatatagagcctttattcattttttgttattaatgaagtttgatttgtgaacaattttgattttggaattctgcctcttctccttgaagctttcttgtaacttcttctcattatcttgcatcaattgccttctttccgcctgatctcttgccttttgaatgttatgttttaatgattggaagatgcccatgttctctgtgggggaagcgccagcgataggagtccttggtttagctacttctgttatcttcagtttcgaacgaacccatttgtttctcaaaatcattgtctgtaggacggagaaggcaccattaa

SEQ ID NO: 13730 - DNA, 495 bp, Saccharomyces cerevisiae
tcaagttttgatcagccctcatgcccttttttttaagaaatattttcccctattagttttcctaatgtcccacctaattttaaagcgctaagctatacttattgaccgtacataccttgcgtagtttaattacatacgatttgatgctttctcagtgccatcgtccttcctccttgcgcaaaaaataggaacccgctttagaaaagaggagaggaaggtgaagaatgctgtgagtactgccttagttttaaggtagctacatttgtattgatttgttactatcccagctactatacaggaattatagccattctttaagtatatttaatttgtctttagcgaatttgggtgtacttgttagaggcttttaacaatgagtagtggtaccgaaaatgatcaattttatagttttgatgaaagtgattccagctctattgaactttatgaatctcacaatacatctgaatttactatacatggactagttttcccgaa

SEQ ID NO: 13731 - DNA, 463 bp, Saccharomyces cerevisiae
ttaacaattttaaatagaatagaaccctcatattttgtagctcaaggttatagttgagcaaataaagaatacaaaatttattccaaaaaacactacgaatctatattttccagttctttgtctataatagatttggcagcttttgaagcccaagccaatcttctttcatccctatcaaaagctttatctcctttctttcctgcaaggaaattatggtatctaaatttcttgttaataaaccacttcaaacctttgagaatgaatagcatattttccgatttaacgttcttcgttaaaacatcgcgcaaataatcatcggagtagattatacgcttatttccactttcatccatcttgagtttcttctcactttttttagctacagttaaaaataactgaaatagcaatatctccataaataacatcccttctgtgtttaatccacccataaatggaacatgct

SEQ ID NO: 13732 - DNA, 402 bp, Saccharomyces cerevisiae
aatgaaataagggctaaccattgaggcgtatcgggacggcgtgttattagcacaaagacatttacttataaatctttgaattatatatgtgaaataagtatttacgcatgttaaattagtaacaaattcgtgatattatatctttttaacggacttgagcattagcaatactagcaaccttgaatgattcgcccttagcgttggtcaactttcttacaggatggtccttttcttcttcgtctttgaagataacttccaacccgtcatttgtagtaaaatgaggttgtaagtgttcccagatcttcttttttggattcaattgcttcattggagcttcgtcaccgaaaccttcaaagaacaccttgtcaccggccttagagtcctttggtggctcgacaaatt

SEQ ID NO: 13733 - DNA, 491 bp, Saccharomyces cerevisiae
tggaacaaatagacaactttttcaaacatgtttcttttatgacaaatatatatatttcaattttctcttttctatctagctatggtttagatatacatatttttaatagatttattccttttcacttatatcacaaggtgagcatctcatttcgtggaataatcatcgctgttagccgccgaggtacacaggctccaacagacaacggcaaaagatctggcattattactgcttatgtaaaagaggaagatcaatttaaaaaaggaaaaggaaggggtttgcgtattggtacattgcaagcaactaaacgtctaatcgactcatcctacgaagctctgtttttaagcatttattgtctatcctcatcaaagcaaagtttcgtaacgaaaaaaaaagcagcctgctaccgataggagagtaaattaaggtcagctagacgattagcacacaagttagatagttgtgctttatccagcacagcatgaagtaaa

SEQ ID NO: 13734 - DNA, 435 bp, Saccharomyces cerevisiae
acatgcatatatatttgtgattgattatatagaatacattactttatacaaaggaacaacacaaggcattcttccttgttcaacatatatatatatacatatatatattaagctcagtaaattgttgaaatgtgaaaggctgtacttttgctcttaacttttgaaaaaattcatcattgagaattccctaatgtttatgggtgtgagtatcggcagaatcagaatgagtatgagtatgatttgttgatttagtgtcatgagagtgctccaaatcacctttagagtcagaggttacatcaacaaactcgacgtccaccttcccacgtttggcaccttcatacgtaaatcctctcttatagtcgaaatagcgttttccaaaaatcttatcccaacttcctgacctgaatgtaatactggcacttccaaagttgtggt

SEQ ID NO: 13735 - DNA, 467 bp, Saccharomyces cerevisiae
tgaaagaatttaagtattcaactttcgtatattcgttttttcttagtggatctattgttactattatcactattattatattgtaaaagaccggatggttttgttatatattacatacacatgttatcgttgaaaaaagttttccgtttcctttcgacagtcatcagataattttatccgagtcttttatatgttaaatcttgttgacaaatcgtccgctctaaccctagataacaacaatgatctttttatcatttctggcgttattttagcgcctcctcccactaatgttaattgcttatagttacctgaaggagcagcgaggatggagatcgtactgtgtatacttgtttcttccgcttcagtatctaggtctgctattagcacagtgttcaatttatccatatcaatgtccacttcctcttcttcagagttatcagagttttgtaattggcattcggggtcta

SEQ ID NO: 13736 - DNA, 421 bp, Saccharomyces cerevisiae
actctcgtatgtatgcatttagtgacttatacatatatattgtatctacataacacatcattgaaattcaccccgatgagtacatatttggaattcagcattttttttttctcgcttttgatagccagcccatctatggtgcttactaatgtatagagaggatataacaatgaaaaatcaagatttcaggcatgagtcaagactttagctcttttatataccttcaggatgttcgtaccatgcgtcgcaggccctagatcggcgttttgggttttacacatgcatgtttgccgtggttcaccctcttttaacccacaggaatcgctactttgacacccccgatcgtgtctcttttcggtattttggcaccctttcttgaatgagagcatggcgaagactgaaaggcaagaacaccctgcta

SEQ ID NO: 13737 - DNA, 409 bp, Saccharomyces cerevisiae
ataggtgtaaggattccccgtgacgaaaacagccttcagaatagatagagtatgttactgtattataaaagttattctattttcttatgtgttactatatatggtattattttagaagaaatttgtcgaattatgttcttcttagatccttctttcccgccgtctcaatacgaaggcacaaggagaggattatgaatatatgaaaagaaaattgtacaaataaataaaacgatgatatgcgcacctaggaatagcaaagaacacactctaaaacgtctcaaccaagcacgctatgtacacacatctatccttcaaacttatgggggtgttttaaaaagcacctgactttttcaattgaacatagcaggcaacaaatggaacagcaaatccaatagcgaagaacccgaaa

SEQ ID NO: 13738 - DNA, 457 bp, Saccharomyces cerevisiae
aatcccaaggtgctatttctatatttatatattttgttgtgaaaatgccaaaataagatttttgatacaagtaatactggatatttttttatttgcttataacaataaataagttcctgacttctgtagtagtagtataaactcctgatgtattaaattcttaataactgaaaagttaaactttgccacgaaaactataagtattggcttaaccatgaaatatcgtaataaagacacacttataaaaatctttatgatattccaataggaaagattagttacaatcttcaacgattcaataatatagagattagctacccacttaatgatactcatcgaaattagagtatcataaggccatatcaacatcaatatcggaaaaattttggcaccgtacgataataagatcgtatatgatatgacatcctttgaagaaacggaatagtgcttccaatgc

SEQ ID NO: 13739 - DNA, 455 bp, Saccharomyces cerevisiae
tctggaatttaccctaactgtacaaaatatatttagcattatatacccgctatttaattattataaaggagacctttatactcaaacaaatgaagccaccttatgccattatcccattcgtaccagtctaaaacaagataaataccctgtttaacatccgaacaccaaatatgtgtgggtgtcaaacaaagagacaatgtaatgagacaatgtactgcttgtaaactataacagtatcagctcaatttcaatgccatctactccagatatcgttgcgattgtacctacaagccgcctacaacggcgttattgttgtaagctggtaaaatgcagtgcgttcccccgttgtgagttcgggccaaacttacttggctgggagttccgtccgtacagttgtggcttgctgcctagacttaggcggacgcggcggcaattactcctgggctctccctaga

SEQ ID NO: 13740 - DNA, 455 bp, Saccharomyces cerevisiae
tcacaataatgcatctggacatctatataaatatacatatacatatattggcggttgtttgttctcccggcaagctggcagtcgggccgagattcggataaatttttccattcgtatacatatacatagatatatacaattataaaatttgtccaaggctgcacaggatacgtaaccatcctaaagttttaggttttttaactttttttctgtctcttcaattgtcgaattgcttattctatcctttctggagttcgtattttcatcgttcaaatatatagataacctttcatcactcacttccaatatacttttctgatcgttactttgtaaggacgtcagccgaatgatgtactccagtagtgtgatcgacgaatccttgtcctccaatttattttcttcttcttcttcttcctttcgttcttctccgtcttttccttcctcttcgtcctcct

SEQ ID NO: 13741 - DNA, 486 bp, Saccharomyces cerevisiae
ggtttataggtcactgaggaaagatattatttattggttatatttcgtattatttatctatttattatatttattattatttaggcttatgcttttttctgaatatcatctaatacgtttgtacggtacgtctatgaaaaatggaaagccatacaatggtatatcataagggaaactatgttcaaagaagtgttaaaaacattcagaaaacattgtccgcctcttcaaaatgtttaccagtgccattagattgtcatcgcaaagactgttcgctagtcaaccttctgtcaccgctgcggcattgcgctcgactgctacaaccttacccttaagatcatattctcagcccgcatcccttcaagactccagtatcttgacatggtctgattttttcaaattgaggaaacagcagcgtagaatcaatgttggttcttcgctgtttactgctcttttgggctgtaacgtttcatgggcttacctttccac

SEQ ID NO: 13742 - DNA, 408 bp, Saccharomyces cerevisiae
tccaacaagacattgaaatccaaagaagactgaagggccaagaataatagacatacttaatggccgcccatagattggaggaaaactgaagataaaaaagataaatacacagaatgtattaattcgtgcttcccttttttccttttttgctttttttctcaattgtcggtgggagttatcaatttttttcgttattaccagcatctattaaagtaaaataccggtgaatatcggtaaataataggttactgtataaatgtacatataaatatttgtatagttagtatgccatacaaaataaaaaaaaaaaaaaaaaaaaactaaaaggttgagaacttaagggtgagcatgactgtgaaattttgaagagatgcagtaagccatcccatatctattgctccagggccc

SEQ ID NO: 13743 - DNA, 445 bp, Saccharomyces cerevisiae
gctaaaccataacctatacaggacttaatcacttagacagtatacaaatacacatatacatttatatttcatcgagaatgccatcagtaaatattatttgcaaaagtcgatcagcatattagtaaagcagtaaattaaaaggtaaaccaagtcacaatcgaccgattgccttgtcgaagtaaaagaaaaaaatttaagagcggctcccctttccccggaatgggaaatcacattatccgtgcggcgttttctgagcgaaaatcattgcgattgccaaacttttggtagccatctgggggaacttttgaccattttttccaatgatgaaaatgtattattggtgcgaatggcgctaaatacagaggtttttttttctccattccacccttagaagtttcttgttcaattctcattttaactgttgcgtttgttatcgattaatgtg

SEQ ID NO: 13744 - DNA, 472 bp, Saccharomyces cerevisiae
attgaattaagtaacatcattgtttaacttattttactcctttatttcactgattcacgttttctactttgtttttcagttcaatgtataatttatgtaaacttttacgtattttaattttcaaaattcttacaatgattaaggcggaacagttttatagaatcccattagcaaaaaagagagaagaaaaggaggaaagtataacgcagaacgaagattctcatttttaacgtgtcttttcttcaaggataaaacgcctaactagcaaataactggcgattagcagactacaatggacagtgaagcaagtgacattgaggcagagttatccgacagcgtctcagctggtggggaagaatacattgacgatgatgattatacggaagatattgacgatcagatagtcacagccaaatcatctagaagaacagcacgtaggagtgtacctaagggtgtaagaacctcaaaacgc

SEQ ID NO: 13745 - DNA, 438 bp, Saccharomyces cerevisiae
ttcgtttcgaaatctatatttttgtacgtaagttaagtgtataaacatatatatatatatatatatatatatatatattattttgatcttcagaacaatctagattgtttgaccaaaagatctcaggaacttggtagatgtcagtaagcctggagcgcccaagtacaaagaggaaaatagagtttcaaaaatacttgtacccaagtagtacctagcgaagataacttcaaacccaacaatcgtggcgatgaatcctaggaaatatacagcagtgacaccggtcgggatgttattgaatgcggcggcacaagaattcaaccaggtgactattaaagataaaatggtaatgaagataattaaaacaaaaatcacagcaattggtttggcaactctctttggctcggcatgaaatatatgatggatttctggcttaatgcc

SEQ ID NO: 13746 - DNA, 456 bp, Saccharomyces cerevisiae
tagcaagtatggtgctatttgtctgtaaatatcctttattattattttatttttatcgttattacaagtggtctgggtatctatacaaatgcaaaactatgtaggtacgtttatatatctatatgcatatatattagtgtggccgtaagctgtcaataaattctctcttgttgacagtataattcgtaaaatcgttttcatatgggtcatccagttttatttcttcgtgtaacgcagtattttctgtgctcgatgacaagtttgacgtagaagctgatctcaaactactcgtttctttgcgcgatagcgtcagtggatacataaaactataggaaggatctctgaccatcccataattcaccttttcgccgctgaaaatgacggggacattggtatatgcagtgctctgcttttttggacgcaaagtccccatactagcgttcaattgccttctgt

SEQ ID NO: 13747 - DNA, 483 bp, Saccharomyces cerevisiae
gacgtttgatatggtccgttttttttaaatcttaccaactagctcttacaatgtagaaccaacttttcctttcttcattttcttctctattgtatcaagcttctcttaaaatctaaaaaaaatgagagaaaaaaaaaagaatacgtctggaaaaaatcacatgaaaaaatttcagaaaaagaaagcggagctactagacatatggcatctttatagtaataataaaaacattactagtgagaatattgaggtgtaaaaaatattttttcgagcatatttagtttatatatatttaataaagaacctcaacttatagaaggcacagaaggattgctttatcattcaaccaaagtacaaaaataatatggtagagaaggatacatggaaactgataactgccactgcactattcactgtggcagtgacgacgattacagattatgcttggaccagttggcaagcacaaaagcaagtaattgcgca

SEQ ID NO: 13748 - DNA, 490 bp, Saccharomyces cerevisiae
tagatcaattgtgattccatgaactcacaaacaactcgcctaagaaactgtctaaatttttatgcactaaatagaccacaaatgagaacgtaaagagaagcttttatcattttatttctcttctccttaggaggaaatacaaatatcttttctacatttaattcaatctgacagtcaaagttatacatatacattataccgattaccaagttttcagactagaacccatacattattttacaaacccagacagtacactatacaaaaacccaagcaattgcaatcaatttttttgcacgaaaattttattcgaaatcgccaacccgctagggagaaaaagaaggaattctcaaaggagaggctggacagagaggtcgtcccagtctaccgcctacgagtaatgttggatactaagcagttcccagcctgaacgctctgctggatgggtggagatttccctccaggcgggaacactcctggtggattctgc

SEQ ID NO: 13749 - DNA, 474 bp, Saccharomyces cerevisiae
cgttaataatatagttggatatgctcaactcgtttgatgttactttctttgcctccctcctaatttttgattctgttcaaatatatattcttttccgtgaatttttcctaaacatcaaaattacgtacatatacgaataaataagaaacccctctaaaaagtgaatttttttgttcgagacaaccattttaatcatatatatgttcgtgtatccaggcaaacttatattaatcgcaaaaaaaaaaattataagtgtatatatggaataaacataaaaaataataaaagaagaaaaaaaaaaataatgaagaattctcatcagttttcgaagatttcaagaaagtccgaagaacatttaagacctttttgataattcaagatgtgcatgcacaataataaccatttcatagttgaattttgatgtattctttcgttacaaatcaaatatatagtcaaagtcacgcctatacactt

SEQ ID NO: 13750 - DNA, 478 bp, Saccharomyces cerevisiae
aaataatccttctttcgtgttcttaataactaatatataaatacagatatagatgcatgaataatgatatacattgattattttgcaatgtcaattaaaaaaaaaaaatgttagtaaaactatgttacattccaagcaaataaagcacttggttaaacgaaattaacgtttttaagacagccagaccgcggtctaaaaatttaaatatacactgccaacaaattccttcgagttgtccaatttcaccacttttatattttcatcaacttcagcagattcaaccttctcacatagaacattggaataaacagccttaacaccactttcaagtttgcacagcgtaatatgaggaattttgttttgacaacacaaccctttaattttctcattgttttcatcaattatgcatccatctttatctttagacagttccactacaatagcaatgattttttcatcccaacatagtttttcgagc

SEQ ID NO: 13751 - DNA, 446 bp, Saccharomyces cerevisiae
cagtgaagaaagcctaaagcacatttcataaataaaaataaatattacgcaaatcactaaaccaaaaacattgtatcaaaatgggaccgttatttttgagcaaaaatttctatttttccttttacttactacacacgcttatttcttgcagatatatagatatatatatatatatatatattagtgtatcgtcattggggctagatgccaattatgcatcgttgttgctgctattacttgcgccaaggcgagaaatctcatttaagaattcagctggtgtggtaatggctgtgctaccatacatgacttttttgggattatgcaactgggaatgtgcccattcttggaggttttgatattctaggtagttaccgccaccaactacaaacactagtgacttattataagattgtctttttggctttctggtatgggaaccccttgta

SEQ ID NO: 13752 - DNA, 432 bp, Saccharomyces cerevisiae
ctagaggtatatactgagcatttggtttgctctggtttttttttttgctagatggttctataaagcagcaaaatataagacggtcctcctgatgagaggaagagaaaaacaaaaataactacatagatatacgctattttttctgagaagatacatatgtacaaatagatattttacaataattttaaacttcgcaataaattcaatattaattcatagcgtagttcggctttctagcaccttagtaagctgaaatttaaaaatgtatcagtttatttttttcaataaaggtaactttaaatgagaaaccaacgtgttatataggtgaaatcatgaatagcagtctgcaagttggcatcggaattgatgtaggttcatcaagtgctagaataggtgtatataattactacaatgatgcgctgttagaaatgg

SEQ ID NO: 13753 - DNA, 469 bp, Saccharomyces cerevisiae
ttcttagactaacagcgatagagcgctgcatataatatgtacagttttttttttttttttttttttttcatagctggtccgttctccaaccatcaacacttaataggtcattcaatggccattgcctaattggacatatatctaaatcactaactaatcgtaagctttcccatatctcgatacctgcccagccgatcataatagagttgtcactacaaaggtccataggaggataataaaaattaaaaaagcttgtggagttcaacgtccccaattccgtttctaattttgttctcaacctttgattactactcactccaccagaacatacaaattcacgcacgtttttaaacttttccggttgtgacttgagcacgtgcttcagtttatttattatatggtcgaaaacagattcctgtacttgatatgcaattgaccgtatttcgcgttctggcagttcctggatttc

SEQ ID NO: 13754 - DNA, 422 bp, Saccharomyces cerevisiae
atgcatccacacactattttcagcatagtgtggcttttcatctgctttatgtaatttagaaagccaatgacagcagcaagggaaacaaaaatcttttaaatcaaattaattgtttaaataatatactatgtaagcatcgattctcctaactattataaccaaaggttgatttgaagccattggcattgtattagaattgatttgtttcttcagtgtaaaaaagttaaaaataagcgaccccagtgagggttgaactcacgatcttgcgattaacagtcgcacgccttaaccaacttggccatggagtctaattgctatatttttcttttgaaaacaagatatataaataatgcttgagctggagcatttacgttgtaaatgtataattagtgtaagaaaccgctgggccctatttgttgatg

SEQ ID NO: 13755 - DNA, 493 bp, Saccharomyces cerevisiae
gggaacatatgaatgagaaaatcttttttttacctttttccattaagaaatattcatctccttttaagatcaacatatgtaacaataaatatactcttttaaagatgttcttttaatttacttactgaaatttaatattaataaaagttcgaaaacaaagactaaatacaaaaataaaaagatcataaattcaaacttttaagaatgtcttttacggatacatatttacatattagactatgataatcatatatgctcctttctatctcttcttgctgaactttcttcctttttatgtttttttgactttttggattttttatgcttcgatttatcaccttcatcgctgctatgcttacttttctttccttttttactctccttcttgcttttcttcttcttcttcttcttactctcactgtcgttactagtctttttatcttttttcaatttttttctcttgaccttgttatcatcttcatcacgccttctt

SEQ ID NO: 13756 - DNA, 405 bp, Saccharomyces cerevisiae
cgcttacgcagacatctcatagatagacaaatggtacgttcgttttagtatatagatggcaccttataatcttcatatgcaaccgggtaaaatcgggcgttcttattttttttttttccacctcaatgagagggattaataagaggattggagcaagacagcgatctgcacttagccaagaaagcatatcaggccagaacgtggcattttgtttacagtgctgattaaagcgtgtgtatcaggacagtgtttttaacgaagatactagtcattgatgtctgaaaatcaacgtttaggattatcagaggaagaggtagaagcggctgaagtacttggggtgttgaaacaatcatgcagacagaagtcgcagccttcagaggacgtctcacaagctgacaaaatgcc

SEQ ID NO: 13757 - DNA, 476 bp, Saccharomyces cerevisiae
gagaatttatttctgctcggaatgttatatacttatgtcaaagcagtgattatacatttatcgactttaaacagttgataacgaacattatgtgttattcgaaagtcaaagtgccatacaaaacaagtggtttctcagttcttgcaatttttctttatcagcgtagtcccagaaaaaaaaatcatcactggaaatgtaagatgaattcaagtatcaagtgccgttggtattatagtttatcaattaatacgtaaatatatatatatatatatatatatatatatatgactatagtggcatacttctcaatggactgttgcttctatcattttatacatgcgttcaactttgaagattatcacaaaaacctcaaacttttcaattaatctgccccggtcatttaagttagctcttttaggactctcatgttttcaaaaaatagattgaaaagagcattggtggccctactttcaatc

SEQ ID NO: 13758 - DNA, 416 bp, Saccharomyces cerevisiae
taacaaaacaggtaattccgtaatgctttgagatatgtatcatatgtatgtgttttttgtttaagaaattcgaaataacactaggtggttttattaagaggattattaaataagcttgatgtttgatgattttgaagaattatttaatctcttaaacatatacatacacagtagaatttttcgaattatgaaatcgtaatataactctgcttaagatcttggcttttccttcttttccttccacaaagccaacaaggagacaccagagaccttaacgaccttgaatctaacacctggaatatcacccttagccttaccctttctaccgaaaccggctagcaagacttcgtcattttcatcgacaaagttcaaacaaccatcgtttggaacgaaagcagtaaccttcttaccgttct

SEQ ID NO: 13759 - DNA, 415 bp, Saccharomyces cerevisiae
cccttgatttattttcctctttgccctaccatatacatatgtactttacctatttacattgtttcagtttttatatcaccactattattattattactattaccactttggagtactttagtgattcatttccaattgttttcctggagcccagtctttgaatgccttggccaagttgtaccagtactttagctccacggtcaacttcactgcggcggcgtaatccttgtcattgtagcattgtcccaactgggcttcaatatcttgaattctttccttgttttgcttttcaagcagcttcacaccagcttcgtcgtccatctgggataattcatcatggatgtctagaactttcaatagtaactgtggatcactggtagttacttcatttgaggtctgttcttgcgtcaaatcg

SEQ ID NO: 13760 - DNA, 449 bp, Saccharomyces cerevisiae
agtgaccaataagattgaccttatagatatatacgagaagaaaataaaaagcaaacattatttgcaatctttctttcgcaagataaagtaccaaaatctttccatgttatgttctcagtgaagttgagtagagcggagaggagccctccccaaaaaaatgaatacaaaatatctgtgatggatttttgaattcacgcttccttcaataaccttcgccaagaaagtctagaattgttttatattctttacataaaagtaagtaaatcaactttaaaaaactttaagggcgaaaatgaaaaaaaaaaaatgtaaaagtgaaaaaagggacggcgaagcgatgccctgccagtcttactaatccagagggctaaaagcatgtttacagtgtatttccagtcataggagagtattgacctggcatggaaaaagaaacgcacaatgagaaaggg

SEQ ID NO: 13761 - DNA, 494 bp, Saccharomyces cerevisiae
taagctggtgcaagtttccggtaaaaataatgatgttctagtcattcatatatacgatacaaaaataacaaatttccacatatattctgaaaaattaatttttaatattttatattaggaacttctcaaaaaaacgtcggacatttctacatactctttaacgaaatatcaaagtattattgttttgcagcttctgaatatcaagatcgctcttgctactcttcctgaagtcatacaccgttatttctcacataaagcctgcttattcgaagacgacacagttgcacctttaaattttaacattattgtaattgccgctacactcctcgtggccaatgtctcttgttttcaaataatgttctcagtatcacatttaactttttattccatgtatatgtgtgtacatacatctatagtgtactacataataatttcaagcgcgggataatcaacacgctaattgacattatgcaactcaaaaatcctgctggagc

SEQ ID NO: 13762 - DNA, 460 bp, Saccharomyces cerevisiae
gcccaggatgagcactaggaaaacaaagcattcttgtgcttgagttgtattatagataaaaaaataaaactactgcatatacgtgtacatctatatattaatatattctaatcgtcctcgttttcgttttcgttttcccttccaattttcttgaaatcattgataataaagtcattatcgctgaggtgtgatgattgactacacttgattatgttcagaattttagaattccttctcatagcaaactgctctattttcttgatggtcccacttaccttgacggggttcacgatcagtccatcgacgtcgccaattttcgacatcaacatcaatgccatgataacaaggtcgcaatcctctcgatggcatcggattatccccgtagacgtcttatttgaaaagtatttcaactgcaagagagagttacattttgcagacccatagtcgcccagattcaacg

SEQ ID NO: 13763 - DNA, 400 bp, Saccharomyces cerevisiae
taaacctgtataatataaccttgaagactatatttcttttcatcacgtgctataaaaataattataatttaaattttttaatataaatatataaattaaaaatagaaagtaaaaaaagaaattaaagaaaaaatagtttttgttttccgaagatgtaaaataggttgaaagttagaaattagtattataatagcaaaaaaaatttaaagttagaaattagaatttaaggctctacacacgtttacgatgatattggacgaccgacacgaaaagacagttttaggctttcttttgtcttgctcttgcgttgaaagtacgtaatttccattcgattacttactcaacacttgatatagagaccaactataaaataaactgtttgggaaggaaagcagaactc

SEQ ID NO: 13764 - DNA, 489 bp, Saccharomyces cerevisiae
cgatataaacttatgctgaggtaggtatataccagaggatttattttatagatattagtctgctgattatctagtttcttgtcacctcatacgtgttttttttttttttggttttctcggtttgcattatggggctttttgctaaaacaatatccccgaaaagacaaagaaagagaagtgaggtgaaaatacgagcagcttatcttataaaagtggcaacgattttaaaaataaaaagcaagatcgtcgacttatctaagctataaaaaaatatcccttttatcacacaaaaaaatgaacacatcagtcacttccataaagttggtactgttgggtgaggcagcagttggtaaatcgtcaatagtcctaaggtttgtatctaatgattttgccgaaaataaggagcccaccattggtgcagcattcctcactcaaagagttactataaatgaacatactgttaagtttgaaatatgggacactgctggg

SEQ ID NO: 13765 - DNA, 402 bp, Saccharomyces cerevisiae
gagcacatccactctcattcccgatattccccgtgactctctttatttctttcaagacaaaccctagtggtgtagctatttgtacatgtataagtatatacgaaatattaattataacattattaccacggcgatattttcctatttttattctcttttcttactatattttgaaagtttttcttatgggtaccgatgcgatgaggtgaaaaaaattttcctctttccacttttagtacaggttatgagatgcttctcattagaagtcaagaagagagcatatcagtaacaatacgatgagtagcagtggtgtttatacgtgtaattcatgtgtcctgacctttgattcaagcgacgagcagcgggcccacatgaagtccgattggcatcgctacaatttga

SEQ ID NO: 13766 - DNA, 410 bp, Saccharomyces cerevisiae
gattcttgaaatgtagtccgtaattttataagatattcatttacatacgccatctacagcattattcaaatctactcatctatatgtattaccgttttgtatgataatactttccatgacatgctcgcgtgaaaaaacagcatgagaaaaagaggatcgcaataagaagacacgtaaatatctaaataaatggcaacagtacatcagaagaatatgtcgactttaaaacagagaaaagaggactttgtgacagggctcaatggcggttctataacagaaattaacgcagtgacatcaattgctttggtaacttacatatcatggaacttattgaaaaattccaaccttatgcctcctggcatttccagcgtgcaatacataattgattttgcattgaactgggttgcttt

SEQ ID NO: 13767 - DNA, 469 bp, Saccharomyces cerevisiae
tcatgaaaccattgcgctcttttttctttaccgatattatttatgcacgttgctcatttaattcctttcaatcactgattcgtttcacgatgttagatgatgctattgactgtcctccaattatttgtttcacaaggataatagtacaaacttacatagcgttgatagtaaataggcttcgtctttataagatatatacagctattaatacacattcgttctcctgatcacggtctcagtaaagaaaatattttttataggcttccggcagttttataacttcacattatttgactaagcaattgttccattttctcctttcctttttatgttttgttcttgattttaatactacatttagttcagctctttttcacttatttttgcacatggaagatcaaatacatgaaaagtacacaaaagaacaaacaaaagccaaacaaaaaaatgctaaaaggaaacgctcaaa

SEQ ID NO: 13768 - DNA, 488 bp, Saccharomyces cerevisiae
acgcactgataaattttaagataaagataattaaaaaaaataactgaataaaaactttgcttgaaagcaaatctgagaataatcatggattttcccccgttcattaaaacggaagttttatatgatgtttatttttttctcaattacaataacttatatatatatatatatatatgtacgtatatatattctcctttgttagagttaatttatgatctaatttcatttctcaatttcgaggctaaattagaatttttgaagtccctaatttcatattttgtatcaaaactttaaaatctggaaatattaaaagcagaataaaacacatatattattctatatagtattgttacatattttggagaacgtcctatttaacctatgaatgtgtctatgatagatcattttaatagaataaaagccatctagatatcatctgggaaagagaattcaacctttttttttcctcgagggtcgaaatcatcatc

SEQ ID NO: 13769 - DNA, 447 bp, Saccharomyces cerevisiae
acataatttgtgggctttcatcatctgtataatatttatatgtcgttttatggcgaaatagagtgaataaataggtttttttttccttcttttttttaggacgccaaacgcgtaacgttagcggtgataaattagtttagtattattatccggctatttgcttcatgtatttaacgtcttcactgaccaccttcgctgcactaaatcgtatggtaccatagcattaaactttttgaatcagagaaggttttccaatgaaaaggcacgtgtctttatctgatatattgacaggaaataagagaaaagtgagaagacaagatgctctacagattaccatcgatgacgaaaatgatactgaatcaggcacttttgacgccagaacagccaaacatgacgattcttcagtaatatttttaaaccactctgttgtgaagccaattgaagctg

SEQ ID NO: 13770 - DNA, 444 bp, Saccharomyces cerevisiae
taatggataaaggtattcttatgagaattgacagtatactcgcttttccgctttgtcgctccaatggttggattgtatgtgtgaggctttttcttattatatgttggtatccctacgagaagctgtaaatatgaatttctttagtaggcatcacacacaacaatagggtgtatttatttttatttttttttttcttatataaatgtcagtaatacatgatatctttaagttaggatttcacgaaattttcttctgccttcatcatggcatctgtatttgtgctcgcgagcctccaaagtatgaacataaacacagacctatacggagaaaatgtttcagagcatttttccattatgtcgtcgtcatatattttccagttgtatttcttatgcttaatcttactctttttaactacttttctttcacgcattaattctttttcca

SEQ ID NO: 13771 - DNA, 407 bp, Saccharomyces cerevisiae
tcaattgattaacgtgctaatgtagatttcttgtgtacatgaaaataaaaaataaaaaaaaaaaaaaaacagaataattaaatacagaatcgtatgcaaaatagataaagaaaagcagaggacagttaactcttccctttacttagaaacattgttctgttctcattattggataccctagcattatcaattctaactttaacaacggcggtgttcttttcaaatataaaagctttcgcatcaggattagcctttagtattaaatctttatagtacttggattcttcactttcaggattgacaatttcggtttcgccaccaatagatgcgctcatttggttcaattcggcttgatttaactcctgtaacaaatttaaaagctcgctttgacgttgctcttcatgagg

SEQ ID NO: 13772 - DNA, 485 bp, Saccharomyces cerevisiae
tctaatgttttcatcaagctacttaaatactctaaaaataaatatatgaggaatttcaagtactcatataaatataataataattctcgatcaatcaaatgaaagagcgccgtaaggcagaatcccagaattcgaaaagaatgagacaatgctccttttgctatttattgaatgcagataatacgcactgtttctgtgttgaaagtgaagctgaaatggaggtcatgtactcacgcattttcgtcttcttcactatcaatttcgtcatcgtcatcttctagctcttctatttcgacagtgaaaccttgagtttcaaagaattcttgaactgattccaatttagctggatgacagctcacaaaggcaacgcttttattggaatcaaacatgttgacaaaatatttctgcatggcatttttcagatctgttttggtaacattctgcaacctttccaaatacaattcattgaagttgttccccctttg

SEQ ID NO: 13773 - DNA, 463 bp, Saccharomyces cerevisiae
ttgtatttatagttaatcacacacaattatgtatttttattggtatatataataaacaaatagatttcatcaacatttattatataataacatttttgtttgggcaagcacactattgatacacccatacaactcaatgaagtgcagcgttagtagagacaataagaggagttttaaattcttaaactatatctggcaaaacaccaccaaagccagccaaatagtatctcactgtatctgaatgaaagtagatttaccagaatccagactaccatctttatatagagattttaggccattgaaagatttaaatcccgatgggtacgaagcaaacatcagtacatggagggatttcttcttgcaacaatacatcagcaactccaacagaatcatatttactatagggacaaggactttgcaagaattaactcatgaagtttatggcgtaccgaaaagcattgat

SEQ ID NO: 13774 - DNA, 462 bp, Saccharomyces cerevisiae
ttaagcccgataacacattctatttttcatgttttaataacgtttcatatatgaatttttctcaaatatacgatatatacctaaatgaatatgcatatggaagtgaagttggggattttgcaaacttgtcttatgttaatcttggcttaaagaatgttttccaaaaggccgttcttattaatttttcttctcttggttctgttaaatgctagtgaattcgcattgacgttcgttggtatggctactgctccgaatgcgattggatggcttgccttcctgccacgattactgaacaaatcgagttctacatttgcatccaacagtagttctttcaatataaaccactttctttctttctgtgaaagtttttggtactcttcaagcaagttctcttggattttggtcagtatatcaattttttcatcatctgataagtcagggtcctcagtttcttggtcctgc

SEQ ID NO: 13775 - DNA, 481 bp, Saccharomyces cerevisiae
taagaacttttctgtatttcaggacttattcgcttctatttatttctatacttatttatttacttcctttcctttttttttaaccatataattactagaagcacggatgtctaaattagaattacgttttaatatctttttttccatatctagggctagtgcttgtttttctttttttagtatattcttgaaccaaatacgtgtggggtgacccgaaacttgtttggcggttagtgacgaaattgaaacaaacctggagttattaagagagatttaactggaaaactaggcataaaggacaataagtactcgcttcatatagtctcaacatatttttgttcgcagaattggtgacaaaggccacgcaaaggcagcagaatcaaaaacaaatactcagtagctatgaaaatactcctatcgaaacagcaaactagaaagatagcaatagtttcagaaacacatggactggtatttaggccaa

SEQ ID NO: 13776 - DNA, 435 bp, Saccharomyces cerevisiae
agcattagatagacttagtgaatacattatcaactagtttactcatgacatactttatataaaaagaaaggttttcttttccgttacttactgtgttcaagatgaagcaactgtaccaatggcgcaatttaagttctaggatttatatttcgaacgtgggcaatacttcacacatgtgtggcttgtgtctcatggtcatagcgtattgcctcagcttattctgattagataaaggatttcctctcttacccttccgagatccgtgtcgatggggcggcagaaaataaaaaaaaaaaaaggtgttgaaaattttctccttgtataaaagatattttgatgagcatctctcgtttgcagtagcttctccttttaaaaatataaaggttgttttaatcagcgttcgactttaaattaacccaagaccccattgttaaa

SEQ ID NO: 13777 - DNA, 498 bp, Saccharomyces cerevisiae
gggactgttaatgaaaaattcaatgtaggatctatttaacaccatataattctctcattttctattttatactgtataatgaatctttttataccgcctatagggtaatatgtcagaatataccgagatgaaaaaaaagaaaaaggaattccgaaatttggaaatggcgggaaaattttttcacaaagggaaattatatgttataaaaatagttgaagagatgagctgcctactgctcaccttgccgtttccaaaaaagagttagaaccgacaaattcatccaaagaaaataatgagcaagacagccgtgaaagattctgctacagaaaaaaccaagctaagtgaaagcgaacagcactacttcaattcgtacgatcactatggtattcacgaagagatgcttcaagatactgttcgtaccttatcttacagaaacgcaattatccaaaataaggatctttttaaggacaagattgttttagacgtcggttgcggtac

SEQ ID NO: 13778 - DNA, 471 bp, Saccharomyces cerevisiae
tctctaaggagaagaaatccataactatattacctttatcttatcttgaccccctatatgatattattttgcccatatttgtttttattattgattatccttttattgtctttttgttagggatatttcataataaatatttgaatatataatatgtacaataattaaataattttctgattattccttcaatattttgtgttgaaaatttgctttaaatgtattctttaattaaattctttattcgctatacctgccacataaccactttccccttcattttcttcttttctttgtgtgtgaagagtaactagctgttttactggtcgctttggaaattttctatacatttttttaataaaggaaagttaaagacaaagtactacgcctctttatttttcatctgcagaaataatctgtcactgcttattcatatcatctccaaatctaatgcttggaagtcgctatcaa

SEQ ID NO: 13779 - DNA, 441 bp, Saccharomyces cerevisiae
catataagtaacgaccgtgcacatattagggtgttcatatcttgaaaaatctttatgttatccattttactttaggggaggtggagcttaataataaaatttacataagaacaacaatctgtaagtaattataaaaatatattaaagggacattttaaccctactttaaaagtttaactacatcagtggttcatcaatcaaaggttatgcaaggtagaaatttgtccaaaagaaaatagatcatgcatcattcaatatggagctcacactgtatgctacaatttggcctccattcataactgccaagataaaatttgttggcaatatggagctcacactgtatgctacaatttggcctccattcataactgccaagataaaatttgttggcaatattgaaaattcttaaattagcgctgcgcggaaaccagcgtcactaat

SEQ ID NO: 13780 - DNA, 461 bp, Saccharomyces cerevisiae
gcgttttgctttacggtagaaacacgaaaatgtaaatgcgttcaattttcaattttactgttttttatgtacttttatataaacagtggcaattaatggcgttttttattctacctagcagaggcgttactgactcttttctgagcatgtttcctcagttcttcatccatcaaatctcttaccctatgagcacctgcgatgccgatggcaagaacgttctctaacctatctaacggaattttgtcttccaccaataaaagagaaagtttttctgacttccctaccacacctagtgtcactgtactcatagcattttcttctaatgaattggtatctaataatggggtagtatcgtacagcccgacggatataccacttatgtaatcgaacattgatataccggcatctattaaagcgagggtaataccgttgattaaagatcccataataccgccatcttg

SEQ ID NO: 13781 - DNA, 488 bp, Saccharomyces cerevisiae
aaatgagataatatataactatgcggaaagctttgtgtaaaaaataccctttgacaatccccatttgttataagctttttcttaacaagatcaacgattaaatacaaatacccctctttatataggtctcagatatactattaaagtaacctcgaatatacttcgtttttagtcgtatgttctaagtagattcgtcttttttattatcacggtcagcagcattgctttgtgactttggcgattgacattcagtagagtttgtgccagaagaaggtttaatctcgcctttcctactgttctttgtttctcccccaatagttgaaccattgctgtgctgtttaccattaatgaattttttcaaatcttggctttccttttcattgacaacaatacgacttccttgatctgaaacatttgtcataggaggtggaggtgggaaggaaatcggttgtccaaacccatgtggtgctggtggcggaatagacatt

SEQ ID NO: 13782 - DNA, 412 bp, Saccharomyces cerevisiae
tagtgctctaaaaatgtttcactcttaaccttgcaatcattatactttacacaaatctctacgtttcatttaatttaaaatctacaatccaacaaatataaaacaaaatataattataaggaaaaacgtatataatcactgcaatactctaatttaaaattaggagcacgacattcttgccagtatcattgttgctaatctttttctctcataaattgccacttgatgttcaccctctccttttaacttttctatatgttcctgatcaaaaatatccagaggcttcacaactgacaagcctctcttttttaaaagttcgaccatttcatcattaaattcctctaggtaattaaactcactgtgtgtaacaagcatcccaatcaattcaaaagagacagcaaccgcttcagat

SEQ ID NO: 13783 - DNA, 462 bp, Saccharomyces cerevisiae
gatttctaagttccatgaaccaaaaaacacaaaaacaattttcaagtactttctctcactccttttcctttctcttttttcctccaccaaaatctggcgcactttctttatattttacctaacggatgccttatttgtggtctgttttaagctagttcatattgtaaaaaaagaaaaagagatgagaagaacaagcgttgccctaaatatcttctatactacaattcattttaattcaatatcatatttaagttgagggcatttagatcttagagattcatctaaaaataggaggggtgatgtatagaaaatgttcgaatatcattcctctgcttttttctatatgattatttcctatatgagcttttacttactgatctcatgatctcagtgcaaaaattaggggaccggcacgcctgaaagttttttagataattgaatgttgcggtgcattacctatga

SEQ ID NO: 13784 - DNA, 443 bp, Saccharomyces cerevisiae
ggtgctatgtaaacaaagaaaagaaaaaaaagaaggaaaacaaaaaagaagatcaaattctctctgctacgcgcatttatatacgtacgaactttttgctcttcttttagatttatatgtatctatatttaactcaaagaaagatgacatatggtgcaatgtctaagccatgttttatttgattttgttttacaatcttaagttttattttttatctacctataaagtcgaaaactagtatttacacgcatattgaagaaagattataaataacttatccacgctccttataacatgaagtgtcggtggccccttcgctttgtaccctcccgtttactatgtattcttttatctttaataactgtaaacgaggatctaatgggccgccgctaaatcctttaaattcgtgttttagaggtggtacatttgcgttaacgtagggc

SEQ ID NO: 13785 - DNA, 487 bp, Saccharomyces cerevisiae
gacttagaaaagtaacacatacgctctattctatatattcttttgcctatgaattttcttgtacatgtaccaccacgataaggctgaaatatttttcaaatgcataaataagattaagtacatagaagacatagcagtatttacaatatttcgaatgagaatgtgtctttttttaagtgattaaaaccacctaccagcagcctgaaggcgacgctgcctttgtttctctacagctttacttatataccatccgtacaagacccccatcatagagccacctaaatgcgcagcgtaatcaaatgacccccatcttaaagcacaaccagctgcattccatgccactgaagccaagaatgctacccaagccccacctgggactgggaaaacaaacagcaaaattttagcgtgtgggaatagatatgaaaaacatcctaaaaccccaaatagcgctccactggcacccaagctaggtccgacaatggctagg

SEQ ID NO: 13786 - DNA, 475 bp, Saccharomyces cerevisiae
agtgagcttaaaagagagaaaagaagctatgagacaccaaagccaggcaaataaaagggagagatacgaataaaaataatttaagaccacgttatatacacattacgaatagtttgactttatatatttacagagactaccaacttatatcaaaaggaaaaaattcccattaccagtttcattcataacgtgttgaatgcttggatcttagtacgttgaggtaaccttgactctacaattttccattctatagagtcccataccctttctaaatattctcgtttcccaaatacgccataatcagttaaccatgtttttggtgacgcatcaatggctaaaagcgggatatatgaaacctctttcccagaaaaacctttctgttgggtttcataaataaattttgtcttggcttgcttggcagtcatctcagaatcttcaagattaccggcttctttggctcgttgtttttccatgt

SEQ ID NO: 13787 - DNA, 407 bp, Saccharomyces cerevisiae
gcgcatcaacaaaaactctatgtattttccaataaattatatatcttcagtttaatctaattcaacatctacttctgtattatttctatcacccattttcaccgttttttcgtcttgtctattttgaagttaccagtggcagatcccaacgcttttatcgcttttttaaaagattttcaaaatccatatataaacatagggtccaaaaagaaaacaaataacaaaacaagaaaacctattcgaggtaaagaccaggaaaaacaaaatgactgcagttaacatctggaagccagaagataatatacctagggagattttggcaattctttcgaaacctcacccaaattatcagttagcgtttttgaatattatacaacttttgaaaacgcaaagaagaactggttggg

SEQ ID NO: 13788 - DNA, 430 bp, Saccharomyces cerevisiae
gacgaattgtaagaggaaagtatttgtacaaaacgaaaaactaaaggcaaatatatatatagatgttgccgcgcaccttttttttaatgaatattcacacaaatattgaaaataaaaacaaacaaaattcaaataacaacatgtaagaccaaaaaaaaatccctcattatttattccttaccctttccaaattcttactatactagtaaatatatatttaattatccttttttctacttcagcatacaatccttcttttgccgcaggtttatagttagacccctcaattctgtcaagtttcagtggtacgttattttatgtctcatctcacgatcctggcaaaaaaagaaaggcatgtaatttgaggaggcgattcaccctcatttttacgcaacaacaatgctgtgtggcttacacgcctctgcgtaca

SEQ ID NO: 13789 - DNA, 430 bp, Saccharomyces cerevisiae
agtaaagagcttgttttcttcgtggaataaaagccgtaatatccattgagcatgatattttatttcttggtaccggagaagataaaaggatggaaccagcagaaatgcattaataaatacaaaaaatttagaaaagagttacagtaataatgtatatttctctcacaaactaagtaaccgcttcaaaagcgtatattttgaatgcattgaactttccatttcattacccgcagagccggagtcctcatcaacgacggagtgaaaaattttgtaattgcgagaaaaagtgaaattgatggaaaaaaagaaaaagaaagtagaagaagacattataagagagactaggaaacttcttgcacatcaaccgaaaagcgcctaggcaaccagtcatataataagcacgcacgagatgtcctccgatttagctgct

SEQ ID NO: 13790 - DNA, 483 bp, Saccharomyces cerevisiae
agaattattattaacactttctctggcagaaattgataaataaacatttaagaaccctatatacgcaaccaaagttcctttgatatattttagttttccatcaaagttttcctacataaacactaaggtggctagagacgcgtaacaaaagttaacgttaccggtaaaaatgtgattatacaaatcaatctcacagaacggtgtggaaacaaagtagttgaaggatttcaactatgcgaatcaacagtgagctagcgaacaagttttctgcctcaacggtgcacttagaacatatcacaactgctttaagttgtttaacaccttttggttctaaagacgatgtgcttatattcattgatgctgatgggctgtcatttgtcagggagaataatcatgtgataaaaatccaactactgttatctcgggagctatttatgtcttattcgtatagaaatgaaactgaggatcacatgaaactttgtg

SEQ ID NO: 13791 - DNA, 432 bp, Saccharomyces cerevisiae
ctcgtaaaaaaaagagaaggaaaaaaatcaacaagacgagtattattccaaatgtaactccagaccattctataaaccgtaaataaatatataaagctctatcattgtaccaaatcactattcatttcttcaaaccgaaggacctcatcattcggatcttccgaggcatttctcctgtcgattacggcgctaaatcctcttttagctaacgcctcgactatttcaccaacagttgatatcattcccgtaggaccttcgtcaaagactccgtttgtttcaaccttattcaaccatccatattcttgaggaatgttttcagctttcctatactttttctttccttcggttacgctctgaataggttcaacaacttgtgtggaattgatatcgtcattttcatcgttatcgtcatcgtcatcaccattgaagtgg

SEQ ID NO: 13792 - DNA, 498 bp, Saccharomyces cerevisiae
aagcaggtagcaggttaatgatcatttggtcttccttttaactgttctctatatacataaataagcatatctaccatctaaaagaaagcaaatgtcacataataaatatgttaaaatctcaatgtcttcctggcttttcaggaattcaaaccatttccatttcgttggtgtataatcaggggcccctctactctcacctctctgtaccgaagcgttaatcaattttcttttatttatatacacgatgattgtaactaggttattttcctatacaaaatttgctgaacactgaatctaagatttcctcaataccaatagcttgtcctgttatcttagctattccatcggatgcatacctcaaattttctgtggccaatactatatcattatggaaatctttggatttgaaaaactcttccaagccgtacagtacgtcgtttttgagaatctctgacactcttttggaaacaatgacaggacttgcatcggcacttgatt

SEQ ID NO: 13793 - DNA, 443 bp, Saccharomyces cerevisiae
ggcgagtagttcgccaagtttttttggaacgatgtttacgtactttgtatttgtgcttatggtctttaacttgtttaattatataaccataaccattcggtccacgctgaaaacaaaatattgtcttaggacacgctttgagaattattgaaaaaggagctcccacagtgatgtaggcaattcaacagagatgatttgtgtcattttttataaggtgataccgtcgctcattaactcgatatcttgaaaaggcatatgtgtcggtaattgagaccgctaggtttaacttctcgaataaaaaatggtctaagctgcataagcatatagaattgtacaatcagtgtataggtagagcagaagcagtccaagattcgagctaataatactcatataatatccatcgcgatgggtattatatgaaacataacaatcgtacatggtga

SEQ ID NO: 13794 - DNA, 434 bp, Saccharomyces cerevisiae
aagtcattatgcattaaataactagaaagcccactacatatatattatattgtatttttctaaaaattctaatgaagtagttaatggaatgaatgggaaagagaaaacgcgttaggagggaaaaggctccttaaataacagtaaaaatgaaatggctactggtagtcccagtgccaatttttttttttactttcttttctttcactcttgcttttcccatacttgtataaacgtttccttcaaaaataaaagctcggcttctctctctgtcgtatttatgccatctatttctatccatttttcacttttgttatcatacagctgagtaatccaatggcttttttcatcaccattaaatgcgtttccatctgtggatggttgtttaatgaccacatggaccacatttgcttttaagcgatacttgacgtgcaaaa

SEQ ID NO: 13795 - DNA, 409 bp, Saccharomyces cerevisiae
caaaattgaaatgaaagacaataagtacatttttatataaaaagctttctatattctcacctccatcaactccaaaaggtacatgccattttgttatattaaatattctaagaattttccgaaggatactgcattatcatcagtgatttattaatctatgagtatgaatatgaattaattccaaattttctccatacatctctttcataaacacaatccacttgagtaactaagttctgcgctcggatcatattaactgtgatatgagacacttgggaacatccgtcaatatttaaatatgccagtggttgacctcccgcttcgttgtcatgatccatctgaaatttttttagaaattcatatattgatattcctgtaatttcaaaattgtgcgaaatgtcaagcctct

SEQ ID NO: 13796 - DNA, 403 bp, Saccharomyces cerevisiae
cgaccgccttaattcaaaatttatctttcgtttaaatatggtaataattttattatcttgtaaatacaatgtgaaaaaagttgagatttttaggaatcactttttcaagtataaagaactatatatgactatgagctattatatctttaagtatgactatatgttgataactgaacaaagatagagagagctaccgccataatgtcacttttcattaatgaaattgacttattttgtttacagctaacgcaagaggacttcgctagaaggaagagaaaaaaagaaaagaaaatgtttggatcgctcaaaactcctagtatattttcagagggcattccacatatatttcagtttgtgccaacgaaagttaaaagaaaagcaaaaacgcctcgaaatgtcgtat

SEQ ID NO: 13797 - DNA, 465 bp, Saccharomyces cerevisiae
gagttgttattgtttattgttttattatatttttatagttatactttgaccattaactttttgtaaattttgcatacttaactctttaatattgaaaacctgcctatttggcgtaatttttcatcctgcctttgaacctgttgtaaacgttcgcgttggcaaccatgataagttaacaagacacgtaggcgttcgcactaaaacacagcattgctactaaagtacgttactaagaaccagtaaaaataaatatgtataaataaaatgtagatacagctgattcccaatatctcatttcagaaatgatcaacaccaggcgcccagcaacgttcaatctatctacgcttcagtactactaaaagtgggaaaaacgtgggcttttagtcattccctgcaattttaagaaaactgcatatactagtagtacattcgcgatataattatgatgttggcctttttaaaaca

SEQ ID NO: 13798 - DNA, 478 bp, Saccharomyces cerevisiae
acagaagagagtgtgcgcaatattttagttcttaaatatgacatagattatcaaaaaactttgtatgtttgccagatttcagtgaatctgcaagagtataaattataggaatttgggtgaattaaaccatttattatgttttatgtatcatggaaaaaacagaacctttatcaaatcatctatgaaattttgacaggttagccattttcctcattttattgctctgcaatagtaaattatatagatttatgcaatgctctaggttccggcggcttttcatttaatgtgaactcaagactattatcatccaaacacattacaacatccgtacatttagttggctccattttttgaaaaaatacttccgagtaagatgctgaaagtaatcaaattccgtgaaaaaggaaccgatttggtaagggcggacctgccggaagaaaatcgctcccgcgtgtctactggactttgcttctttgcc

SEQ ID NO: 13799 - DNA, 422 bp, Saccharomyces cerevisiae
gaactagattaaacttgcgtgcatgcacgtacacacgtaaatatattcgtacaaatagagtgcttacatatattcagttcagattatttattttgtggtgccacaagttttttctaataggatcgtatttgattgctagcaagctataggccttaacagcgttgtctcgggtacaagggtctgccccccagtgatatgccaggaattccagggcatatgaggactcgatctcgggcaaatcctctggtgagccaattggaagtgacaatacgtcaccgatgaaggttgtggcgaagtcgactactttgctatcccactgtagcctatcatggaatagctcttggaaaccacggaggtaggtccacggactgatgttctgcggaaccaattgaatcttgtccataatgaactggagctcgtcg

SEQ ID NO: 13800 - DNA, 492 bp, Saccharomyces cerevisiae
tcatgagatggactttacgtaataaatacaatttgtgacattgaactattgttgacgaaaaaaactatctttttttattgaaatgaaaaaggaataaaatagcctaatgtaaaatatcgcctggctagcactaataactttgagtattgttgcagttattcctgccgcaaattatgtattaaaatttatacagatattgtgccataacttcagttaagggtaaattatcaaattctcgatatccgtggtcactttatacgagtttctctttccgtgcctatattcctcgcgatgagattgaggtagaaaaaatatctgaaaaagagttgtcaatatattatctattatgtccttataattttatcatttagattgttcatgaggcccacattttcataggattgctaattaactcacaaatatggttcaagctatcaaattaaatgatttaaaaaataggaagagaaaaaatgtggaggaagaaaatggcag

SEQ ID NO: 13801 - DNA, 429 bp, Saccharomyces cerevisiae
tcacctccagtttgcacatactatatatcttcatgtaatactacatatgtcataacttcaataactcatacaagtcatctgctactatgctttgccgtttctactatccgtgaagcgtgaccggcccttctcaccccccgtgttacgcaaagaacaacaagaggtcgagacaaccaaccggaacgactagaagagaggctgttacgtttcctgtttgttcacgctcaacatcttccattgctgtaaactgcatccagtaaaattaatagttattagcgtactatgtctgcctttgtcagggtggttccaagaatatccagaagttcagtactcaccagatcattgagactgcaattgagatgctacgcatcgtacccagagcacaccattattggtatgccggcactgtctcctacgatgacgcaaggt

SEQ ID NO: 13802 - DNA, 483 bp, Saccharomyces cerevisiae
ttatcggaatttgaagaactatgatgggacaagttatggaagagtgttaagattcgtatgaatattttattattttgaaattgcataaatcaaggatagttggtaaatgctaattccttaatttttcggtgagtgcattcgcaattggcatcatacattagggttcaatgtgctttaatagatgatgatactaaatacttatactttgaaataacttaatcaatgtaaattattgtcttgattcatttatacttaaatttttatatctcaacatatgatatatccttacattaagacttattcaagaaacatttttcaacgataattattagtaggctaaaaatggcataggaaccagaaaataatgttgaagaaatgaagccatctgtttaatatttggggaaaaaagtgaagaaattaacgaatatgtgcatatatatatatatatatatatatatatatattgcacaggtgattttgatg

SEQ ID NO: 13803 - DNA, 454 bp, Saccharomyces cerevisiae
tatacaggttctctaaaacaagcagcaaaaaaaaaaaaagcctgcttactacttgttttgagcgttttttcttatcaatagttttaacatttttccacgtaaatatatatatatctatatgtttttatgcattttataaaaaaaatatgtttgttcattactctttcattttttcattgaaaacttttaaaaaatgtcatgattagttacatttcgtatatataaaactataaaactgtgaaaagaaattaaattgaagtttgtcatggatgtccaacgccctatttaatttctttatgcaacatgctttctcttgcggggccggtaccaacccattcaacaggaacgccaacaaaatcttcaatatattttaagtacttctttgcgttttccggcaaatcttcatactttgtaattttggtaatatcttgatcccaacctggcaaaactttgt

SEQ ID NO: 13804 - DNA, 417 bp, Saccharomyces cerevisiae
gggacagcatctcccaaaagaatctttatgactatcagatctgcaggcagaccgcctccctacgcttctaaatagaatgtacttagcacttctgcctacatagtaattattcatcattgtaagtgtcacattgcaaaaatcgtccaatagacgttttcctcgtttgtgattggccctacgttttgcgccgatacaagcggcggcgaaaagttaaaaagaacaatcaattaaataagaaccatcagtcctcgtattttgtcttctgtttgcaagcaatgcaccaaacacaagatcaactaagaacgcatctacaatgttacgtaacacttttactagagctggtggactatcacgtattacatccgtaagattcgctcaaacacatgctctttccaacgctgctgtaatggatctgca

SEQ ID NO: 13805 - DNA, 459 bp, Saccharomyces cerevisiae
aaattttgttgttttcattaggagaaactgtatattttagccttttatcaaacaactgtgagtatagaaaagtttatgcctcaagctgcagtgcttcttataagtgattggctgaatcaaggactattaggaaagctcatgaggtggttaataaatgtttagctgaaaaaatgaagatagccacatttgtaacattcatttcaaagcacatatatatataatatacatatgtttgttttgggaaattactggaagctgccctagttttgttttgatttcactttcctttgtttacatattaccattttgacgcgttccgtgacacgttaaaggataatagttgcacaaaagggatatgtggcactctatgtcgttcgtggtaattcgagaaaagtaatcatatttatgggcttaatatggaaagagatattgtttagcgagtaagagaaaacgatcatc

SEQ ID NO: 13806 - DNA, 412 bp, Saccharomyces cerevisiae
atgtgtgtaatcttgcaatttagtttcaaacaagatccttgtatttatataaacaaagatataatttttaaaaaaaaattagaaaaagcaaatataattcaggtcccacttggaataatggcactgtattgatgcattttccttatgcttagtgacgcgttttcgcgcgtcagtttcaagtttttcttggctttttttttttcattttcgtaaagggtcttaaaaggattaaaaaatgcagtattgaaataaagaacaattacgaacggtgaagctgctattttggttattatacccttccaggacagtacgcgcaaactattatggagatattcaaggaagaagaagaagaagctttttcggcgatagaaggtataatatatgcctgtgaggtgtatgaccctgtaccccg

SEQ ID NO: 13807 - DNA, 454 bp, Saccharomyces cerevisiae
gctttggagtagaggcaagaaaaaaaaaatgcaaaagataaagaaaaagcactgagctttatgaccatttacctaaagtttgaaatgtttcaggatgcacggcccattcgcgaaccaacttctaaagatcacacgaaatgaaattcaaaataaatgaaatttatttaatgggtaattttatagaatattaattatccgatttatatatggacatacttactatggacatgataatgaacaaaaaaagatatccgcttgatatcatgcttgctccaacttttcataaagctgttcccttgcataccttatatttttttgtaatgtctgatcgatttgacgttttaaatcacatttcttggcaacatatccttcctcataaattcgtttccaagtattgtgatatgacttgacgaaatcagctggcagtaaatcattttcagtggcattgaccaaa

SEQ ID NO: 13808 - DNA, 473 bp, Saccharomyces cerevisiae
agatattaaatctagcgaagcatagagattctttttttaccagtcatcataaccattattttacaaaatttccacgcaacagcttttattttcgttcgtaataggaaccatacttcccattaaagcagtatgattgttttatacacctttttattgttatttaagacataccccaaataattaattaattaattgatgaaagaatcatataaattcttggccatacatatttttttattatcttttgctacattgaccataggtgaatatcttcccggggtgacactccactgaagtgggaaaaaaagaaaagttttaaaacattgctcaccttaagtctcgaaggtctagcattcactacctgtaagtgtcaagaccccacatgtatacatggatacaataaagaaacaatgtccgtataatttgtatacattttactacagataagggatctcacccccttcttttgtgtc

SEQ ID NO: 13809 - DNA, 420 bp, Saccharomyces cerevisiae
agggagatgttatatatgctttatttggtttatatatgacccatatagatatttttgtacactactatttgtcttggtgttgttcaggctgttcagactgctcaggctgatcttgttgttgttgctgctgtcttaacctttcctgtctttgctgctcttcttccatagacagacgcaaggccattgccagttctgggtccattgatgggtctaccccgaagtccataaatgtgccattggcatcggaatcaccgccagacccaccaaaggcgcccataccggaggatccttcttcgagaattatgggtgaagatgcgatgttctcgtacagcagtctggggccaggcgtcacagtaagcaaatgactagtttcttcttgagggttgttcactgcagctatgaactcatccaaaagctccg

SEQ ID NO: 13810 - DNA, 466 bp, Saccharomyces cerevisiae
atgattatttatatccttattcggttaataatagtataagctggaggcaaggggacagaaaatttaggaggatatcatggaggatagagttacataaatatacacacaatacataaactaataattgcttgtggctataggatataatttataacagttgatgtgcctttgaaaaatgacatcgtttggaatgagatcaaatttatcacttgatgaaatcacagtgaaaagcgacttgcaatggcagtagagatgacaggtaaattcatccaaaaagagagcccgaagtctttctcacattcagaaatggcagaagcagtactagaaaacgttaacgttcctgcagtcgtttcaaaagatgagtgtatttattgctttgaatccccttataatgaaccattggccctcaatgcatcacctaaacattcattgaatatatgcttaaactgtttccaagctacgtgca

SEQ ID NO: 13811 - DNA, 464 bp, Saccharomyces cerevisiae
aaataacacatctttttctttagaaatacactatataaaataactataaaaaaaaggcaacagtataatattaagtttctttaaaagtcttgattctaaccctcgcctcttcttagaacaatccgtcgttatcatcattatcattgttttcgtcgttgtcatcgtttttattttgttccgaaccgctcatttgagcttcttcctcatcactatcttcaataaattcattcgatagttgagattttttgcccttattgtgagaaggctttttcaccacatcatcgtcatcctcgtcgctgtcggaaagagtttttttagcagctttccttctcttagattcaccgctatttttagtttttgttgacctctttcttttttgtcttggctgttcttcgtcatattcattgtctttatcagacagatctgaatcatctttaacattatgttcacttatggccatggct

SEQ ID NO: 13812 - DNA, 418 bp, Saccharomyces cerevisiae
gatcactgcacccggaacaacggtattttcataacagccatagtaatacagatcatggtttgaaaggtcggcgctcacaaaaccgaaatgtgtgcagagtcatataaacatctaaacaacagttatgatacatattctataaatgcgtaattttagtaacacaatttaattggggtcgcaaggcttcaatggatgaacgcttagcttctctagttcagggttcttcgcaggaacttttggtttagactttttcttgcaagggagttcctcttcagattttgaattcgacggggaaacttttattgagtgttcttgagaggtgttaagcttgttagcagcaacacttaaataatgcggttttttgacaactggtggcttctcaggttttgtggaggcctttgctggctcaggatcttct

SEQ ID NO: 13813 - DNA, 469 bp, Saccharomyces cerevisiae
cactcaaatcttcggcatgtgtgaacggtggccgagcatagttcgtgaacatcatcacttaaaataagaactacactttacatcagcgtggaagataaaggttgttttaagctcaagggcgctggaggtgtagcgcttcggaggaaaataatattgaataacttcgctttttgttccaaattctagattatcgtgtatgttcttgttcgtacgtccatctccatagttataatgagtgggcatgattctgttacaaaaatatctcatatcctgaatgaaccggttaacgaaaaggtaatggtacaaaacgggttccatgaaagctctaaaattgcagacatcgaattagagatacaggagcgaccttcgattaaacaatgggaatcgccgcggagtgctgtaattcctacttcaaatcataattttagcccatttctctatacgcaatttaaatctcgtggtgcagcac

SEQ ID NO: 13814 - DNA, 436 bp, Saccharomyces cerevisiae
ttcttgtgtttcttctggttctcgtatctcattatcatagcatattaagaatatatgtactaacatatgtactaaacagaaacacaatatgaattacaactaatactatattatttgtctcctttttttattagtattaaaaattaccgttactggttaaaatggaatacagctcatccatttaaaaaaaaaaaaaaatagaataacaataattaagcagaaaaaatgttaacgaatataataaatcgatttgtccattttcataaattttttttttgtattatttcattatctgtgcctcaaagcattaacttttcttgcagtcagagagagtctcttgcgtggattataccaaccgccattatcagccggcataggggccggcgtagcatagttactatcagctgtaattatgtatgaccaccctggtgttacg

SEQ ID NO: 13815 - DNA, 449 bp, Saccharomyces cerevisiae
ttgcttccgtttcccaatttttcgcttccctccgccgcgcacaccgtttcttccgatcattttagatattcattcaatagttgcttatttttgggttctttagaggaaaaaattttcgattaaaattacttaatattatattgttatatatataaacttgaaagaaattacttttttttttgtattcgttttttttttttcattattcaccggaaaaggtgaaaacttattactatattgcacaccgagagaaaatcatcggaaaaatgtggccaatggattaacaatgacacatatcgccaataaaggtgactttggattgttctttctacacccgattaaccactctttctctttcaatgtattccaaacaaagtctaaatttaaatcaaaaaggccaaagcaccagctagagcaacaccagcggcgcctgcaaccttaccgttgtt

SEQ ID NO: 13816 - DNA, 437 bp, Saccharomyces cerevisiae
tttcttttgcattttatcttttcccttaatatgtcatgagaataaaatattaaggatataccgtaaatatacaaattcgtatcgaatatttgatattgtttcctaacttttctgtgttaaaaataaatatgcaaaaacatactaaccataaaaataaataaaatacaagatataaataaataatccagcaagcaaagacattgcggtccatgccataattgttttcttccaactattagatttcagtgtgcattatttcatgtttcttttcttcaaaacgttctcaataaatgcttcaccagccttatatgacgatcttactaggggtccagatgcacaatacaagaatcccatctctaaagctctctctttccagtagtcaaacttttcgggtttcacatattctacgactttcatatgtctcttggttggcctca

SEQ ID NO: 13817 - DNA, 495 bp, Saccharomyces cerevisiae
cattcacccacttttacgtttttgtctataactagcatatataataccgctctagagttactctaaactaaatgcgaccactattcttaactaataattgttctttttacaaataactctttcaaaacttctaatcttttctcttacgttttccatttatctgctcttcttctgaaactctttttcctgcattggccctctctttgttacatgaaagaggttttagggttggtaatatttctggttgtaaacttcttgaatacacttgggtagctaactgcttattccagttctcctggccactaatcccggctacgctttttgttgaaatagtattcttctacagcatcatagctatcatcacacatgtctactagtttccacgtatgtcttggaggtactctatcttgaccgtagatggaagctttaaaattttcatcccttgggaaatattcctcacgtggaattttttgagcgctgcatggctaaattcta

SEQ ID NO: 13818 - DNA, 462 bp, Saccharomyces cerevisiae
tagacgcgctctatatgtttatacaaatgtaagtgaccaaatgaaaagatgtgtgtaatagttatattttcaaaattgtacactatattatataatcaataaaaagaaactatctgaaatagcatgtcctcctaaacaaattcctttttacccttttatgcattacaagtggaccaaaaggactggaaatggtaaaaagaaataagaatttaaacatgctataaatttcttttgttaattgcaaattttttgtttttatcaccgattatgatatcataccatcgtcaatattcttggttgataaataactttgtgcttttgattttatgctctccgaaaagttgctatactcagcaaagaacttatctaggcctttaaacagacatttcagttcagaaagtgaatcaattctcccaatcaaatccttgtttgtttcatctttagcctcgttatcaatcgcag

SEQ ID NO: 13819 - DNA, 489 bp, Saccharomyces cerevisiae
tctgcttattgtttctttgctatgataaacttgtccatctcattttgttggtgaaaaaaagcgaagcccagcaccgcaggccttggatattgccatatcacaattgtcctgaaattgtgaatgtctatattcccatatatatatccataggcgtttcattcatataaaaataaatacgcatatgtgtacgtaggagattgtgttttcaagatggagaatataatgtgtttttgcaccgttatctggctttttgttaagaagtacttcgtctcgtttctgctgattctccctggaatatttacattactttagattttactatatatatatgcgaatatatgtgtgcaaatattgatgcactagtgtgtacgcgtttcatcatcaacatgctcaattttcttccgtctttttatgatctcaatatagttatacggaatgtagccaatattgccgttctttgtcctcactttccaccagtcagaatccctc

SEQ ID NO: 13820 - DNA, 416 bp, Saccharomyces cerevisiae
aggcctaaatagtactgttgatatactaaacattatattatagttaaaaaaagaagaaaaaaagaggaacaattctattaaattcacttcaaacatcaaacgtaaacaatacaaacagaactcttcatggatgatgggttttaaaaaattagtcaagacataattcttaaagttcatagtctcatttttcattttctttttgcctgctttctcttttatacatcgccgcataatttactaaacgccctttgtgtttgtgggcggaaagaaatatattcccttaaaatttccaggaaattatgttgctacaatgacttataaagggaaaaaataagaagagaaatcttggaagaataccctagtaaaatagtgtacaaggcaaagttcttaattatgcaaaatcgccgtatatgaaa

SEQ ID NO: 13821 - DNA, 479 bp, Saccharomyces cerevisiae
gcccctcctccaatctctgtgcgtctctttctctctcccttcaaccaaccctttttgtcgcctccacgtataaacaagcgtatgtacatatttaaagatataataagataaaaagctgtttttcctgtaatgcaaccgtttcccacgtattcatcccttttaatagccgcacctttaaacgataccaccccttataaaagcctagatgtagcagtgcgaagcgaactcgatacttgctcatcattgatttcggcatctttgtgtagaaaactacaaatgtctgacggaacactgtttactgatttgaaggagagaaagttgattaggaccattgtgccaagaggtttagtgcgttccttgaagctggacgttaagcttgctgatccaagtgacgctcagcaactttacgaaagggagtttcccttgcgtaagtacccaacttttgttggaccgcatgacgagtggacgcttacagaggc

SEQ ID NO: 13822 - DNA, 426 bp, Saccharomyces cerevisiae
ttatcacgaagagtcaatcaatctttttaatacgcattcaaatgaataagaacaactttcacttttttaagtatataaaaagccgtacaggcgaacgtatataattaaaattctttggaaaaaaagaaagctcgcactcaggatcgaactaaggaccaacagatttgcaatctgctgcgctaccactgcgccatacgagcttttgttgtatagttttaaggcaatagaataataacacttatccacgcaacagtaatgtggttaaataataacttcctgtcaggacttgtggttgattggtgaaaatcaaatatcatgctgactactagaaatattagcagtatattatcatatacggtgtaagaagatgagataaggattgagaaacagtcatcaagtttaatgaaagtgaaatgaaaggattga

SEQ ID NO: 13823 - DNA, 425 bp, Saccharomyces cerevisiae
gaattgaattgaaatcgatagatcaatttttttcttttctctttccccatcctttacgctaaaataatagtttattttattttttgaatattttttatttatatacgtatatatagactattatttatcttttaatgattattaagatttttattaaaaaaaaattcgctcctcttttaatgcctttatgcagtttttttttcccattcgatatttctatgttcgggttcagcgtattttaagtttaataactcgaaaattctgcgttcgttaaagctttcgagaaggatattatttcgaaataaaccgtgttgtgtaagcttgaagcctttttgcgctgccaatattcttatccatctattgtactctttagatccagtatagtgtattcttcctgctccaagctcatcccacttgcaacaaaa

SEQ ID NO: 13824 - DNA, 419 bp, Saccharomyces cerevisiae
tttcagaggatcaatttttaatgctattaatgtgtacgtggaaccaacacaaccgaagtattcatcttctgttctcatcgcactccttttcctttctctgcttctccactgtatgtcatttaaataaatgtataaaccgctgttttctgtttgttgtcttctacgtacgttgtctgtatcaacctgcacatatttgagtatgtaaaatcatgatttgtaaactattgtaaaaaaacttcattgatatgaaaatctgtcgtctgctcaatattttgtcttcactgttccctttatgcatcccatgacgccattgaaaagcaaaacttcgttgccaacggtaaggcttcctatatctatatctccctcttcaataaggccgagccgcaataaataatgacgcattgttccgcacaaacatc

SEQ ID NO: 13825 - DNA, 475 bp, Saccharomyces cerevisiae
gagcaacggctttcttttgttttatttgatcgttattaggctttttgtataatataaggcctgttcagtccattgcgcgtgcaagaattttcctttggacctgaacgaaaagagtagaggattttatataatatattctccgtcttttttgtactgcgtggcctttactacgaatatctgtatctaatttcttttctaacttttttattaccattactactactactattattattattattattattattattattattattattgtgtatgactataatgctttactgcctccaattatgctttttttattattttttttggctgaaactacagtatagtaggtatgtatatatctaaaactcaaaaagtggcatgtctaatgtaataccatcaaaaacaatgaaattatttaatggagatagccttttacctagaatgttaatgacatcctgcgctacagcaccccctataa

SEQ ID NO: 13826 - DNA, 414 bp, Saccharomyces cerevisiae
cgaacttcatttccactctttacttacaaatatactatatatatatatctacatgtaatttagatacaagtaaatcatatctcttgatattgcaaaaatttgaaagcaaaagcatctcttttctgcagctttattcttttaagattgtacatttttctatcactttcttgtaatcctaaattatatttttctccaaaatttttcttttcgcttgtagattgttttttttccacaaaggcaaaaaacaaaaacaaaataaaagaaataaaggatgaaaagtcatctttgtttatatagctaacctcttgactacctgaaccttttgaagcactattcaagcccgcagaggttaagtctacacaattgtttaaaaagaaaaacagcagtaaacacacggttgaggcatggataact

SEQ ID NO: 13827 - DNA, 462 bp, Saccharomyces cerevisiae
gttaattagtccgaggccttttttcattttgtctccctatccgactggaaaagttctagcgaaaagtgcagcagacgctgcagcaacaggaacaatttccgaatgacccacctgcggtggtgtggcacacgcattctgcatgtctcaataacctctagaattatctatatactttttagtaaacacaacttaaaacccttttgtcttttccaacatattttgcatataatttttgtaaaggtttttttcttctcttgagtccactcactattcgaaagcaatatcaacaaatagaagctttcttctatttttaagggaaggaatctttaaagtacaaggaacagaagatactaaaacatagggggaaatggtggtacgagatcaagatgaggcgttgagaaattcttataaatatgttaagctgtatgtcaggcaggaccagctggaggatacggtggacat

SEQ ID NO: 13828 - DNA, 495 bp, Saccharomyces cerevisiae
catcctttttttttttttttttccataccatacgaacatacataaccttacatacaatattacatgattactctgttacaacacgtctccccttcttggtcttgaccattgtactttggctggtatgtccaatagagtcgcgtgcgctacaacttcgtccttgtgggtcatgaggttcgtcagcttatccatcttcttgttcaacttcattaaatacagcagatttaacaccaagagcaccaagattattatgttcacccagttaaacctccatctgtcgctgcctatttctgagatttccgcctcagcttctggtttcgactccggctgtaccatcgtcagctccggtgctgccactttcctaggtgatccaaaagatgtaacactgggcaacggcttgagtgtatctgctttttctttgctcaattccacgtatttctctacaaattcttcgactaactttaccaagtccttagtggcgctaatttgtccatt

SEQ ID NO: 13829 - DNA, 464 bp, Saccharomyces cerevisiae
tgttggtgctttacctgttagcatatatataataaatacggatttcgtttatcttgtgtattttattcgtttcattagatatttaatgtttaaatgaagaaaaacttaaagtaaaaattttcattcacaaaataaatctaaacagcggtaggtaatcttcattgatcagagtgaacacattgcatggagccagccaatcatcgtgtcctgtttacttcccaaggacaggaaaaagctttgagaagcaaaaccgatcaagtgtctaaatcttgtaaaagatttaataattggctggtagtaggcctttgtataggatccacttgaatgcatttcttgattacactcaaaagcccctcagaaaatctggaatttctcgggaaactgtacttaccagtgtttatagcgtaggttaaagaagctccatgtatctgctcttctcgctcaaagggggagataccgaacat

SEQ ID NO: 13830 - DNA, 456 bp, Saccharomyces cerevisiae
aaacggcgtacatacataaagaataaatcaggaacgtgaacaccttccttacatatatacacacatacataggcatatgtatcgcatcttaaagtgagagatctacctattttccttttttttccatttacaacatagcaattgatgtttttttcccttctaagtcatctcgatgtcatcatcttcatcgtctttgtagtcaacttctttcctgaccctcaatttcttcatcacaatattttcgtgccctttcttggtttcatttttgttagacggtgaataactgtcatcatcactgtctgattctcgatccccatcaccttcttcgtcgtcagcctgtgatctcgcatgatgaactttcttcttttttttttgtgattcattgttttcgtgagctaataacctcttttgaagcctttgtctttgagtttgtgacgtgtgaagaatccgtccgat

SEQ ID NO: 13831 - DNA, 485 bp, Saccharomyces cerevisiae
cgttcccaaaccattacattatgttctttcacttattacatacgatatatagcatctacatctacatatctaaatgatgttttttcccatctactttgtccgatacgcattaaaagaagaagatttactctcccgtgatgccgggccaatcagacgcgcgcattcgcggcagaataaggggaggctgctgcgggtaccaaatatccagatattcacaattatgccaatcaactgtctagttgctgacacccatcgttttccactgcaacgaggttttggggctagaaaaggcgttaacaatcgttagagaaggaggggttcataacttgacttgttgtatcttgtttaaaactttctttgaatttgttcgtggttgaatttgtttttgctatcccaaaggagtgcattttacacgcattactacagcacacttttatacagttccacaatagaatatgttaccacgttcagcattagcacgctca

SEQ ID NO: 13832 - DNA, 455 bp, Saccharomyces cerevisiae
aaattcatgttcgacatatagatagcagggtaatgtacgtgtatattttaatgtaataaagaggccttactagacggtaaagttaagaatatcgagtgaacttttccttaagataaaggtaaatatagtcgagtatttatttattattcttttccactatacagtatttaaaattctgtaagaaattgattctacatacataagacaaacgaacaggtcagagagaatcagatttttggttagcaagaatacattttggagaagaaagacattaactccaccttactgtatcatcttatttgctttttcactccttcctaatattttttttattttattttgaatttcttcctatttctgatgcattgaacagatcgtaatctgtaagtaaataccataacgtgctcacatttgtctccaaatactggtgaaatcttggctccgttgtgtacaaa

SEQ ID NO: 13833 - DNA, 481 bp, Saccharomyces cerevisiae
tgacaccaaaccatagaacgccgaaacagaaattattagtagagctgtgtagagtttaatttaactgtagtcaatgtggaaaatgaataccgactgttgtctggaataacaacattaatccgggtgacgcagcctggaatttttttttcaattctcgccgaataggaggattgatgagctgccactattgaatttttgaggaagagtggcttcagcatgtagttttcctttctactaggccagaaaagcaactatacaaagacgaaagcttccttactcgaggttgaaaagaatagcaaaaatctttccttttcaaacagctcatttggaattgtttatagcactgaattgaatcgaagaggaataaagatcccccgtacgaacttctttatttttagtttttcattttttgttattagtcatattgttttaagctgcaaattaagttgtacaccaaatgatgaataacaacggcaaccaa

SEQ ID NO: 13834 - DNA, 402 bp, Saccharomyces cerevisiae
gggggttctttttccactttcttcttttggtccttcaccttggcatatatgtaacatagatatttgtatacacgaacttttttcatctaatacttctctttttttgccagtttttctgggaacttgaacgtggaatttttcattcttacctggtttctttttcttcatttctttacatgttggaaatcattgtaaatataagatgacaaactccgaataagaaacacaaaacgcaacattaataagcttttggcatatcggaaccatcgtaatgccttcgacacctagctttgttagatctgctgtctcgaaatacaaatttggtgcgcacatgtcaggtgccggtggaatttctaatagtgtaactaatgcatttaacactggctgtaattcgtttgccat

SEQ ID NO: 13835 - DNA, 466 bp, Saccharomyces cerevisiae
ggcagaaaatgagaaggaaaaaagttcagtagtattgtaacgttctacgcaccttttcaatggatatgcacaccacaaaatatgtcattgcgcatatccgcatctattacagtatttgattgatattttaccatacatactaaaaagctccgctccgctcctcttttacgataatgatctttataaccttgtacctaatgtctcattgagatatatcaatgttgtatcgaaatcactaaatactttgaaaagcggaatctttttcttttcggttttatttagcttagttagcggactagaagtagttttcaaatgagagaatttgacgtcaagctcatcatggcctattcctctatgcaaaatcgatctgtacttttcatattgcattgttaaaaggttctttaaaatttgcctgcaatatgtgttgtcccttgcaatatcccacttttgaacttttgtttcgggc

SEQ ID NO: 13836 - DNA, 419 bp, Saccharomyces cerevisiae
tcctgaaaatagctaaagcataaattaattgaacggtccctttttgccacccgctaatacttttatttctgttcaactatatatacatatatatatatttacatatttttacctccctatctctattgataataaaacaaataaaaatcgtatatttttgtatatgtattatcgttttgaggagcgagagcgaaaacgaaaataaaagaaataaagggaacacacgtgaaagtgaaggacagcaccaaccaagggggacaaaacgcgtcagagcaagaggtgaaagggttgccacgtacgtatttgaaccggagtgagccgtttgcgtgttacaatcaattcgatatctttgttgttttgtttaattcgctaagatctaagtttttaactaagtgagcagcggcagttacagaaagagg

SEQ ID NO: 13837 - DNA, 470 bp, Saccharomyces cerevisiae
gctgtttaggcaacgatatgtagcgctagagagtgtatatacaaacagaaaagagtctaatgataaatgacaaatatttcgttacaagtgataattgttgaactaggaagagttgatataaaaaaataataaacacacgatgggatacagttaagaaggattgatcgactcctaaatgatgcgaagaaagccaattttcaacttggaatcatcctgccggtttgttgttggtgttagctgtgttaggactcgttaaaatggcaatcaaaccaagaacgaagggcaaaacgtactcctcaagatcggtgggttcgcagtggttcaacaggcttggtttcaagcagaacaagtacggaacttgtaaatttttgtcgataataacggcctttgtttttatcctctatttcttctccaatcgcttctatccaatttctcgttccgccggtgcatcatattctccatcccatggg

SEQ ID NO: 13838 - DNA, 486 bp, Saccharomyces cerevisiae
tttttattcttagattcctgattgcttgcatgcctaaatacttcataattgtattagtttaaaagaaaaccttttactgagacaaaactataaatttaagaaaaaggttccggagccggtttaaaaaaagaagattaaagatattatatttatgtaagaattaaattaatactgtcagagaaaaaatagttttaaaggagacggtgaacctttaccttcccttgatatgcaaatatttttcagcttttcctaaaactaaacattctcgacttttttttagaagactttatgggtgtgttagaaacaaagctgtcgtctatagcagtatccaaatcgtctgctataggcagctcttcctttttcttttgaccactattgcaagttcttagccaatcatcgtacttgattagattgtctatattatcatcttgttcttttgccatattttcacgatcattcttttcaacagcgtttgaatacatcgct

SEQ ID NO: 13839 - DNA, 495 bp, Saccharomyces cerevisiae
taaaaagaaagtggaatattcattcatatcatattttttctattaactgcctggtttcttttaaattttttattggttgtcgacttgaacggagtgacaatatatatatatatatatttaataatgacatcattatctgtaaatctgattcttaatgctattctagttatgtaagagtggtcctttccataaaaaaaaaaaaaaagaaaaaagaattttaggaatacaatgcagcttgtaagtaaaatctggaatattcatatcgccacaacttcttatgcttataaaagcactaatgcctgaatttatgttgaaaatatgtgtcacaaataaagaaactgtgacatctgacacatttccactttattgacaagaatagaatttctttaagtttcccctctagattatttattttcaaattttaggctctgttgaagtttattacgtagaaattcctacgatagttattagtcctaattggatgttgcagcaagg

SEQ ID NO: 13840 - DNA, 442 bp, Saccharomyces cerevisiae
caatattcctttatgtctttcctgcgcatatcctcatcgacgtatggatctaaataatataaatgtgcagattagattaagttatatacactatgcatggcgaaccgattttgtatctttattattgagataaaccctgtatgatccgaaactcgtattggtaacaaatattatacctattatgctaattaaaatgaaaaggaaagatcgtatactgaacgcttcaaaaaaagcatttattacctccgccagagtacgagcccatgctttagcccattggtaatcggagccagacactatttccttgttcatacattttgaccattcattgcaacgtacctccaatgctggaaccctcatatgaggttcgcactggttttcaaaataccttgatttgcaagttgcaattttatctaattcttccctcacgttatgctccagt

SEQ ID NO: 13841 - DNA, 400 bp, Saccharomyces cerevisiae
gagtgcggaactgcaaatttagacatttattactatataacagagtcctatcgacataaaaacgaaaaaagcgccattatgcaatgaaaacttgccagcggtttttcatttttcatactggtaattcagagagccaagtctttctttataatgcatagcaataaatagtcatatatatatatatatatatatatatatgtacatatatatgaacatatatatgaacaaataaatgataatggtatgtgatagtcattattaacgattaagcgtttttcttcagtttctgagggattctaaccgcttggcgattttgcaagagataagaaaatttttcagtcatatggataacctaacacagcgtgcgacgtattttacttcagggcccaattgaataaga

SEQ ID NO: 13842 - DNA, 415 bp, Saccharomyces cerevisiae
tgggtttaaagaatctgcgttatgtacacgacagacattcccttaaggtgtaacacaagagtatatatagatatattatagacgtttaaaagttttaagggatcggattttcagccagatattttttactttattctaatttttttttttatttttcactgctgctgtcttgcgtgatgagtaagatatcctaaaaaactactaagggaagttcgggcagctttcaacattaagtgttcacatctcgaagaactcgcgccttaaaccagcctatacaaaagcttagtacagattacctactgcattgatagctagcatctgtcttgttaataaattagcttgccataaaattagggaaatttttactcacaatatgaatataatgaaaagacaattatgcacctcctctaagcga

SEQ ID NO: 13843 - DNA, 453 bp, Saccharomyces cerevisiae
aaaacatttcagcatacagtaaacacgcagtttgcgaacattacctgtaatatctgcatgattattaccaaagaaaaaaaaaataactgacacaatggacaattaaataaaattaagtaaaaaaaataaggactttaatttttactagaattcttgaccaacagtagaaatgcgtaaggtattggaatggccgactcctcctttgaatccttgaatggaaacaacagtatcaccgttgtccaccattccgaaagacctcgccatttcaacaccaaactttaggcgcctatgaacatcctcaccccagtcgtctaggcgtttcggttcatacagaaatgggaaaacacctctatacaaatgcgcaattcttgccgttcttgcgtgtcttgttactaatatgatagggcagcttggtctatacttcgacagtagccttgccgtgttccctgtagt

SEQ ID NO: 13844 - DNA, 438 bp, Saccharomyces cerevisiae
taaaggaagatcatgtattttgcggttaacctgttttttttttttcggtcaagggttccaaatgcatttgcatgtaaagtgaatgcccttgtcttacttaatattacatagacatatacttaataatctaccacgtttcaaattcaataatgcatgcttcttggcggtttttgacatgagatcctcatctgtcacgaggctgatgtgcatacttttacttttaatcgatgacatgatcagtttcttttgaacaaaaagccgttatgggttgaaaaaaagtgaaaatgaaaaagtcatcagaaatatatgaaagatataataaattgtcgaagagaaattacgtcgaggaggttgaggaaaataagaatggcaacgacagatatcatatctctagtaaaaaataatttactctatttccaaatgtggacggaagtggaa

SEQ ID NO: 13845 - DNA, 405 bp, Saccharomyces cerevisiae
aatgtatacgtacataacctgacgaatattcgaagaattttaggcgctgttttaacgcataatccaatcaaatttgagctgataaggcctgataaggtatgacaaattgaactcatattttttctccatgccagatcatatttaagcctttgaagcgagaatatgtaaggaaactgaattactaattcttacctcaggaaaatcaaaagaacaaagaaaaactagctaagcaaattatcgaacgatggaaacaagaatacttgttgtgaatcctaatagttcgaagtcaatgacggtgtccttgcgggaaaccattgaaaagactttttcaatggaatcatgtaaaatcagttatttcacagggccagacacgtcgccaccacaaattgatgggcaggaaacaag

SEQ ID NO: 13846 - DNA, 455 bp, Saccharomyces cerevisiae
gaaaggatgtagcgttcatgacagtataaatataacaggatatagtatataaaatttaatatgatttagtgacacttatttttacgcgaacgggtaacacactgccatttatctggtgctggaaaattgcccctaaagaaatgataagaatgaaaacgaatcaatgtgaaagcagtttgatgagatgtgagctactttgaaagtataggaagtcagacatcgcactgagaaatgtcacgtaattctgcagcaggtttggaaaacactcttttccaactaaagtttacatcaaaacaattacaaaagcaagccaataaagcctcaaaggaagaaaaacaggaaactaataagctcaaacgtgctcttaatgaaaatgaagatatatctcgtatatatgcatccaatgctataagaaagaaaaatgaaagattacaactgttgaagttggcatcacg

SEQ ID NO: 13847 - DNA, 494 bp, Saccharomyces cerevisiae
gtttaaagtaaatagaacaaatttccttttttttttgtcaagaaaatcgaagctagtaaaacatgcctatactatttctgtctctcttcttctttagtaatacctgtgccatgtgatagccatatattttgctgtgatgtgcagaattcgtatatactagggggaaatagaacgaaagaaagaaagaaaaaaaaaaaaagaaataagtgactgtacataatataataatattaatgatattaatagtaataggtatattaaatggttaaaaaatagtcctgcttttatcaattatttgtaaaactgcgagattactgttagtgttgtatggtctaaatttgtaactttttcacatcaaccggaatatcaactttcatagaacccaagtggttatcaaatttgatgtttactcgaacacaataaaatctacaacacaaacacgtttcaagattgggcactaacgtttctttaatgttggggttgagcttcaaatt

SEQ ID NO: 13848 - DNA, 498 bp, Saccharomyces cerevisiae
aatcaagtttacccctctttacctacataagagccaacgtaattttctctcagtattatatgtattatctccgaagtttattattctttaacgaaatataaaagaaaaataagaaagattaagaccctaaaaggtgtaccactacgattcaacaagcacaacgaatcctatccgtaatatacttttgatttctgactattctagaaaaattttagttcattttttttccctctttttacttattgtatttttcacaattgaattgcattttgtcccctacgaaaaaaggcagaaaacgagatctaaaccactttcagatcagaataataataataataataaccaaccaaagccatcaacaggtccactagaagcatctgccaagttacgacctaagcaaaggtttgagtgaaaagtgaattgcgacagtacaatcacaaaagtatagaaacataattgttatggaaaacaaactactttgttggtggttgtactggc

SEQ ID NO: 13849 - DNA, 424 bp, Saccharomyces cerevisiae
ggttagggctcttctacatacttgataatatttaaaaagatattatatagtagtgaccggcgagagcgttttcgctcataaatttcgtaaaaagccaaacaccacacgctgcaacccagatgccctttttaggaaatgtaattattcaaaaagtaaacaatgacatgtttcattcctcaatctaaatcattcgaagctaccttgatgttgaagccctccgcttgttgtttatttaaaaataaatacaaggaggcaattcgtccaagtaaattattgtaagatagaaaccttgctaaagatagaaactaatataccagaaaaattcaagcaacatctacagtattccttgctaaagaaaaattctttaatatgctatcaaaatcagaaaaaaatgtcgacctcttggcaggcaatatgagcaatt

SEQ ID NO: 13850 - DNA, 419 bp, Saccharomyces cerevisiae
tatttctgctatgcttctatttttcaatattaattgttcttttgtttgctaatccataatttatggaggtggcgccgctaaatcatattttccttttgaaacctttgtttaagacttacgtagaactacacttatgtactataatgttctgtaaagattctgtattttcgttcttttctattccatttttcggacttttaggacttttcatctaatacttattatttgtggaggagtgcttaaaaggcgtttgcgcccagacgaaaaaaaaaaagctaacacagtagttgagaaagacaaataccacgaatttgataacaagtcatttgctaattgtgtgtccttgacaaatacaaaacaaacaaaaatccactaatccattgtaatgtttttacgtactcaagctcgtttcttccatg

SEQ ID NO: 13851 - DNA, 418 bp, Saccharomyces cerevisiae
cgtcgtcactaagtttctaaaaactgatttttgtaatatatatatagatatcatattttctttttaacttaggaaaaaataacaccaaaaaaaaaaccaccaatactttcacacatgagagggcctagagtaaagtaccactagccatgcaaaaagcccatgtactgagctgatagtcgttaccaaccctacattttttttctgaagcaatataagtgttacccgaaaagtatgaatattattttttcttcgtaccgttatatctttttctggtatataaagcggtgagtttagaagaagttcctgtggtgcaagaatctttattggtatttaaaaaatcttttcttttcctttttttggttttttgaaaaagggtaataatgtcttttataatagacacccagagtcacgattcgtc

SEQ ID NO: 13852 - DNA, 410 bp, Saccharomyces cerevisiae
aattaggcttctcattctattttaattatactagtacgatttctcactctgtaatttaatatcagtgtaatatgcacctagttatgggtagtttttgctaacgttacgagccgcgaaactgtcctcaatcttcaccactacctctaatgactgaagaatgctatgcgatataacgctgtcgcactttgaatatatacttatatttacatagttttcaagtgcgtattactattgcaaagtagtattttgtcacgtgattttgatccaattaaaactaaatatggttcaacccgttgtttccgcatcaaaaaaccataccatttatcaaggggacgggatatatcacataacagtttgaatgcataatttgttatagatatcttctggaataatcttcacagcaaaagcgc

SEQ ID NO: 13853 - DNA, 407 bp, Saccharomyces cerevisiae
ggttgtttataacatcaaaaatccattccatatattattctgtacttttaatttaaaaggctttaatctaacatataaaccaaaatattttacttcacgttatattctttttttttactgttgcagcaaattgtagtccggctgtgttcaatcaaccgtctacatgttgaaatagatatttccatctatgaaatgggccaaattgttcatcgacgtaaatatcaggcaggtttctagtatttgacccttctctttgcaaattttttgtcttgacatccaagcttcctgaaacccatctttcacttgcttgtattattgtagaattatttcaacgataccactcataactaaaaaggctatccttctttgcatgtagccaatgcattgaagtgttgctattgtccccg

SEQ ID NO: 13854 - DNA, 485 bp, Saccharomyces cerevisiae
aagctcactgaaaaaaaaaaagagatattgttactattattattattattactgtcattaatactatactaataaagaaaaggaaaatacgcataataatatttaattaacaataatataacatatatatatatatatatatatgtatgtactaccatgtaatttcaaagactttcaaaagaagttatacgtcaattctcgtgtacaaatcagtcaaactgtaattcattcgtactgataagccaaatttctacctagtattcatatgaagatttgaaaaactatgataaaaaacgaacaatattaaaacatattattccgactgtttcccctcatgctgtccgtgttgctttgggcgtcaaaaggaaattgcatgtacttccccacatcttgctgcataggttgttgaaacatttgccgttgcgcttgcgcatatgctgacgacggcgcagatgtctggtactggtcacctagccacgttggat

SEQ ID NO: 13855 - DNA, 485 bp, Saccharomyces cerevisiae
aacgttatattttccttcaaaaatgatttttttgtaaaaagaaatactacatcgaaaagaaaaggcgatataatgtttctatcatcggagtatggtttatattccatttttgttttcattataattatacatccccagttatatatcattaatacgtaacaatattatgagttggtctttattatctaatataattaaaaaatttacactattacatcattttcaaccaataggatatatatataaatatatacatatatgcacattaaatcattcacttggaagttgcgtccttcaagctaactattctattcaaaataaccttagaagtcgtactctctttatccagagtgaaataacctactctcatagcttggaatctacacacttctttggaatccttatcttcttcaacataaaattccgagtttttaacagaatcaacgacccatggactgttcttgacaacgtccccgaagttatgt

SEQ ID NO: 13856 - DNA, 439 bp, Saccharomyces cerevisiae
aacgtaggatttatatagaaagtagttttaaagttaaaataataaaatggttcttatatgtgagaagagaataaagaaaaaggcccttacaataatatgttcaaatatagaaaagaaattcccagatagaagggaagcaggatttgtgcactttctcatatgaaatatacacgactttagcgtctcagaggaacatttttcttactaagagctctcaatttaaaatacggcttatttccactatttattggctgtctcatgtatatttttattatcctgttaaacctacctctcttactacgcgcttatgaaaaatagcggatctgagatacgataattatcgtccctacattgtggtgatggtgtataacatgaattttaaaaactgagttgatcgttaaaccatgccagtaaagttaaggtggccttggttaggaat

SEQ ID NO: 13857 - DNA, 409 bp, Saccharomyces cerevisiae
tccaagctatgagctacttcaatttttatatttttcttaactctatactcctttgtatcttgactcatatcgttgtataatgtttcgcttactatgatattttatactcaagtaaattgaaggaaaggaaaccatatcctcctagtggctgcgctgcactacgccgctatgaccaattccgctatgaccagtttacctttaccacactcactccacgatgttttaagcgttccttgtcaaatatgcaccatctcgtgatttttcaaagattggtaaaggaacatgaaaaaaaaaaagcgggggggtggggaaaatagagttgattctgcaaaagagaaagacaaaggccgcccctgggagcaaagtcgtccgatgaggaactaaccaggggcagcattatccgttagga

SEQ ID NO: 13858 - DNA, 475 bp, Saccharomyces cerevisiae
tcatagtaaataccacgataaaagcacgcgaccgaaaaggcgatacatattctttaaaggagcttgaaaggtaatgattgaaatattagagatatttacagtataaaacacaaatatttagaacgataaataatacagtaaaaaacaatgcaatacctaaatctatctacaaaaaacggtcaccaaggcgttggaagatagaaatctatcaaatactatttcttctatgtaataaaaactcaggaacttgagaattcaaagtggtttcttgtgaaccaggtatatatggcatcttgtcgtcgtcaataagcccttgcaaaaagatacgaccatagtctacacccacatgataaatttcttcgaacttgctaaagtctaatgtggcatattcttcaataggtggtctcacataaacgacacctggtgtatttttcgctttctctaaagcatttactgatgcgacgtaacccaatct

SEQ ID NO: 13859 - DNA, 439 bp, Saccharomyces cerevisiae
ttgtactaagcataattacgtgttttcatagtttaacgctttcagaactacttatttaattttgtaagaagtaatttgagtcacatttgtatttagtaaaagattaagagtatttctatttcaccgccttgataggaaagagcggcgcggaagggcagctgtagggaattttgctctgtattcccctgtttaatatcaaaaacaacagagaaggatccccgatgagaaagacgctcgggaggtctctgtgtttgctaggcaattgacatatttaaaagattttgtttgaggttttgcagataaacaagaagcagtatggctaatgatcaagatcccaacaagtctctcattaatgacgctttgactcggagtatgtccgaattttatgatgatgatgatgataacgacagtgacatgtgtagggcaaatgatgagggag

SEQ ID NO: 13860 - DNA, 473 bp, Saccharomyces cerevisiae
taagtatcacgctaattgaagttttttttgatcactccaataggcaaatctatagatatataaaaaatatagacaagacttttttttacattgccagttttcttttttcctttttagtatctattcaaatgggcgaccctattgtctaatttcattagcttcatcacaaaaagtgccacgaattcatatagcgcgagggtaatccctaccctaactcgtttaagggagacatagaatgaactccgccatcatgtgctcaagactagacgaagctatattagaaggacaggaggaggttttattttaaccagttacttcatttctaatatagagattaaggctgcaaaagagtttcaaaaataattaattatgtcatctgaggatatcatttatgatcctcagttcaaacctgttcagggaatctacgagaatagattaagacaatttattgatactggtggggattaccatga

SEQ ID NO: 13861 - DNA, 434 bp, Saccharomyces cerevisiae
tacctgtagaaaatgcgctgtttttttttttttgatctaaatacacaatacatacatttgcaaccgagagagatagaatatgtagaaataataagatggcgttgtctctataatgcttttctattgtttagtaagctacaagaagtaatcaacatgtctgttagaagcagatctggcttggtatacatctgaaaatatgtacatttcagggtccgtggagccatctgcggaggcagagtcgtcttcgaaataatctgcaatcaatttcctgttggctaccggattagatatgctatcttctaaggcattgtcgttcatactgttctctttcaacagtttattttcaggtgcctcttcgaaaacgttgaagtagaattgatctttactatacagctccagaatagatgctttattgccgcaccgataacaatagt

SEQ ID NO: 13862 - DNA, 498 bp, Saccharomyces cerevisiae
gaaaacacgggcttgcttatatatcctctagatattctttttcatctatgtatttattcgaatggcctttctcattcatatcattttcaaagcggaaatcgaaatcattgttttctctcgagctgcactaagaaaaaaagccactttactaaaacaataccttcaacatatttgaaaatattattatggtggaagaaagatattggttacacaaatgagtcagtcttacgaagcaggaaatgccaatatgggccaaggggaggatgatgaatttgatggctatttcgaagactttgacaacgatatcatgccaaatagtaataatggacaaagggttggtactaatgctggattgtcattcaatgacgaagtaaatgttaatgatgatgattttttagacatttataatatgtcccctagagagagattgatgcataatatcaggaagaatgttcaaaaattacagttttatttttattcactacgcttatggcaaca

SEQ ID NO: 13863 - DNA, 430 bp, Saccharomyces cerevisiae
ctgagtatatataactgcaaagaccccctgtatagaaaatatgtatcttagtggaaaatgtgatttgactatttaagttatagaagtagtttgtgatcctaaaaaaaggaaaacgacagaagtctcatagaagcaaagaggccagatgaagaagagaggcaacaaaattcacgcccatcttaatgaaactggatagtatagacattacacactgtcagttggtcaaatctactagaactgctaggatttataggtcggatacatatgccattaaatgtctagcactagatttcgatatcccgccacataacgccaaattcgaagtatcgatattaaacaaactgggcaacaaatgtaagcacatcttacctcttctagagtctaaggctaccgataataatgacctattgttgttgtttccctttgaaga

SEQ ID NO: 13864 - DNA, 439 bp, Saccharomyces cerevisiae
agagtagtaaatacacacttcgcggcttacgtacgcgtgtgtatacgtatgtaagaaaatatactataatacgtatagagtgaggagacaactaaccatggagaatactagaggtaccataccaagggaacggttcactgtacagagttgtgtccatagttggttaacacatcgaaaagaatggaaatctatgtttttattattacaagttttgaagattgccaaagaaatcaagaatttcgtgagattgaaagtcatcgggtccaactcgatgttcaggtcgtagcggatgaagttgatgtagtatgacactaacgttggaatacccctaaagaagagcagccacgtgagtattggtaaacagaaatcgagcgtgtattgatatttattatgggcggcaacggcggcttccagcgacgatgcgagcgaagaagaagaa

SEQ ID NO: 13865 - DNA, 429 bp, Saccharomyces cerevisiae
aggctgctttaaaaacaagaaagaaagaagaaggaggaaaagaaggttataagggtatgtatataggcagacaaaaaggaaaattaagtgcaaatataaacaaaaatgtcatagaagtatataatagttttgaaatttctgttgcttctatttattctttgttaccccaaccacagaattccaaaattttgttttatgtaataattgaaatactataaatttctcaactatattcggggtgttgtcactgtatatctggcgctttcaataaagctggtacaattgcgtatttttctcggcatttgccacgatgggcttaagaaagatcacaatagaaaatttcaaatatttaatatttgcgaagaagggatttgttcagttatgacgattagatacatatgtaacttacatgcaaacggtttttgttca

SEQ ID NO: 13866 - DNA, 451 bp, Saccharomyces cerevisiae
gcaattgaacacggaaatagaaaaaatttggttctttaagataaagcacataaattacataatgatattattattatatatatttgaagtataaaaatgcaatgagtaataagagcaataatgacactatggaccaaaagaatgcataatgaaaactgtttatgtatcagcgtcgaatgcttataacagataaaaggaaaatacaggtaatggtgtgttcctggtcgtttttatattcccttaattgtagatttccattggagaaagtctatccgagttaaaaatccaatttctactctcaacttctttagctaaccattcggttgggaaaatgaccaaatgaccgtggatcctttccaagattctctgcgccgtatgtttgtcaaaaaccttttgattgaatccataaagcaaactaccggataacttcattctcaattcagcggctttt

SEQ ID NO: 13867 - DNA, 485 bp, Saccharomyces cerevisiae
taatccgccatttttgaccgagtacatcatgtacagacacatatatatatatttatatatgactcgttatctatatgcatctggaacacacataccttgttttaattatgattagcataaatgtactatccttgtcaatttggtatggctgagtttacccggacgagaggaaaaggtatagtgaataggattaccgaattttgccacccgaaaactaaactagcatgcagcttactatacaaagaactgggtatatacagtattttccaaggagatgagaattcaaagcaatattcaattgagatatttttttgaaccatcgtaataaatcaaggaagttaggaactatacggaatgccaccaaaagaagactgggaaaaatacaaggcacctttggaagacgatgataaaaaacctgatgatgacaagatcgtacccttaacagaaggtgacattcaagtcttaaaatcatacggtgcagctcc

SEQ ID NO: 13868 - DNA, 444 bp, Saccharomyces cerevisiae
tggatcaacatttccatgataggaaagcctcatcatactaaagcactttttcagttttttgctttagaactgctaccaattataaaatagaatgcacaggttatcttgtttggtttgttattatccttttttcttctttaccagtcatatcacctcattcacgtatgttcgtaatttataatgttaaaaatggcatatatagatatatttatgaacatcctaaaaaataactaaatttttctacatttcaaaaaaggtaacgttgactgccgcatggcagtctaattaggagcttagtgatacatatatatatatatataaatttcggccaagacacctcacataagaagcattaccagaggtgtcctgatctgagatggaccctgtctcatttgttgagttgacaaaatatcagggaaattgattaccctggtgtgcactgac

SEQ ID NO: 13869 - DNA, 444 bp, Saccharomyces cerevisiae
gcacgaaccatgagcagaagaaaaacctaaaataaatagaagcgatgaattgaattgcattcatcgtatatatacctaaggataaattaattagttttacatattttaaactttgtttgttaatacaaactcggatctggtttgggtcataatttttgttgtgggggctcaaatatcattcatgaaaaggtctgtccaaaactcgtcatttaatgaattaacgccccatgctaaggagtttatatccgtcaaataatcgttcaagttgtctaccgatgaactaggtgatggttttatattagttgagtcagcagagttagtcacatcattagaaataaatggtggtggtaatagagttgtgcctgtcatactctctcggtgttcatgtggggattcattcatatatgaagtactgttaatattcaggttcattgcggcagtatc

SEQ ID NO: 13870 - DNA, 417 bp, Saccharomyces cerevisiae
ctgtgagtccacggtactatattaaaaataaataaatatcacttgaagctatatgcaaaatgttgtaactaaattcgtgtcaaaatatcaagcaactgccccttttaactcattatttacatttctattcttccattcttttgaaaagaaataagatggatacatccgtagaattattatataaagttcgatacaaaagttcactgttctaacgcacaaattaccacggattttgttccatatcatcattattcgaccaagcaggacgttgagcagttgaagacggaatatttaattctttaaaataatcatcattacctacattgaacgcgttgctctcgggttcgactgtttcgttaatatctatactttcccctaccccttcagtttcatattgcgccttatcctcatctccag

SEQ ID NO: 13871 - DNA, 497 bp, Saccharomyces cerevisiae
tgaaaacatagagcaaaagcaactaccagttgtaagaggtagatcgtttacgtactttacgtaagccttctgaggcctcttgtctgttgtttattttttgttattcatataaaaaagtcgtctatttacgatatctgttcaaagtacttttttggatatttgttaaacccattttcactgtattggaaaaatcagactcttttcacagtcttcttcaaagtcttcgaaattttttcagattatacgtatacacaatgacattataaagttaaaaagcctggaaataagtcaagaatgaataaatacttgtcgcagatccaataggtgagaaagtatatagatcgagagtagttctagaggcgtttagcgtacgatatatccaaatcacaacccccatagttataattattcaatctttcaatacaaacatctgcatcatcgacgttatcgtattcaacgacagctattccagttggtgcccctttggaatcatacct

SEQ ID NO: 13872 - DNA, 498 bp, Saccharomyces cerevisiae
tcgttgacggccatatcagttgatgattccatacttcctgaaatggaccactcaaagggacaaaaatgacaaatgttgaaattataaaattacatattaatacgtaaaatgacattcttttttagggaaattcggagatagattatcactatgtaagcttatgtatcgtaatatacagggccgatatttcacctagtttactttttctggtggcctttatgtttatgactgtgccccctcttgtgtttgcttttagaggctttctctacaggtatcagtatggtgtcctcatccttctcccctgcctctgcttcgactggagctaacccattttcgttcttaaaagttttcttcctccactctcttaatcttcttgccttcatcactttccttttatccttcgctcttagttccttggaacgataaggtgcaaatttcttcaaaccaataaattcatttaaatcagtatcatcggcggcgaaaatctctcttgcggtc

SEQ ID NO: 13873 - DNA, 448 bp, Saccharomyces cerevisiae
cccatcgattgcatcttgctgaacccccttcataaatgctttatttttttggcagcctgctttttttagctctcatttaatagagtagttttttaatctatatactaggaaaactctttatttaataacaatgatatatatatatattttttttataaagaattgtatatctatatttataacacaataaatctaatctcaacttttttctttaaagttaagcccaaccgattttttttctcattcataaccccgacgtgttttccatgtattcagacaatgctaatgttaaaggtggaatatcagccaatttatgtagaaccagtggcctgatgcgttgacaaaatgcggaaccagcaccatcatccgtgtcgttggataaaaggcacaaaaacgtacaggccactttagaaacatctgagagttcttgagggaatttgacctctgg

SEQ ID NO: 13874 - DNA, 445 bp, Saccharomyces cerevisiae
aaaaaaaaggtgaagtattatgtaaatttttgtaaagtaaaacactatgctgttgaacgaaatctttcattgaaaatattgttattcattcgtgatagctgcccctttctgagtttgaacttaatatttcaattacgctacttcaagtttcaatgagatattattctgtcatctttctcgtcgttcctagtgattaacgttactaaaattactgatcctaaatagcgggcgaacagagtgaaaattttcttatcttcgcttatctgcgcttatcaatcctaatcagtgaaaaataagatataggcttgataataaggtagtttgaaagagaacatattgcaagcggttgaagctataatactagatatacgaatatcatttcgggtatttgtactgtgctctacaattctactggtaatattatggcatcgcaggctacaactct

SEQ ID NO: 13875 - DNA, 453 bp, Saccharomyces cerevisiae
tttttctgttaacttagtgaagtacttcatttgaatattaattaataataattttatgagccgggaattttgcatctatattctaggtttctagcaaccgtagttttacgtaagatgtatttttttttgaatattccgttttagaatgatattctaggccctgtatattctccaataacagcggcacgtccaggttctgtgacaatgctaatatattccttttttttttttttttaacttagtatacgctgtattggaatcagtgatttcatctaagtttactaacgcttacacaattgtggaagaagaggatagaaacacctcagatccccttgttacggtaaaacccctattctatgcctcagtaataactagaaatagccgattatcattatgttaagcctgtcgatacgcattacagttcaaaaaaaaggcggacatcgtggttgatat

SEQ ID NO: 13876 - DNA, 454 bp, Saccharomyces cerevisiae
tctatgcatggctgggggttttcgatttcatagacatgtatattatcatatatagttactatcgagtatagttatgagattttctagaggaagtctatcaaccagaattctggacaataatgctagttctgacttccaatcctggaataaatcgtttcttaacatgtttagatttataggatcttttttcaaaagagcatttatcagccattgggactgctgtatagatgaactgccaatacctggagaggatccatgcgacactaacgcctgaagttcgttgtaaggctcatgctgcgatataaatgataaaagacaaagccccacggcatacaaatccgattcaaatgtaggaacatgatcggaggagctatcaattagttctggtgcacagtattctaccgtggtattcagatctgttggtgtttgattaatgtgaaatgccgacgtaaag

SEQ ID NO: 13877 - DNA, 497 bp, Saccharomyces cerevisiae
ctggtggcataaaacatatctgttcttaacagcttatttttagtttgttttcgttttcctctatataaatatcttatgtatctgttatataaaaaattatttagtacgaattgaaatgaaatgttatgttatatttttagagagaatctgctattactttatacatgttaactatatacataataaaaaaaaaaaaaaaaatattgtctaaaattaatcatttatttgtaagttttgttcaaactgcctgctaatttcaccttggtcatagctctgactctttttcccattttcattactgggaaagaagtttggatagcccatataagaataattgtctaaatcgttcggtcccaatagtttctcaatgttgtatttttcagtttcgtcatcattttcatcaaaattactttccatagcgtattcagcccaattttcgcgcctaataaaatagttttccaatggattgaaatcatctgccatgttcttctgagcac

SEQ ID NO: 13878 - DNA, 480 bp, Saccharomyces cerevisiae
ggttcatcggaagcattttttttcctctcttttccctttcaatcttcacatgataaaagtgtatcaattaatatatagattttactctgatataaaaacaagtttaaaaaacaattctcccgctaacacgtttataccctttcttttagttgagtaattgtgtagtgttaagctgagaatattcatgatttgatttctgataaataacttctgctttataataacaaatgtttaacgtgttagcgccataattatatagaattgagggaaaaagaaactgaaaaccaaaaataccctgcgtcgcttgaaatgagaacagcacaaatcaattttaaaggaaaaggtttcaaagaagaatggcagccaactctggtctcgactcaaaagttgaatattatcggcttcaagagaatgaaattattagcgctgtatcaagtgaggatgcagatcaaaatgatgcgggctttcgattgagtacca

SEQ ID NO: 13879 - DNA, 428 bp, Saccharomyces cerevisiae
atccactgctcattcacatacacacaacatatatacacgtatatacagatactttataacatacaattctggttaaaagcggttgctcctgccgccgggatttaatctgcggcctcacccatacctcaactaccgccattgttcgtacgttttaaatggcttcgcttcacccttgattggcaaagggtccaagagggatcacatcacgatactattgtttctactaatgtgctgcgggctgatgtcctccacacgtcttcaattgcttctctttatgggttctcaaagtacttcgtcataattacttcattatacctaagaaaataatttcattttttttctgaattttttagcagaaaaaaaaaaagttcaagtttggcctcattcgcaatattttctccatggaaacggcttgtatcttgaggctt

SEQ ID NO: 13880 - DNA, 489 bp, Saccharomyces cerevisiae
aggtaagccatttatatagttgagaaaaaaaaaggagaaattaacaaaagatatgaattgttttaaaacttaaatatgagactgagaacaaatgaaaaaggaaaacatcgtattaaatgttgaaaaagttttttttttgaagaacttcctccccattccctcccctcccttttattaagtatagtttttgtttattaataagtttagtgttagaagatcccaaagtatatgattgaaaacagaattgtttattgcgagtcccgacttcactccagtagatagaataatcccatgataacatttaacatcctttttacaacggaatttcatttccaaattgatgagtcgttaaaacttctgtattggattttaattagaccttctttcgtgtaatactactactactacctctagattcttatgtgtctttcaattttttttatttccctgcaccaaactatcttttattgaatggaatgtgctgcaaaa

SEQ ID NO: 13881 - DNA, 439 bp, Saccharomyces cerevisiae
taaattcgttcaagcataaaattatacaattattctacaaagtgttattatgttagataatcttttaaataacctcgtccctggatagattaaaaccattaaatagctcaaatcttggagtaaagcagcagtaatatgtctgatatgttcgttatattttttcttgaagtttatcaacttatcctttactagaccatttccctccccatccaatcgttgatcgattttaaatttcaccttgcataattttattaatttccatacacattttatcactgaaatgcacgagtaacacagccaaactttccgtaatagcccacttacatataacttatcgttgaccacgcctaggttttccaatactgcgaagaaatcaagcagcgaacttacaccactccatatattctcccatatatcttttgcactgatttcagccgta

SEQ ID NO: 13882 - DNA, 475 bp, Saccharomyces cerevisiae
actctgtttagcacctggcgcttattcatcttataaatacatacacaatctttacttactatctaaatattccacataggatttcacaaggatttcacgaggatttctaacacagtataacaacaaaagattagcaatggtctcatgttttaaaaatttttcttatttcgtaatataacttctcaaactgtgaaatcgaacaagtgaaattatcaaatgaatcagtaataaaattgaagtttccgaggcttaacgcctaaacttgcacggttgacatctttggaccaaatggttcatagtgaatcatatcatcacgatgctctagttcttttagatgaccaatcatagcttgcataaaagctaaagagccgcaagtgtagacatcggcatgcgcaggtgacttttccttcaagaatgcagcattaatcagtggttcagtatcagtatgaacaattattttgtcgacattcgcaca

SEQ ID NO: 13883 - DNA, 441 bp, Saccharomyces cerevisiae
tgatcctatctaactctccctcttttttcacatattatttaatacgttataatttatttgaatatatatatatatatatatatgtatatatactaaccgcatgacacgtactgtatcgcatttcgtttcggagtgcaggcgagttttaggtgcattctatagcgtgaagaagtgaaatctcgtcatttcttcaagttatgccattcagtccagattgtttcacatgctttcatatagtcatttttgtcgtcgcgaacttcaaatttgaaaacatcatcatacagagagatttctccaataatgatcctttctttgtcgttgtcatcatcggcatcgtcgttaagtgaagcgccctcacttaatgaatttttcgtgacagagcattcaatgtcttcatcagtcttacttatgattgggtctccgttgtggtgtttggagaca

SEQ ID NO: 13884 - DNA, 457 bp, Saccharomyces cerevisiae
tgtagaaaagagtttcttgtaacagtatgtaaagaataaataattataagtataaataaaaagagaaggtgaaataataataagtaagcagctcggttataagagaacaaaaacacacgaaaaaaaaaaagtcgtcaatataaaaaggaaagaaatcatcattacaacttgaccgaatcaattagatgtctaacaatgccagggtttgacaatgtagaaacgtcgcctagttggtcactttctcctgctaggatttttcttaaaatacgtctcataattttgccggatcttgtcttgggcaagtcatccactaaaatgatcaattttggtgcggcaaatggcccgatgtcttttctaacagtaaagaccaaatgcttcttgatatcttgtaattcatcatctgttgcggtggaccaactagatttgtttttcaacaccacaaatgcagcaactgctt

SEQ ID NO: 13885 - DNA, 465 bp, Saccharomyces cerevisiae
ttttgccacactctttttatttcttttgatttctgtttctttatcctttttctaaaaatacttttatttcgaatcaggaagaaaagaaaaatgtataaaaaaaaaaaaataaaacaccacaatcgtcaagatataaatatctatttataaataaaacatcaaaaatacctaaaccccaaacattctactaggaaagaatattaacagtaaccacgaactataaaaaatgcatttgaacaccaatgtgggccttgacagccgtattagatgaaacaaaccacatacttttcttgattagccaagcattctttcttttgtgacgccgtcgatcactcaaatatcaatccgggtaacgcgcggctccctacattttcttcgatttttatctttttttcacaaatcgaaaacattagacttcctctttgggaaatcggatgcattttagcgtttctgaggcgacttttc

SEQ ID NO: 13886 - DNA, 470 bp, Saccharomyces cerevisiae
tttgttaattgaattttacctaattgctagttaggtgaaaaattacaaaatttctggaagacgttggaaacacgcaacgtcttttttgacataaacttaaaactgccaaaagtcaaacaaaaattgcaaaaaaagtaaaaaaagttacgaaaaaaaaaacatttaaaagaaagaagaagttaaaagtgcacgcaatatgttccaggatatgaaatgaaataccttttgtttcaccttttaaataatttaatgttatatatacaactttatcgtatcatattcgcaattacattatacaagaatgagtttttttttttcgcggacaaaagaagaacatgtcaacgccaaccccctaggtgattttgttagacaaaagcgaattaggatcagggtctgttaaactttaaatggattatcaattcttttgttcactgattttgaatttatcagctaccattgatttaaaccca

SEQ ID NO: 13887 - DNA, 412 bp, Saccharomyces cerevisiae
acaaaccggccacggtaaggctacattcttatcaacaaatatgggcaatcaaaaacttataatgtaaattttattttttatcgtaaacatgtatttaagaagtaatataaaggatgtttgacatgatcattttatatatgcatacacgttattgaagttatatggtcgttaaatcattaaaaggcccgtttctttgaaatatgctaacggaatcaaaccggtcgggtcggttagatgtggtattgttgcaaatcagaaagccttctttcattgttttgggagttagagccccttctggtcttgttgaagactgtcttaatttcgccagaatcgattaagtcattaatctcatcgccaggcttgccccaattgcctttcccatagcctcctctcttgacgtggttgggagact

SEQ ID NO: 13888 - DNA, 440 bp, Saccharomyces cerevisiae
gctcttgtgtctttgttatatgggtacaagatataagaaacataactattacatacgaaaatgtgcatgttatctatatccttctttatatagatgctgttaacttctttttttttttttgggaaaatcaactgttaaacgcgacagtaaaagcagcaaaacattaattttgcttccaagacgacagtaatatgtctcctacaataccagtttcgctgcagaaggcacatctattacatttactgagcataacgggctgtactaatccaaggaggtttacggaccaggggaactttccagattcagatcacagcaatataggactagaaaatatcaggtagccgcactcaacttgtaactggcaactactttgcatcaaactccaattaaatgcggtagaatcttttcacaaaaggtactcaacgtcaattcggaaagct

SEQ ID NO: 13889 - DNA, 500 bp, Saccharomyces cerevisiae
ataaaagaaagaggaaagccgagtgtcatattttctcaactaaagcactacactctgtaaatatatacaactacaagacttcgttacgtaaatagtaaagtgttatgttttgactttaaaatattctagtgaaaagaacgatgtttttgattttctatcgtttaacgcatttatatattttcaggcaagtgatatcgaagatgtgagtacatcgctcgtccccatcgtcaaaaacaaaagtaaataaaagagctctgctctgattttacaaacaagaaaattccaaggaaatagtccaagttttatatgaccccacctcatttttttttatctctcataaaaaaaagatgcatatgctggatatgtttggaagaatccacatatgactctacatggctacagcacacgtgcggttgcaacttacaaattcataaacgctgctatataagatggctctatcaaatgcatgttgaactttttcttccgaacacagtggacct

SEQ ID NO: 13890 - DNA, 475 bp, Saccharomyces cerevisiae
tttttcagcatagttatgtgattctttatatttatttattttctctctgtgtagtgacaatttttttttaatgtttcatgttaaatatatttattttaagaagccgtcagtttccttttgtttcattgaaatcaataactaaaattaaaattataaaaggaataacgtaaaagaaagtctactacccaaggaaaatctactttatttagtgattatatccaactaaatatcattcaaataacctcacatatttgtcttcacccttaagattttacgatttactaagttcaccttctcatggctttggagggattgcggaaaaaatataaaacaaggcaggaattggtcaaagcactcactcctaaaagacggtccattcacttgaactccaatggtcactccaacggaactccctgttcaaacgcagatgttttggctcatattaagcatttcctgtcattggcggctaattcat

SEQ ID NO: 13891 - DNA, 452 bp, Saccharomyces cerevisiae
taatcaggttacttaaatcaatgactgaattgtataaagatcgatctattacatatatagcattattaaccaacttagtatatgaacagaacttcaacccaagggaagcagacattcactataaaacttttctcagcatcaaaataaagtgcaaattatgttgtttttttctattgaattatacattctattaaagagaaaatattgatgtgattctctcccattcctaataagaaattagaaggaactttctggaagaataaagagatacattaaggtacaaaaacaatgtagtcctcgagaggataactttcgtgcttatgatcttggcttttccttcttttctttccacaaagccaacaaggagacaccagagaccttaacgaccttgaatctaacacctggaatatcacccttagctttaccctttctaccgaaacctgctagcaaga

SEQ ID NO: 13892 - DNA, 476 bp, Saccharomyces cerevisiae
aggactgcgcacttagttcacagagcatcatctgagcataagaagaagtcattacatttatgggaagatgatacatcactgttaaaaattatatatttgtgatttatcaaaatagaagctcacttttaatttaaaaactttaaccaatccgcctcagcctttgtactaatttgttcttccaaaaagagttttcataacttaaccatatatctatgtataaaaacctggttcattcaccacttttcactactaagttcagacaaatattttcaaatttcagtgcaagaagctcttaaccatctgcttttctccaatgatcttcatacacgttgtaatgctactgatagcgtttgaattttaagtgtacgaaacattatgtgacgaacatgaaccttaacccattatttttaacagagtagtttaactacgttaaccaaaaaaaaagaataactttttttcgcaggcaaatatgcatt

SEQ ID NO: 13893 - DNA, 473 bp, Saccharomyces cerevisiae
atgggtgtttattttagtactttgtttattgtgatatttagtttttagatagtatacagacatagctatgtcgaaagggaaggaaagaatttattgagcgctggtatatacagctaaagtgatatcattgcgtttgtacaggtgtacgagtagcgaatctccttgaacttgagcaaaaccttctgcatccagcgtaactttcgataaatcaccgatatcttcgatcctttgactgcccacgccggtagactctataacgttaccgtgagtatcgaaagcaatggttcccttaatatcagattgtttttccgcttccatctttgatttggtttaggtgatttggtttgaggttgtggtattgccctttaatagcggaatcctttatattttttgataatcttgaaattttaaggtgagtttccatatgtaaacaagggaagaaaaactaaaagcaaacaaaagcaaacgcgaag

SEQ ID NO: 13894 - DNA, 426 bp, Saccharomyces cerevisiae
tgtacaataaaccaaatcttgcaacttctctttattctcacaatatatatacataaccaaagaaaaaacgtaattagtataacattgtatttatgaggcattgctatcttcattacccagcccgcctagttttaaaggcgaaaaaaaccgacgaaaagagttaacaagcgtggataataaagttgatctactctatcgaaagtaatacgacaggttcaggagcagtaaaagagctacgatttcactgctattcaatttggctgagtagagactgattattaaccattgtaaaagtctctgccaccactcgtccacacttacgttagaggtattcagcgtcgatcccctttcagtatagatttttaaaactatattagataatcaataggaataaaacctagaacagtagctgcggagagaagctct

SEQ ID NO: 13895 - DNA, 458 bp, Saccharomyces cerevisiae
aggcgttttcttccttacatttaaaatgaatgctagcatatttacatatatatatctacattaagttatatgtttttccactgttttatttcttattgttagaattatagaaaaaaaatttttgtaaaacatttcattagaaaaatttaccattctgaatacgaaagaacaaaataaaaaatatgcctatttatgtgagtatgtatattactagttattttattgctgttactattattatgcgagaatgttaaaaaaataaaaataaagaggaaaagaataaaaaatataaaactatgcgtgcgagtgctttcaagggtcttcatcttccaagagtataggattatctctgccctcatcccaaacagaatcttgagactggttattttcatctccataattagagagaagttgtgcatttgatcccttgcttgtcgcgctggttcttggaatacccc

SEQ ID NO: 13896 - DNA, 466 bp, Saccharomyces cerevisiae
ggtgagtaaataagtcattcgtaagtgtacactaaactttaaggacagctggtaggacaattttatggtcatttgacagctgatgtcttaaattgtgtgctatggttcatgtttacattaagaccaacttttttaaaggcgcgtaaagcagaatcattattacaaatagtaaaaataagtaaacaaatttatataatatataaaacatgaaggcgaaaaaagagattaatcaacttcttccatctcggtgtcagctggaacctcttcaactggagcttcggtagaagcttctggagcggtttctgtttcttcatcctcatcaatgttcaaacctaaagaaatcaatctatttattcttgatgcaaaagaagttggttcttccaaactgaaaccagaagtcaacaaagcggtctcgaataataagttagtcaaatctttgacggtcttatcttgtgcaccaccctca

SEQ ID NO: 13897 - DNA, 470 bp, Saccharomyces cerevisiae
tctttttgatcactgctttcacagttttctttaagatttttattgatcaataatttatgtatattttaatttctatgtttttgtaatattgtttattttggtaaaatatagacgcaacttccttattataaagaaaggcattatttaaaagaaaaagcgttccattagtcagacatctttttttttcatacattcttaagctcaggcaaattgagcattgcctcatacccttttcggtaagagggtaacgaaaatatttttttggaagaataaaaataggtgacggatcatagactaggaagctttaaaacatgattgagcgtaatattatattccttctagaaaagataaaagagccaagacctaaaattttttcatccctgttctattaaaattgtggaaatgaggtttttgaggggatttgtattttctttggctttcactctatataaagtaactgccacggcaga

SEQ ID NO: 13898 - DNA, 400 bp, Saccharomyces cerevisiae
ccatcgcccatattacaataataacaaaatccttggaatgaagagaataaaattttaattaaaattaataaaatagttaatcatattcttttgccttcatagattagatatgaaatattttgctcacataagttaatattgcttttgcatttttgtttctgactttagtttctcattagtcgaaatgactttagttctttagaaatattttaaattcagtgggggattttcgttctttattggtgcaaataacgattagtttttcatttcacgatatttagctgcagttgataggtgatatatctgctttaactcttacctttacagtttgtgatgaaatgataggtttaaacagtcgtttaaagagttgtataacaaaaggactcttaacaatcgaagt

SEQ ID NO: 13899 - DNA, 485 bp, Saccharomyces cerevisiae
tgcgctggtattatagaaatagagtttcattatataagaacatataggaagaatacattattcctatctagggcatcaaataattgcaaccacttaatgttaacttccttcataattcaaaacattatgttctatagcactatgtattttatgtcattatatacgtagtcaataactttatacgttttttttattgaacaaaagtaagaattgcttaagacataataagaggaaactcatcgaaccaattcaaaacggattatagatttatcataccagatacgtttatcaggaggcttgtataatggagcacagatataacgtgtttaatgatactccacgagggaaccattggatgggcagttctgtgtcaggatcaccacgtccatcttatagcagtcgtcctaatgtaaacacaacacgacgcttccaatatagtgacgatgagcccgctgagaaaatccgacctttacgctcgaggagct

SEQ ID NO: 13900 - DNA, 497 bp, Saccharomyces cerevisiae
tgatctgttatacacacaaaatatcgtgtataaatatattgaataaatagtttctaaaaaggcatacgcagatattcttgcgaaagagaaaaaaaaaagagcgagggggacattagtactgaaggtctcaattcttctttgtattttctttcggagttgtcagacaaagctttctctttcccataaataaagtgcattcaaacatcggcaggtttgtttttcccagttgttacgtatttgtttcccgttccattcatgatcttaaactgggttaactgaaaaatcaacatgattttgtgaaaagtaaaagagggtaagaaagatagataccgctgtcgtgggactatattttttacagtaccaagtctacttgcttctcataaagttgataagttataattcatataatttcatttgtcaaaaaagattttagttacaaaacgatatcaaagttcaatcttgttgggaaaaaggaaaacattatgaagggtttccgg

SEQ ID NO: 13901 - DNA, 421 bp, Saccharomyces cerevisiae
aaacaactcatataaatacgtacaaatttttctctactcgaagtgatatagatgtatatgtgtaagtttacgtttaagttagagtcatgtaatgctaactgtctccaccgataatgttgtataatacccgtgaaatcatagcacatgatatatcatcacccggaggccggttattttcggcggcggcaaaaatatttggtataattatggaaatacaaaaaggggaaccattaaaggttgaggaggggattgataagagaatctaataattgtaaagttgagaaaatcataataaaaataattactagagacatgaagtctacatttaagtctgaatatccatttgaaaaaaggaaggcggagtcggagaggattgctgacaggttcaagaataggatacctgtgatttgcgaaaaagctg

SEQ ID NO: 13902 - DNA, 481 bp, Saccharomyces cerevisiae
ccacgtataatgcatagctcttactaaatagaaaaggcatatagacacataggcaagttattacagttcaatagaaaccgaaatcggtaacgtaaaaaataacaaccataaaaagacagtattggacaaaagagcaagttctgtatggtgcgtcaccttcttttttttagtaataattaattatattaataataaagagaaaacatattaataaattgtgtacatgtcaaatcttataatttatatttattttgtttacacagtttccaagacttcatccttgaaaccagaaaccttcttacccttttcttcaccggaaccttcaccatgcaaagccatcaaagcaccaacgtcgaactttggttgtttcaataacttaacctttctaacgtggatgttttgtagtgggaagatgtccttggtagcattttcgatttccttgttgataacttctggaatcaatttggaggtcaattgagcc

SEQ ID NO: 13903 - DNA, 473 bp, Saccharomyces cerevisiae
ctagttgtatagccattatagattataatataccacaacatgctatgtcgtatgccggagactacctcttatatttggaaatagttattattcaatgttctaaaattcttaacattttcgttgttacatatacatagcatatatatatatatatattacattaatttttatctaccttcaatctacaatttcaaacgcttcaagttttcaatagtagcttccaaaccttcgatttcggcaacagtgttatccagcttgcttttattggcttccttggcctgtgtattagcctttgtttcgtaatccttactgttaatggtttgttcaataccgttcttggattttttagccttttcaagtttcttttgaactttcgcaatttcagcatcaatatcaacgtgtcccttgacgagaagatgtacattgacttctgggttaacagattgcaatacgcaaccttctggaatttcgga

SEQ ID NO: 13904 - DNA, 459 bp, Saccharomyces cerevisiae
tcataagcacgaaagttatcctctcgaggactacattgtttttgtaccttaatgtatctctttattcttccagaaagttccttctaatttcttattaggaatgggagagaatcacatcaatattttctctttaatagaatgtataattcaatagaaaaaaacaacataatttgcactttattttgatgctgagaaaagttttatagtgaatgtctgcttcccttgggttgaagttctgttcatatactaagttggttaataatgctatatatgtaatagatcgatctttatacaattcagtcattgatttaagtaacctgattacgttttatttttatatttttttacaattgcagcatctttctctaaaacctcatttaaatatgttataccgcgttgttgattcgtcagaatttccactatcttattaatacgatcattagattcttcaccggtgcc

SEQ ID NO: 13905 - DNA, 410 bp, Saccharomyces cerevisiae
attcatgtatattttgttcaatctttcttttataagcatggttatataaacgcacagaaacagagtgtttcctgtaccttctgaatgagtttggctattgccatatttttgaaagaattaactatttccgtttttatttatgtacgaggcaccttaactatcctgtcacatcgttttttttttacttaattacatacagaggttcgcctattataatagatgtgttggtataaatattcatatatacctatttattaacgtaatgttaacctgacttggtgctctcaactgttggaatctctacttgatcatttaaaaaattcaccaatttctgcgcatcgagtaaatttgtattaaaatattgacgttttggtataacgctcaataaatcaagaacctctgttggaagc

SEQ ID NO: 13906 - DNA, 453 bp, Saccharomyces cerevisiae
ccgtactgatatacttcgcactttacatatgcttatataaaaataccagtttcccatcgtcaattacgcagacgtagccttcgtttattttctctctttttgtatatcattgtattaatcataatccattgtattttactttgtcttatctggctttaatgaatgacgccggtcacacgcgggtgcctgattctcgattgtgccaagccatttgggcacggtgtcaaattacctaaaaaatggccgagagccgcaaaagggaggtccgcggggccgggcaataccctttgtttttcgagcatttcggcgccgaaatcggcaaaggtcctgaccaatcaatagagaaattagtgcatacgagaaaaatttgaacccttcagttgttctccgcaggcgactttaaccatcaaacctccaatcgctgccggttttcggaaaggcaagcacaaaaag

SEQ ID NO: 13907 - DNA, 473 bp, Saccharomyces cerevisiae
tagaacaactatgaattccttggataattatgttactttaatcaaaaccctaccgcccacatatatgtacatacgttatgcatgaggtggactcatgttataaatgacatctatcacgcctataagatagacacattgaacacttctttcctttgacgtaatctctttacacgtaaaaacttcgttatttccgcggcgcggttgtgaacgtgggaggttccccggaaaacatcacaagcagctgctcgttcgcgcatatgggcgcccacaccccacacccctggattttttaaacgagaaactcgtaaagagacagtgtatttgttccgcaatttccggggcgggtaatatttgttaccatagttctcgagaaggtttccctcgtttaagtctgcgaagtctcgtaccttttatcgctgctgacaaaacatagcccaaacctgcgtctatatgctgccggtgtttatatcgct

SEQ ID NO: 13908 - DNA, 434 bp, Saccharomyces cerevisiae
gctttttatttgattttgtgacattttctttaaagtagcagaaaaaataattacatataaaaaactttgtatatctaacatataatataattgaaccgatacgaaaataaaagtaccgataatatgtcaactttttgttttttgttgccgttttattacgtgcactaatacatatacatgcgtatataaatatacataactcttgaggggttttgtttctatctttaatgaaccacggatctggagaaatctcttgccttttggatcaaaagcgcgtcagccaacaccagagcggtcatggcttccacaataggaatagctcttggagtgacagcagggtcatgtctacccttagcggctaagataccttcttcaccatcgtaagtggcggttttttgttcttgagagatagtggccactgacttgaatgggac

SEQ ID NO: 13909 - DNA, 492 bp, Saccharomyces cerevisiae
ggtaagattatcagttatggataccaacatataagcgggtgatgtctcatttcaatgaggtcagataactggtacagtttcgcctttaatacacttgtttgacagaaacttgtttttaattgcttgattagctaagtaactcgagccgtactgtagtaccgttaaatatatattatgtaggacttagtagaatatactaataatagatactgcaattgatgatcccaattactgttttattgactaactttcactgaaatgttttcattctctgattttatatttagttggcgaactagctcatcctaattataattaaacttatatatagcataaaccgacaataatgcgtgggtggtcctccatgccgaatttgtgaactgaattattatctaagcactggatcgatcaccttaagatgatatattatttataactaaaacgcagcagcattacactccagagtaactcctgaatttcgtcatggcatgt

SEQ ID NO: 13910 - DNA, 441 bp, Saccharomyces cerevisiae
aagaagaattaaatatagcatatcatgaatgtcacatatatgttgtttctgttctgccaatcttttttaatatatttctcatgatagctccataatcttatatacatggttgcataataaaataaataaataatgagcctttaccaatcgatagtgttcatcgcacgtaatgttgttaattcaataacgagaatattgcatgaccatccgacaaatagttccctcataacccagacctattttattacacccaatcattcaggaaaaaacatttcttttcatctttttcacgatttcaaatattgttccgcggatacgcgacactattcccagctaataatattcccggtgaaagaaaattccaggccaacccaagtaagtcgtccgctgggtggacgcccccacgagtcagtgtttctgcctaagtttacgcggacccaa

SEQ ID NO: 13911 - DNA, 409 bp, Saccharomyces cerevisiae
gaggaataatagcatatccgcatacgcacacgcacacgcacacgcgcacgcatccacattcactttcacttataaaatttcttctctctagttttatatacgttgtattagaaatataaaatatgacaatagtacactttgtaggctctctttttttttttttttttttttcttatatatttttttacaatgaccacggtttgtacacctggggctgcaattttgcaatggagtcgccttcgcctacttcctcgccttccttgcctacacgtttcacgccatgtcctgtggccgtattgccgtcttcgtcatcgccctcctggtccttctccactagttgtatgcccgagtctacttgctccgagatcagtaccagtttcttcgacacattcaactcctccagcgactt

SEQ ID NO: 13912 - DNA, 412 bp, Saccharomyces cerevisiae
ttagcataaaattgttggttttatacgtacataattggcaagcatttcatgtaggagtctcaatagatagtttaattcatttgcacggcgctttgctgcttttgcttcttcacgttggttttcactatgcctgatattttttgacgtcacttagtaagcacgacccttgtcaatttttcgaggatttcggagctttccatttggaatctactattaaaatcagtctaaaaaagtataagaaacacttctggtttttctcatgcgcttctcactctcagtatattttgctgctttccttcatatgtatatatatctatttacatattagtttacagaactttatgctttctgcaaccaaacaaacatttagaagtctacagataagaactatgtccacgaacaccaagcatta

SEQ ID NO: 13913 - DNA, 430 bp, Saccharomyces cerevisiae
gcggcgatgggtatatattggatataagcatatacatgtaacattattaatagcaataagaacccttgtagtcaatagtattacagaattctcctacgaataaattttatgtgtatatataaagatatatatgtgtgtgtgtacatgtgtgggtgcgattaatttgtactcattaaacgaatagtcaaaacaaactaaattcgtctcttagcttaaaatatatttttaaagatagaatttatacctggaagttcatcttgctcattgcgtatgtcatttgcgctggtcatagaagaaagctcactagactttggattatcatgtttagcctctaacataccgtaattttgcgattgctgcgatggcgtgttaatgccattctccttgtgcagtgggtcaatgtcatcctcctcctcctcgtctttgcatc

SEQ ID NO: 13914 - DNA, 402 bp, Saccharomyces cerevisiae
ttttctttttcgtaaatgctctatcactttttttcaattgtaccaaaccatttacagcgttatcttaatctcttatattgaattatagtacataccacaccatcatccttatttaatagctttatttaaatttcaaaacaaaaattaataataatttggtaattattcatatttttggaatatatgcaattaatgttctttcgtctttgatgtatattccttcggcgttaattacaactatcaccgtaaagtttttaccaccctccgaaagattaagggcggcaatgaaatgtggagtaaagtgaatgttagatgatgatattgatggctttgctcgatcaaagataatattatatttaagtatcatcttgtcctcaatccggtacaaaacaaacgtcttca

SEQ ID NO: 13915 - DNA, 423 bp, Saccharomyces cerevisiae
atatactttgtaaattgtcatgtatagattgtttttttttttttcatctttatattgtagtataaaaaatgccattcggtcagagacacataggaacatcttacgtgatatgtacatgtggtgcgtctttcataccttgaataatataattaataagagttgtccttttaacgtcatcctctcttttttttttttttttttttttttctccttcattttgacttttccttctgtgttaacatgatgagtttatacgtgcatcctaactagtagaatgtatatatattatattatgattatatatataattttgattaaaataacaattatcttaagaaaaattcagactatcttacaaggtgattgatggttgagggtgtctaccattggcactggaatgtggaaagaattccaaatgcccgt

SEQ ID NO: 13916 - DNA, 500 bp, Saccharomyces cerevisiae
tcatgaaatgaatttgtgatcaatcttatcttttattttttgcaaaacaacaaaccaccctacatttttagttatttttatttattttgtttcacattttaaataatatcaataacagataaataaacatattaaaacactggtataaattctaattgatcagattttttgaatatgaaccacatcttaaagaaaggtacctaaaggacattctagagacttcgaattttcaccatatcaaaacaaagcgtgaaagaataacaatatgcaaaatgaattttatattttattatatatatactttatgtacatgtcaatttttattatttgcagtaacggtcaagtaattcaaaattggaaatatgggcttcctctctcacccaagttgtatcgaactgatgtttttaaacacttggtaacggagacagtaagttcaaaaagtttggtctattagaagtgtgtgcccagcccaaatacaaaacaaatgggatccagccata

SEQ ID NO: 13917 - DNA, 436 bp, Saccharomyces cerevisiae
gcataaaacaaaaggaacaaaaaaaaaaaaatagacaaaatgtagtgtaaatgtatccgtttctaaattaagtacttataaaaaaatatgtaactgaaaaagtcatgttgtataaaaatttgaggcaccgtaccaggaccccaaaagaagaataggttaaagtcatcatcattaataaaccaggaaagaaaagagcataattaagatacgcctacaactttggcgcgtgagccaagtgtcttctggtagctagtgaggcactcaagggaccatatgtcttggcattttctctatattccttaaaagagttgaacgagttgcccggagatctcttgaaaatagtgctggccatggcgctagcggctatccttgagacacccgcggaggcggctgaagaagagacggcggcggctaatctggtactttgggcgatcat

SEQ ID NO: 13918 - DNA, 489 bp, Saccharomyces cerevisiae
tcagttccgtaccatacataaactatatgtatataatgtatatatgcataattactttctaaatttgtgattattactattatcttgattgttaaatgagtgggaagggatattttgtgtgtctataaagtctatctatttgttgtgactaacaataaggttattcaaaacacgtttaacgtcgtccttattcagtacaccatcattgattaaagtcttgatgtttgtatcgtaaccgtttccatcttcattttcgggagctgttgctgctgccgccgcggcaccggcaccgccactgccgctagcgctattgctgttattattattattattgtcgttgttattattagaggaggaagaattgttgtagttaaagatgatgttgtttttcttgagttcgtctaataaataatttgtatgcttgagtttcatatgctgtaaaagattatcttttctcttctgcctgcttaagcaccaagggcatagaaa

SEQ ID NO: 13919 - DNA, 477 bp, Saccharomyces cerevisiae
aggttatatagtcatgcagtaatgttatacattttctatttttattttttgtatcagtactctatctataaggacattcctttttttaagcaatgcggaaagatacgctattcttcctgtggatggtttaccgcggtttgggtggtaatatcattgcagccctagtcctttagcagtttttttagcgtgtaatacattgttattcatctttttcttagtgcctgccaagagatcgtgggaggttacttaacagaaaagcaaaaaaaaaaaccgattagaatgtgcatgccgttgttacagagaagcaagggaagttcaccactgatcatatttctaagttcatcaaaatatcgttttggtttcagcagtagggatctttaacccaagtgttcattttctttcctttttgctttttatttgaatgatctgaacaaaaggagaaacatatactgtactattgcgtgaaaacgaacagag

SEQ ID NO: 13920 - DNA, 489 bp, Saccharomyces cerevisiae
gtctaaaagaaagaaaagaggaaagttcataaaaagttctttcttttttttaaataacttagatagataatgagataaaagaagtaaaaaaacggaatcgtaacgcaattaattaattaagaaaattgattatcgggagaaaaaaattttattttttattttattttctttaaagtacatatatttgaaatgatgacatgtggaaatataacagagacagaatatttaattttatgtatgtaagcatcgattggacaccaggcttattgatgaccttactcgtccaatttggcacggaccgctttaacttgcaagtagttttgtaaagcatcaacagacatttccctgcccaaaccagatgcattgaacccaccgaaaggaactgcgtggtggaaatcgttataagtgtttatccagaccgtacccgcattaactctatcagccacttttaaggcggtattaatattagaggtgtgaataccagcagcc

SEQ ID NO: 13921 - DNA, 484 bp, Saccharomyces cerevisiae
ccgcttgcatagactatagaatgtcataatgtaataaaagtaatttcggataatttaaataatatagattggctttttttttaataatatattattagtgttatgcatgctttttttttttattttaataaagggttaacctgaaatcggcttgcttttggttttctgtcaattcataaaaagaatagttttgaacgggcaaaaatggaaaagcaatggaagaacgacgaacatcccactggacaagaagcgggagcaagtgtttgtaagaaaaatttacaacaaactagattaagaagaattggacatcagaatacttttctcggagaaaaaataacaccaatacattacgattaaataaaaagttaaaatggcctcctcaagtagcacgctaccgcttcatatgtatattagacccttaatcattgaagatttaaagcagattttgaacttggaaagccaaggtttcccaccaaacgaaaga

SEQ ID NO: 13922 - DNA, 435 bp, Saccharomyces cerevisiae
taccctttacctctatatattacgcaccatattctattatttttttcacaggtttatataactggcaaatattataattaaacattcttactgtcatatatacacaaatgtgcgcctgcatatccttacgctaagaaaatcttgtacgttacatatatttcaaaaatatgaaggctgatgtaaagttgtctcttgagaaatatagaaaaaagagtagagggaaatgaacaaagaattggcttctaagtttttatcaagcatcaagcatgaacgtgaacaagacattcaaacaacttctaggctattaacaacgctatctatccaacaattggtgcaaaatggcttggcaataaacaacatacatctagaaaacataagatccggtctcattggcaaattatatatggaactgggacctaacttggcggttaacga

SEQ ID NO: 13923 - DNA, 436 bp, Saccharomyces cerevisiae
aacaatctcaagtgaagtattggcaagatattggtgcaattatttgaaaggaaggagaaatattctgacagtaccttgctagcaaagggatttaccaatccactgacgctaaaatggggtagtaaattagataaattgcattctaacgtgactttatatagtgggaaacagatatgtagcacacaaaacggcatgattatgcttaattgattcctattttttaacgtaaatactctcccagaacgatcagaaaacttaacccgcaaccatctttgctgtgctaacaacttatgtcgcctcaataccatttttattttgtatcattccggaacttagtattgaatgaaaaatgcctccgaagtaaaaagcaggtgatgaaaagtttcaattggtataagacagatcgctattttgatccgcataacatccttcaaca

SEQ ID NO: 13924 - DNA, 439 bp, Saccharomyces cerevisiae
taggatgagtttcttactttttttctccttttaattgcgctaatcttttatttatgtgtagtttttatttatgtgaaatggaacattcgttgatttaactttaaaagcagcctactctatcgtcttgattatacttggcacaacaaatgctcaaataaacgaaaaatttcatattgttggtactttttctcaacgcggtttttttcctgtttttttcgagcagttcccgagggcatatttaacataagccaaggagagagaaaaaacgtttgttggacagatcaaaaagaaaaagaagaagacctctcctctatctcaagcttctgcccccccccccggaaggaattcaagcacgaaggtgaacattgcctacaagaaaaaatggatgttttattgtcgcttcctcaaccggaattatttaagaccacggtgattccgt

SEQ ID NO: 13925 - DNA, 430 bp, Saccharomyces cerevisiae
aacctacaatagacgcacgcgccatcggaagataaacgcattcacaccaagaaaataaatactacgtacttctagaactaagaagaagttgccgctctccgtctcctccttcataaatagggatagcttttactactacgtacgaaaaaagaccacactgcgacggatcctctgcatcccaacaccagcgatagaaaatgcgccgcctatatcgtcatcttgcttcctttttcttactcccttcctgccctggaaacaccatacaatccatcacatcatatcctgccaatgcactattacgcagctttcggcacgtgagtacggaaacaccagttcggaaccgggtacacaatagggatagtcaaagctgtccattttttccgctgatggatgactgataccaaagtgtaacccaaaaggggtagtcgat

SEQ ID NO: 13926 - DNA, 449 bp, Saccharomyces cerevisiae
gaataaggtgcataaccgaagatattttagccttttcttgatatgtctctatgctacacacgactacatagcaagaaattttagatagattcaaaaacacatagcaagcccattatcatatatactaaggaatagcctttatgaaaggctttgaactatacagcttgagtatatgatacctctgcttcccaaccgcaagctttttttcttcgtgatgctgaaaaaaaaaaatggacatagaaaaaaccttcataaatgaaacagaccattcattactcgtgcggaaccagtaaacacaacacgccaactttcgaacttttgcccaacataagatgtcctctcaagcattcacttcagtacatccgaatgcggcaacatctgatgtgaatgttaccattgacactttcgttgctaagttaaaaagaagacaagtgcaaggttcatacgcc

SEQ ID NO: 13927 - DNA, 452 bp, Saccharomyces cerevisiae
tcttgagtgaagaggatatgtttacttgaacaaatattctttatgtaatgtgtttgtagcctttttatttgggaaggaatataccgctatcctttcccacctccgaacttatcgattcggaattttaaagagccttccaaatgacaaaaaaaaggattgtagttcctagatagcgaaatcgactgagcaagataaaagcaaacattccccatcatctttggcgacgacacatgtgttccataagctaaactcaaggagcaaatgatagtagattatgaaaaggaccctagggctaaagaggctattgctatttgggaaaaaggtgtactgaaagagaaggatgggtcaatgtcagatgctataaacttctatcgaagtgcattgaaaatccatgataatgtggaatcactgtacagaaaaaaaatacttgatgagtggatgctgcacaaaaa

SEQ ID NO: 13928 - DNA, 496 bp, Saccharomyces cerevisiae
ggtcaaagaaaatacacagtttgaaaaataaagaaaaaccaccgaactccacatctcgtaccttaatattattttaattattctcttagtatttatatatttgcgccgtttacatatttgacttattgttttcaggaatacaatacctccatcgttggcagtcaattttgctttcacatataaaactaaaaaaaaagtaaagaactcggttaatcctcggttagtttgccaagctcacctattaatcttaataggacttcttgagtttgttgtttgcccagaccatacttatatatttcatgcccaccttcaactattttccattcttgagtcttgtgagaaattttggtcaaatctctttgccaatcgccccataatgccgacttcttcaccatttccttagagctaacgatgcttgtcttcacattttgcaaagattctgcattgtttgtcacatctctgtaacttagaattgaactcgtcacgctttccaaaa

SEQ ID NO: 13929 - DNA, 448 bp, Saccharomyces cerevisiae
ctatgacttcgaggcgagcggggcgcaatacaattaatgttagtatttattctaagtagtttctttctttttatttaatttgagtgataacaataacaacaataatgactaaaaggtgaaaattgaaaacattaccttcatttttttacggccggagaggggtaggtacacttaaccccgagcgcttttagtgccaaaaagagttaatgtgcgtagtcggattttaaacgaccatgcatgtacagccccctagtgatttatactgatgcctcatcaagaaattttttcatccagggtccctgctcggcgaacctttccgcaagagtcacaaaaatcaatcttataaccaggcaccagtagtactgccaagcttggactacatagccaacgtaaagacaaggagtctgatttagtatttcttttttgccagccagtattttctgcgcag

SEQ ID NO: 13930 - DNA, 458 bp, Saccharomyces cerevisiae
aggaagtgaaagaataagtgttatacgttttatagacacactgtaaatgaaggcagccgaagcgatgtaaagtaaaatacattgctaaataaataaataaatacataaccattggaatagcgaagcctttgacatttcattattcctccccatcggaattaatctcgaactgatccaatatttggctcaattctttgtttttattggtcgcatttgccgtaatatccatggtatcgacttttggccaaaccaaattcttatccttgatactggtattcaataagattaaacaaccataacacaatttgacatcaccgtcttcaacatcgaggctattactggcaccctgtttgatttcattcaacaattcaacataatgtgtgtgagattgccctaattttgaatcttgccactgtttaaataaatacttttcttcagtggtctccacaggataaggc

SEQ ID NO: 13931 - DNA, 420 bp, Saccharomyces cerevisiae
atatacataagccgtggagatatcagatgtaaagtagttagagtagaaaaaatgcggcaaaataagcgccgtctatataaaagaaagaaagtgttaaataaactgaccacagaaggtggcaaaaataatacgagatttagaagtcagataatggacccgattggaataaacaaagtcttggaccatttagcaccctcagagcttatcaaacctgttaagagttgccataataaaccttcagtgttggtgttggatgacaggattgtggatgcggcaaccaaagatctctacgtgaatgggttccaagaagagattcagtatcagaatcctacaccggagaacttgcaacatatgttccaccaaggtattgaaatattggattcggcaaggatgatcaacgtgacacatttagcgctttgg

SEQ ID NO: 13932 - DNA, 497 bp, Saccharomyces cerevisiae
ttgatatttcacaatacaaagaaatggaggaagactgttctacatatcttgcttattttattgaaagccagacatctttctttttcggtagaacactgtcacgtatttaccatataatctaatctgaaaacatgtaaatatatatacgtgtataaatgcacctatatctatatatgatcaaagcgcttctgtgaggctgtcattggttaatacacgcgatcttttttttatcgctgattccacggcttagcctatcttatcttcagtattcgcatgatacactttttcactgcgtcgttttgttggatgatatctgtccgacaataaacgtaggtcatcttaagggccggtgatagagaagagcatgcggttccactttaggccaacccacattcccaaaatataagaatacagcagcgatttttttctatcgaattattttgttttttgtctcctctttgttcttcactaagctcagagccctagttgttgaggga

SEQ ID NO: 13933 - DNA, 412 bp, Saccharomyces cerevisiae
agcacttaaactgccctcatgtaattacatttcttattactgcattctttgtacctttttaaactttatatatatgacgaaaactaaaatttaacaaactaaaagtaaaaaattgcagtagattttatgcatctttctgaacatctttatacagtggcatgctttcagcagcaccttttctttgaatggtcaatgaactagctaatgtagagaactttatagccgtagacaaggtctctccttgatacaattgagtaaccaaaccgcccaggaaagtatctccagctcctgtagtatcaacaaccgaaacattttgaatagccggaaggaattgtacttcagggctttcgtgcgaacagaaaagcacccctctcgaacccaaagtcataaccacaattcctcttttctttcg

SEQ ID NO: 13934 - DNA, 434 bp, Saccharomyces cerevisiae
gcgatcattttccctcctgtactttcaaaatgttctctttcttattcttcagttatagtttttacgagcgattataaatataaaagtacgatcttccttttacgtatatatgtatatacagcacgataaattacaaacaagtttcaactaacaatgtgggttatttctcatattgttaatgagatcttataataatcattatacacgaacgctatttttcacttttttttcatttttgttttcgccgcaagaagtaatagtgaaaaattgaaaaaagcttcaattttagtttgctgaaagaaacctttacttatgtagaaggtgtacttgcaaaagcactagtgtaatatagagcaaagttcatcatgggtaagaaaaacactaaaggtggtaaaaaaggtagaagaggtaagaacgactctgacggtccaaag

SEQ ID NO: 13935 - DNA, 418 bp, Saccharomyces cerevisiae
tactaagtgcgttgttacgtttaagtaaactattttctatttaatattagactattctttattttgttctctctcgtaatatatgtggttttatgcatcaaataagtttttatcactttatttccttttacaatgtgtattattgtaaaatactcacaatgtaatctattttttcaggatgtgttacgatgcagacatgttttgtgcatgctctttagcattgttgtgcattttagattgtcgtcgtttgtttctgtatgtggtgtacggattatgtgtaactgtattaattgttcaagattcattcataatattaactaatgatcccttcaagaacgcgccatatataaaatattcaaagttaaaccttccaaaaatcatagcgtttcatctataggcacagcaaatcatgtccctg

SEQ ID NO: 13936 - DNA, 432 bp, Saccharomyces cerevisiae
tgagacggatgactccccccatactttcttaaatgaaaggatgcttacctttttttacatgtgaatatctattacatatatacgtacgtatataataatctctgacgtgaaaagcggatcgtgtgtgtcttgtatttacgatgctagttgggggaaaggatcttgaagacaatagctataatcccgatggaaatagttccaaatgttaatagtgtgaaatgattacatagcgtgttcttgatgctaaatttgtcagtacccttaggattcatgcccgggacgcctctagtgtcatgttcggtagtcttttttttagatgcagttgagagttcttgttctttctgtttgttcttcttcatcatttgtgaattcttatatcgttccacttctaacctagttttcaagtcttctatttccctttccatgcttttt

SEQ ID NO: 13937 - DNA, 456 bp, Saccharomyces cerevisiae
aatattgagaagtgaagggagattgattttaaacctgtagttctttttacatttgtttggaaataaaaaaaccaaagtaaatattataaatatgtattaataaaatatgcattacctcaatgtagaagaaaaagatagtgagcacccaaacggaatccaaaatgcaaaatcgaaatgacacctaaaaattcaatgcttcttgatgattaatgcaccggtttgccagccaccagcagttacactgacacaaatataatcttcaggtagttctattttcgtgggcttaacgaccctaatgtttctttgcccttcccaattgccaatatgtagctcgttaactattttttcagaagggcccaatcctaagcacccacaatcctgactttcaataccccatgaatacaaatgaccgcgttcggttagtgccaccgtgtgatagtcaccacttgcaacgga

(The sequence listing continues in the following parts.)

What is claimed is:

1. A recombinant *Saccharomyces cerevisiae* yeast, comprising:
    a promoter that functions in the recombinant *Saccharomyces cerevisiae* yeast,
    a heterologous target gene controlled by the promoter, and
    a regulator of gene expression disposed downstream from the target gene, wherein the regulator of gene expression comprises at least one terminator region of a yeast gene selected from the group consisting of:
        RPL41B set forth in SEQ ID NO: 15873,
        RPL15A set forth in SEQ ID NO: 15872,
        DIT1 set forth in SEQ ID NO: 15878,
        RPL3 set forth in SEQ ID NO: 15866,
        IDP1 set forth in SEQ ID NO: 15881,
        YHI9 set forth in SEQ ID NO: 15856,
        YHL039W set forth in SEQ ID NO: 15855,
        PPA1 set forth in SEQ ID NO: 15812,
        PRC1 set forth in SEQ ID NO: 15877, and
        VMA2 set forth in SEQ ID NO: 15833;
    wherein an expression intensity of the terminator region relative to that of the PGK1 terminator region is 1.8 or greater when the recombinant *Saccharomyces cerevisiae* yeast is cultured in SD medium.

2. A method for producing an expression product of a target gene in *Saccharomyces cerevisiae*, the method comprising:
    culturing the recombinant *Saccharomyces cerevisiae* yeast according to claim 1 in SD medium, and
    expressing the heterologous target gene.

3. A cassette for gene expression in *Saccharomyces cerevisiae*, the cassette comprising:
    a promoter that functions in *Saccharomyces cerevisiae*;
    a heterologous target gene controlled by the promoter; and
    a regulator of gene expression disposed downstream from the promoter, wherein the regulator of gene expression comprises a terminator region of a yeast gene selected from the group consisting of:
        RPL41B set forth in SEQ ID NO: 15873,
        RPL15A set forth in SEQ ID NO: 15872,
        DIT1 set forth in SEQ ID NO: 15878,
        RPL3 set forth in SEQ ID NO: 15866,
        IDP1 set forth in SEQ ID NO: 15881,
        YHI9 set forth in SEQ ID NO: 15856,
        YHL039W set forth in SEQ ID NO: 15855,
        PPA1 set forth in SEQ ID NO: 15812,
        PRC1 set forth in SEQ ID NO: 15877, and
        VMA2 set forth in SEQ ID NO: 15833;
    wherein an expression intensity of the terminator region relative to that of the PGK1 terminator region is 1.8 or greater when a *Saccharomyces cerevisiae* transformed with the expression cassette is cultured in SD medium.

* * * * *